United States Patent 8,067,671 (METHODS FOR GENETIC CONTROL OF PLANT PEST INFESTATION AND COMPOSITIONS THEREOF) - sequence listing, part 17

SEQ ID NO: 17838 - DNA, 2951 bp, Heterodera glycines
aaagaataagcatggaaatgtgggaccctttttgagctttgctccatttatacccatagaaaattgaatctttttcgaaccaatggccgaatgggttcaggccatttgaatatttaaatccaacagttatcccatttcttgccttgtacactgttcgaatttgtgccattgggtaattggcatgctccttctcattctgctccccttgttggtcatccttggcaccgtgccaaaatcggtttctgctttgaatagccgtgcaggacatatccaagtcattttcagtaggatcttcctcacgacaaatgcgtcgtcttaccatctggctaatgtattttgcgtcattggcaaacagacgagcacagtccaacggcgcacttcccttcggcaaagcccaccaatcgaaacgtatttcgggcgcctaaattaaatgttttttttaattattccattagggatggatataatattagatctacctcttcttgagtgaattttattttatcatcattttcgttcacttgaggatctccaagaagcaacatttgtccttgcacctaaagaggaaagatatcaaatatattagaaattcttaatgttttcaaagtttaacctaaaaaatgtcaatttttgtgaaaatttgtaaacataccaaaactaaattttcaaaaattttcccggcggcgcctctggcaccgccgaacaatcatataaatattctccatagaaaaagctaacaaaaaaatagagaaacaattttacttattcgttaaataattttaacacaatgatcaaacccaatccctggccccgacctatttgaccacgataactcccactctcgtccacccgtttcacctttatcccactgatttcctccaatggcaaattgccttccaatggacaaattggtctgcccaactgagtgccgttcattctgagcagatagcaacgcttggtcagcacaatgtccaagtttagcacgtaaataccagttgccaatcttacgcctttacttcgaattgattttgacaactaaatgaaataatatttattgcattaaatttaattaattaattaattaagtacccttggtaaagtgacttctaaatcgctgtccgtcccaattataaatctcgcttccgttttcgtctcactacctaaattaatttctattttttattctttaattattttttgattgtttaccttttttggcacttaaaagttccaccaaaatgcttctgatgttggcatcagttaagcctttgattttgattatctgcttctgttcaccgttatttgttaaattgattggaaatattttatcagttaatttgggtggagaagatgccgaaccggcggatggcattttcggaaagaatggcccaacggaatcagacgattgaacaaactgaaatataaatgtgatcaaatgaaacaaatataaaaaatttatttatgtgtagaattttaacttttaattttttgagaattttcaaaaattttttttttatcttaatttatatatataaaacgaaaaaatgtaaaaaaaaactacgaaaatatatatcaaaaagttggaaatatgtaaaatttaaataaaattacttggaatttaggaaaaagtatgtatacataaaaatcagaacaatgttaattttcaatattaattcattaaatatcggtaattaattaatcaattaattaattacccatgcttccatggtgcagctgcaactttggcttatgaacagcttcatttcctgctgttgttgtttgttatacattggcagcatgtccaaccccagcagccaaagtgcggcataatctgccaaaaaggcaatgccattttgatgaagattggccacaaaatcattttgcatggcacactcatctgaattattaaatgaataattttctgcaaatgcaaattaatttttttgaattaaatattttttcaccaattttttgctcaccaattcgattttcaccgaagataattaaaaattgatgcaatttttctcccaaattaaagcttaatttgaggtagaaatttattatttaatgctcgataattaattaatttatttctaacggttgtgaagcaattgtcgcctccagtctaatgatggaatgtgaaattgtgccattgtccgttcgcattggcactgtgcgcagtttaatgccatgccaacgaaatttgcaatttttattgccatccttggccatcctttccccgcattccttggcaatgtcgtccttttgattcataatttattaaaattagtaaattaataattttttattacttttttgtcatcaattgtgaacgctcttttcgctttaaaattggtcacagtgtccgaatgattgccaagttgaagcaatgccggataacagatgagcagcctaaaagggcatttaaaaataaaaaccaataatagttttttaatttatttattttcttaaaatgtttttatttcttatccctttttaagccccggttccgatcaatttaaaattccggtctctataaaattaaataatttgaatgtaattgaattccttctcccacccttcatcacaatttcccccttcatttggaagccaaaattcaatgccatagtgctcttccgtggcttcatccgtataattttttgcactacatttctcaaaagctcgaaattgaattagcttcattccgtctgtgccatttgtcagatagaaacttaaatcactttttaaaaaagcaattcttcaaaaacaatttactgttcggcgttgacagaatggtcatagaacgacgacgttagaacaaaaatgaaaacattagcaatcataaagcccattgtgcataaaacaatcaataatctcaaataaaaaaagttattttatgtgtttaggctatattaatgcattttaatagaatccattttcaacattaggag

SEQ ID NO: 17839 - DNA, 1536 bp, Heterodera glycines
agtgaattttgtatcccaaaattgcaataaaaataaaattttttgtttatttctttcttaactaaaaaattttacttttattttacatatgaattctcgtcgaaggttaaatgccaaaaattaattcaaataaattcgagttgttattatttaaattaacattataaatatttatttttgctttcgttaatgattgaaattacaataaataattacaccaaagctttcctcataaaatgaaaagaagttggagagaccgtgcacgagaagattaaaaaataaaaacaaaataactacacaacattgccattgaattaaatcattttaaattaaaattaaaatgttttgcaaaaagagaaacaataaccttattttacatttatataaatcaaccaatttagcctcatattaattttgaatcagataaattaattaaacacgcaaataaaaatacgaaaaatgagatcacaattttattttttgaatgtaaatcacgagagaaacgagcaaaatcgggagtattctaaaaactttgaaaaatgataaaaaatcaaaggttttattaggttaaatttcaaaaacattaaaagaaataaaaggaattaaaaatacagtgtaaaatgattttcccggcagcaggatgggtcagttcagtttgtaaatttagaattattatatttattttacttaaagtgagtatttctggggttttcgtgaataaatgcatattatgccatttttggaaattttcacaagaaaaacgcaaaaaaagcgaaagaaacacctctaaggatagactttttgggaatttaggtcacggcccggacccggtcaattgtctaagccctgtcacgggcccggtactttcaaaactccgggctcaactaacctaatgatgagagtttttttctttctctaaaaatatgcctaataaaataaatcgaaaatacaatttaagttgggaaatattaatgaaaaaagtatttaaatttaatgaatttttattcctttggatatttttctaaaaattctgggttgtttagcagtttaatttttgtttttatttcatcgtgaataaatttaaaaaccaattaattgtattcaaataatatacaaaataaaatcgtaaaaatataattatttaactaaatttaaagataatataataaatttctacgaaaataaattaactttataatatataaatttattaataaatgagtcaattaaattaatacaacaacaacaaaaaaataacaacaaaaaagtttatggtaggaaaaaaataaaaatttttaacttttttaatttaaaataatttttatagaaaaaaacattttcaatcatttcaatgagattttgactttgaaatttcaaaatttagagattttttttgcgtatattaacaacacatttagaacatgcattttttgaattattcttgtttttatttttttatccttccgcacggctcccggacaatcggacagtaaatcacactaaaagataagaaaagccatcgctgaagggaaccga

SEQ ID NO: 17840 - DNA, 1821 bp, Heterodera glycines
  misc_feature (97)..(97): n is a, c, g, or t
aaatagcaaaataaaaaagtgcgaatgtagtctaaacattatttcatttgctaattagtttaagtttggcatttcataaatgatggttgctcattgnaagaatataaaagctttttcttgccattactcgcacacaatgccgtcttctggattatggcacaatcggtcccatgcggcgatggcatttaaatatcgtttttgtgtgttttactgtcggattgcccagtcacgctctgcgccaccacctcacaaatcagagttattcccttaaaaaccattctcgaggaaaaccttcaaaaaataataaatatcgactgaaaaatttaataaaaaagaaaatctcaaagcacaaatcagaaaaatcaaataattatcaatcgtttcgattcgaagagatggagacataatgaaaaattttaaaaaataaaaaattaccaaatcgaaatatgaaaaaattaaatttaattaattatgcaacaaaaaaaggatatattatttctttaaaattattgaatctattatctcatataatttttgtcttatttaaaaaatggcttaagtaaaataaaattaagattaatcatagaaaattaatatctgtgaaaatgctgaaataaatcaaatgaaacagcaaaaattgaatataaaaaatatttatccaagaaatttaaaaggacaaagaccaaaaaaagttagattatatttaatttaacaaaaggcaataattaaaaaaaatataagtaaaataaataaattttattttataaattaaaaaaactaataaataaaaattaatgtttttactactataaatgtaacattttgtccgtaactcagttaagaataaaaataaacatttctcgaataaaagaaataaatgtatcaatttaaagttgattttttactaaaaatgctggtggtcagcgaatgagaacgttcgttatcttcgtcacgattactattaaagaacatgagattaaaaatcaaaacacaaaaacccataaataaaaaataattttttaatttaaattaaaaaaatagatatcaaaatataagggaaattaattaaaaggaattaataaatccctaattttattcatttattgaatgtaaaaaattctcaataaatgatcaaacaaacctaacaaaaataagttttaaattagtcaaaatcaagaccaaacgatcctcgggattttaagtattaaagcgaaataaaaaatattgtaatttttaaagattaacagagaaattcgttatagctttgaaaatcagagttattcccttaaaaaagcattctcgaggaagaccttcgaaagataattaaatatcgaagcaaaacaataaattaaaacatttaacactaatattctcatcagtcgcaatttaaaactcttttctccataaatccattaaatttattatcatttttcttattaatttaatagattaaaatgcgttaacaaaagataaattttttgtatatgaattgttagaaaagaagtgtattaaagtttgggcgcctgaaaaagtacaaaattgtgcatttttcacaatcaattttaaaccaacagacaaaaatccattaaaaaaataataattaaataatttatataaaattattgccgaaaattaaatgcggacgtaatgagaaaggtgttcacgaacgagaacctgaaaaatacacgacaaaataaatattaatttaatattattgaaaaatttaaaacagaaataatcaaaataatcgaaatgatttaaattctaaataaaacaaatactaaaaattaaattttacattcttggtatcgtttgatagcc

SEQ ID NO: 17841 - DNA, 2344 bp, Heterodera glycines
agtaatttcaaaatgagaatttattgtgagattttaaggaaaatagataaatcggtataagttaagctgtaaaaaatgaaataaaaagattttgaacagtattgaataattttttcaagaaatatcaaaagcattttacaatcaccttttcttttgttaagaattttgaatttagcagattagaatatttagaaaattttattatattttatattttttggaaaattgtcaatgtttttgaggtcggaatgaattatttccgctttccgacttccgtatcggcctcggaattccgatttccgaaatctttttaagccatagaactccgatttccaaaaattcgttaagacttaattaaattttaaaacatttttgtaaaaaagatttaaaaaattaacattcagaaagagaacacttatagctgaatgatccatgaaatattaatttggttgaaactgagttaatatgaatttatatatgtgacaattcttttttcgatagatcaagaggatgaggatgaggaagagcaacattatggagaagaggaacaaaattatgaagaaaacaattaagaatgtcttgaaactttattacgatggattttgtcgaaaatataattcatttttaaattttttaaattaagaaaaattaagaaaaatatatttaaatagtttatttggttcaaagcatttaaatttgaatattttgacgattatcctttgtcttggtgattaatacttgttggattcagctgaacaaaaactttcacttttcaggtcccgccggtggcggcagcggttattacggtgctggtggcaataatgtaatatgaaattttaattttattattaattttcaatgtaaatatttaaatttgacaaaataaattggtttattattttaataattttaatttgttttcaactttatccatatccttaggtatctcacacaataacaaaaatttagaaaaaagaaaaacaattaagaatgtcttgaaactttattacgatggattttgtcgaaaatataattcatttttaaattttttgaaaattttatttaataaattatatatgtagatgacttgaagttttaaaaagaaaatttaatctaataattgcttctgaataaaagttataaagcattgatcaggctagttttttgccatggtcatataaatataattttaaacatttaaaattttaagtcattaaaatgcaaataagccgaaatgaatttatatattcgatagtcctaagaattctctactattgttaattattcaaaaagctcatcgagttttaaaaaagttctggttaaataattccgacttaagattttgtggaatttaataaccataacttttttttactatttttaaaaaatttgaaaattaaatattatgatagataataacatataaagctattgaatagagaccggacaagagggtcggtcgaacggtttcggttaaaaagcgaaaaactcaaaaaattctcggtcgaacggttgcggttaaaaaaccgaaaaaaaccgaaaccgaaaaactcaaaaatttctcggtcagtttttttcggttaaaaaccgaaaccgaaaatcgaaaaataccgaaaaaaaccgaccggtccgatctactattgaatggcaccatgaaatattaatttagttgaaattgggtcaagatacaatttatatgtcttttaatttttttgagaaaaaaatttgcccgaagagcaaaaaaaaggtctttgctttggaaaatgttttgctaattttacaaataattattgacgaaaatgttgcatttttgaatgttgaatttttgctgcctttttccaatttttcgtgccttttttgacgtttttgttcattttttatgccttttttcacatttcgtgcctatttttggtgcctatttgagaaattttcgttccctccaccgaaaattattgtttataaaatatttttttgaaatttctaaaaattcccaaccgagtcaagatgagctacatttggtcgagaccaaaggaatcagcttagattccgttagattggcacaaatagcagttgaagaagaatcggatgcaaacggaatggaagggatgaagcggaatgatgagagggcaccattgacatgaaagaatttagagagataactcagcgggtttaagtcgtaaagacttgcgatctttttcatattgtagcaaattttgtcccttttccaatgcgctggttttcaaattttccaaaaaaattttcacaaccccctaggaatttttcaaaaatttttccgattttcaaagaattttgtggtgtaccgatcactatgaaggagtgatct

SEQ ID NO: 17842 - DNA, 2924 bp, Heterodera glycines
  misc_feature (1668)..(1668): n is a, c, g, or t
  misc_feature (1676)..(1676): n is a, c, g, or t
  misc_feature (1690)..(1690): n is a, c, g, or t
gcgccgaaacgggagcgccgaaacgcgagcgccgaaacgggagcgccgaaacgcgagcgccgaaacgcgagcgccgaaacgcgagcgccgaaacgcgagcgccgaaacgcgtgggtccccaaaataagggcatgcaaaattgcttcaaatcagttatttttacaatttatttgatcacacggcgagtcaattttgggctccaagtacaattaagttggttttttcgtcttagtggtctgtgagttagtcaaaaaatgggcggtcaccggttcgaatccagtgcatgttatagctgtattttgaggtttttaaagcaaataaatatatgtgaaatggtaacacagtttttaaagaagctcaaaattttataattttatttcctggaaaaacaaagaaaaaaccttttatccaactgttattcaaaatcgaattgttcttctccatcgctttcttcgtcgctctcccggcctccgatttcttcctgttgttcttcacggtccttaagcatgggaatttgatttggaacccaatttgcaccaaactgacccgcttcatttcgtcaatttttcctgtgtcgagaagccaatttgagacaaagtggtgctccaacaattgacgcatttgttcttcgtcgggcattgtcttccaaagctgttccaaccgcctccacactgaatgcaatgcttcatcacctaaaaaaaatttagggcttaaatttcaaaggctttgtgaccctgaccctgctcgtccaaaagtgccaaaaatttgtgctgtctggcgaacggcacaaaatggttcaacaccaagtggacctttggttttaaggcgagcaaagtgcgcatccgtggctgatcgtcgagaaatgtccgaaattgatcaatcgacgtttccaattcgtccaaatcccgtggcgacaatggctgggccttaaatttattttttgattttaaaaaaacccaaataaaaatgcacttttgtaaaccaattttccaagggtttgacaaatagagtttgcagcgaacatcggctcactgatcgagagcgatctcgatcgatcacatcagcgattttctctgccaaatttcgccgcgaggtccgctccaatgtagccgcattctttttgcgccgtgtagatgctaagaatattttggatgataatggttctaaaagtctgcaaatttacttgtcggctggtccttcggcgcctgttgttccaattgacggcgcagctcagcgatcattgcgtctctgttgcggacctgcagtcgaagaaagctgatcgcttgttcctgttccttcagctgtttgtccaattggtagtttttggacggacacgcactttcggcggcttgggtcgatgtaccctctccatctgctgttggcgcggcatcggtctgctttagccctgaaaaattcagtgtttctaaaataaaattaatttgtttaattttcgtcactttttggcgtcgagccgcctttttgagcaagcccagcgccattccttccgctttcgtcttgcttcaacaccctgagttgctcatattctttaaattttcgctttttttgcgtgtcaagaccatttttagctgaaaaatgattgaaatttattgaaatttttcactagggtcaaaaaaatttttcatcgggtcagattttcttcaattttgncataggcncatagtttgacccnatctatcgaatcatagtttattttttagctgtctagtttttaactctagatcggctcttctatttttacaggggaaaattcccaaaaaattttaagttttgcaaagtttgggcgttctgattacaaaataaataattgtaaggtagatccgggttttcttgtttgccggccgaagccctatgaatttcacattctacatttatttcatttcgcatttaatttcccttttgcttattgtcgcccctttcccgacgataattgatcgatcacatttcagaattaatgttttatgccagctgaaacagcatcctattattctgggtcttttaagcatttttgaattatttttactatggactctttatataaatgtcctgtaacgattgctatttctcttaagccgtaccccctcatgtggaaatcctagacaacatcatatatctgaggagcaattggactattttattttttgagttttaaaaataattaaatattttctgcatgattctctaataaaatcctgtcgattaaaatgaatcaattaatgttttatgccagctgaaacagcatcctattattctgggtcttttaagcatttttgaattatttttactattgactctttatataaatgtcctgtaacgattgctatttctcttaagccgtaccccctcatgtggaaatcctagacaacatcatatatctgaggagcaattggactattttattttttgagttttaaaaataattaaatattttctgcgtgattctctaataaaatcctgtcgattaaatgaatgaattaatgttttatgcctgctgaaacagcatcctattattctgggtcttttaagcatttttgaattatttttactattgactctttatataaatgtccggtaacgattgctatttctcttaagccgtaccccctcatgtggaaatcctagacaacatcatatatctgaggagcaattggactattttattttttgagttttaaaaataattaaatattttctgcgtgattctctaataaaatcctgtcgattaaaatgaatcaattaatgttttatgcctgctgaaacggcatcctattattctgggtcttttaagcgtttttgaattatttttcctatagactctttatataaatgtcctgtaacgattgctatttctcttaagccgtaccccctccatgtggaaatctctagacaaccatccatatatctga

SEQ ID NO: 17843 - DNA, 2677 bp, Heterodera glycines
cccctattttttggctccccaccagggctctgatgccgactctgaagtgagggactcctcttttgctgcgttgggtgccattatgaaatgcattggggaaaaggccttgggctgtttcatctcgcctgaattggccaaagatgcgaacaaaatggccaaggtcttttcataaacttttttcaattaatttttgttttattttacttttagattgccgaaaaccgtgacaaggctttgacagactctccaaatggaccaaatgtattacctatttccctcaatttttaattattattattttaaaattcggtttaggatcgtgttgaactctttgccaatgcgaatctctcttcacgtcctgttgctgactcggcaaaaaagagagatgcgtccacgtcgcggctcaaccaaacaatcaactcaactgtggacgatccaaatgcgacaaaaagggctcggtctgctagcgggtaaatgaaaaatcgtacaattttcatttttgctctttattttttagccgtcgtcgttcggttgctgtcctccccaacaattcaatgctcaatgacaacaccgatgagggcaatccgcgtgccccgcgccggtcacattttgttggcagtggtggactttcctcagccgtttcgtactcatccaacttgaacaccacgatgacacttcaatcgcaaaatgttgctggcaaattccaattggacccaaaatttttccaaaacgactttgatgacaatacattgttagccggaaacaacagaggagaaagggaattgacaaacaccacgcaaacgctgctgttggacaaaacattcaaagtgtccactccaaaagtgggcgacaaacacaacaacaacacaaacgcggcacaatcaatggatcaggcatcttctgttgatctacaaccaattgtaatttcgttaaaaatactctgtttttatttagccctctgagaatattgggttgtctcataggtattgagtgtcaaacaaatgaaaattttccaaaatattaaaaaaaaatcaaatttttggatgtatgatctgattcagaataatgagatgaagccatctaataaaaaagaaatgagaaaaccatagcccactctttacgcattaaaatgctattactaaaattgtcaacaaatgcaataactaaccaatttttataataccaagaatttgtgacccgttccccatgagaattggttgaatgttttccgattttttcagaaaccagttgtgcgcccaaccagcactttttcgcgtcgtagtgagtcagtgtcttcaatttcttcgctggaaagtgcggaacacattgaccgaactgtgcacaacatttcctgtcttcagcttaacattgccgaggaggcgttagcccaggtaaaatttaaaaaaaaaaaatttttttttttgggattttgcaaatttgactgcgccctttcagttacttcatctgatgaacgaccagacaacacggcagtatattattgacagaaccgaactcattcttaagacggtctttcattttttcaaaaagtgggaattttattttatttttttagatggtcacgcaaatctttcacattcgaagccaacatcttgaacaattggacggagtgaaggaaggggaccaaaaagagcaggagcttagtgaatttatgcgttccatttgcaactttcttagcactgttagtgaaatgccatcaaacggatttcataacaatgccactaattcaatcccttttagctgactaacgaaatgaccattatgcaacggataagtacggacactttgcgttcattcattgattcacttctttcgttggtcagcgatcagcgtcttaaaatacttaacaaacaggtgattttttaaaattgatttggcttttttttaatgtttcaatcattttttataggtattccgttctctcaacattattgtgattcgactgtgcgaattcacaaatccgaatgtgtgttttgtggcgctgatgaaattggtcatgaaataccaggcctctgatcctggcggtcaattgtcatcgttggtccgcaaatgtctcaccaaattcactgacgcaattgttgagccgaccaggattgaaaaagtttattaaatagtttttttttgtaaacaaaagttttctttttaggttgacattctgactgtgctgcacccaatccacgagtattattcgcgtttttatgttgccgatggacaaaccaaccaaatttctgacacagtgaaggacacgtccaaattgttgtgcatttttttacagcgtttggtcatcaaccaaaaatatgcggtacgtttgtcacttttagtgaaaaacactgtaaattttattaagaattttattaacttttggtttaaaaagggatttttaatttattttttcctattattttcgactaaaaatttttaatttttttgtaggggtgtgcatatacttattgcagcctttctaaatggatttttgctttttgttagatgctcaactatctgtatccgtttcccgaaagttcccaattggtgagttatgtgcggcgatgtatccgaacggtgggccgaaaagcgatggaagagaaacgccaggacggtggcgcaggcggagctgccccaaatcagaataatccaccaaaaatgggcgggtgatgatgaa

SEQ ID NO: 17844 - DNA, 2313 bp, Heterodera glycines
  misc_feature (2232)..(2232): n is a, c, g, or t
agagaaacggcaggggggtggcgcaggcggagctcccaaaatcaagaataatcaaccaaaaatgggcggtgatgatgaactgtcgtcaatattcagccgaatttctgggcgccattttcaatggggtgaatgaaaaagaaattttatgtggaaaaatttaaataaaaatagcaaacaaaaaacgggaaaatttgatttcaggctgtcgaggacttgtacaacttcatggacatccatcctgaccaaaatttaaaatttgaacaactgatggctcggtgcgaatacgcttccattgttcggcgcgcatttgtcgaaattcgtcaaactcgtcttaatcgggagccattgaaaccggggtaaagataccattttaaaatttaattttcggctggattttgtcaaaaaaatacagcccatgtttattttccaatgtcgaacttcatagttattttcttgttttttaaagcatttgtgtgcgtcgtgtgctgccggaggaaacgcgtcaatttttggaggaacaaaacgcgttgagcaaccgtatgaatgaactgatgcgattgttcacacccggcgcctcccccagcaccgctaacactccctcctccgcaacggccgcctccattattatgggcactcttaagaataacttgacgaggaattagataaatatataattggcgctctgaaaatgacatgggaaagagccattatcaaaacaatttttattccgcttttttaatttattactcatttgattagaaaatatgcccatgttttgtcaaaattccaaaaagtattatatttatcgacattttattcggcttcggattgactgctgtaccataaattacaattgcttcttgtttcacttattcagaccgatcttttgctatgtatagtataaagtgatgcaaaaaatctagcgcctttgatttctgaagtttaatgcataatcagagctcagattatttttaaccccaaatttattggtaaactttttaaataatttaaaaaatcaaaaaatatatgtagttgatgataaatcatagacaaaaatcaatgatttccaaaatctgagctcaggtccgtgatcagcgcatttttaagcctagaaaaaatacgtaccaatttcgtcgggactccaattctagatgtaaactcgattttaagattcattgatggaatcgagtccaatttaaaaattaccatttgaggtggattcacactttttgaatataatttaatttattctctaaatgacaaacacgacaatatatatttaatattaagcatcttatttatgaattaaatgatttcaagcgaacagtgtgctcggttggctgttcattacaagataagcacattcaaaacgggtcatctgctgctgtttcccattatttccctcctctttgatcgacggcgaagagccgccgcccgcgggcgaaagtgacgtcgtcagctcggatttgatcgttgacgtattcaccgccggcggcgccacacaatccgtgccaaaaggcgaaaagtgacgtacccccaaatgcttggcgatgtgcacaacgtccgacacggcgccgcctttgctcaacacgccgggacgaatgcatttgtcaaagtcgcgctccaacacccaattggacagcgtaccgctgaaaaaaatacggaattaaatgggggaaaaacaaaattttatttgaatatgacagtattaagtgcaacacaacatcatttgcttacttcaatttctcaaaacggatgtcctccatgttggttttgtacacaaattccttctcaaacacattgctcccgtccagaacagtgaaatgggacaagagtttcctgcaaaaaattggaattaaaacataataaagtaaaatttgcatcactttgccgtgttcgtcttctcatgcggcggcaacttcacatagagttcaatcattatcttaacgaggcgagggagcgctcatttacaataaaaaaggtgccaacatttcttttaattccccacccaccattgattggagtgccaaatgcagtgggatcagtcgctcaatgcgatcctcaagcgacgccgatgaatggcgaaagaacggctccaagtcgatggtgttcggcagaaagccatcagttaaaaatcgatgggtgagctcaccgctgaaacggtcaacgccaatctgtgtatggtgaataatttttttgggaaactacaaaaatttttatccgaaaaaaaantattaaaatttcgactgtttgtaggaatattgaccccgacaagagatgtcgagacccattttcgccatgtcgtatagacct

SEQ ID NO: 17845 - DNA, 987 bp, Heterodera glycines
  misc_feature (904)..(904): n is a, c, g, or t
tacccctgacttttcgccactaaattaattatgctattattttggcatttcgtaattgaatttcatttcttccaattaattattttttaaaatgaacttcattcatcataaacttttaaaacaaagagaaatttaatgctgcgaaactgttcaaatattagtagataatgaaatattggaaattgaacagctgacttatgcggtaattacgttaattagcgtcacttttaattgccaattgggagcatataaaaaggcattaattaatccctgtcaagcatcaaattaattagcaaacatttaaaataatttcctccaaatgctgctaaaccctgttcaaagtgcacttttgcttgtgctaccgttcctttttgtgtcctccgatgctttttggatgtttccgttcggcggcggtggccaaaagccaccagcgcaatggcaaatgccaaaatggccatggtatttgccgaccgatgccaacaattcgtcaacttcttcctcctcttcttttttaatataaatgaaagcaggaaaatggcgcttgttgggttgttcagtgccaacactccttccccgcccctactcgtcctcccattcacctcacacgcaggcatttagtttagagtttgttgtatatgattcttttttaatgaaaatataagtgtatataattaggctgaatacacttaagtgcatatgaatttgtgcaaatgccaacaccccttcccttcagccttccgcatccccccattcacctcacaggttggcatttagtttcgagtttgtgctgtgttcagtggcaacactccttctcctcccctcctaccccactcacctcacacgtactccctcccttcatcccagtcattaaaatgaaaaattcatccatcccctcctcctctcnccccattgttctcccttcccccttatcctgcgcccgccccatcatgcccacattaatgcccatatataccatttcactatgcc

SEQ ID NO: 17846 - DNA, 1728 bp, Heterodera glycines
atgatcagtagggatgggaatttaagtcaaatgactttttttttttgctgactctaaatgaccttaaaattacttcaaaaatgttctaaactttgttcgaagcttctaacatgcattttttggtgactttttttgctttttacactttttgggatttttatgacttttttgcgtttttgtgacttttttcatgactttttacactttttaaagcaaaatttgactttttgtgatgaaaatgccgaaaaatacaaagaaaattcagaaaaataagtcaatattcgaggcggaactgaaatttcttataccataaggactcaaatgacgggaactgaaaaaataaaaaataaaataaaaatttggcggtgtaacacttttgaatattttttccgctaaaattagtcgttttaaattactttcttcgaagaatgtttaaaacgcttttgggtttaattacatttgtcttattttcacgacttttttggatttatttagtgcttttttggcatttttctgtgactttttggttatttttcatgactttacattttttatgactttttcgtgactttttggcgatttttaatgactttttaagtcgccttttttgagaattttcgtgacttaaattcccatccctaatgatcagcaacaattaagaaaaaatgaaaaacttcctgaaaaatggccagaagattttatggagttcgcgtgcaattcgctttggaacgtcgttcccgtggtgactactctcatttcgcgccccaacgaacggcccaacacttacgcgagtcctgaacacaaaaacgcatgcgtagaaacagaatctagtttggtcacaataaaggaccttcgcgtgaaaaagatggtgagtgattaaaaacaaacatttatataaaatatttatattaagtaaaataagcactttatttgtttttgatttccacaaaaaatttcactgctatatatttatgctccgcttgagaaaatttccctagtcccagggttgccattcgtccttagattccagagaagtctttgactctgggcgtcgtgtcttggaaaaacttatttttaaattttctaaaatcaaataaactaaaaattctttaacttcgaataataaaaacaagttgtttgtagtcgaataaatggctttgcttttgtataaaaatgttgaaataattgtttttttacaaattttatttattttttcttttcaaaatttttcggtcaaaattagttaaaatctcatttaaaaacaaaaattactccggcggtgcctgccggcaacctcggactttttcggtaaacatcctaattatctcaaaaattctttaaaatttaaaacttttaagttatacctgtttacaagtccacattaagattccaaaaatttaacgcagcgcttgtcggcactgctggttcatttttggggcatgctttgaaatgacaatttttttcaaaatgccttttgaaaacaaactcgggagatggcacattagcctagtccatttatttgactataataaatagacaattagcagtcaggctgatgtcggcaattgacacattctaaattgataatttatttatcacagaaagagcaactgatacgaattggtcccaaatgcgatgtgtggtcttttggcgttctaacgttggaaattttggcacacactccgcaaataaatccaatcgagaaaagagaagacccaatcgtcttat

SEQ ID NO: 17847 - DNA, 1415 bp, Heterodera glycines
  misc_feature (50)..(50): n is a, c, g, or t
  misc_feature (52)..(52): n is a, c, g, or t
  misc_feature (55)..(55): n is a, c, g, or t
  misc_feature (99)..(99): n is a, c, g, or t
agattaggggggtgggaggggaccgacccttggtattcttacatagggcngnggngggggggggaagagataggatccccctttgacggacaatagagnaattcgacaaaaaaggagttggataattaggaggaaaagtgaaaacaacggagtgattctgacacggaaaaacaccggaaaataccgtaggcgagaagataccgtagaaaaatgcgaataatccttttttataatttttgttttttggactaaaaatgttgaatattttttatcggttagcggaaaaagtaaagaaagattggattatgttatgggaggagagagaaaggggaaatttggtcggaggaccaaagaaaagccaaaagaaaaaggagggggggggggggagcaaatagcggcgtggaaagggggaaaagcattgacaggccgagaagccgaggaggagcattgtcggttgcgctttattattattattttcccctttcccgatccaatccaacatttattcattcattgggtccgctttctcctaatgatggcaataattgcacctttccattgcccaatatttctttttatgcttttccttttttgcccctccccaaaattggccctttcttcagactgtccgtccttccattccctcgcaaacaattaattaataattaattagctcattaattagcccatccattttttcaatctctcctcccccctttcctttccaatcgttgttcaatctctttcattattattttttgtatgataaaggagcattcattcacacattcatttcccgtccgtcttatcaccatccaaatttggctaaaatgggcaaatttttgggggaaataaaagacgagaggcaacgagccaattaaagtcaagcaaatcgacacaattcagcacacttttcctccttttgccaactttcaattccttccgtttctgtcagtgccgtgccgaaatgggcaaaaagtgaccatttgccgattgccgtcggccattgttatcaaatggacccatttggacgtgccatctccccacaaaggctcttatttccgctgtgcttcacatttgcctatttttggcacactttttctatgcgctccgtcaaatataacgggtaaaaagcgaaaaaggacaacaaaaatgggaaaaactaagagaaatgctgaaattgggaattgttttttgttgttgtttcgattatgagggttttccccgtctcaaaaaagtgaaaatttatccattctttgccatggttaggtacaatttataccgtattcatctgccaccgtactccgacacggcgaattttgtccaatggttggaagagatggaggcaaaactgaacgaactgtcggttggttgaaggagtttcaacggaattgaacatttcttgtccattatca

SEQ ID NO: 17848 - DNA, 1839 bp, Heterodera glycines
  misc_feature (1755)..(1755): n is a, c, g, or t
cccccgtcccatgcaaatgcctcgccttcggtcaatgcgtccgttctgcgtcagttcgattttgtggtgattccctgcgcaaacccggacgggtacgccttctccatgagcagggaccgcctgtggcgcaagacgcgctcccgcaacgactcgctgcacaaatggtgcgtcggtgcggacgccaatcgcaactggggctaccgctgggcaggtggggtcgccacgccatcgaacacaattttcggccccatatttctgactttggcatttgccacttttgcagagaccggcgcctcccgaagcccatgctccaacatttacccgggccgggcgccgttcagcgaacccgaagtgcgtgcggtgagggacctgctgagcccggaactgagtcggctggtggcgtacatttcgctgcacagttacggccaattggtgctgtccccgtggggcttttccaacgtgaagccgtcaaatcactgggaacaggtggaaaactcgagaatttgttgttttggcattccaaaaacgaactgatcaaaccatcagcaaaagttggcctcgttggtcatcgactcaattcgcgaggccaccggcacagaatacactttcggcaccatcgcagatttgctttatcctgcctcgggtacaagcattgactattggcaggtgcttttatcaattgtaaacccaacaattaactcattcaaccaaagtatcgcggcgtcccttacatttacggcgtggaactgaggccggaagacgtagaaaggtttgatttacatacatataccatttcggaagaatggcactcatatgcaaataaattttaattcccacaaaatttcagtgaaattcacgggtttgccatcccacccggacagattgagccaagtggtaagcgaactgaacggaataaacagacgaaaacagtatagggaaagaagtgttcacaatggtcaaaaagatgatggaatatgtcagcgaaaatgacaacaaaaggacggagaagggaagaacataaaaggagacaaagccaagaaaaagcccaatttgagaaggaattggaaatgtaaatactcaacacaatcattttattgtttacattaggcataaatattgaagaaaaggcgaaatgttaaaatattcaaaataaaatgtaatgtgagatacacacgacttcgagcagtacaccagcaacagcacaacagaagagtcagttccataccttcaacagactgtcccatgagccagtgcacagcgcagttccatcgttgggcacccccaaacacgaaattcggttgtcgtggccggaaattattcctaaaatggggggtggtaaattatatttaattgtaaaatgaatcactcacccgtcctttcaacgcgcattgagtcccacaaattgcaattaaagtcgtcgcacccgacgaacagcaaacggcccgacttggaaaaggcaacacttgtaacgcctaaggaacggtcactgattaattggaaaagaatgaccaaaaaaggcccaccgcagatgatgttgtcgtgcgagtacatggccaactcctggtcagcgcggatgtcgaacagtcggcacgtggcgtcgtcggagccggtggcgaaggcgtgcccattggggaagaactgaacgaacgggaggaaaagtgccatcagaggaaacaagtcgagaaacgggattaaaaagatggcaaaagggtcgggaatgggatctcgccggaattgaacctcccattttcatgnttcccatcgactgcattttcattgctaattgtccgtacccgaacggcgtttatgtccgactcgtgcccggggaatgtctgcttg

SEQ ID NO: 17849 - DNA, 3407 bp, Heterodera glycines
  misc_feature (1790)..(1790): n is a, c, g, or t
cctaaataggacttagaatcatcttttagtatttaaaaattcctttttgatatcccatttcaaaaaaaaaattatttttttgtagcacattttcacaaaaaattctcaaaatttttgaaaaaattgcgaaattttggatatttttggggacatttaataaaaaaaattccttaaaaattctcaaaaaatgcaaaatatgtacgcaaatatgcaaaaagtcctaaatatgtataaaaatatgtacatatgtaatatgtagaaaaatctcaaaatatgtaaataaaagtcgcaatttttgttcgcaaacacaaaaaagaaagtgtttttcctactaattaggctatggagaatccaggaaaaaaacatgtatttacataaaaaaagaagaagccctggttattattgtatttattatttatctctattattattattattgttatttttagtgttattattataattataattattttcatcttaccattttgcgttgaacagaactgcgcgaaacatttctcttcattgttgcaatccctgtctcgcggttttcttatcattaattccgattcaacgagatatttgcacctagttgcttaatgtggaatttgaaaaaaaagtgctttgtcgttataaaaaaaaaatccatcaaagagagcgttataaaataaataccaaatgaaaattttcaacaaaaaacttcacataattttgctcaaaaacaactaaatttttaattcttggtatcattcgatagctctaagagttctttattagcctgaaaaattcaaaaatttcgttttaagtttgaacaaagttatgggcagaagcacacacatgaaaccttttcaaaaatttttggccatgacttttttgaaactaaacgaaattttttgaaattttgatggattagaaaacacaagatcacgtagttttgttggttctaagaaagctttaattaaaatttattgtttattctaagtaaaaaatgttagtcaaaaattcattttattttttattttcttgctattattcgatagccataaatgttctattagcctgcaaatttcaaaaaatttcgtcaagtttcaaattcgaaaacctggttgtgcttgtgtacttttggccataactttgttcaaacttaataaaacttttcgaattttttcaggctacagagacctcctagagctaccgaataatatcgagtctaaaatcacttgaaaatttctgttactgtattcacttaccatgcccgggtttcggcaaaacgctgagcaggcacaccagcagcagcaaggcaaaaatcgatggacgaagcattgagcggaccattttgtgaagttcttttttgctttttttaaattaattttttaaaaattacattttatactaattctttaatttaccgtttttgattggatgaagggcagagtgatgggatggatgaagggtgcaaggaaggttcaactgattgatgattgaatgaaaggatggattagctgtgatttgaatggaaaatgtgtgatttgggtggcttttcggtgcctatttatggacagacaaaaaaggagtagaaaaaatgggaaagcagctgaagggggcgccaaatcaccacaaatttacactccccaagcacaatttttgtccaatcgctgggaaaagcgttggcaaattgagcaaaagcgatgaaaaaagggaaaaagcgaaaaataggaagccgaatcatcgttaaaacaactgatggaatgccatttccgatggatgggaatggaccaattggacaattntcgtttaatattccgtacaataattattcattttttttgtggccgacgaccaatcgtttggaaaaagtgttagcaaataaatggaatggataaattgagatcattaaataataaaaataatttagcatagtaaataaaatatttatgaattaattatgtacataatgtataagaaaaagctatttaaaattgaaaaaaaaatttctggaggcacttaagaatttataattgactcatttatcagctaacaacagacagaatgtcaataaggtgggcgcccgagcaagcgagcggcgtgagtgtgcggtttagttttggccaaaatgctaatcaccggctttatttgaaaagtggtccgccccaccccagcataaaatttgttgggctagaaccctgaaactagtaccaatctattccactcgtcgacaggaatagattactctctcaaatgcttttagttcccttaattatacgatttaaaaaatcatcgacaaaatcatatgatgataacatatataaaagcacagatttatgcagttttgacgccagattcttgattagcgcctaaaacaaccctagaaaagtgctttctcttgtcggaattatgacatttttatggtgagcggcattacggaaaagtaccctattacattatcgtttttaaacaaattctgttaataactgccatattttccaatgacccatttttaacggtaatttacagaaaggagggcggtcgatttatacaaatttatagtttaaaaaaagatgattagcctacggggacaataagccctaattacggttggtctaatcaatgaaatatgacgattggtattataatcaaaatgttccggtcaaaaaaggaagattcctttaggggtttaatcaacgtacatactgtaatttgaaattttacccattaacttagaatgaatcaatcacaataaaagacagaacggtggtcgtggaatataggttaaaagtcgtacaacaattaataatgcgctactcattcataatccatggaaatttcttcgatttttcgtcggcacttcacaacaaatttatttgtctccccatgcccagtcaaccttaaagcgaatgaatgaatataaattattttacaaatggacccgacttttattaccaagtaagtttgaaaatttttaacccaccaagttgtcgaatatcgtttttttcggttccgatgcggccgcctcttcgtattgatcaaagcgcttctcctgcttctgctcaatctcagtctgctcctcgcgctctttctggtcacttcgttggtcttctccgccttcttgctcattacaaccccacgaatcgtctagttcttcgtttccgaaatgatcagtctgctcctcgtgtcttttccgatcagtttgcttctcgcgcaccttctgatcacttcgttggtcttctccgcctccttgctcatcccaaccccatgaatcgtcgagttcttcgtttccacaatgatcagtctgcttctcatatcctttccgatcaatatgctcctcgcgctccttctggtcacttcgttggtcttctccgcctccttgctcatcccaaccccacgaatcgtcgagttcttcgtttccg

SEQ ID NO: 17850 - DNA, 4331 bp, Heterodera glycines
agaatcatgtaccaggtccaatgttgcaccatatctggcttacaagaaccaatccaaaccacaggagatcgaagaaccaccttaaataattattcctaggaaaagacttaaagagcaaactcctgatcctgaatcagataatgatacacttgaggagttaactccggagccccaaacaacatccacactcaaaacacccattccgatcaaaactattatacacccgacccttttaaacggtctttttaggtacgtgaaggaaaacaaagatttatttaaaattacggcggccggaaagttacagtcgaacatgaatttgccgattgaaaacagtaattataaagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagagaagaaacccttcaaaccactaatatgggcaagactgtagagaaaattttatcgaaaatttattataatttaaaatctccggcaagtttcgctgggattcaaaaaattttaattgaggcgaaaaagattgacccgaaaattacgaccgatgacgtaaataaattcctagaaaaacagagaacatacacgattcacaagcccataaggaaaagattcccgagactgaagacaataccgagtggcttccacaccgattggcagtgtgatttatgcatttttgatcagttgaaaaagcataacgacggttacaagtatttattggtctgcatcgacgtgctgagtcgaatgatctttagtgcaccagccaagtcaaagaagagtgaggacatgatcgaagcttttgatcgggttttcgaaaagtcgaaaattatcccgatgaagatatatagtgacagcggactcgaatttcaggcgggaaaaatgaaaaattattttgagggaaaattcatcatcaaaaatgtaatgtatagccccgacctccacgccggcgttgttgaaagggcaaatcgaacaataaaagagcgcttgtacagatactttacaaaaatggacactctacgatgggtcgatgtaatagataaaataattacaaacattaacaacagtgtaaataggacactgggggtcaagccgtcttcaattacttttgaaaatgccggaaatatttgggataagttatttggaaatttggaaacagaaaaaaagaataaatttaaaattggtgatttagtccgaattacaaaagaaaagggtatatttgcaaagggttatcttccgaattttacggaagaaatttttaaaatttataaaataattaaatcagacccaatcgcttatagaattgaagatttaaatggagataacattaagggaatattttatgatgccgagttggtaagagtttcgaaaaatcaaataaataaaatataaaagaactttgacaaaagcaaaaaataaataatgaataaaataattttcttcgtagtttttggtttggcaatcggccaaataaatagcgattgttgttgcctatctaatgaagagaaacaacaattaaattctgctagaaaaaccattgaaaaatgttttcgggatacattccgattaaataacgaagcccgagattttgctgctgcttctcatagggcaattacggaggcagaaaaaattaaagttcgtcatcctgaggcaccgggtatgaaaacgtggttcggtaggttattagaaggggtgagaaaggtacagagtatttcagttaaaattaatgaagaaaaacagaaaattggtcataagatggacaagtgtttggacagaaaagatgtgttaatgtgtcgtgaattggctgacgaagcaaaggggacctttgaaattgttaaacagtatagaaaggacgtcggtactgcgtaccgtaacgcctatactcaatctgacctcgggattggggaattggccgataaagttaaggaaacaatgaaggaatatttatcccgccccggaccttccccaagaccaacatttaaagaccaatttatatctgattaatgtataaaagagaatggaaagacaataataaatttttaaaaatgattcaaagaacagaaaaaggaacagcaattttgttggaagcctcaaaaaaagaggctgaaagggcatggaaggaagtttcagtattggtagaagctgatgattattccaaatctgctcgtggagcccttaaccgggcaattaaatcccgagaaaaggccccctatgccccaggggttcgagaatggttcgtaaaaatgtcagattgtatctgggaaatttacaccgttttggataaaattaatgcagagtctgaaagggttgagacgatgtggcgtgagattgaacattctaaagatttcgatcagaccacaaaacttgaggagaaagtatttaagagttcaaacgaaaccaagaagttgcatttcgagtcccgtcggattcatactaaaatattggagcaagaaagcagagttcagtctatagtgttgggatttattgagcttcacgagtaaaatggaggcaattcagtataattgtcacgtaattaacaaatttgggatcaaaaaacatattacaaagtttattttttccggtacatctgattatgaatttaaacaatctctagaaaaaatattagaaaatgcatatataaaagaatcaggaatttttaaaacaattctaaaactacaatattctaattttctagtagtcttgccattacgattatcacaggaaaatacaattgacgttctgttagaacagcctgtattttcacactttttaccgttggatgataccgtaatttttgaaataacaattgttaattttaataatgacaactatagaccaagaaattaattttataaggacacaagtcgaaaaggcttggaaaaggggtagaaaattagttaaagaagcagataacttggtagcctatgcctatgagatttcgaaaattgctgaatattatattacagaaaatgacccacgaaataatctattattcgaagattttttgaaacagatgagaaagacttggattctttttcagaaaatctcacaagaatataaaaatactgcctttgcaatgagcggaattgagaattgcctaaatacaaaaaatttgattatttgccaacgagcagagaatatttcgaaagaaagccaagaattatttgaaaattatcaaaaacaactcgaaaatattaaaattgaattagaaaaagtaattaaaaaaatacgtgagccgaaaaaaatagagaaagaaatattctttacgccttaccgtagagggcagtccaaaattaataaagtttatgaaatattatacacaccttatcataggaaatgaaaattgaaaattcgagttctaaaatttaccaaatgtcaaaattgaaaattaaaagattatttatatacctttccataactattttaaatagtatgaaatctttatttttatcctttttaactttctcgttttaataaatttggttcatttttaaaatttttttaacttgctttcaactgatttaatcgatataaaaaaagacagtttcctttgggtgggaggacaaaaggaagcgcaaaattttaatagtttccccaatttttcatccaaatcccactgacaatatcctatgcgatgatcatttttgatttaatatgcaacctaaatttttgttcatatcaactaattttaaaataatccttcgcttcgacttttaattagtgtataatatagttagcacatctatcatgttaaagcattttctttataaaaatttatttccaaaaaatatttttcaactattcgttttgcatttattcgcgcactctcttcgattttaaaggacacttttcattaccgaaaataaataagagttttcccaaaataaaaatcatctcgaaattttcgtaatataaaatcgtgaacaaaggataaaatattaaaaccaaaaaattttcgcacactttcatagtcctttatttcccgcactaaaaaaaatcaaaaatagaacatagagggaggagaattcaaaaaaaaaattttactaaattatttattttttcaattcataatttcgtgtgcattaaagttgttgcaattcacaaatcgataatgcaattcacaaatcgataatttccgttgatatcgattaattggggggggggcacaaaaaaaacggctgaacactcgcgcagtggtgctaagcgtaccc

SEQ ID NO: 17851 - DNA, 3098 bp, Heterodera glycines
ttatttctaacagattttatccgctaatttcccaaaagcctacccccgacatttgcggaccgaaattgcggctgaactgtctataaacaaaaaaaataaatcattttttcaaaattcggtgacctaaattagttttatatgtgatttttccgagttgaacatcacccttaaagacaaatctgatcttcttaggcaatcaacaccgaaagtatttaaaaatttatgatattttaaaaatttttatattctttgataagtatagtatgtagttgctgctcgtttttaattttggatccacactttatgtacacggcgattcaattttgggctccaagtacaattaagttggttttttcgtcttagtggtctgtgagttagtcaaaaaatggggggtcacaggttcgaactttctattttctgtaaaaatcaagaaaaacattttatccaaatgttattcaaaatcgaattgttcttcttccccatcgctttcttcgtccgtctcccgtcggtcaccaatttcttctcgttgttcttcacgatcctgaggcaaggaaatatatttggaacccaatttcaccaaactgacccgcttcatttcgtcgagttttcccgtgtcgagaagccaatttgagacaaaatggtgctccaacaattgacgcatttgttcttcgtcaggcattgttttccacagctgttccaagcgcctccacacggaatgcaatgcttcatcgcctaaaaaaattcgggctaaaatttcaaaatgctttttgaccctgctcgtccaaaagtgccaaaaattggtgttgtcgggcgaagggcacaaaatggttcaacagcaagtggaccttaggttttaaggcgagcaatgtgcgcatccgtggctgatcgttgagaaatgtccgaaattggtcaatcgacgtttccaattcgtccaaatcccgtggcgacagtggctgggccttaaattttatttttattttcaagaaagacaaaataaaagcacttttgtaaaagtttatctttgccaagtgtcccatggttttgcaaatgatttgaggccattcagctgagtaaagcctctccaattgatcagcatgaatgccacgtcgtcttttcgttcctttcgctcaaattttttgtaaataaaatttacacacatcgttttgtttcaactttcggtgggggtcgaatgggcgccagcccccttttctttccctatgtacaattatatttttgaacattatttttgcaaataatttaataaattttggggaaggaaccggagtctggttgggagccaacccggagtgactcaaacacggaaaacttccaaacatttttgcacaatttatcatttcatattcgtctttgaattaaccgacggagaaatgtcttttaatgtttttgtcgcggaatatgtatggaatagttgatagatggagcccctagaccagcgggaccgagacttctacgagattttacgggattcccgctcctgctggaaatttcaaattttctactttgttcgaattcgggtccggggctcgaaataagttgaaatggatgtcaaatttgttatcaacgaccctgaaaactcccgtatttgccccgcgggattccaggtcacgctcccggaaaattttaaattcgcccgtaaattattttttaccggtctctagtgtgcttaaatgtacatatattgtgggaaccggccactttggcgcaggccattttggcgcaagactctatatcattttgatttcacagcaaaattaaataatcttggtatgattttaagtggcttgatagtgcctattagagtcgggggcgtttgggccccagtttttgggcccccgcgtttgggcccccgtttttgggccctcgtttttgggccccagggtcgtttgggccccagggtcgtttgggccccaagtacagaaaaatgaaaaatcacagtaaaaacaactttttaaatttcagcataaaaatgtaaaataaacattttaaaaataaattcaacaataattttaacaataaaaaatgtaaaaattaacagaaattcacgggttgttcataaggtaatttggacaataaaacaaaaaatcacgggttcattcgatagttgcgagaaattccccggagaaactccaaaataatgtgaaattgattgggattttggtggtaattgtgatcatggtcgatgttgcctgcattcatcgggacgtaaagacgcaccaaattaagaattcgttcatctgtcgccaaaaactttcgcttttttggtggtggctcctctccggcaatgaatgacgcgtatttgtctgctcacgacgtagcacgtcaatgaagtgaaaaatcgacgggtgtcggcaattgaaggcgccctgtagacgatgatgctccgcctcggagtggttgttggtccgtgcatcggcattaagcgtgcgtgtgtagacgttccattgttcagggcgaaaagttggttgtgaccatgtgccattgggcctgggctgtccaacgtaattgattaatagcctgtaatttcagtggggtttaaatttttaaaaaaagttcacacaccagtcaatcagcggttggaaaaccgccaaatttccgaactccgtatcaagtgccgctaccgccattctaatgtcacacaagggcacgaacgcaacagacgtgatcattcgagcgttctcggcaaacacagaatcggtgcagtagcgctgaaacagctaattaaaaaaaaaattattaaaacctgccacaaattttgttccttcaatttcttttgcaaatttcgcacaaaatggaagaaacaaaaattgatttgacaccctccaaatacagttgtgaccgcattgctcacggccaattcgaaatcaattgtgaacgatgtaggagcaaatgttggccatgcctgatgtaggagctcaaacatacgaatgtatgacgcctgcgacttcgatgtgagcagaaaatggcacactggtatgatccatttgcctcgtctaaacattgcaaaaaaaaactaaaaaatttctaaaaactaactaacctagccaaaattgtataaatttgataaaaaagtggcggcg

SEQ ID NO: 17852 - DNA, 3192 bp, Heterodera glycines
aaaatgcatccaaaagggcggaagccatcggcccagcaattgttggcaccatccgctgttgggatggacgtcggaacgcattgacgaacggtgacaacattcgaccaaattcggacaattcgcaaattgacgtccgttccagtgaccaagtgtgtttcgcccgtcttcgtgctcaactgtcccgtttgtggagctgtgacatggtccgctgtctgtccgaccattttctttctcggggtccggcaaatgaaatgccatattatgtaaatgctctttgccattttcagtgcccatttcgacttcctcgctggaaactcggcaaaaaatggtccaaaagcattcgctttttttcacccgtcgtcacagttcagcagcgcaggaaaacgagcacaatgagagcggcactgggccaagcaacaatttgccactctttcaaagtgcgtttctgatcactgatcggattcggacaaacttgagagctactgtaacataattacggtacatcgatcaatttttaaagtgtttttgcgcaaattgcccacgcggccgagctgttcaaccctttccgctaccacttcatccgccgctgtggccgaaggcggcgacatcgttggccaacaacagcaacggcacaaacccacgcgtcactccaccaaaaacagccgcaccgccaatgtctgtgccgtcactgtcccactcgtgccgttccctcccatcacacccaccgttgtgctgtgccaactctaccgaagtgcactgctcgcctttccgtgttctgagagtgaaatactcgcaagtaaatgagcattgaaattgcatttggccaaaagtgcacggtttatggagtctccctaatgatttgtattgaatttatatagaataattcagcatgtgctttttccaggcctaggtcgtgatgacacgctcgtgctgaagcatttgtggcaatttctcaacgaacagccaacaccaccaccgctgccgcagcaaaagcggagagaggacggcaccgccatcgaagatgttcgtctgcgcacttacctcggctatttggtgtccgacccggaagtgttggcggcacaatttgcaccgctgcagctgttcatcgacatcactttcacgcttatctcgtaggaggggggcggggggcgaacggaggacgatcattcatcggcatattgcccgacatttttattgttttaattttagaattctcgacgagcgtgagatgtacgagtgcgaacgtccatttgggcgggaccagcttcgtcagatcgccaaatttgtcaaccttttctgtttccatgcgctttggaatgagctgatcggtgggtgccaaggcattcattccccgatttattaaaaaatgctgccatttttcacagattttgaaaaggatttgccttccaaactcttcaacagtgtgtaccgactgctccaaattctgttcaaccgcgactgtcgtcggccgttcaccggcgtgcccaacttttggacggttgacgagctgagccccaaggcgctcattgccgagtttgtcggcggcaccggcttcctcctccccccgctgtccgccgctgtgtcttcttctccagccacaaaacgtgcacacattttgatggacaaaatgccacacgttattccggtactgtatattcaaaaaaacaacattttcaaaacgaacagagaggacgaggcaaggaaaaggaaaagcccgacctttcatattatgccaatccatacaatatttacacaaaaacagctgcgcgaccgaattgtgcttttccgcaaattgatcagacaggacaaagaaagtgtggacacgtccaccaccattatcacggtcgaacggtctcgcctgatcgaagacggtgaacttatcggatatttttaaataaaaacacgaattctgatatggccattttggattttattttctcgtcaattacttactaattaaacatttaatttgatgcttttctcccccattaggctattcgcaattgggcaacctttctctggcagctatcaaagggactgtccgagtgaagttcatcaaccagcaagggctcgacgaagcgggcattgaccaggacggggtgttcaaggagtttttggagctgacgctgaaacgggtgttcgacccggacctgaacctgttcaaggtaacagataccagaattcgttgtcattccattcttgtgcacaatttggcctctagagcaccagtgacaagttgctttatccgtcctccacttcgaccatccacgacaaccatttggaattgttccaatttgttggccgaatgcttgccaaaggtattcggagagtttcgccttttcactaatttgcttttccaatgcaaatttagcggtttatgagggaatttgcgtggatgttcagctagcacctgttttgttggccgccgttctcggcaaacaattgcatccgttcgatgagttggccacgttcgaccccgtgctgtacaagaacctcacctttctgaagcactactccgactcggacgatgttgccgatttggagctgaccttttgtgcacaggacgaattccttgggcgggtgagagacaaatggaggagcgggggcgggccatttggccattaattagcactaattggacttggggttggacaagcgaatggtggttgcagaatgccttaaaaacgaattaaacagtgattttcttccaattaggtaacaaccgtggaactgatcagtggtgggcgtgacatcaaagttgacaacgagaacaagtgagtggagaaattgacggacgaaaaaaatgtcattttatgaaacaaaattggtatcactgatatttgtgtcttgaaaatttgatcccatgaccaatttcccttgctccagggtttcctacatccatctgatggcccaccatcgtgtcgtcaaacagatcagggaccagactaaacactttgtgctcggctttcgtgccatcatccaacccaaatggttggcactgttcaacacgcacgagttgcagcatttgatctccggcaaaatgaggtcaacaccagaagcaaatttgtgggaatgtgaaggaaaggaaattgttttatgatttttgctgttttttgtcggagaaaatcccaccgggttgtgaagggtatctcattgtcaacttgagaccatgtgacccctcactactgactt

SEQ ID NO: 17853 - DNA, 1418 bp, Heterodera glycines
agcactttcattgatgcacggcacaagggcaacatttcacgcttcatcaaccatagctgtgagccaaatttgtcactgcaaattgttcgtttgggtcgccaatgtccgtcgttggcgatgttcgcctccagagatatccaatcaggtggcataacccccccccccccccctcatccatttcttcttcattctcttagttatgtttgttcgagagagtggacatttttcgaacacagagagcgaaaatctcgagcaataatccactaattaatttggaataaaatcaatttgaactttctgctgattttgcagcaaaagcaaaacatcttaggccagatttgaccgggatttaattctcgacacctgctggattcaatccaaattttgcctgggttttgatcccgacattaatctcgggaccaacttgtcgggaaaccccgacatgatatggggctctagctacaaaaaatgcaaatttttaaagcattttcaattctttttcttcatcaaaaaggtgaggagctctcgtacagttacggcttcttggctggcactgacggttctttttccggaaaagcctgtttgtgcggtgcctcctcctgcatgggccgtcttccatcggccacatcaatttgaatgttcagcagcagcagctgccgcaggcagaatgaacaaacaacaattatcacatattgtctaatgtgtctctgtttctcatcaacgactggtttattggcaccggcattctcaaattttcgtaccattattattccgccgatttaatgaacccttcacccctcccctcaatcatattccaattgccatcttctgctctgttcaccaccgatcatcatccatcgcatcatcattttggcgtcagcccatctcatcagggaacaacagagaaagccacggagaaatggatcattccaattattgtatacatcattaaagccaatatgacgttttttgcctttgacggcgccaattatgcgtaaattggcttataaaatgtttgtcactattgtcaatttctctccttgaaacaaacgcacactccactccattcatagtttttctccatttggaattgctttcgatggaatttcggagggcaaaatatcctttttttttgctctttagccccctaacagaaagaaatggcaatttcagaatgtggcgaatttcttcgttgcctttggcatttatgtttcaaccagttctgctgttgttgtcttttcgtttagtggacagtgcctcgggtgccaatgccataacgccaataccgatggaattgttgaacccaagactgactgaattcagacggatcgattcatcgggcgatgatcagatcactttctccgaatttcttctcagtgatccgtgtgtttgtttatcttatctcactgtaaattcaa

SEQ ID NO: 17854 - DNA, 1951 bp, Heterodera glycines
tcagtaaataatacctatcatatgtcgaatttttcagctcgggtataactgaaatctccgaaaatttgggtgcctcaggctacggttatggttcagtacagaacaaaatgtatttcggaaattttgggtgcttctggtaacggtcctggtacggtacaaaacaaaatgattccatggatttttcggtctggaatttataattttgtttgactctggttacggttctggtacggtacaaagggcaaacatcggaaacagtgattttttattgttgacacagaacaaaaagtaaattattgcttaattagcgtgatttatcttctctgtttccaatactcctcctcgttgttccattccgacaattggtccgatcaaaatttacaaaaaaaaaagaaaaaccgatcattttcactcccatttccatatagacagtgactgtcggaccgattgtggaacgagaacaggagggggacgcacaaaacgggtcccatcgaatgcactatttcacggcaggagcgcgcaagtttgccgccataacccatgtaataaatatgcatggcccttttttcgaccgtttgtcctttttgatgccttgtccctttgactatatatacatttagatcttttgtcccattttttgcccctttttacccctcaatttgtctattttttgccattttcgaaatatgcctctcacagggcaccggtatgtttcctccgtcttcgccttcctcgtcgtcctctgccgaattggcatcgccacttgcccatgactttgatcatcatcatttccacaataattttccattccatgcacaatttttgttgcctgcttctgccaccattctgggctcacctcaactatctccggtagacaattaattaataattattatttaattttagaattaattaagtaaatattgacgacgcccaactcgttctgcctcgactcgtactgtttcttttaagaaaaaaaatcaattttttaaatctaggtgctttaacatggtatcatccgatttgtatgcatactaattcgaattgatttcaaaaaagctatgtccaaaaattatattttttaaaaaaatccgcgccaatatttttttgaaacatgatcaattttttgaaaattttctgtggtaatagagaaccttaagtgctaaagaatgataccatgaatgttagagtttggtcgatattgataaaagttagacaaatttatttttgtcggaaaaagagaacagtactagtcgaggcaatggagttgggccaagtgcgagttgggtttcttaacctaaattataatttgcaaagcaaaaatttcgatgaaatttaattgtaaaatgttaaaatattaattaaatgtaaaattagcgcggcagagcgccgattgaacaacaacaagtgacttcaattcctcaacaaggcaatattcaacgagaacaaatattgaaaaatgatatggcagcacaaaattgaagaaaacccaacattttattcaattttaaaaaattttggacacatttataaaagttttctcgtttaggatgtccactaatattcaaaatcacatctttgtgaacccaaaatggaataaggaatttgtgtttacactgtaaaaaaataaataataaaaaatttgagtgctcatcgcctccactcactattaaccattattatcacatcccttttgtcaattacaataattattgataaaatgatggaggcattggtcgacaaaatgatggatggatgggtgtcttaaaacgtacaaaaaaattgaaacattgaccaaactgtaccacttgctgggcggagtggagaaaccccactccccctcccttgcccctcccccccccgtaatcgcccctgtgccttttcctcatttaattttgccgagccgcgaaattatttatttgttgtcgtcgatttgatcaagcgacttgcc

SEQ ID NO: 17855 - DNA, 2140 bp, Heterodera glycines
aagtgaaaaaacagtgattctaagaaatttctaatgctttaacttggttattagtaaaccaaataaaaccattttggtctcattttgaagggaaaattctgaagaacatgtctatcgttttttacatgttaatatcatttttaacctttaaaatgacggtaatttagtagaatgtttgcccttgttaaaaattttttcctactgtcagatttttttgaaattttgcataggccaatattttgagccctctagcgattctttgtttattttatggaacaagtttttaactcgagatcggctcttccgtttttacaacggaaattctccaaaattttttaaattagcgtggtttatggcgttttgtctgtgcgcactttatgtcaaattgataatatgtatatgaataagaaaatttttataataatttcttctaattgagggctgatgagtatgtctgggaaattaaaaattgaaaaaccccgaccccgactcttccaaccccgacaaccccgaattttccaaccccgacgtcggggttgcaaccctattaaataggtacaaaaatcccgaaataggtagaaaaataggtaataaaaattttattaacgattttttaatgggaaaaaagcaaacaaagagggaaaattttgttctacttcttagtaaacgaataatgcaaatatttttaatattttcttagaaaatatttaaattacaaattttgtcaagaaaaaaatatataaattttggggataaattctttaaaaaatttccaattcttaggggtgtcttttttgatattattgctttttgctaatggattttctaaaaactcttaaataggtagcaaaatgccaaataggtataaataggtacctaggtaatatgtagaaaaactcccaaattaggtgagaataggcattataaaggtcatcgtagacaccccaaacaaagtggaaaatgcttttttcttgcttatctgtgcgtataagtgcgcaaaagttttaggtatttacctaaatttcccagccctgctgatgagagtagcagatttatttgcatttaaatgaataatttatttatcacttagcattgtttttcatgatcaaaaaaatttcaattaataaaaattttatgagaatttaattattgggttgatgaaaaagttctgaccctctgaaaaaacaaattatgcaaaaaatgatatttaattctaaagagattgaaaaagggaggcaggcaattgggatgaatcagcggacggttggccatcttcatgaccaaattcgtcgtcctccattttctgcaaaattccgcggcggcgtgctccttctccatgacaatgcacgcccacatgttgcgttctcaacgcaacaaaaaattgagaaacttcgatgggcggttcttcctcatccaccatacagcccagacatcagcccgtgtgactactatctgtttcgatctatggagcacttcttgagagggaaagaatttgctgatcaaaacgaggtcgaaaatgcattggatgacttttttggatcgaaaaatgatcagttttataaaaaggggattgaaatgttgcccgaacgatgggggaggatcattgatcaaaaaggtgagtacatcattgattgaacatttgtttttttgtgaaataaaaaattgtttaatgttgaagtgcttaaagggtcagaactttttcatcaacccaataaatatcattttaaaattgtgggcggacggaatttgaagataacgacgtaaaacaaatgtatgtatttacttctgatagcacataaaaacatatgtttaataggtatgcatattgggaattcatttaattacatacgataaaaaattctcaaaggaaggatctaaatttttatatgtttattcatttttaaatattaaataaatttttgaaaatttcttcaaaacgtcccaaaactgttggccattccgatattggcacagttccctctgatgcagcgttggcatccctcgatactgtacacacacttttgctcacaactgtatttgacacagtctttgcagcgggcaacaagcgaatggcctccataaggcatgaaaaggtcgaaaaaggcctgtaattatagactattttcacataaaattagca

SEQ ID NO: 17856 - DNA, 3021 bp, Heterodera glycines
  misc_feature (2986)..(2986): n is a, c, g, or t
gatgggtgcttctttagatttgtgtgtctgcggtagggtcgaaacacgctttattttcttagttttttgttttctttatggaagagcaccgaacatgaggaggaccactcttccattaaaaatgtgtataacaaaaaaaattgttttcatttaattatttctcaggaattgaccgcaaaagaggcgaccgcaaatgtccgtccgcaaatgtccgtccgacaatgtcccgtccgcaaatgtccgtccgcaaatgtccgtccgcaaatgtccgtaaggcgtttgaatatgctttccatagaatgctttcacaactatttcacaatccgatggatgatttagacgatcacggagctcattaattcgacaattcaaaatttgtgcaattttttcagcaagaaggaccatttttctaattaatctagatttatattaattaattttatagaggaaatttgcaaaattattttgtaaaagatgattaatgaaaaaaaaagaaattcaactgctatttataatagttaagaatataggttaagtaaacattaacaagtataaaaacagattttcattcatttttagtcactttaatattaatataaataaaattgcattttttcatttctgattttcaaacaatttattaataatgtccgtcccatcaaaaaacaaacaatttccaaaaaatatcgatgacggtattttatttttatttattactcataacacaaaattttgcataacttaagatgacgatgacgtggataccgatccgtcacccgaggaagttgagaaatggactcccgagcaagtgatagagtgggagaagcgaatctttgggaaaatgcctccggaagaggagctttggcagcaaattattgacagcggagacaaaaatgtaagattttaatttaaccataattattatttaatcaaaaaaaactcaaggtcctaattgaattcttcggtgagaaggatgcgccggttattcgaaagagcttaaatgtttatgccgaaaggaaagagcgcagagatgagatattgaagcgaaaactcatcgaatacgaagaagcactcacgaataagacaaaaaattaatttaacagtttcacttgtcgatttggcacacaaatttttgttaaaataaccattaataaaggtttgaaaataaactccgttcgaattaggttaagcaaacattaaatggtataaaaaactcaaaattagatataaaaatcattttctttcatttaatcaaaaaataaaataattttatctttgaaatgtttgacaacgaaaatggaggatccggcgaacctcaacaaataaacgaaaatattcctgctaaaacttcttataatgtccaaccctggaaacttttccgtccgaaatacatgctcacttaccgcatgtgtgaatgtaaacaatataatagaaattattatttattaattattattattattcagtatgtctttcatcattgtggaacaacacaaacaaatatattgctaacgaacgtcgatcattaatcagttttgaactttgtgaaaaatgtacaattgacaattgtcgtgctaccgaaatacttgccccattcaagccaaagaaataagcccaagatgaatttttattatttcatcaccgataattatttaaacattcgtttgaatccaaacccatctccccatctattccttcctcataaaattgttctatttactcgacgatggcaaataaaaaatgcacaaatctaagaagcaatttgaccttttttgaccttcttatttgaattcacgagttccatgagcaaaataatatttgcattagacacagggttggggttaattgcgggatgataaaagagattgcggatcaacagttcaggcactgtgttcctctattggtcgcctttgaaatttgagaaactttttagataatgtgccagctgatcaaaatgcgcagggaggaaatgcttcgggtgatggaaatggtaaataattttaaaataactcaatttcagtcttcaaaatttcagtcccctcgtttggggcaacgattgaaacgcacatggagagatctcgtcgacgtttgctgcatgatgagatggttcagcgcagtgtccagcagcattttcagcatcaacaacaacaaatcatgttccaagcacaacaacaggaacaacgccgagttgagatgcagcggcagtttgatgaagccgaacacttgcaagaagaaattcaggctgcggatgagagacaaaacgcccaacagaatgaccaagagcaggaacaagaggaggaaaatgtacagcatgctgtgcagcagcagcaatttgagagaactgtacgactccagttgcgcgagtcgcagcgcttttacggcggttcgccttcgtcagtgttagtgccaccggttcaattattttgggagactgaatgtgtaatatgcaccacttcaaggccccatttctatagcaaggagtgcgggcatatttatttgtgcagtgagtgtgctgtcactgcggtgatcaacaaggttcgacgctgcatgttatgccgcgctagtgttagtggcatttatccttttgtccgttgagtacctttatggaagtaagaaaatgttaacatttcacattttcagcttaaatttgtcttacttccataaaaaggtgttatttgaaagttggaaaataataaaaaaatgaattttaggatatacaaaatttcaaattttgtcctctattttttttacaattatttctcaaatgattctaattttggtaatattcgagctttcaaataatagaagtgtttgattgtatgcgcggcattgagtattggaactaaaatcatgatgaattcgttttcttgaataaccgcattaatccttttctgtttgttcgtcacttttttttcaatgatttaactgatgtatgtctttaataattcattatactctcaactcatctcatatgataatcaacganacagttcgacaatttttccgtgctttttgttaatg

SEQ ID NO: 17857 - DNA, 1272 bp, Heterodera glycines
  misc_feature (995)..(995): n is a, c, g, or t
agtcctttatgcaaccattcatgcattgcgagatctccttcgtgaaaattttttgtttatggatgagttgttgggtatggatgggttgagttttgagttttacccatttttcatttccagataaaacgcactcatttttttaattgaaacaatatgaaaaacaacaatcattacggcacagtttctccaccgtcggcatgtgttcctcccaccgcaccaccgatggaaccgccggtcagacaacacaaccaaccaattgtttaagacttttattttcgctgatttcgaaacttaaacatgcttttgcgtgctttttctgtccaatttcggggtgtttaaaaaaatgccagaaaaacaaagctttcctccttgcctcaatttaacattttgggcgatgggtggacgaaaatcgggcatatcccggcttgccggtaagccgcatttcgggcaccgagtggggtgggggtgaatgatctaaatcctcccaaattcgaaaatgtttggccctccctctgcctgcctcaattgctttttgcatttcatcacattgcattttcagcgtgagacggttgcccatgtgcagggcgccacggatgcccaaccacagcagcagagccaagcgcagcaacatcctccaccgccgccatacaatgtttatttttgcaattttggggtggatggctttcacaatttggggtaatttcggttttgattctacgcctctaagttttcaaaaattctacataagttgagtggaagtaacttcccgcgaggactgcaaaatatgaaatttgaactcatttgatgaaattttgatgcaaattgtggcatttgtgctccttaaaatggcggcggtgtgcgctaaattgcttcccacgcgactttagttgacttatttgaaatttagagttataggaccaaaaccgataagtacccaattcctgaacaccggactcgaattagaaaagaacgagtttgtaaatggtcaaaaaatnttgggttctagtcggttttacgcgtcccatgacactttacgcgtcccatggcattttatgcgtcccatgacatttgtgtccatggcagggatttcattccgaggctcaaatttttaactaaaacttcgttgttaaacataaagtataataacaactcatacacaggcaactcgaacaatggcttacactaagcctaagcttttggcttaaagctagacttacgctgttttttaaattcttttatattaggacctttcggttgaggtcattaataaaa

SEQ ID NO: 17858 - DNA, 2607 bp, Heterodera glycines
gcgcacatgccgtccttgggcaacaacggcgcccccatttatgtgatgcgtaagcgactttatttttgcaaatttgataatacccaccaaaaaaatgtggggaagcgtttgagggggggggggggagaagcaaatttccactgcatctaaaattacgacagggtcgaacctgggttcgatggtaccctaaacgtcgccgggaaaaaccttggcaagttacactcctatccctcctcccccacccccgaaaccaaccagaaaaaaatttctattagaccggaaaaggtttttggaggtaaccccttggattttttcccgctggctacgcgaccttttggcacaataccaaaaaatgccgaattgcttttcattctttgcgcaacgcatgcatgatgatgccccactttacagctgccgctccaatgccgacaattgtcagcaccaccaccgtcatgcccgctgaggtgcgccagcaggcgccggtgcgcaccaatccgtgcgcccattgtacggtgcgttcttttcttgtttactataatttggaacattgcacctcccccacatctgaggaatttactaaatgtgaattttttttaaataaaaatatgaatttgccctaacaaaattcgcaaaaactgcaaattttccgctggtaccaccggccaaagcacatctatctcttctcctcctttaacattgtgttcatttttcttttgctttcagcatggcgtcgtccgatccgagacggattattgctgtgagttttggaaagtatcgctaaagttttaccggtggcacaaatagaaaatgggtaccaccggtgaccggtcacgggagcaggcactcaaatacacccacgaaatttttttttaaaccaaaaaggttttcttaattttttgggaattttttcattgtgtttgtggcgagtcgccgccgaaaattaaaaaaagaatttttcaaacaaattaaaaaattgaaaattttaagcgcttttttgaaattttatgataaaatactgtttttttcgaataatttatgtgtttgaaaaattttctttttaaatttctgcggcgatattttggggcgcacccgtttgtggcatatttgttaaattttctagaattcattttcaattccatgctttttcagttttaaaaatgcaaaagtttgcgacagagcgtacaaattttatttaaaattttccggcatttgatcggtcggtcatctttgtccattgattttttccatttttcctcacaggcctctgctgtctgctcatcttctccgtcatttcgttcccgttcggccttgttctgctcctcttcatcccgctggcgttccgtcgtcgttgctccgcgtgccgtcacctgtacacctaagaaatgccgctgggccttcagaacaccgaccgactgcttactgatggattggatattttaatgttttgtttggtcatcatcacccaaaaagcgagttttttcccccaaaaaattccttgctggacgataaatattgccgagaattgatcatttttgttctgactgattgattgatcgtattttgtgtatgttttgcgtttgctctctctcctttctctctctctctctctctctctttgtttttgttgtgttcccttgctcattgtccaatcatcatcatcaaattatcagagttatatcatcataaatctgtttaaacataatcgcaattgtgtaatgcccttttctctgcctaaattttatttcacttaaacatgcgctgttttttaaatacggcaatgggttatggcttgggagtgccacggcgcgagaattttttgttttgttttaagttttcttttgaattgaggcaaaaacaaaattaaaagttgtactggtaaaaatgagcaattttttgatttttaatttgaatattgtaaaaacaaaatttgaggactgtgcctactctatttccgttatccaaattcctttttcgataaatccccaggctttaaatataaataagtaacataactactttttgcttttatttcaacgcaaataaatggtggaaatttttgaaatttaatttttttttttttggtttttccaattttttaccggagagagcctaacaaaagccaccaaatttccaccatttcctttcttttcacaatacagcaattataaatacctatttgcttctggtttttaaacaggttgcaaattctttataaatgtttgaaaattggctgcattgcgtcggctccgtcgcaacaacataaaatttacagaaaattttttatttttggcgaattctcttatttatctcatcattctttgactgtaaaactacagcttgacacagggtagagagaacagtgatcgaaatccaaaataaccgaaattttaaactttgaaaaccgaacccaaaattcgccccaatcccggttggatctattcacaatattttaatgtcccattcaaaaattgcttcggcagacttaaaaatttaaatctatacatatttcttgaataaaataaacatttgggcgctatatgctggggtttttggggtccccgatcacgaatctttcattattttgatcaattccgatttccctatcta

SEQ ID NO: 17859 - DNA, 1808 bp, Heterodera glycines
tcttcttccgtcgatggatatatcggcttcaccacagtgtggggctgcagcttaaccaaagaatcatttatgaacaatccaatttggtcaaaaacttccaaatgtaattattttattggggaaaaaaatgacgacatgtccaacaataaagaagaagcggtcattaacaatgcgagtaataataaattaattgtttatttaattagcactattaatttttcaaaagacctgacaaaccattggtgcaaaggtggctttttgtgggagagaagcaatggaggcaaaacagaagataccgtagccatttgcaagccaaatgagcactactgttatgtggcgaactgttcagtggcaatggctggtaagtaaaaatacttttttactttatagacttttggtgatttttggtgcatgtgctaataaaagtgccaaaataagggttcaaatcctgtaaaatcccgaaaataaatgcaatttaggtaagcatattccaaacatgctcttcttatattttttttttactcgtcgcccaataaactgctgtataacaaaataagtcgggaccggcagtgccaaaaaaggcgctgccggaaaaaattttgaaaatttcggtttttttaataagatttacaaatttttgggccaggcaatgccggaaggcagcgccaggtgaattttaaaattcagctctattttcgaacgggttttaacaacaaaaatttttgaatttccgataatttttgttattcttcgatatttggtcaaaaatattttgaaagatattaaattttcatgatttcgtcaaagaaaattgaattttttaatttcaacgaaaagaaaattttaaaaaaaaaatttgggttaatttgttaacatattatgccaaggatgatcgtttttatgggcatttttgtttaacattactttatttaataaaaatttggcaaaatgtttaaaaaattcaaattttttataaattttttttgccttttctccaacgaaaatgccattcttaggagtgtatatttaacccggccccaagtttgagttaaaatcggggtcggggtttgtcggggtcggaagcgtcggggtcgggattaacccgaaaaatggccaaaaaagttggagttcggggttggggaggggtcggggcccaacttatgactcgaaaattcttttttcacctaggttaaaacaaattgtcaaaaaaattataattttccagcaattattttctgtttctttgttggcaatgcgtcccggacattgacacaaaatcggaaatctgaacaccccagcgaaaatcagacaatttcgccctcaagaaaacaatcaactaaatttcaaaaaaaaaatttattgtaatacctatgaagtgagaactcactggagttcaaattttttacaaagtggggatgtacgacaaaaattctgatgaatttcatttttggtgcatgtactaataaaaagtgcaaaatgccaaaataggtttcttaatcctgtaaaatcccgaaaataaattttcaaaatgccaaaataggtttcttaatcctgtaaaatcccgaaaataaatttgcaaaatgccaaaataggtttcttaatcctataaaatcacgaaaataaatttgcaaaatgccaaaataggtttctacataatatttagggagtaagcaatcattggagttcaaatttttgacaaaatggggatgtacggacaaaaaactgaatgaatttcgcatggacaatccccgacaatttgtcgacgaaaggaaagcaaacaaatcatcaacaaacaatgttatcacaat

SEQ ID NO: 17860 - DNA, 1468 bp, Heterodera glycines
attcggaaatttgtcggctaagtcaaacaaaaagtgcttgaaaagactaacagagacttaaacatcacaataatgggctttaactggtcaaactccgttttccatttccaatttcagtggcagtgagtgttacgccacggccgcgagttttcccaatcccttcaccacgtgttttgttgcattattgttattattttgacattttataataaaaatgataagaaatgatgagaacacgaatttggggaacgaatgaaacaacgcaaataaacaaagaaagcagcgatcaaactcaagaatcatttaaaccagcaacattttaataaatttaataatttttgtttttaaattattctaattttctctttgggaatcgcgttttgtttgggagcatccttcaaaataaattggaaggaagctaatgataagcataacggtcaattcgctgcttagagttcgcttcggcaactttttgacgccgggaaaaggccaaccagcgaatactttgggaggagagcagcggacggattattcgccatggcaatgcgattagccgtgcctttcttctccacttcgccctttttcactcttttttattgcggcagataattatttgttttaagagaacaaaattgaaccaatttgcaataatgttaacatccattggaaagagaacaaaaggattttttttctgcatttaatgcgttttcggtttggcaatttgctaccgtatatcacaattattttccgctaccgtattaaaattcaaattgcgacagatcggccctttgttctgttagttgttcagctgctggtgtttttgtgccaaccaatggtgcgtactcttcagacagttcagcactccctgaacaatgaatgccgttcgtttgttgtgcttttgtccgtccctcccccctatttttaaatcaaaatcctaataaaaatttcgttgaatttcttcgcctcttatttatgcaaaattttcgaaaaagtaatcctcctatttaaaattaaaatattcagaagcaaattcaagatttttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaagaaatattcgatgctgtgcgaactctttgtgacccctctctgactctgccaatgcagcagttgaccatttttaccactatttttctctcactcatcgtctgctcgtctctcctttattataagctatttttccaaagccaacaacgcccttttctcccctctttt

SEQ ID NO: 17861 - DNA, 2120 bp, Heterodera glycines
gtccttttcccgacttactctgtcccctcggatttcatcccccccccctcccttttcgtcgtccttttcccgacttactctgtcccctcggatttcatccccccccctcccttttcgtcgtccttttcccgacttactctgtcccctcggatttcatcccccccccctcccttttcgtcgtccttttcccgacttactctgtcccctcggatttcgtctccgtgtccccaatggcaaaccttcataatatttaacaagagtaaaactactcaaatggacatataaccatttcaatgcgcttctgttttttattgtggctgagagtcggagaaaaaagcgcacttcgacacgccaattggcatgagagactgactttgtccatctcgcaacagacgcggcctgcccgcgagttcagctcggtcaaattagtcctcgtcagaatgactgaaaaggtggtgaaatacggcaaaggaaaagcacgacaaaacccttactgaaatccaagcactttaacaggtcgaaatagtcagtggaattgcagcggggcacctgaattctctgaagaagtgccctctccactcgatgaacacaatctgtgggcacggcacattcagtcaacgctaaaagtgcaggaagacaaaatgaaaacaaaatgggcaaaatggaggcaaaaaaaaaagtgaaaatcgaaacgtaaaatagaaacaaagaaaagtgcaaagtttccgcctaattagagaaggcaattttcaaaaagaattcatcgaagcacgcacaattctcttcagtttctattcgaactgacctttgcgaacgatgaaataaaagtgatcacttcgaattttttgctgtctctgagggctttcgtcacaattggcgcaaagggaaaagaacaaaaacaaaaggcaacttctgatcagtacaaaagaaggacaatgagccgattgggaagggggggaggggaaggcattgccgaacagaaaaaggagaagcatcacttaatttgggatcagtgaacagcgaatggacgcaaaagccgacacgaaaatcaaagccaacggacgccatcccccgggggaaattggaaaaaaaacaaattgttcatccatttacgagcagcgaatgagcgaagacagcagaataatttggctataaatggaaaaataagggaagggagagagaatgcaaattgagaaatggaggaggaaaaagccattgcaaatttatgtttaagccaaaaagcattgacgaaggaagaagggtaaaaagagaagaatttggttactaaaatggaaaaaattttatcggaaatcaaaaacagaaatttttttttaaaagttgggaattggcaagcaaaaggcaaagtcagctcagtgtctgcagtccctttcctccaggggaaattgcagctccatgttcacgatgccaacttcgaaccaatcggacaaagtgccattgttgtaataggaagaaggaaggcgccacaaagtgcgcctctgacagggcttatgttcgtccatacagtcgtggtaaattttgaggactgccttaatgtcgcgaagagaaattacgcaggtgcttttgctttctctctccatccctttatatcctcttcccactcttccctcatctttccctcttcttcctttttcctctttctctcatcttttactctttccttttttcatttttctctcctcctctttcctctttccccatcttttactctttcctctttccactcttattcctttttcctcttcccactcttccctcatctttccctcttcttcctttttcctctttctctcatcttttgctctttcctcttccctcattttttcctcttcttcctttttcctctttctctcattttttcctctttccctcatcttttactctttcctcctcctcttttttcatctttctctcttctcctctttgcctcatcttctcctctttccactcttcttcctttttcctctttctctcatcttttactctttcctcctcctttctttttcctctttctctcttctttttccactttccttcccttcttttccctcttcttccttttcttttctttcttctcccacttaccctcatgtctcccgctt

SEQ ID NO: 17862 - DNA, 2495 bp, Heterodera glycines
cgaagcgggtcagttccgtctggccagttccgtcttattacaaaagggccggttccgtctcaaatatttttggacacaaattttttaaatttcagaatgtgaatagaagttgagaaataattaatagggctaatatttttaaatgctaaaaactgccaagatagttaggttttagggatacttgtgcagcagggatgggccaaattgaaaaataaaaagcgaaatccgaaaagcgaaatttgcgaaatgaaaaaaaaagcgaaatgcgaaaagccaaaatatgcgaaaatgcgaaaagcgaaattttttctacaactttttaatagttaaaatcataaagcaaaaatcattttttaaaattttattccaaatttaaaaatcaataaaacgcttttttgaggcgcgctttttccaaaaaaactttttgggaagagggggcaggcgccgccgggaaaatttttgaaaatttgattaaaatttgttgacagattttcaccaaaaaatcatcaaattttgtgatttttgtatcatttttctaatgagaaataagagttttggcgcgccgctgagaacagtttttcagcaaattaccaaattttgcgattttgggccattttctaagaaaaaataggagttttgggggcgcggcggtgccgataggcgccgccggggaaaaaaattggaaattttgatcacttataaacagtttttcactgaaaattagccaatttataggtaaaattttgaaaaattttatgggaatttaatccaattcttaggggtgtaaaagtcgcttttcgcgccaaaaagcgaaatgcgaaacgccaaaaaatgcgaataatgcgaaaggcgaaatgcgaaaagcgaaacctcggcccatccctggactgaaccgtccattgccgtaaaacgcataaaatgcaacaaaatagatatcaatcgcttcctctcggcatgtaaaggatgaatccgaaagaatttttaatccaaaaggaaattgacaaaagttatgggtcctcaaaactcagagatcgggccggtcggttttttttcgggttttttcggtatttttcggtttcggtttttaaccgaaaaaaccgaccgagaaatttttgagtttttcggtttttttcggtttcggtttttttcggtttttataccgaaaccgaccgaccgaaatatcaaaaaaccgaaaaaaccgaccgacttttttcaaaaaccgaaaaaaccgaatcaaattggagcgatataacctgttaataataataaatttattgcttttttgtgctctttttcattttgaagaattttttgtaaaatgttttctgctattttgaaaaaaattattaacaaaaatgcaataaaaacgaaaaatacaccccttagaaatggaaaatttttatcaaaaattcatattcaaaattgatttatttatttacttgactacatttttgatttttaaaatatttatctcatttccatttttagcacctattttgggggtttataatagggttgctccccgaccccgagcccctacctccgactttttatcccccgaccccccgacactaactcggggaattggggactcttgaaaatttttaaatttgtacaattttcttaataaagttaattaaaaattcctaaaattccgaaaaactttcggcggcgcctatcggaaccgccggcctcccaaaactccaaaatttttttgccccccccccaggggtcggggagaaaccctagtttttaagaatgttgaagatgtgaaataagttttgagctagtgaatttgtatcatatttggtttatgcattaattaatcggttagccgacttttgcgccgcgccatttgattttaatggttaaaaaattgaatgtcaatctttttgactagtaattttttcgaattttcaattagttatttttgtcgatggcttatagttttagtaaaagttattgataatagtggaatttttatgaatataatatttttgacagcgcggcgcaaaagtcaatttttgctgggcggcgcaaatgtcgcggcgcaaatggagcggcgcaaatatccgcggcgcaactgtctgcggcgcaaatggcgcggcgcaagtatcgactttgctgagcggcgcaagtgtccacttttgctgtgcggcgcaaatggcgcggcgcaaatgtctcatcacgctaaacattttttgacctcaccaataattcctttgctggctctggatagactcattttgttttctgaaagatatgaattaataaattaatttagtttcttcttttacagcttaagtccccatattttctttttcacctttccaaataacaccgccaaattactaagctttcgggatcatttatcaagatccggcaagcaacggttttcccaccccatttcgacatcggccccaaattccacccacatccacaacatttgggctgaacattcctccaaccccccagaaaaaatggcgccactgata

SEQ ID NO: 17863 - DNA, 1353 bp, Heterodera glycines
ttattattattacagtcatttttcgccaaatgttctgccagcaaaccatcatacacgaaaattccttcgttgcagtgatccaaatcccagttcgtcgtcaattggaaaacgtccacgcaccgggttcaatccgacacttgtgtggtgctcttcaatgtcaattgcatgtgcacgattggcagtttgcgaaacacggcgaaaacgctcatacgccgaggcagagtgcgaacgaacttaaataaggaatcatcatcattacagataataataataaaaaatttttttgtaccacgtgtgaccatcagagcagacaaaaaacaaaaacaaaagaacgcaatgacaatgagtccaatcaaaatcagcatattaaaaaacaaaataattataatccgaataaaacaatttaaattaacagcacaaataaaaaatgtattagaatatatatttttttttgcttttgattacgctcggaaaagcccgacggggattaaattaatggcgaaaaaatatatcataatatttttttgttttttgattacgatcggaaaagtccgaggcattaaattatttgcgatgggaaaaacagttagcgcttgaaagctttttcgatctttgtcctttggcggcggcggaagggggggggggtattttgtgggtaacggtaaaaacaagtcgaatttgactgcactattaaactttttgtcaaaaagcgaggggataaacaacatttaagggaatgccagacttaaagaaaaaaaaattttaattggtggctataaagtgccacttttcgctgtcttccatccattgctttaccattgttccgcctggtgacactcgcatgaccaatcggttccaacggcgtctaactgttaacgatcaattggaaactgagcggaaacggcgtcggctgagtgttgttggtgtgccggtggagaacgaagcgctagaattgacattcatctgaagcggaggccttttattatttaaatggtcaattaacagaatttggcatttttcgacaaaagtgccatttgcattaattaataacattttcattttgtttattatcagacatttcgctgttttcacctctaatgctatcatcagcaacaaatcatcaaattcaatgcacaaaagtgttttcttcgccttttcctttttccaaattcgacgaatgaaagtccaatgccaacacattcaatccatcggcaaattgaatattttcgtcctctccacgacagagggacaacggacggcgggggagagaatggaccaaattgccgggcaaagggaggaaggacaaacgattgaaagtgcgagaagagagcactaaacgtagaggacggaagc

SEQ ID NO: 17864 - DNA, 1632 bp, Heterodera glycines
tgaactaatcagttaacaagcagaaatatgcaaaggaactctcaccctgctcccaattggcgggctcaacttgctgactttcgcattggcaaatgaatgaatcgcttccttcaggcacacaaatgcctttttccacatgccttccgggcattttcttcatggcaaacattcgtccatttttcacgtacttccaatgaacgggcacttggattaagtggttgtgttgatctgatcagaagagagtaattcattgtaattaataccaagcacctccgtcatgaattgttctaatctctcctccaaaatggtcaagtcttggctaattatttccattccatcggtggcaatcctcgctgacagccaacgaatgaaaagtccgaccagcagaatgaagaaggtcaggaaaagcggagagatcaccgaaaatgacgaaggaaagaaatgaaaagagggcggactgaaacggggtacggtagagaaacagttagggaagagacagcaacatactgtaggagcaaacttgcttaaggtgactcgtttggcacattcgttcccatcttcgtcctcgatttgacactttgccaatgccaatggcacccgtcccttcgtccaaatcagttccaaatgccaccattctttggcattttgagagggtaaaggcatgaaatgcaaataacagaacacaccgagcacatccgaaacgccgaattgctccgggtccggcattctataacaaaattttaagcgaaaagtaaaaaaatagaaaacaggaaacaggaaacctaattcccaactgttccggcggtacgctgaaaaagtgggcgaagcaagcccgacttttttgatatattccatggtgaattctaaataacaaaatgtgtctaggcaagaaaatgccaaagcttgggtagaaacaaccaggctaaaaacttttgaggaattctccgagattttccaacccggccattttttggactaattttggggcagttgcattaaatcaaaccatttctgattgatcattacaaatcctattatttgagcatttttggaaaatccaccctgtcgatgggtttgtttctacctcgtaaaaacccaaaaaaaaaacaaacggtaccagtgacgggcaatgtcagcacagtgtccggctgctcatagaccaggtcgtcgagtatttcctcaattgggtaggccaattttcatagcctttccgctttgttgacaaatgcgtcgggttcgtcaagctgactcagatcagcaatcttaagggaatgcaaaagttggagaatggaaatcataatccgtttggaccttgttttttcgacttcttttcgggtagcgaattcaggctccaaaatattcggattcgcccctccatatttttacgggggtttattaattaattgctttaattaccattggacaccacttgttctccgcgttttgtggtgaattctgtccgttcccgcgcttccattcgcttcccaacggccctccaaaaatttgcgctttttttgttgttgttgcgctttccaaaaattatttggttaatatgtatttaccctgaaaaataaataaataaatgactatagaaggattaaaaaaacaaaaaacaaaattataatacataaa

SEQ ID NO: 17865 - DNA, 1745 bp, Heterodera glycines
atttgacaattttgaacaaaaatggtcttacatttatgatggaactcaaaaacaacaagctgaccgggtgcgcaaaggtgagatgagaatttgggagagggacaaaaatttagccaaatttttgaaatttgtgaaaatatggggacagaagggaaaatttaacaaaaatcttgaaatttaatgaaaatatgggcatgaaaattagccaaattttttgaaatttgtgaaaaatatgggcacacacccatatacggtaaccacttcaaacgtgcacaggcattacggtagtagtacagtagaaaaacggaaaatttagtaaattaatgctcagaagggggtttaagtttattaattagacaatttttattttttatttttaagatataaaacatcttttctgtttacatagaaatttctatacaaaaaaatatatggcagttctaaagagcaaaaaagcgggattttacaaaaagaaatttttttaaatttttgcataactttttttttgttgtcctataaaatgatttgaaaatatgcattgaaataaaaaaaagatgcccgaagaacaatttatatgtttataaaaaaaacagttccaccaaaaataacgtatgaccctacgtactgtaccttacagaatcgggtttaaaaattagggtgtggaaaaattgaaatttccatgaaaatccatggcatattttaaacacacaaattccacgtttagttggaggccatcctgctgcatttgagggtcgcccagcacaaaattggctgcttcagcataccgatttgagaggagctttgtttattacaaaaaaacagtacaaaaaagaataccgtatgccacccagctgataatacagtatggaatccaaaatacaaatagcactcttaacgtattgattcttctgtgatctttttaagcccccatcaattcgacatatgacgtcattgtacaaattcctcccccctctaattaattgttcaattattctaccatcttatgcagagcagtgctcgtaagtgtgctcattttttgagtgtgaaaaagccaaaagtgctgatttttgaggtttcgacataattttttgcaacaaatctcattacaaaaattttctttttttgcggcaatgccaatgggcgccaccgaatgccatagccaaaaatcccaaatttggctagagttgaagaaaatctattatttaatttcaattaattttttaaaaaaattcccaggcggcgcctataggcggcgacgcctccttttttccttaaattttttgttttactagcacgccaaaaaaggggcatgaaaagaaaaataaattagccaattattttttaagcaattttaaaattaaaaaaaaacacagaattttgtcttattaaattccaaatccgtttgttctgggttttgaaaaatttacttatgagctttgctctttttctcattgtatgccatcaaaatttacattttcatttttttctcatttgtgtgctgctcaatattcccgaaataaagagagaaagagttgatgtcaagaccaattgagagattcgaagcccacgtttggtcgagagaaagaaaaatggcgaagaataaaaaaaacatgctcataccttttaccgtattccctgaaataaagcccccggggcgctttatttttcatcccccccccctcaaaaggggagggggggggctttatttgagggggagggacactaattcaggggatcgtatgata

SEQ ID NO: 17866 - DNA, 1051 bp, Heterodera glycines
aaaaattggtccccactttttcgcggcatttttcttttgcattttggcacttttttccaattttttgctcaaattctccccgaaaatgtgtaatttccgcattttctccccgattattaattgcataatccattagttccgcctcattaagcaactcaataaaatagccttcgtcggcattttcgccttttttacccaggcgtttccaaatggcattcagctttttgatggccttaattaggcttataaataatccccctccatttacaaatgatggtttcaatgctggcactgtttgtttggacacttccgagcatttggcttaataaatttaaaattttaagcaattaaaaaataattaatggaaaatagccatgtttaatacaattttttttataagaatgaacgctcctaaatagctttttaaattttttaatttgcaaataaaatttttatatttaaaataaaaaccaaaaaataaaaaaataataattttagaaaacgttcattgcgaaaaaaattttaaatttataaaaaaaattattataattttcaaaacaaaaattttgcttaatgaacaagtactaaagaaaaaggtcaggttttgttacttaaagtcgtcaaaatatttttattttatgaattatggtcataattaaaaaatttttaatttttgattaatttactttgaaattgtatcgatgtcaaaaaactaagaatcaattttaagcttacggtatatttttgccaggaaaatttttaaaaatctgcacttttctgagattttttcaattaaatttttttcgattttaccgaaataaattcgaaatatttttgccattttttgtttataaaaaatgctattaatgagttttgcaaattggccccaaaacaaaatgaccaactttcaaaatagagccggaataaatattcgtacaaaatgtccaaatatttgcggtattttttgcaaatttcttcgtcaaattccttcccaattttggcacatttccatttccttctcagcctcatcaaacacacaatgccaagatgg

SEQ ID NO: 17867 - DNA, 3640 bp, Heterodera glycines
  misc_feature (14)..(14): n is a, c, g, or t
  misc_feature (28)..(28): n is a, c, g, or t
tctagagtcaatantgggcatacctcantttcgttgtaataatgtaaccttaataattttttctttgtctttttaatagaatgttacaataaaataattattctttgtcttttttttaaatgattgccttaagccaaaccaatgggcgcaagtgagcacaatttttatggaaggatgtactgtctttttcccctttccaatctttgttcttcattttcccatcatggcctccagctatgctggaaaggggtcatacgaggcaaaatttattaattatatatttgaaaaaaacggggaatctatggtttgataatttggaagtcggggtaaatttttaataatagccttacacaaaatttatcattttatgttaaaaaaaattctttcattcattcggtttatatttttgctcaacacaaatttctggcaattttttcatttttcacttcgttagctcattcctctcgtctctcttttttaggtaatgaactcttgtgatttattaaatttaaaaaaaacaattaacacatccgctcatgtcacttctgctgaccttcatccgccctctcctccctctcccccccctcctctctctctctctctctctcccgcccactctatacccccggtaatcacttcataaattatttagaatcttttccccgcatccgtttatttgagctgcttcttcaaatggttcttcccatcctttgccgtcattttgttgtgccttcattgaagaagagctctcaacacgaatttctaaacagctgattgcgttttttaagttcccattaaattcatttaataaattaaatgaccaataaaaggcaaaaaaaaaacagtgccgagaaaagcaaagggtcgttaatcagagaaatttccttcaaaaaaaacattggaggagaaaaaggaattttttcctttcggatgactccgaattttcttttgctttttgaggatttttaaggaaccctctttttcaacgaatttgtttagaaaactcgaaaatgacaacactaatttaaaaaaatattgcatgattttgccgaaaatgataactaattaccttgaccatatgtcaaatattcgctaatagcaattatctttttttaaataaaagttgcctttatgtaaaaaagtttaaagtgacactccaataaaactttcttaatttcacagaatttatatttatgcaaatttaattttgaatattgtttatcggctacaaaagtgacagtgaaaaaatcggttcccataagtaagaaaatttacaattaaaaacctaatttaaaaaagagcaaatggttaattgaagggatggatacggtaatgaacaaaatggatactgtaatgagcataacggtaaattgacgagatggggtgattatataattgtgattattaaatggtgaagatgctcaacatatgaaatttgggacgtaacaaaaataaataacaagttaattagaattaaaacgtaatgcaagtgcatttgatacggtaaatgatactgtttcccattttatctatttaaataaaataaaatatttaaagttgagcaccatcacattgaattgcttgaatagcaattaaataatacattaaatcaaatcagtgcggaatgagttggtgtgaaacttattgtttatgtttactatgtgatcgtgagaatgagaaaagtgaatgaaagtcaacgtataatggcaatctgatcactcaaaatggtaagctaaatctaatcagtggaagaatttaatttgggagataaattttagctaatcattgatcagggataaattcaaatggttatttaaagttatcaagagtttgtgaaatttaaacggtaacttaaagtcattaagagataatggtatccaatttgtttctaatgatcaaatttgtaagcgaactatttaattgtttgaattgatgagcattgatcagtaaatctatcagagtgatcaattgagaaagatctaatcgaggcttttaaaccaaaagaaataatgaaagatcagtaaaaaatcactataaatcagcaaaagaatagatcattttgttggagcaacggcgttggtggtggcctaggctaaaagaatgtaggcaattttgtgtaaaaaaaaagtgacacagatcacaaataataataataattcattaattaaaaaatgaaaaaaaatcaatcaaaatttatggtgataaaccattggcatttttgtgaattggaaatgggcacaaacaaacaaacaaaaaaatttacgacacgggtttaaataagattttgaaaaaaaattaatgagagagattttggaattgagaatggaaaaaagcattcatcaacaaattgctaaagagaatttaattattggctgaatgtgtgagaaacgaaaaaaaaagtgatgaaaaatgccaccaaagccttaaaaatttttgggttttaaaagagaatttgtgtcctatagttgtaaaaagcgggaaattattttcttaatttaaatatttcagaaaatcggaatggaaaatcggctaattcaataatttagggtagcttttgagagttaaccggccttccctttcttgaaaaattaaaaaaattttcaattttttgaaatccattttttgaaagctttggcaaacagccagaaaaatatatgtcatggcatgacagagcaaaaatgagagagctgattaatgagatgatatcattttttaattaattacaggcggcgaagaacaaagacgtgccttttgagcactcactagcggttgtgtttttgcttttttgggatacattgtgtacgcgagaagcacaatcctacccgaaatacatgaatgattgaaaacacatacaaaacatatgtaaagcaaagaaaaaaaagtgatcagagaatttttttgggggggggcgatcagtagcaaaagacacagatcagtagagaaaagatcgcgatcaaacggcggatgtgatcggaaagccagcgcggagcaaacagatcaagaaaaatggtcacatcagcagagatggggagggaaaagaaacaaagacgaggttagagcatgcagagagcagcagattgatcacacactgaataatataatatgaatggatttgtgtttggggatgggatggtccagcgtagtacagatcacaagcattgtgagaatggataaaaatggatccaaaaacggtatcattgtgcccacaaaggcaatgaatggcatttgccaagccttggaataaggcaggaattttaaaaaaaatttgtcggtatggaaattttccagaacttagtttttaagtggagtctctctagcgattatatgtaattaagctcaatgccatccatgcctttgggctgtttttcgtgtgcacaaaattgagttaatcaccagggaagaaaagacacgtgattaataggcatatcaactaatgcaaatatgatttttgtcggcactttatccgtttttggtgatgttaaattgaagccacaagcattggcactttaattgttgttgcactttcggatggcgttcaatgccgcgtcgttgtgcgctacctgtttggtggggccactgccatggcaaacctgcaaaaataatggttgtttgtttatgaaaactcattaagtaccaactg

SEQ ID NO: 17868 - DNA, 2152 bp, Heterodera glycines
ttttctgtgaaaatgccgaaatatggatgtaaaatatggaaataaaaatgcatcctagagaagcatcaaaccaagctaaaactactttttacgctatttttaggccgaaatgagtgtgcaaaaaaaatatggaaatccatacaaatccggtccctagtgatcaagacatactacggtacatatttttttttaagatttattttttagtaaatggctaattaataattaccgtaggataaaaattcggtgatattcaccgaagaaattgttggatgaatcattcacaccaaatttaattatccgaccgacgttaccaagaaagttgccaatgttcagctccgcttccagcggtggcaacaccgtgcccagccagttgagcagttcggcaagcacctcgtcaaatttgccgctttggatcaacgcctcctccaggctgcgctggcgtcgcagtgccgcgcgcgataacgcctcccagcaccgcgtcatctcctcattcgcttcgtccaactgcaacttctcgctgggtggcgcgtgctctgccagtgcactgccacggcggcgaacctcgtcgtagacgcccgtcttgcgctgaagcgcgtccgcaagcgtgcgatgctcggtgagcgcttcacggatgcgctcacccgttccggtgctgctcggctcagccgcctcgcggtcgcgcaaccatcgctgctgatcctctgtccagtggagcaggtcgcggcgcgagtcgaagaacagccgggactcgtccagtgccatggtcagcgacttcagccgctcgccgcttcgttggccgagcttgtccatgcggtgcttcatcgacacaagacggttcttcatcggaatggcgtctttcttctcgcagctgagctggatgcgaatgcccttgttgctcagctccttcatctgctcaacgcgttcgcccagttcggcatggaacgcctggtggtgttgcagctgtgcgctgagtggctcgaccagcttggactgttgcggcaccatggccaaatgctcttccgccccgtacagccagtcttgaactccttgcatgccatgcgaaaagttgcaaagcatcctccaacgcctggcgcaaccgtgcctcgcgctcgaccagtttttgttgcgcagttgtccaatccgtgcgcagcttgcgctgctgtccggcgagcccattggtcagcaccaccgctggcacccgtagcggaaccgccagcgcctgctccgtcggctgcagctgcggccaattgttcgtctagccggcttaagcattcctccagctccgcccgtcgctgctccacgtccgcttggaccacgcggaactcgtccatttgtgccatcgccgtctccggcagtccgccaatgggccgattggtgcgcagctcggccaacaggtcggtcagccacaccgcccacttgttcaggtcgtcgctgcgcgagttggcctccgcgcgtgcacgctccaactccacccaggcctgctccgcctggtggccaacagaggcccagcgctgggccagctgatcaagcatggactgagtggcaacagcacactgcgggtcttgttgcatcatcttttgtccagtggccttgtcagggaagggagggaggaaatgatcaaatgattgaaagctgatctgattcagaccaataggccaaaatttaaaaaaattttaccgattttttcaaaattttatgatcaatcaccaagtttttcaaaaaaaatttccaattttttgaaatttgttcataaatttttttaaggcttttccctctgatcaccagtctgatcaactcattaagcttgtacttaagcctcacttggatggcttcaaagcttggctggtgtgcagcgatgtcgttttggatcatgcgcagcttgcactgctcgatctccacgtgcttcaaaccaccatccgatgttgtgtccagcgtggccaacaactgttcagttttggccaaccatgccatcatttgatcgttggcatgtgccaactgttcccatgtcctatcagggatcgttccaagtgttgttgagtgtcttcggagttgggcataaagctgtgcccatcgttgcttcaggtcagcagtgccacacggatgggactgagcttgggctatgagtgccgggcatggcacacagttcggc

SEQ ID NO: 17869 - DNA, 2230 bp, Heterodera glycines
gaaatttttcgcaattctttaagctaatagaggacgcttagggcattcgaatgataacaagaaagttggatttggttgaaatgaaaaaagttatagttcaagaactcggttggcgcgaaaacgacaccgtattttgcatataaacataaaaaatttttattttatgcataaaattgaaaattttggcattatgtcagaaataatcgctttgcactttttgaaagtatcaaaacatccaaaatttttctgaattaactcgggttggccaaactcaatttccaactacaggcaaactaatgaaaatttatttatttatagtagggttcctccccgaccccgagctccccggtccccgaccccgatcaccgacatttttgggcctattcccccccccaacccccgacatgtgccccccggcggtccccggcccccgacattttgtttcccggacccccgacccataatcggggaatcaaggaccccgagcgttgtaaaaatttaaaagttatttcaacaaaatatttaaatttacccaaacactaagcaaaaataaaaatttttaatatttttttaaattaatagaaattttcaaatttaacttgcacatttttcaattttccatgtgatttaatagattttcatccaattaattaccttctaatggcttcaaaagcatctgatatttggaattttttcactaaaatttcttcagaggttgccggatgtcgcaaattacaaaatcacccgcactcttaaggttttctatattcggtcttgggttaccttttttcgtacaagtaaaggcatgtccttgctccgcggctatcaagaaaagacaaattccaagcaaaaaaactcataatggtttttataaattaatgttttcacaattcttcttttaaattaaggcctgcccgacccggtggaattcgacctttgaatgatgatggcatttcgtgaaaaaaaacgttcttttaaccattgaaggagaaagacgtggattcggtgttggcccatcaaaaaagtcgcgcctcgacattgtcccagaaaatttgccaaatttggaaattaccgactttgattttttgcgtgaactgtgccctttattgggaatttttcatcgagagactttaaaggcaagtgaaatatgtaaaaactaaaaataattgtgaataatttcagttttctaatgaaaaatcgtcagcatcaactgttatttcaaccataaaaagattgcgtgattttttgcaagaaaaatctttctcaaatcgcattttgggcgttgctggagtcatagtggagtctttaaatgaacgaattcgtgaaatttgcagcaaccctctgttgcgagtagcaatgctacttgatcctcgatttgcttacacagaacttttttctcagcaaaattggagggttgttgaacagcaattagttgaatttgaaaaagaaagttcgttgaattattatgaattttaggtcattaaaataatatgaattttttatcccttaagaattggtctgcccgacaacagaaatggatgctaattttgatgttgacgactttggttgagttgggtcaggaattgatccgacctttgcttaccgtgtggtatttctattccttcaaccatttctggagatcctgactctgattttttatcaaaaattgaagctgaacttgcttgctttaaggcaggccaaaggttggaagtgaacggagacttattttcttggtggcatgaaaacgatggtcatcttcccgagttgtcaaaacttgcaaggatggtccacagcattcatgctacatcagtcagctcggaaaggctgttctcaaaagctggacttatctttgccaattcacttcgaaataggtcaaaaatcaataaataagtttaatttatttgttaatttaaggctttccgcaatactgtttgacaaattttgattgtaaaggccaacttggacgcacttttactggcaccaacgaatgaattagaatcagatgatgaaagtaaagaaaaagacattttttgagttttgataactttatttaatagcattttaaaataaaaattggttttttcgttaaaaaatttagttgatcactacccgatctgggtccccgacccccgacaattgagctcctccccgccccgacatgtcgccccccgaagtccccggcccccgacattttgccccccgaggggtcggggaggaaccctaatttata

SEQ ID NO: 17870 - DNA, 3323 bp, Heterodera glycines
  misc_feature (3252)..(3252): n is a, c, g, or t
  misc_feature (3260)..(3260): n is a, c, g, or t
ttgtgggggaattaatgggataaaatggtatcatgggttggaccccgccccgtgggctgggtgatttaaaatcacacatatatgacatttatcctttttctttaacactatccttggccttattggttgtgctctggatttggctcttgggttcgggtcccctgcttatgggttaattaattggaattaaatcctctcataggtatggaccccggcccctgggatcaccctgggtggtctcgacattcaaaaacattggtaaaaaaagggtgattttttgggcggagggagggttttggacgcccgtaaacgtgtccttatactactctcgtccttcatttccatttagttcgggaagtttttccagagtgaggagaaattccaaagaacaaatttgtttttgttctttcttactttcgcatccaccattttgtaatgaaaccaaaaagttgcgattgtctttccaattttcctcggccgaaattttgtgttgacgaagaaattgcatgttgaaatgggattttcgtttcccggttttgaagtcagttttgtagacggagttaatttaccgaactgacaaattttcgtgatttgtttcacactttacggcttttccttttcgaagttgagtttttttgatatgcagagggatttagttttcccgttttactgatttcgtggccacaaccaatgaagaaacttcattagggatttgtttcccttttccagagaccaggatttgcttttcctgttacaaattgcagaagggtttacttttccttttaaaatcgttgctcgtccaaatttgtcgtttattgccactgctgagccacctttgtacaggagcgccacgtcgtaggaaaaagaatagtccaatgggaaaggggaattgtatcccaaatccaaaaccaaatcgccgtctcttttcactgctttcttttacttccaattaataaaacagcacacagcaatcaattacaaatttaggaagagcacatatatcacacataccccaaacaaaacaaaataaaataaagggtcacaaaaactaaaacaaaacgccaaaataattcaaatcaacaatgatatgacagttttcaataaatgataccgaatactaccagaaattaaatttatttgtttcagaaaaagtctaaaaattatttgtgagtaaatttgtttttaccgattgagccgagttttgttgcccactcatcaattagcttttcaatttgtgtttttacttttaaaattttttctttcttcttttgacttatttcaaacggagcgatgaattggataaactaattaaaaataagaattgaaataataattaatttggtttcttctttttctttttttacctcatttgatagtttaatttcactttcacgagtgaattgagttgttcggattaaatggtaatcaaaaaaatggtcatcattataaagaaaagcacctattttaattaaaacattttaaaaaataataattaaaagacatttaaccgattttctgttgtttttccatcttttcaatgttctccacggatttcaccaaattttccacacttttgaaaagggaattcagccgttccatgtttattatgtgtgaataataacgttgccaatttggtgcgcatttcgtttcatccgattcgtttgaagcggtaattttttgcacattttttgctaccaaaactgaaaatatgtgcgtgtgaagaatgtccaacatttggttgaattctgtgcttttgaatgacccaaattgggtggtaattagcccattagcttttttatcattttggggaattgacacggtttgtttggaagaatgtgttttaaattcggcactttctttttcaattttcatcagttcaatcgcctccaaatactcaattgttttaattaaactcctttcattttgctcactaaatttaatttgctctttattttcttaattaatttattaatagtttccagttatactacagaataagccgtaaaaccgaaattttttttagtttttattcaaaaaagaagaaattatttttttatatttaaaattcttgattaagttatattattttgaaaaaaagtacagatttttcaaaattttcgccactatttaggccaataaattggaatttcgctcctaaaaatcctcgtcctaattataatattccatagatattttttgatcatttaattataaatattatttaatgatcaaatttagatttttcttactcaagaacatatatatccaattcattgtgcacaaaatataatttctccatcaaaaattgcatcgtttcgaatttgtccaatttaatgccgacaaattccttccattttccattaaattttttccaattgtttttttctgcaatttcattttttgcacttttttcaataaatttgcgcttcgcttcaattgcctttccaagcagagaaatgtgcaaaaatggcacacattcggcgccaaatttgtcttcaaaataatttttatataaaatagtcaaaaaatggtcgtccattaaatctgaaagtgtgctaattatttaactcattagctttgttattttaccaatcagtttggaaattcccattttcttcagtgacacaatgcaagtgatgtcacgcgttctctccattaaattctttggcgaatttttgacattttctcttaatttttctccttttcttagtgtatcatttgtttcaagcgatttttttccattttctgaattattctcatttttaattgaattttcgctattatttttttgcttttccgacgaataatttttcttccgtttgccatttttctcttttccttttgactttttattctgacttttctgaatccaatgctcattttccctattcatttcttccatttcttcattaaattcaaaatgtccttcaatttctttctcctcctcttcttcttttacttctttttttggtattttctctttttcctcagatttttccgcctctttttcatctgattttatttcattcattttataattttggctttctttctcaattaattcttcaatttggtcttcatttgtatcgaaaaaaatttcagcggaattttcggactctgacggatttaaactttcatcggaagcagttacaaattcatgctaaaacaaattatttctagtcttgaaaatctttcatgaaaactcagttacattgcacaaaagctttttcattcttttcttttcgttgcttncccataanttttgcactttcttctaaaaattcataaaatcattattaaaatatagcgcacttacgagggaa

SEQ ID NO: 17871 - DNA, 2543 bp, Heterodera glycines
tcggttaaagtgattaatgtcgatttatcacttccgggtgcagtcttcggcatcattttattcaggttgccaattaactaaaatagtcttaaaaagtttttgaaagccgccccgccaacgaagacctgcaactgctgctcgcatttcgaaaaataagcactcaaagaagcgtctgtggtatcaatagataaactaaatacaaaaaaataaggaagataaagtatcataaggcaaacccgccaacgaagattttgtggttttttccattaacggaactgctgctgccaggggctacagacaattggacatcggttggctggttgccctcggatggaatttgtttagaagacatgttgttgttgtgggtgttgtccatcagactgtgctgccctcggatggaatagaaatataattttgctgtcaacgaaatattttgctaaacatataaaaaaatgtagcatcaacacaatgggatgtgcaatttcgctgcgcttatatagacttttggagagtagtgtaaagtgcagtgtagtgagtctctacactatagaacacaactacactctacactatagaacactctacactatagcacctgtaaaagtgacagcggatgtgcaatttcgctgcgcttatatagacttttggagagtagtgtagagtgtagtgtagtgagtctctacactatagaacacaactacactctacactatagaacactctacactatagcacctgtaaaagtgactgcggatgtgcaatttcgctgcgcttatatagacttttggagagtagtgtagagtgtagtgtagtgagtctctacactatagaacacacctacactctacactatagaacactctacactatagcacctgtaaaagtgactgcggatgtgcaatttcgctgcgcttatatagacttttggagagtagtgtagagtgtagtgtagtgagttaataatgaatttgtgttaaggtattcatagacggcggtgtacgcagtttcaacttttgtggttattataataaacaaaacgtaacaaaaatttatttgtgctgcacgaaaatcttcaaggacatcatcatagcatataataaaccggtaaaaaatttctcaaaatcaacgttaagatcataaaaaattctaactaaaattcatattgaaaatatatttcccactttcaagtacatctttcttcttgttcgtcccgcgcttttcatcttctttcttactaacctcctgcttaattcctttaaccttggattcaccacgactttgagtgtttttctaaattattcgtttattaacttagttcaaacagactaaagatttaattagtatttttttacatactcgagtgcgtttgttgccaagcttattttttggctgctgattctccatctgcttcacatcaacaactttcccatcaatggtatgaggtccacccgaaattattgcggcagtcttaggtataaagtagtttatctttataattcataaatacctgggtacacacgaaggtcacgaagccaaaacagcgcgaatgtttgttcttgacatgtcgtacaaccttgcaattttccaccttaccaaatttcgaaaaataagcactcaaagaagcgtctgtggtatcaatagataaactaaatacaaaaaaataaggaagataaagtatcataaggcaaacccgccaacgaagattttgtggtcttttccattaacggaactgctgctgccaggggctacagacaattggacatcggttggctggttgccctcggatggaatttgtttagaagacatgttgttgttgtgggtgttgtccatctgactgtgctgccctcggatggaatagaaatatgatttcgctgtcaacgaaatattttgctaaacatataaaaaaattagcacctgtaaaagtgactgcggatgtgcaatttcgctgtgcttatatagactttttgagagtagtgtagagtgtagtgtagtgagtctctacactatagaacacacctacactctacactatagaacactctacactatagcacttgtaaaagtgacagcggatgtgcaatttcgctgcgcttatatagacttttggagagtagtgtagagtgtagtgtagtgagtctctacactatagaacacacctacactctacactatagaacactctacactatagcacctgtaaaagtgactgcggatgtgcaatttcgctgcgcttatatagaattttggagagtagtgtagagtgtagtgtagtgagtctctacactatagaacacacctacactctacactatagaacactctacactatagcacttgtaaaagtgacagcggatgtgcaatttcgctgcgcttatatagacgtttggagagtagtgtagagtgtagtgtagtgagtctctacactatagaacacacctacactctacactatagaacactctacactatagcacttgtaaaagtgacagcggatgtgcaatttcgctgcgcttatatagacttttggagagtagtgtagagtg

SEQ ID NO: 17872 - DNA, 742 bp, Heterodera glycines
tagtagggctgggatttttatgttttaacatattttttttgcggcttagttatggcgagagaagcccaaaaatagcattttctccgaacaatttttgatttagagcgagttataaaaacataaaaacacatattttggcgttttggcacataaaaacatatgcacatatttcggggttttggcacatattttgcacatattttggcatttttgagaaaaatcgtaaaaaaaatacaagaaaatctgaaaatgcaccctaaaaattgactactttacgtttcttaagcatttagaaaatttctttatatatttaaatgcctaaagcagccaaatcaaacgctgtgttaaatcgtcactggatttcaaagttcccggaaggaacttattcaactgatggaaaaattaatccgggactttacaaattgattgatatcgccaaaattttgattggaggtcgggcgaaaattgataaagactgatattaaatatgattttttttgcgtaaatacacttggtttttccaatttttagcacatatttttgcattttttaacacatatttaggccttttttttggtttttagcacatattttgggtttttttagcacatattttattacatatttcaggatttttagcacataaaaatcccagccctatatatgacgcagtattattttacactagaaaactcgaaaagaaaatttttcaatttatttttcgccgggacaccaattctcc

SEQ ID NO: 17873 - DNA, 2835 bp, Heterodera glycines
ccctaaatgtttttattacttgagcatgctgttgcttgctaaaaaacttataggtaaaacttaagaatcttccgaggtctcgccgatcggtaaaattaagaattttccggtaccttcgatcgataaaagaatgtccagaggtaccttagatcagtaaaacttaagattttcccgtgtaccttcgttcaactctttgtatatttggttgtaggtactttcatattcggtctcgctgtgcttgtccgacagatgctgcttgagctgattgaggcttccatcagacaatggcaaagtgtctttgcattcattacattcaaccgattctttgtttatccgtttgaaaaggccaatttgccatattggatgatctatgtgattaaaaaaccggtcattataagagttttgagataatatcgcttggaggaacggttggtaacctaagaccttttaaaatttttctgataaaaaaagatttattttcctaatctctgaattcttttttatttttttactgtaagtgtcatggccaaattccggttgttgctgctgatgttgtgtttgttgtcgttggtgttgattttgtttttgcttgccggcctcctcctgtttttcagctaatttcttgaggcgtttgatgtgccattgttgtcgctcaatcaattcttttgatggtgaagtgcgccaatcgaaaaggccttggcctcgtgctaaaatcaagtccaaaaatgtttcaacaccatacagttgtcccttgaatgccctggcatctttggcttcaacccattccaaatttttgttcgtcttggcattggatttcacgtcgagttttcgaaaactaattattggcaaagggataaaaaatatgtatatgcttttgatggtaatatttaaaagttaattttaataataaaaactgattaaaaatttcaaatgttataaaattaagaaacatttttcgggttcacaggtgccggtaaacaccggcaaaaatctcacctaaacaaatcggcaaaacattgaggcataaccactgaataatgtggtctacttttcagattttcaagctttgtatctcttagataatggaaataacattcgtcaccactcgaaaaaagtggaaggaataaaaggaaaatcgtaaaaaaataataaaattgcaacatctttaaaatattattaaaaaataaaaacattggaaaataatatatttcttaattataaaatcaattttgcataattataaattgattaatgcaattttttgccagattgaaaatcaaacagcaatcaaaatttgaaaaaactaaatatgaaattggagtaaataaatttttaaaatattattttggtcgtccactaattttttgaaatattttgtttaacttcgatatagtttattcaaaatgtatgaaacttaatgttattttttgtttatgcgcatctaatgaatgaaattagaaaatttcgctgtatttattctaaaaaatagacaaataaatggcaaatttttttcatgtgaattaattaatcgtctgggtaagttaattaccacataattaataaaggtatcacgaagagattatgaaacgctctatttttccataatgtataaaaaaattttattattatttttgctatttaatattaaaaacagacaaatggcacgcgtttttcatgtgaattaattaatcgtctgggtaattctaggaataatttcataattataaaattattagaaaagtttatgaaaattgctccattcaggcaaatagcaagctttttttcatgtgaattaattaatggtctggcaaaatgaatattttaattaagaaaacgtatcatgaaaaaaatatgagaattggtccattttttataatgtataaaaaaatttttgttatgcacatttaatgaaaatcgtctgggtaaatatgaataatttcataattgacaaatttttaattttctttctatattattcgataatgcatataaaattaacaaaagccgaaaaaaaattcaaggttcatcacataattatgtcaaacacgggcaagaaaatcaatattttgtggattaaatttttcaacattgacacgcggtaattgcctgagtggtaattgcgtattaatacaagaattctacagtggtatctttgtgcttttggcggtggatcgtgttcagcaacgcacaaggccataaaggcgcctctcgtagtttccgttcattattcaacgtgtcaatgaaaagccatgtgaaaggatgggagcaggaaaagctctctttgcaaccgcctatgtgcagctttagcaaaatctgatgtactgggttccgaaaaattcacatttccgaaacttgacgtcattacccatatctttgctcaaaagcaatgaaatgtttacttcttgttatcattctcgttaaacctaagggttttatactagcctaacatcaaaaaatatagttaagtttgaacaaagtcattgtcaaaagtacacaagcaagcatgttttcaaatatctttggccttagcttttttgaatcttaaattagggaatattgaaattccatttttgcggtgctaacaacaaattagtttattgctctaaaaatataattgtttttacatatttatcatgtattgaatttcatagctttcatcctttctgctactttcagcttgttcggccattccttcctttatcaaatcaagatgccatttacagacagcttaaacaaaaaattttttctcaataataaataaaaaggcttaaacgctacaggattttttgctaattcaatttttttttttttttacaatttttttgaagacctgca

SEQ ID NO: 17874 - DNA, 2183 bp, Heterodera glycines
attttaaatgaccgatttttatcctcccgcttccctcgcctcgtcccatgttaatccctttttatacgcttcaaatttcaggtggcaatggtgaaatggaagcgatgttcagggttcttgccaaggtgtacccgcgaacttatttcattggcattggctttagtatgggtgccaatgtgctgaccaactgtttggcttctggacttgatccttctatttcttcgcgcattcttctcggcatttccgtttgccaaggctattgcgcttcggagtgctttgaatcgtttttttcacctttaattttcccttttagtgcttcttcccttttattcgattggcaaggcgggcgacgtttctacaattacatcatcactgaaagtgttaaacgattacttcggcggaattacgcaatggttgttcagccccatgtgaagtcgggattggtggatgaacgagtaagcaatcactcgggtggggtatgagatggattttactgtcctgaaaacttaaaaaatttttattttaaaaaatattttcaaacgtagaaagaaaaatattagaaaacttggtaatagtttggtttgttcccctattcttcaaaagaataacaattgtaaaactactttatatggggtttcgaggtcgctgatcacgaatctgatatccatttgaccaattcagaaggaaagtggatgaaattctaaattttttaacttaggaatatactcggggctaattttcgcatttgtatttgaaaaacctatttttatggaattgattttttatcattatcgataaaaaaagattccattttcatatcgagtgaccctgaaacctttgtgaaaatattctaacaaagggagaaaagataaaaaatttattcaaagtattaaaaaaataaatttttctgtaattaaattgattttatcttctttgaagatttaaaactacaaataaaatttattgttatgtgaatggttttaacgaattgtcttttaccaattattttgtttaaaaaacagctacagttatttatcttttcagaaactttggtcgtcgacttcgcttctttggcttgacgaattttacagtcgtcgggtgcacaactttgcttcagtttcggatttctattcccatataagctgccttccacgcattaaagacataaaaattcctatgattggtattaaaaatgaacaaaaaaaaacctaaatttttttattaaataaataaaattgtttcagattttcatcaacactttggacgaccccctcgtgcccgaagctctttgggaaccagttcggcagttgtgcgaaacgcacccgctccatgcgtttgttttgcttaaacatggcggacatttgggctttctcgagggcaattctctgaggcctcgctcgataacttggcttgaccgtttcatcctccaagtggctgcggcagttagtgaaaatgtgtgtttcattttgctatttggcaatgctaattgaaaaaaacgatttttatttactagttgaaaattggcgagatgagggcgagctgttcaaccttggccgatgtttttgatacggaagaagaagccgaagcatttgatgacgcctttaattagtgaagctttaattatccaaacacgtgacaattgctcattgaccttgtgaccaaatctcgattgtttatgttcgatagttagtgcaattaatacatttttgaatcatattcactgcattttttgttgcaaaattctttcatttgccgggttgtcataatagtctgattttttgataaaattatactgcttgatttttactttttgtgttttgtttttgtcaattacttttacaaaatccgttttttctaattttgctgttttattgtcaaatggatgattccactttgtcctcttcgtccgctcttccctttcattccccaattgaggcttcttcctcttcctctgccacttcgtccaatttcaactttctttgcattggtaatgaggcggagaagctcaaatggttggtgctgaaccacgtgaggccaaatgcgttaaagaaaatgttcgagccgttaatacaaaagaggcgacgggcggtgaatttggaggacgaattggtctgtgttcaagcgtgcatgctcctccaatcattggtcggtgatccacgatttgatgcgcaaaagcatcgttt

SEQ ID NO: 17875 - DNA, 2765 bp, Heterodera glycines
  misc_feature (5)..(5): n is a, c, g, or t
  misc_feature (18)..(18): n is a, c, g, or t
ttttntggaaaaatatgntagacgtgaaatgccccatcgttccacccttcaaaaaaactacttacggttaacttttgaccaggtcattccaaaaatgaatccaaaaacagtaattaattttagacaatggagaaaattaaaaacaatattggcgactcttacgtttggatttcggtggacgaaacaacagacaaaatgggaagagcgatggccaatttgctgattggaaaattggatggacaaaaatggcacaacccacatttgatttccgtcaaatgcttggagaaagttgatagcgcggcaattgctcggttcatcccgttcccgtttcccgtcttttttgcccggacgggatttttacgggaacgggaaaaagccgggaatcccgttcccgtttcccgtcccgtctttttgaattcccgttccccgtttcccgttcccgtcaatttttcttaaaaaacgggaataaaaatacactggtagaattgggttttcagatttaacttaggcattttgccaaacaaaatatttgtttttgagttagtcaacaacaactcaagaaacgtatgcactattcatatgcacactacatttttgcttctttttaaaaaatcaaaattaagctttaatttcttgtcaatggctccatatcatcctatttggaaaattggcctctttgaaaggagcaaggagaacgacaaaattgctgaatgtgtcgaatgtaaagcccaaaaacaacgcaaattccaattcaagctttccgatggcagtgtttcttctttgattggccatctcaaaagcgacaagcacaaaaattccgaatacaagaacaaatttgacgaaattatcaagacttaaacaagaactggcaaaaagactgaagtgatcgccggaaaaattgacaatttcgttctgcgtagtagtggtaaatgaatattatgccatagtatgttctttttttatttaggtatcatgactcgcctagacaaagctatcatcaacctaatctgttgcaacaatttgtcgtttaacttggtcaatagcccacagtttcgagtattgtgcaagccatggagtgaacagctaaaagatgaatcacattaccgcaaacttttgcctgttgcaagtgaactagtcaagggaaagattaaggaggaattacgaaaatgtgattcattttcgtgtacatcagacatttggagcgggccaaatcaaggatttataaggttagctgaattttaccattttcttttatcaaaagttaagtctgacaatcgagggagttacaaacaaatgggaacgtgtgagacatactctcgcaattaaaccctttcccggcactcacactggacgtcgcgttgcagaaattttgtccgaaattattgaccaatgggaatgtcgagacaaaattcacacttttgctactgatggaggaacaaacatgaaaaaagttggttattagttatgggttgtaaatattcgttttttgcaggcatttgaggaaaaaaaacgaaaatggtcgaattttgcctttttatcgatcaaactgtgcggcgcatttattggaccgtgctatcaaaaatagttttggcaatcgagagggagaaatatcgggacttttttgtatgaaaacgacaatttctttaaaatttttcttaataattaagcaaattgtcgtcggattgttggaagggttaagcactcgattaaagcatttacagaattgaacgaagcacaaattgaggagggacttccgcagcacaagctgcttcaggtaagctgaattccggaataaaaacaccagtttgctgtaaatttaggaaatggcagttcgatggaattcttctttgatcatgattaggcggctttctgagcaaagggctgctattgaccgaatcgcatttgaacagaggaaatttgaattgactttgcaagatggcgagtggcgactgcttaattcactggagatgctcttggcacctttggaagaagcatcactttatttttgcaaatcaccgctttcaactcaaataccattttcaagagcgttgctttcacaattaaagaatttggaccttcgggtgaatatgtgaaaaatggatatttacaagggaattactgaaattgaagaaaatgcgttcaaagcttttggctggacttgaggaaagattcggtccatttggagaaatgagaagtgtgtatatatttttaaattttcttttaaatttcttttttagattacgatgctctttcaacattcttggaccctcggtacaaatatttatttgcaaatgacgaatgaccgatttcaaattaaagtgtgtatattagggttctaaattatctaaaatgtgaataattaagggtgaaattttggctcgcggacgaacaactgagtagtaatggctctgagcctattacgatctgaacgatgttgaaaccgcgtcgctttttattgttcctcctcctcccgagcaacgacgtacgattacttgattccttgtcgagaaatggcctcgaaccgagcgaaatcttttggtaatttttaaaagatttcttttattgatgcgatgataaaatttaaagtgcgaaatcgaatcgacgtttgacgatgaattcgaaaaatattgttcggttgatttggttgggcgagaattggatcctttggactggtggaaaataaacgaaggtctgtttcccgttctcgccgcgcttgccaaacgttacattcggccccggcaacaacgattgaagcgagcaacttt

SEQ ID NO: 17876 - DNA, 2621 bp, Heterodera glycines
ccattttccgctcatttcccccaccatcgccaaaatgtgataatttgtgacgagtgatttgggggggggggaaggcgaagtaacaacttttgagtccatccgcgttcggtgatcaaccgcttctgggaaaatgactgactgattgctcactgatcaataatcattgaaatgggcacaatgaaaaaaaaaatgccgtcttttttattcgccaattttcgctccgttcttttcagctcgaacattcgctaaagaccatttctcacgcggtgcttctgctggtggacacggtgatgcgcgagcaggaggagcagcagcagagaaacgaactctgagaaaagaaaaaggggaagggacggagagggaaagaaaaagcaatgggaaaaactgatcggaggaggaaaaggaaaagcagtgccaaaagcaaaatgagggaaaagcaatgccaaaagcaactttcactccgtcttttgcttgtctcatcgtccaaatgccactaaaacttcaacagaacggcgtcactattcactcagctattgatctcatcaattctcgtctcaatacgccccaaaagttgtcaccacatgccatttaatttcctaattatttcataattaatacgcaaatttctcgtcacttccccttttcttttttgtgtcttccaatttctcaattggaattattttgattatttcttttgttgttcggagtgagagaggaggcaaatgccgcgtggccattaattcattctcattttgccgatttcatcgcgacaaattcatttagggatttcatttcctttacaatagaattttattgctgaattttgcatcatttgaacggtgtgctcaaattgtatttcatacaaataaacggaagaaagaaaaggaagggaagagaattatttgtgttaaacaaatgactgactgtttaaaaaatatatatatataataatattcattttaaggcgaggagaggcattttcaatgaattgtaatgaagcatttgggggggggggtggcaaaaaatagtataaaggacttttgtcaatttgaacaaaaaagcgtcggttggtcacaattcacaggggggcggaagtcggcacagttttttcttgtcgaagtgccgtcgacgggggtgaaaaagcgcgggcgaagaatgaaagaatgttggcgtgaaagaattcgattgattcgccgttgcgaatgccgtggcgctcattgggaaaaagcataagcctatgatattgtaaataaatgataatttctaacaaaatgggttgtctctctattcaccggtatggcttttgtgcggcaatcagtgccgacatcagtttggcacagtgggaaaagtgcacattttcgtcaatcattccgtgcacaatcatcagccgtccctctctgtacaaatcaatacaaaattaacacattaaaagggagaggggacggaaaacgtactcattgggcagacgggggacgaaggaggaaagtgccgacttctcataagcctcggcattttcgtcgggcattcccatgtacctgtaaaatgctgtccgtttttttattacccaatgacatttctctatgaattgggtttttgcttcgcctcccctccctttctgttttgcccaccgttcagtgtacgccgtgtcgtacaaatgccaatcgctgaccgctcctcccacacacgcgcatcgataggtgcccgggaaacaggccaacagcagcagagaggcgtacccaccgtaactccaacctgaaaggacaaaggcatgggttactgtgcgtctcatattttgccagttttgtccaccgaccgatcactgccaccctttccatgtccaacagatcgccaaatcgttcccccgccatgcgcatgccctcctgttggtcctcaatctctgcgctgcccatgcgatgtttgatggccgactcgaattgtaagccgcgatttgccgagccgcgtccatcgaccattagcacggcgtagccaaaggcgacgtacttcaaattatgacaaacactgaaaaggaccgcagtaattaattaattaccgttggtaaatgttcggtatttttatttacctgtaccaactgttgcgcacgagttggacgctcgggccggcataaaccgcgtgaatgactgggaatttagcggtcccattgcgatttgcaggcagtaaaagcaggccatggtgcgttttgccggaatttgctgatttgtattcgaaaaagatgggtttgacgatgtcggacgaggggcggaagagatagggcattccccagccgacggactgaatgccaaaggacggagacaccacttggacaccgattctgacaaggggaaaagcgtaaaaaggaacaaaatggggagcatggagaaacaaaacaattagtgcaaaagaaacgattagcaaatgagtgttatccattaagggtaattgttatggtaattaccgatgagtgaacaccgcccgaggcaatgggtcggcagaggcagcggaatggacgaaacggtagagacggcactcgggcaaagtttggacggagctgagccaacagacgaaaccgatgtccgggttcaaaatgagcgaagcggaagcacgatcaaatctaagggaaacag

SEQ ID NO: 17877 - DNA, 2327 bp, Heterodera glycines
gtcaaagatttaggagtaataatgactctaaattatctttgctgagcatataaataaaataataaaaaatgcttacttaaaggcataccatatttgagaatgaatgaagactagagagctaaaaactattataagaatgtataagacttatgtcagacctcaattagaatatgctgttgaaatttggaaccctaacttaaaaaaagatatagaaagaatagaaaaagtccagaaatttttcacgagaaaagcctttaaaaaatgcggacttttacatagatcatattcagaaagacttgaaatttgtcagcttatagaattagccaagcgaagaaatattgctgacttaactaccgcttttaaaattatgaagggttttacgagtcttgatgctagtaaactttttactttttctgatcgaccccattcgtaggccattacttttgagaatgcggcgcacaaccacaaaaagtaagaataatttttttaaccgtatagccaagaattggaacaaattaccaattgttccaattcaggcagataaggcaaatcaattcagggcattgctaaaagctatgtatgagttctaagggatttattgacatttgcattgacattcattccattttattttattttactttacatttcatattgttgtattttttgacattattcattttgattttttttatgcgccacataagagcactaatgtgcctgtggtttgctcaataaatatatatatttaatttcgtattaaatgaatttggcaaaagatggatgaaatgtcgcggatgactgtgtataaaagggacggacattcgcattttcatttttggggagtttggcgtattgatgattccaattcaaatttcattccaatttttttgcctctgttttcggctttgaatttcttcttaaggaaaaggtgaaatctagagatccgcctggacctggatccaggcttggatttttcctggatccaggttcaggtccaagccatttttcggcaacctggatttatcctggacctggatttatgtccaggaaatccatgtccagcaggtccaggttttttccaaaataccgatctctagtgaaatctaataaattaatgccttctcattttattttatccatttgttatttaaaaaaaacaatttttaacttttaatttagacacttaaagcgaaaaatgtttgaagctaaatttacaaatgccgcccttctgaagaaaattgtggaagcgatcaaagagttggtcagcgaagcgccatttgactgtacagaaaattcaatgtgtctacaggttttgcagccttatctaagaaaatattgcaattaaaaaaaccctgagtttaggcaatggatgggtctcacgtggcactgatttccctcaaattggacattggccttttcgaagtgttccgatgcgaccgcaccattgcacttggactgagtatgggcgagctcagcaaagtttgtttgggtggacgattagggcattcagaactatggcacagtctttaaaaggtgctcaaatgttccaaatcggaggacactttgatgattcgctttgaggacagtgagcaggacatggtcacgttcacttttgaggacaccaaaggacggaagcaggacatggggggaaattcgtccgctgtttcgcccattcttttggcggcggtttaccacacgtttcatcaacaaaaatgattgttttatttgtttgtttttatttacttacacaccatcccagaaatgagctcctgtaccagaaaagatttgcatgtgtggctcagtggtttttgtaagatagtaaagggacaaagggtggtggttcgagtccgttgtgcaacatgaatattttcatttatttttgtgcaaaatattaaaaaatcacgatatttgggaattatttttgaagctttttaccaaccaaattggtccatcttggtatcattcgaaagctcttgatggggagaagctttttctaagcaaatactatgcaattagaatgagtagaaaaaatatatgagcgttcgaaattttattttttgaataacttttgagtttgagcacagacaataacaaatcagcacaaaaagatgcagaaaatttttctctatcggtatgcaaagtttaaagaaaatctgttaacggaaagggaaatctcttagagagaagtgaatgttgttattcctaataatgaaaatattagatagtacgcccaaaggagacaaaaaattagagaaaaaaagataatgtttttctaaggcattctctatttattggtgcacatctcgttttttgggatggtgtgt

SEQ ID NO: 17878 - DNA, 1466 bp, Heterodera glycines
aatttgcgggttttctcccttgaaaacggtaacccttcatacaatcggcgtagccaggggggggggctgaggtggctaaaccctccccccccccgaaatccaaaaaatgaaccccaaaatggcaaaaaaacattcattttttggcgaaaaactgctataaatctgcaaaaaaaaacacctaatcgggatttctgaaaaaagaaaaatacaacctaaaaatcgaatttttgaattcataattcagcacctccccccctcccacgaagccaaaggtctggcctatacgcccttgccttcatacatataagtcatatatgtagattttatcaagaaattcaaaacaaaaattatgttgcaattatatcaggggattagactgatttttggttatggattctttcatttttgggacaccctataaaaaattcacgaatttatttagacaactcaaaaattgaggcacaaattttggatcgggattcaacgaactttagctactttttctgggttgaatatgttcttcaaaaaaatattttataaaaaatggaattaaaattatttttatctttcttcaaaactttgtttatttgtttaattatgaaatacaaattaacagctccttaattgggtctgaaaaatttgaatatttttaaaactggccttattaaactcgagatcactccaagaggattttattttactaaaaacattacctaaaaaattaaaaaaaaattttttttttgggctaagcaaaaaaattaaaaaattctttccattgagagctaaaccatttaaaatatgttccgacaacatttcttgttgaccacaatgcttttgtgtgcacttttgtacccgattattattggagttggcccgccagcgtatttggccatttgccaatggaaggattgtgtgggtgaaaagccggcccccggtggctctcacacggtgagacacgattttattttattatttttattttaattaattgttttaaaaaaaatttaaattgtgacgaaatgatttgaatattgtttgtataatacaataaatatgagaaacattgcataattcaaatattttattcaaatgaaaaaccatggattttttgaactaaatcgattttataataattatcgtattcatattttaggattaatttaaaaaaacatattcatttatttaattttgaatttagatttaataaaatatttaaattaaatttatttgaaaatttttgctttattgaaattaagaaaaatttatatatttttaagatgatttgtttgcccgcgactcgtccggcccaatgtccagaagaagcttggaaccaactgacagaattgaacgagctggagccttgttaaatttccaaattagcatacaatggaaaaatcgcttttttaaaaatgacaaatttcggcaaattgttttatttttccgataaataaatcaatgtttgacaa

SEQ ID NO: 17879 - DNA, 1328 bp, Heterodera glycines
ttttttttattaatctgaaaatctgaaaattaatttaaaaccggttattataaaatgatttggcactaaagactttttcatttcattgcttcatgtaaaattattttaattgaaaaatggattttcaaagttttatttctttcatgttatataatcattttttttatttcgctatatcattttttacaatttttcgcaaatttttgctgtttgaataaaacaaaaattgaggaaattggcatttctgctgttgttatcttacgccttttgttgcccttcacacaaaaattaagtttcaggataaagcggcactctaaattgaatatgttttgtgccccttagggatggattcgtttatttatggcaaaattgccaaaaagtgatggacagaaaacgacgacactttccaattgatgtggcaaattaactttattcactttcttcaagtgtgtgtgactttctttataagttttgaatttcgtcaagcaaatttgaatggcatgcaatttgaaataaaatttttgtaggatttaatttttcatttgccataaatttatgttaatacgaaaattttactatttttataaaaattccaaattttaaagccaatttttattctgattaaatgatttgaagaaaaaaaggctattaacagtatagttaaatccaactttttcaagcttttcacaaattttacgcttgaaaaaacatgaccaaataaaccgctggccaatcattaaggtattcatcagtctttaaaattgttggaatttttatttttggcaaaatgcataattttcaacatcgacatcaaccccaccatcatcatgaacaaaaactacatgggcatgaacagcagcgcgttccattgttggcacaccggcactcacagccttcgctactcatccaaccgcgcaagcaatcggtaaacaaaattggcttgttagctaattgagaccaaaaattcacgagacctcgagactcgagaccaggggacttggcaacgaaattgggaccatgaaaacttaaaaaaattttctttccgagtcgatgaattatgacagcgagaatatgcattaaagttttgctcactttgtcagagcaatttgataaaatattcttggcataatttgattatgtatagcaccattgaatgtacacaaacgcattcaaaaattaccgtgaccgagtcttatacggtgtgatatgatataaaaattatttttcgccatttataagaatttttttaaggcaaaatattttatttgcaatattttaaccagcatctcagagggacacaacaccatgagcgtgatccgaagatgaag

SEQ ID NO: 17880 - DNA, 991 bp, Heterodera glycines
aaaacaaagagatttgtggtcctggagcgttgctaggaaaattttgtgactttttaaaataaatatttttcaaaaaaatattccccatttttttaaatttttccaccctcttcctttaccaaatagttatcgggcctgctcgtaaaatatacagtacacagacagtaagaagttttttttttcgatttttgtttttgcgccttttgtcgcccttcatcgcctgataaaccaaacagtttgcttcgtttggccccgaatattgtactcaacacaacgctttcggcgccatttgcagcaacaaatgatgcaggttgtgatcaggcaaatgatcgcaatcaaaagcaacgcagcatcgccaatgtaaattgcgggatggactgtcaaaaatttatgtaatttaatccgtgatcggaaaatgcgtcgtcagtggaaaatgcgacagtgatacaaatatttttaaaatgaaaaatttctgtagcattagtattgtagtacaaaaggcgaaaagaaccttgttcgtaattggtaatacagtagtttgtaactaccttgtttaaaacaaattttcagcagtttgatttcattaaaagaagttccctctgggttttttgagtcgctgataacgaatcagccaattttggactacggcaggggtgtgatctgtcctgatttgtcagatttgtcctgatttggaggtagcgaccaaaatttgtcctgatttcttaaataaactcacatttttgaaattttatggcataatgtcactgttttatcaagaaactataagatttgtggtaaattttgacaaaaacctgttaacaaatcgattaaaaacgcaaaaatttttcccgtcggcgcctatcggcgtcaccggacgcccgtgtccatcccccaaaattttttgaaaaacgcgccgcaaaaaaagcgtttttaaagaaaaaaaaagtcgtcgcttgacttttaatttaaattgaaaaaattggcccttttt

SEQ ID NO: 17881 - DNA, 2581 bp, Heterodera glycines
  misc_feature (1947)..(1947): n is a, c, g, or t
tttgaatggatcaagaattttctcaaaaaacacaaactcaacattgaaaatttggtcccctgccaattttggaagttcggatcacactggaactaacaatgtctttcaaaaattgaaaagtttgcgcggaaatttaattgctgtcggttgtccagctcatgtgctccacaatgctgcccgtcgttcggcggacaatttaccaattgatatcgaagtgattatgttcaaaatagccggacattttcgacattcaacacaaagagtcgagcgtttcaaagaaatttgcgattattttgatgtattattctaaataatagtttctttcaaaacacttttcaggcaaagtttactgtcctcaactctcatgggccgacacgttggacgactttgaccaatgtcgtgcaaaaaatttacgtacttttgcaaccattatgtgaatatttcaaggaagatggacctttaattctacgcaattttttttatcacaaacatctgaagttattatcaattttctcaatcacgttttaccaatattttccaaatcaattgatgcacttcaggtggcttttgtgttttgatttaaaattaaacaacaaaaacaacaaaaccaccttgcaacagaaatttattaatgagcatccaattaaaaaacggttgtgtttcattataaaaatatttatggctattttttaagaagaacaaaatgattctgccagaattgctggatatcatgagtcattttaaagtgaaaatcaaggacagaatggacaaacaattttttggaattattactggtcaattgttgcaccgtctaacagaaaaagaagaacaaacgttgaaaaatgctttcacggtagattgagctaaaatgtttttaaatattacaaattttcagtcattctacaaaacaactttggattatgtcgccaaatggtttcgcaccgaacgttatccggatcatattcaatggctttcgcttacagatcggcaactagtccatgagaatgtcattgaattggcctcaactttttcccctgatttatccgatactttgttcgatgaagttagtcaggtcaaccacattttgaacaacatcgacgcagcagaattcatgcgactgacaacagagtaaaaatggcaaagaattttcagcgctgattttcccagtctgtacaggctcgtaagcaaattaatgtcaattcccgtctcaaatgcatttgtggagagagtgttttcgctttgttcggcgcaatggacagatgtgcgaaatttgttgaaggtcgtcgacacagtgaagtcgctggcccaaatcaaagtcaacttcaattttacatgctcggaatttcacaaaatgcttatttcgaacaaaaaattgctcaaattgatcatggacgatcaaaaataccacatttgaacattttaaacgtgttttgaataaaataaatttgtgaaaatgaggctttttgaccaaaaatgaggcttttttgcgtgccaaatgaggcttttgaaaattttcatctgcgaaccctgtccattaatcatcatcatgtcttttcatcctcttaatgatggtggtagaacagcaatgcaatcagcagaattgctggaaaaacggaaaaaataaatacctaattgtttaaaaattaaattgcctaaatgaaaattattacaaaaaaaaaacattatgtacctatattttcgttatttaattcataaaaaaataattttaataaaattttgacgagtcaaaaaaagtgccaaatgtggaccaagaattaacggagctgcaacggcacaattcggacgaacgcccacatctgtgggcatttccacatggaaaccaatgttaaggaccaattctttaggaaacatgtctaaatttggaaaagaacgtttttaacataaatgcgcggacgaaaaaaggcataaagtttttcaaaaaaaaanaagaataaatttgtcgatttaaagtttttcttggatctgaaattcaatccctaacctatctgctggtcgaaaattctggattggtttttaagagttgcggctaaaagtttttaaaaaatttttgtttttaacatgttaacagatttgtgaatatatattatttgactaattaaaaaaattaatttaataagaagatttttgtccatcaatgcccgctcgccccgccgcggtaggggtcagttccgtaccagtcaagttaaaagcatccatcataaatcttttcttgattcaaccaaatttttaaatttgattttattctaaagctccgccttggtccaaaaaaatgactcattaattaatagggattcgttttttaggcaaatgcctaaaacttctgcgcagttaatatacacagataagcacgaaaaacgcattttccggttggtttggggtgtctacgatgacttttataatgcctaactttgcctattttgaactatttgtgcttaatgcctatttttgtgcctatttcgccattttaggcgccattttcagaattttcggaaaaatccttaacaaaaatgcaataaaaatgaaaaatacaccacctaaaaaacgacctgaaaaaatttca

SEQ ID NO: 17882 - DNA, 982 bp, Heterodera glycines
gggattggcataggacaaatggacaaggagagtgagtacgtgggattggcaagtgccaaatggacaaagacagtgagtgagtgggattggcaagggacaaatggacaaagacagtgagtgagtgggattggcaagggacaaatggacaaagacagtgagtgagtgggattggcaagggacaaatggacaaagacagtgagtgagtgggattggcaagggacaaatggcataggacaaatggacaaagacagtgagtgagtgggattggcaagggacaaatggacaaagacaggaatgagtgggattggcaagggacaaatggacaaagacagtgagtgagtgggattggcaagggacaaatggacaaagacagtgagtgagtgggattggcaagggacaaatggacaaagacagtgagtgagtgggattggcaatggacaaatggacaaagacagtgagtgagtgggattggcaagggacaaatggcataggacaaatggacaaagacaatgagtgagtgggattggcaagggacaaatggacaaagacagtgagtgagtgggattggcaagggacaaatggcataggacaaatggacaaagacagtgagtgagtaggattggcaagggacaaatggacaaagacagtgaatgagtgggattggcaagggacaaatggacaaagacagtgagtgagtgggattggcaagggacaaatggacaaagacagtgagtgagtgggattggcaagggacaaatggacaaagacagtgagtgagtgggattggcaagggacaaatggcataggacaaatggacaaagacagtgaatgagtgggattggcaagggacaaatggacaaagacagtgaatgagtgggattggcaagggacaaatggacaaagacaagtgagtgagtgggattggcaagggaccaatggaccaagacagtgagtgaatgggatttggaagggacaaatggac

SEQ ID NO: 17883 - DNA, 802 bp, Heterodera glycines
aatggcataggacaaatggacaaagacagtgagtgagtgggattggcaagggacaaatggacaaagacagtgaatgagtgggattggcataggacaaatggacaatgaaagtgagtaagtgggattggcaagggacaaatggacaaagacagtgagtgagtgggattggcaagggacaaatggcataggacaaatggacaaagacagtgagtgagtgggattggcataggacaaatggacaatgaaagtgagtaagtgggattggcaagggacaaatggacaaagacagtgagtgagtgggattggcaagggacaaatggacaaagacagtgagtgagtgggattggcaagggacaaatggacaaagacagtgagtgagtgggattggcaagggacaaatggacaaagacagtgagtgagtgggattggcaagggacaaatggcataggacaaatggacaaagacagtgagtgagtgggattggcaagggacaaatggacaaagacagtgagtaagtgggattggcaagggacaaatggacaatgaaagtgagtaagtgggattggcaagggacaaatggacaatgaaagtgagtaagtgggattggcaagggacaaatggacaaagacagtgagtaagtgggattggcaagggacaaatggacaatgaaagtgagtaattgggattggcaagggacaaatggacaaagacagtgagtgagtgggattggcataggacaaatggacaaagacagtgagtgagtgggattggcataggacaaatggacaatgaaagtgagtaa

SEQ ID NO: 17884 - DNA, 1706 bp, Heterodera glycines
  misc_feature (23)..(23): n is a, c, g, or t
  misc_feature (47)..(47): n is a, c, g, or t
  misc_feature (96)..(96): n is a, c, g, or t
aaaaaaaaaatttgacaataatnaacgattcagaattcgatctcttngaggagcattgcctccgctcccttcacttgtttctcgcccattttttcnccaattccttttgtgtgccaacaatccactgttcagtcgttttaacaactccttgttgttggaggatcgttccaacaatttgctgtatttcttgaacacctcgttcagcgccaatttgtactcattgagcacgagcttcgccgagtgctcggccaacacctcacgcctttctattattggaaataatgacaatacgtttaaaaatgggggggggggagtggatcggtctggccatttacgaaccgaaattaaggggcggtggtgccgataggctccgccggggcaaattatgttttcttaaacctttatggagcataaaaataaatctgcgacaaaatgctaaaaatcggcaaatggatcattttttctatgtttttcgcgttttaaattgctaaaaacgccatttaatgctttgacgccagccttggatttgtctagcgttttcattgtacaaaaagaaacctcttgtgatctttgggatttgcacatttatgacaatcccgtccacttgtggagtgacattttctgccatattttggatggcaattcgtgccggctttatcgcagcaggattgtctgcgaaattgagtacaattggtcccttaggtgtttttagggaaattcgcgcgaacttgaccagccgatgggtctgtaaggggagggggagggtaaaaagtgagcaaattttaaaacacaaattcgacaaaaaacaaaaatatatttggaaatgggactttcttttcgaattcggttctgggactcgaatccggaaaggatgcccagtaaaatctccaactggacacaactactatttttcaaaactttgtgaatggggatagtaacctttttaaataattccaaaacgttagtttattttttgtattcttgtgggtggtatagaaaaccctataacaaaacctcgccattgtccaatgttacagacaaatcctcataggcctttaggttgatgttgagagacaaatgcttaatgagcgcgttgttcagtgcgttgaaataaagttccatctccttgacggcttctgccacgatcttttgaggactcttcgacggatcactgaaaagtttaagatttttattacaacatatttttgataatttttgccatgaatccaaaaaagtatcaattttgcacgggaaaacaacatttagttttttgtgaattggtctgttaatatgcatcagcaaactgattagcaacatcaagctctgatgggggtttgaaaagcccaatttttgaaaaagaattattggattgaataaagtccagcgtaaattttaagagaaaaatttttttaaataaattagccctattttggttagggttcgaaaaagttcaggctacaaatgttgtttttggctgtggccacaaaatgccgggccgcaaaaaacagatcgcaacccagacacatgcgcatttgtccaaaatcagattcaaactaaaaaattttccaagtctgatagcctaaatatcattgaataagaaattgtagtcttctaattaattaggagcatttaattctgctgcttgaataattaaattaactgttaaaatatcagacaccaatcgctaatagggattgaaaaaaaaa

SEQ ID NO: 17885 - DNA, 821 bp, Heterodera glycines
aaagaaggagacgcgctcatttggacaccgcgtgccaatttgccggcggtgacgcaaagctatgaaaattttatgggctcagtgagtagcagggatgggccgaggtttcgcctttcgcattattcgcattttttggcgtttctcatttcgctttttggcgcgaaatgcgacttttacacccctaagaattggattaaattcccatgaaatttttcaaaattttacctataaattggctaattttcagtgaaaagctgtttataaatgatcaaaatttccaatttttttgcccgggggaaaaattaagaattttgaccctattttcattaaaaaaattctttattttgcggtttttctcaaaaaaccacaaaaagcctcattttgaaaatttagcctcattgacctatcaaaaaaccacaaaatgggctaaagcctcagatctgcgagccctgcacataaatatgcaaataaaaatgccaaatatgcatcaaacatgaacaaaaatatgattaaacctttttttgtccggtattcagtaattttttaactaaaatttcgttgttaaacataaagtataataacaactcatacacaggcaacgcgaacaatggcttagactaggcctaagcttttggcttaaaccaggcttagcttttttgtaaaatttttttatattagtaactttctgttgacatcattaagaaaaattataaaaagaagattctagcttatttttttaagtttctatttcaatttttttttcctttattttttatgggacgcgtaaactgttgttgggacgcgtaaaatgtgttgggacg

SEQ ID NO: 17886 - DNA, 3333 bp, Heterodera glycines
  misc_feature (2077)..(2077): n is a, c, g, or t
atcaaatcacttcctcgtcaatgtacaaatgcttctgcttgtgcttctcctaattttgcttttcccttccgaatctcttcaggctgccagttttatcactttgcattgtcaagtatttacaaaaagcaattaataaaagttgcaaaaatgtgctttgccagggcaatggcttatacgtttcgggacgatggaatgaaaacggacagacggcggatttgccacttccatccgaactcacaatgcaacgattagctcgtctaattaagtgcttatttatctgttacatttgctttgaaggttcgtgtcgagaaaaaacaaagatggcaccgtttctttcatcagcaattccaatcgaatgcttttgacagttttgccaaatgcatttggacgcattgttttggctcagcataatcaaccgagtaatcattcaaactcctgctgatttgatgagtgccttttcccaattattcagctgatgggtccaccaaattcaaattaattccctacacggacggcacttacgcaattaaggtcaatttggaatgaataaagtcgaaaaacactgcccaaggtcaccaaattcaggcagcttccattggcaaatacttgagctgccgcaattacgcctatcagctgttcgccaaccgggaaaaggtggaggggcccttcgaaaggttttacttggacattgtgacgacattggcggaatttgtcaccgcaagagttccgctgaaattgcgacacttcaaggcacaaagaaaacatggataaaagagcaaaaagaaagataattcaagaaaaagggctaaatactgcgtttagaaggaaagaacaatttatttattataaaattacaaattcaaaaattaattttcttcaaagtataaacaaaaaaatgaatcgaatttctggtgccctccgattgacccctaattgtaaggaatacgtccacagcagatggacggcgtatatttgagcattgcgtccaagtcaagtcactttcgctgttttgacgcaaaatgtccaaaatctcattattaattttaaatgagataagtagagaaggagatttccgaatctgccgggccgggctgactttttcagaagcaaccggttaccgggcccggtctcccaaaaaccggtgaaaccggattttcaaattgccgggcccggaaccggtttggtaaaaatttaaattctcacatgtatttcaaccccaaaatcgacaaaaaccgtgtcaactgttaaatttcggctatatgtcacttcagtcgcaaaaaaaggcctcttcaatttataaatcataatttttcaaaataaaaattttaaagaattaattttttgaaatttttttttgattaattataaatttttttagaaaacctagtaaataattcacaaaattaaaaattttcttagatattcatggaaaaattttttacgattttttgaaatttctgtttgaaaattaaaaaaaaatttagaggaaaatgacagaggagataaataaagtgcgtggtgcatatcagggatggatggcattccgaggccccaaaaattttcggaaatcggaaattttgaaaaaattaaaatattcaaaaaaactagttatcatggggggtgggtccatcggtgcttatagacgccgccgggaaaattttttgttatttttaatgcgatttgttaagttttttcaaaaaattgttcaaattttgcgattttgagcaaatttttcaagaaaattaaggatttttaaggtacggcagtgccgataggcgccgccaggaaatctttggaaatttcggtgcaatttattaacagaaattgtataaaaacgaagattttttggctatatcataaaccggtaaaaaatgccggtttccggaccggtttgacattttcaaaaagaccggtttccgggcccggcctctcaaaaaccggtcaaaccggattttcccaaaaatcgccggaccggtttgccgggcccggtccgctctctataaaaacccgaaaaataggctgaaacagggggagcacccttatagataccaggatccaaatcttgggaccgtctcgnacaaaggaggggtcggcaagtgaccgtgggatttccaaatgaaatttggtgggtggatagatgacgcccaggttctattgtgaaattttgactatttttgccaaatgagcatgagtgccgagatatgacgtgccaaacttttttaatgaacaaacaaattaaataattatttgcaaccattcgcattgtcaaatggtgtagaggtaatgcgttagtaacagtcgcaccaggttcgaatccgctatatgcaattttttttttttaatttttttttttgctttttatgaaaagtcaattctcaaaagattagttttataaaaagactttatttttaattttactttttattttggtacatatgataataaaaaatatttttaattttactttcattttgatatgtacataagataataaaatatttaaaaaatacgacaggatatttattgcacctttatgtttaatgtagtaattttttgatttctaatggaaaaaaatttaaaataaaaaaaatcccacggtcacttgccgacccctcctttgtgagtgcacaacaaaaaaagctcggaattccttttttcgaccttttttttctgggaccagtaaagcgtacgattaccgtgtatctgttcttatttctaagaaatgtttgatttggggtagtgtcttattttcatttaaaagaggaaatttctgaaaaatttggctaattcctaacaaaattcattaaaaattcttaaaattttcccccagcggcgcctatcggcaccgccggctcccaaaactcctagtttttcttaaaaattagcccaagatcgcaaattttggtcattttttggacagaacttgttaacaaattgcattaaattttaaaaaaatttccctcggcggcgcctatcggcaccgccgaactctcttccctcacccatacccaaaaatttttcggaaaaatgcgccgaaaaaattgttaaaaatctgtttttttgattctaaatgcactgaaatttaccaattgcttatgtttcgataaatgttaaaatcttataattgattttcggaaatgtataaatttctcatttctaagccgaaattgctcagaaaatagttggcggtgagtaatgcttgattttgttgaataaaaaagcgattcaaagttttggaagcgtgttttaaaaaatgtccttatttttgaccctaaaatcttatttttgaccagcgatgctcttatttcgggaaattttcaagggtaaccctgt

SEQ ID NO: 17887 - DNA, 1453 bp, Heterodera glycines
  misc_feature (18)..(18): n is a, c, g, or t
  misc_feature (28)..(28): n is a, c, g, or t
  misc_feature (33)..(33): n is a, c, g, or t
  misc_feature (82)..(82): n is a, c, g, or t
  misc_feature (114)..(114): n is a, c, g, or t
tccgatcttctaattaanaatgataatntgatntaatggcaagggatgaaaagagagtaaaatgaaccgaccataccaagancattgagaaatgcaccggagaaagggtgaatntaaaaaaaggattggggtcgaaaaggaataaccaaaaccagtggctatacgacgaataaaagtaacaaaagcagtggaggcaatgtccaagaggcataccccattccgacccccggacgcgagttccaaccgccgtaaccgccgctaggacagcattcgtagccacaacattgctaaaggaggggggaggggtaattagcggtcaattaagaaaaggtttgtccgtgcctcgttgtagttgcacgaccagacaatctctttgggccgcgactgtcctcccggcagaaacacgttgccaaactgcgggtccgagggatcaaccggcattcggcacatcgtccgaccggaagacattccgcctccggggtaatactgggaaccccagtagtaattgcgaccgccccagctgaaagacagtgagaatgagcagaatgacaagtaaatattgcatttaatggtgaacaatcactcggaaaataacagttttggtgaatgactcactgcatcggcgaagcaaccgaacgaatgatggctttgcccgcctcgtaagcaataaccccggcggcggcaccgataatcatatttttgaaggtattgccgcgtgactgtgagccgactccactccctcgggaaaaactaaaaacaaagacacttaaaattggaagcataattaaatagataaattcaagcataaaataatcttttagaaaatttaatgagctacaaaagaaaacaaaatgatcgctttgggtgtaatccaaggaagaatcacgttggaaaacgaccaacaattggattttaaaaattaaaaaagaatttttgacccaaaaggggactaaattgcactaatgtcatgccaagccctggcccgtcttgcctgggcgttcggtatgccgatcctccgtgtgtgcctttgctaaatgtgttggaaaatccgcctccgccagtctgtccataattcggtttcggtgccgtccagctaccgccggaaccaccaccacttcgactgttgccactgccgccgaacagcccaccgccacggctggccgaactcgcgcgagccgcagacccacccctaaaaaaccaaaataaagaagtagaccaaatgtaaagggtcaaatagtgcacctgccaaagccacctcctcctctgaacggaaaaagagaaagaattagtgttgcatttttagaataatgccgaaccttgcgcctcctcccccgccacgctttccaacgatttcgaccgaacagagcaaaaggaaaaggaaaatcactttgtactgttcgttttgcattttgggtagaaagaattaatatattcgtctctatcaattacacat

SEQ ID NO: 17888 - DNA, 1400 bp, Heterodera glycines
  misc_feature (1388)..(1389): n is a, c, g, or t
tttggggtgttccaattttaggccatttccaattttgttctcccaatttaggcactttacgctcgcgtgttggaccgtcagggcaatttcacggaggcggcgcagcgttaccacgagctgtcgctgaagcccggactgattccttcggagaagcgccaagtgctgcaaaatgcgctcacctgcactttgctcgctgcgcccggtccgtatttttttgggcattgcgagactggtcaataaaatgcttcacccctcttatttattatttagttgtatgactgaattttcagtttttttcataagttcgcttttccctaagggacccaacgcaatcggttgctcaacactttgttcaaggacgaacgctgtcagcagttggtcggccattccctgctgaagaatatgtatttggaacggctcgtcaaagggcccgaggtgagaattttttaaatttcaaactttgaaaattttcaataaaatgtcttattgtttaaaattttttaagactttcaagaaaaaatttttttattttctagcaatttttggaaatcaccataaattaattttcaaaaaagaaacgctacaaactaattttcttgaaaaattaaaacaatacgttttagtttttaaattaggttgcgagtttttttgtggcatggcttgaaatacacgcccatttgaatttggcactttcagctgactgagttcgaactctctctgtgcccccatcagcgtctgctcgacgccgagggcgtctcaattttgcagcgttcggtcctcgaacacaacattttggccgcctcgcgactgtacgccaacatttcattcgacggattgggacaacttttgggcattcctgcggcaaaagtgatttagaaaaatggaaaatgaacgccaaacggccaacgaatgaaataatttaaggcggagaaagtggccactcaaatgatttccggggagaaagtccaaggggcgattgaccaattggagcggacggtttcattcgaaggtaaaatgccggaaaagtggcgaaaatggcactagcaaaacttttgattttttcattcatatattttgccttaaagttttcttgaaaatggccatttaacctaacaaattattacgcactcttttcaagtgcccgattcgtccaacggtggcgccgattcgcaaattgcttctatctgtgagttggttgcttcgatcaacgagaaattggctactcgcttctcggagtggcacaccgaacgattcaacgcgtacaaaagagcacaccaacagcccaatgatcccatgcaatagtgattattatttattacggtgccatttgttttgttcggcttatttatccaataaaaagaccgatttatttattttttcaaattctnntgtggatttat

SEQ ID NO: 17889 - DNA, 1077 bp, Heterodera glycines
  misc_feature (969)..(969): n is a, c, g, or t
catgtttagaagcatttcaaagctattgcttcgcgataaaacaattaccaaaaagttatacattaaaatttcaaaaaagtcgaaatttttgaagttttttcttaataaattttcttataggctataaaattttttcgctttttataaagttaatagagcatgtaaaaagcttttgaatgataccaatgatgttggattttgttgacaaagaaaaaaagttatagtccaaaaattgcacgggcccaactgagcgagtccgaattttactgttaatcgagttttttaattattattagttttatctatctgttcactacgattttacattgaaaagggtgtaaaatggaacttaggcaatttttattatttttttttgaatttttccatataaattggccaacctttgccctttcttttgtgctcggttcgactggcgcaccaattgcagaaaaaacggcagaataaaaaatggcgagcgaactcagagccaaacaatttgtccgcattttattttttaattatatttaaaaaggataaataattattattttggtttttccaattcaatttaaatgggaatatttttgttaatggaaaacgatggaaagttacctaattgtgtttatcaaaacatcactactgattcgcattggtgctcaattaggcgaatactttctgtcctttttgtttattattttgtgctccttcgttaattccggttataattacataattatcaactaatttctataacccaagtcacttgcatttcaatcaatttttggcaaattaaaaagagcacaccttcttttttgaaaaatggtagaattcaaagaatgaatgatttaacgaaattctttaaaaagagcattagaataaatttttatgagtttaaactagagatcgtatacggaccggatccgtatacggatttttacggatccgagtccgtaatccgcatttttttgngtcgatacggatttttatggactacggattttccaaatttttagtcgcatcctgatcctgacccgtataaattatgataggattaccgaatattttttctgtacattt

SEQ ID NO: 17890 - DNA, 2445 bp, Heterodera glycines
  misc_feature (17)..(17): n is a, c, g, or t
  misc_feature (41)..(41): n is a, c, g, or t
tagtcgccatttgtcanatcctcttcaagcgacttccactnttgtgccaccattaggctgagattgccaccgatgctttttcttatcttttcaatcacattgcttacggtgtgccatttttgcacctctaatttgagcgtcacttcttccttttgatcgagatccaagttcaaaatgatttctttaaaataaaagggacagaaattcatttattaaatattaaaaaggcccataaaataaaacatttaatttgaaattcattcgttgccgaattgcgcccttttacttaaactctgctcgatattcaaactcgaacttcctggtttttcaagatcttattcaagaaatccctaattactctgtcataagcattaaattcggaccataagtgatcggtggttggctcagcaacagtacaacaacagctcccttcagaatttggtgttgtgccaacgtttcgtcgtccctcagccgcttctccttaaacagcagcgtttgctcaatcatcggaatgtcctcaatttcttgcattttcttcattatgtaatgagtggtgttccattctttcactctcattttgatacgtttttgtcccaatagaattatcgtaatttctaaatatgtacagtaattaacaatcattggcttaattactaattgaacaagtgcacatggaattgtgcatgaacaaagaaattttaagatttactggctaacattgacaagaactgtgccgagtaaagaagttaaaagccaatatttatgcactacgcagtgggatagaggatttgacatttgcagatctgagatttgagggtaaccccgaatttgagattccgaaatactgagaacacgacatttggggatccgccttttgagaacctgtcatttgaggacccgaaattttcggactttgcttcatctgtttgttgcgtttatatttaatctgattggttaatttgaatcattttctctaattcaaatataaatttactataattaaagctaactgttgaatcggctgtgacacgaaaatcggagacagatatgggttatttgatgtcctcaaatgtcgggggtcctcaaataatcaaatacttaaatgtccggtagtcgtccactcagtttattccctgtgctaacgttcgattgcttaccaaaagaacgcgcttctttcggctcctccacttcgagacggacttcttgccatttgtaaaaaatattaatgatgccgtagtcggacaatgtttttcgcttatccagaagtcgtcccccataaaagagcctttggtatcggttcggaatgcccgtcttggcctcgattatccactggacattctgaacggtatccgacgcatcaatcttcaagccaattgtttttccgtttgtatttttcacttttattttgtattcctttcttaattatgacaaaaattagcatggaatattaaattagatttaattatatcattattttccccgtttaactattatctgtgaatttatgaacgagatatagaagcttgaggggaaactatgtgacgggttagatttgaaccggcttctctggctttccggaccagtgttctaccagctgaactgccgaccctgactcttcagatatatcaattggttttaatctatcattaagcatcctcttggaaaaactgttcttctctatctgaccttgaaagggaaatccacggcacaaggaaaagcacaaagtcattttctcggctgttgtacttgaaaataggcatttccgccctgagcagaactcctcggaagaacaaccgttgttctgcgatcggaataccctgctgctcgtggactttctccataatgtttttaacggtgtccgatctgtgcatttcgtaagtgatcagtttgttgtccttcgttttcacgtttcaaatccaaaaaatgtaaaactgcattgaatttataattgttctataattatttttctattttacaatgcattgaataagtcatcggtcagcagatcaaatcgaattggaaaattctgttcctttgttgtctcttcattcataattaattatccatcggcgttctttgtttctgctcaattcgccgccaaattaacagtggacgcaaaagaggccaaaacgtacaaaatggcagtcagcgcacaaagaatcatcagactgatgatgtttaattttatatgatttaaacatttattataaatgattttaattactcaatttcctttttgcctaattatcagagctgaacattttgaaaaaagcctggcacctgctgtacttgtacccgaattccccgactgagcttacctgtttttctattaaaaaaatgaattatgccaaaacagacaatgattttacacaattttccataaaagagaaaaatgtcattgttatataaataatttatcaaattaaatttaaattttttgtctcc

SEQ ID NO: 17891 - DNA, 2900 bp, Heterodera glycines
ctctccacggcaattaattcgatcattaattaattatcatttataatattgcctatttaatttgagttcatttcttggctctttcatttgcttttttctcacttttcatggcctttttccaggctcaccggccaatgtcagcattttgagtgccgatcagagaaaggtcattttgaggggactgagcccaaaggccgtctatcgctttcgaatccaagtccattttttaaattatttattttaattttgatttattgtgcgtttttttttttttgattttaggctgtcacctctcttggccttggtgccgaactcgtggagtatttcagcacggggcatttggccaaagaattggcccgccaaaaaatggaacccattggcaacagtgaccaagtggcatttccccctctttaaatttcaatttttttgatgcttttcaattcaagtccgatttgtccgtcctcgtcgggcactttccccattcggtcgaattgccgtgggactcttccgcccgtaaggcatcgctcggccacggcttttgcctttggttggcttttgcgtggacagcaattgcaatttgcagaatatttggcgaattcagcggccgatagcataatgaattaacaattaatttatgtgattttgttgtattatttgcacaaatatgggtattattatttcattttatttttaatctatattattgtattaaaatattaataaaattaattaaaatattgtgaatcattcacttttcaacaaatttttaatgacataattggcatggcaattaactaattatttgttaataaaattaatgaaaaaagaaatgggcagaaaaaagaaagaatttgaaaaaatgagttgggtcgtataattgtcaaaatgaaataatcttcgcctgtcctaaattaagaggcaaaaaccaatcattcaacaatttccatgcccaattaattcaatccgacgatccgttggcaaattgaaattgttttacctctccaacccatgtgatatgcccccaactcacccccttctcattccccccccatcattcacctcaccattttcatcccatccaaataattaattttgttcatagaatcttaccatttattggttacataatgtcggttaagaatgaaaaatgccataaaaacaaaagaaaatgccgtaatttttcataaaagcaaccatttcaaacattgttcgtatcagttgacagttctctgttgtctcagactgcaaaattaaatttcacggtaatttaactactccaaaatcttaaatttattaattgtttgtttaaaaaattcgtcgcgagtgtccgtcttttttttccatatttcgctgtcgcatcaatggcattttttcagacttccttccattttgccttgttttttctttcctctttccttctgtttatttgctttttcttccgttttcattttacagtatcctccctgtcaccgtatctaataccatctccgtccgccgtgccactctccgcttgcaatgcctttgatcggcgcctcctccaccggctccttctcctcctccttctcctcctacttctccccccgcgtccgttctccgttcgtccctctccgtccccgcgcccgtcgtctgcccaacgaattgcttactgagttggccactttcgcgcactacgactttcttgagctgagtcgcgccgcaaattcgcgtctgcgcggactctaccggccgattttacagcgaaaggacgcgaaggtgggaatataaaaggaaagaaaaagcggaagatatttccaatattcattgtatggctttaatttgccatcatcactttcagttgtgcgcgttgttcttcgacgacgtccgttcgttgtccctttggtttaaaaattgggctgtccgttccgacgctttgcgaaagtttgtcaatctccgcgccaccgtggacagcaaatggtgtgaggaggcgatgcagacgaagcccgacctttgggcggtgaatcgggcgcgagtgacttcccgcggactgatcgccgacctgcgcgagttgcggaaattaaccgacgaactcatcgccaccacccataaagtgggaatacaggcgcagatgaatagcctcgaaaattcaattcgattttcgttttccgatctctgccgagggtcgtctgatgcaaagtgccgccgccgtttccgcgccgcgcgattggctccgcgtgttcggcctcggctcctcttcctccgtccgtttccattctcagaggtcacttctcatcgccaaatcgttggcggtgcccaaaacggtggtggaccggtggctgaacaaagacttgccgagtctgaaggctttggtgcgcgggttggtccaactgttgcgcgacgacttcaaagacgagtccatcacgtgccaaagtcgtaagtttcggattccgatcttttttacgttttcttgattaatgattaaatcgcttttcagagtacaccggctgtatcaacgttctcaaaacgtgcgacactcgtctgaaagttcttatcgcttctctgaagtgatcgaccgctcggcggttgcttacaatgatttttgacttttaacttttacataaatgcttttaccttcttttttttattttatcatcgtttttcagtttcgcttatgccattcgttcataacataacataaagcttgttttttgaatatcctctcgtacgaaaacgacctggccccaaacttgctactgggataacttttgggcccttttccatttaattttcgttcgcgtctttcaaaaaatttgaatggaaatggtatgtagaagttagagaaaaggaaaactatagagagagatgaaaaaggaagcgagagatgaggtagaacgaagattcagaaagaaaggtgaggtagacag

SEQ ID NO: 17892 - DNA, 2182 bp, Heterodera glycines
ggaaattcctgcaattattaattgtgtatttatggtcgtcggtttcgcttttcggcaatttttccatttttttcatttcctcacattattaaaagccttttccatctcaacgatctgataaatgagccttctttttctcgtcaatcgtcatcgtttatacagtcatcatttgtgatctccttgttcatcatcgcagtggtgcgaaaagggaagaagtgcgaaaaataaagaaggaaatagtactctgtctgactgtctggttacgcttttgaaaaatttgatcaaaaatgtggtgccaaaccaaattagtaccgaaattcgagcattattgttttctatcggtatgcaagacgcagatttaacatagtgaaacaaagctacacagagaaagtaagtgttgctttctgagttgagttgacccatagcctaacgaatttattgtatgttcaatcaagacaaaaaagtttcgtaataggcaattttgtcataatgtctggcacaaataaatttcaaaaatattttttttttttttgcttgattcaaattttacaaatcccatccctggttaggtatgtcatcctcttcgattgttcacaccgaccagtgggattattttgtcaaggaacgaaatgacgcagtcgcaaaattctcagacccaccaaccaatttaattattcggtgttttattttcttaaaattaaaaataagaatcccgactttttaagcctggacaaactaattaacgacttccaacaacagaatactgaatggagtagcagaaaaggtacgcaaaagtgaaagaaatgcaaaatttgcaacgccaaaaccatagaatttgaaaagcatgtcgtgccatggtccgaaagcaaaagtgacaattgtgagctttgcaaaatacgctttacaattactcgacgaaggcaccgtaagtttttggctttgtgtaatttttgtaagaaatttttatagattgtcgcttgtgcggtgcccaactttgtgcttcatgctcccaatttttgactatcaaatcagcgcgtgagtttggtgaccatttctgataaaatgtttggcgctagttaaaaagagcgctcttttgaaaattttttcactttttttgagacttttttttttgtttattttacatataatgatgaatattaagcattaacagcacaattatggcgaataaaagtataattatggcgaagaagatcacagaaagcattaataatagtttttcctttagccctagcattaagtcgaaaaatttgttcacacatgtatgaattcgttaaatttgtactggttccatgaattcttttcgtcttttgctttaattgagcccagagtccttcacatttattcgtgttgacgttgaattcggtgccgtcagggagaatgacaatgcactactccatttggtttttgataagtccatgataagccagaaattgaagaatttcctcagaatcctgcttgtaaatccaacgtaaattgatttcgtccaaagaaggtggccgaaccggcagattgttgtaatcaattattaaataacgtgaaatacataccatctggtaaaaaaacaaattctgcatcaaaataaacaaaaaaaaaatagaccaaaaaaaagtgaaaaaattttcaaaacgccacgctttgcaagtagcgccaatttttctaatggaaattaaatgcaacgaaatggaaacccaaaatggtaattattaatgttaaattaaaattacaattcaaacttccaaatgccttttttgctgctgattttctgtcttttaatcaattgtggcaaaatttatcaacgaatttttatgccatgggaaaaatgaaattggaaaaatattccaattttatatgaaaaagcagaaaaaatgcgaaaagaattttgtgaggaattgttggaagggaaaaagtattgaaaaagcaacgcaaaaggtgagaaaaacggcaataaaattggcaaaagaattggaaaatgataaagtattaaagaaaacattcaaaaggcattgaaaaataaaaacgaaaaaatattattggatgatgcaaaattagttgagttgaaagaagaattagttaaaaattattcggaagaaaatttgaataaactaaagacccttttttacttgaaactccatgaattttttgcatcaattaaaggcaatta

SEQ ID NO: 17893 - DNA, 3727 bp, Heterodera glycines
  misc_feature (56)..(56): n is a, c, g, or t
  misc_feature (3662)..(3663): n is a, c, g, or t
  misc_feature (3666)..(3668): n is a, c, g, or t
  misc_feature (3670)..(3671): n is a, c, g, or t
  misc_feature (3673)..(3673): n is a, c, g, or t
  misc_feature (3675)..(3675): n is a, c, g, or t
cagtgaaattaaaaaaaaagtttacaaattatttaagcttacagaaatagatattntgtgaaattcacaattgatccttcttccacatggcaaaccaattaatccgaaacaattggtcgcatcgtagccaacctaagaaggcgatcggacaaaatggaaatttggttcccaaacgaatattcgggaaaaatccctcattttataattttttgtattttttagcagtaaaagtcgctaatttttcattttattcttagttaattaaaatgttttttatttgtatcaaaattattttatattacaattttctaatataaaaacgtttgaagaaatttaagcattattgtaaagttcaataaaagatgtgaactcacacttagacgagtgtctcgtactcaaccaccgattgtgaggaataaatgggaacgcgcgagttcgtgccgttggatgaggagggcgaacggcgtcggccgagaaaggacaaacgaaaattgaattgagtgcctttattcaacgctcgaaacaatgcgaggaacaaaaaagaggcaataattccgctaaaaatggccagaagaactaacacttgcagcatgggaaaaacgactcgaggcggaagggacttgtaaaatatcttggtgctatgtcgtacggttggcataattcccatgtcgaacgacaatgcaattttttgggcactttttttaataagatgattagcctaaaagacaaaaaggagttagtttttcaggcttttagaaagcacttacggctagtgataatttttttaggctctaaaaaccgccaaaaaggattttcgtgcaggtatacataaaaaaaacccgttttgaggatttgtatcaaaaaatcaacataaaacaccaaagcagagttgggagcccatttaaagccagcaccaaaaatttcttcaaaattgatatattttatttttgacgattttttaatttacttcaaaatttttccgaaattttaaaaatgccgcaatcccgtgcgggatccagcaaattttaaatgggcgattgcgggatttatctttcgggatcccgtcccgcaaagttttgagttccaaaccgcagcgggacgcgcaaattttaaattttcttgatagagattagaacattttaattaccaagattcaacccctcaaaatcagtagaaaataattcgaaaattctcacattttgctgaaagttgtccaaggctccgtgattttggtcaccaattgataaaaagccaaaaacggagttcaaagagattgtaaaaaaagcaaaatagttccaaatcatttcggaaatattgttaataatttactaaaaaatatttgtttactttatatttgaatttcatttttaaaaatgagcaaaatgaaagtgaaaaccatttttagtgatttagcataatatttttagctgattcatcgccagattttcatataataataaatactcatttaattcgttggccttttctaaaaacggtttccaaaaaagaatgaaatatacaaacgatgctcatttatttgcatagaaattgacatttctgttgaaataaaattttaacttttcaaatccttcttttgataatcgcccatctggaagagtaatgatgatcagtcagtgcctaaacggaaataaaattatttttcgactttctggaaatcaaagaaatttttaaattggtatcattttgaaggctatgagtagggctgggcagagtaagttagttgaaggaatcaaattccgacaggggttttccattattttccgtactttctgtgctagaattctctaacaaacaagcgcaagaatagtactcccaggaatacggtagtttggtaaccaaatatttctaccttttctcgtattattcaatcaaagacccattaattaggtcgtgggttcgagtcccaccgggcgagtcactttaggttctacatcgatataatttatcctgggtgaaataatgccaattgaatgaaaccaagtttttactcttttcaatagtcaccctgagagccctaaccgatctttacgaaattcatcggtaaagttaaccaatttagctggttctaaaaatatcagtagggcagtgaatataaaggaatatatgtagtacaattccactaatagtattcatacatgaaagcagtttcgaaaaattcagaaatagaaaaaatatacattaaattaatggttttttccgtattttcaaaatattttttcactcttctgacccaattcttaacaatgaattaaattctcacttttcgcgctaaaatgcgaaaatgagaaacaaaaaggcgagaagagcaactcctgaaacaatttgtacaacaactgactcggtgagaacaattgattaattatgtcattagtattcgcaaaacatttagagaaagagagagaaaaagtcaaaagactctcgtcaattatttacaaataaatatttacggattggcaagcactaaaaaagaacataaaccacttgccgcacggtgctatgtcgttatttatttttattaaaaaattatgtggattatttgttgttgtttaaaagtagttttttacattacatattaactcaaggaccttgagatagatgaagtttggcttaattattaaaatcagaaaaatacttcaaaccctgtccctatttggcttcaacaatctttaaaatcaaaaataaaatttctataacccaaaaaaggaaacgaacccatttcgttctttagattttcaaaaaaaaaattaattttttttaaacacttatcaagcaactaatgaatgactaatgttgaagcctaatgatggtgatgctaataaggttcatttgctgctttttgtggttcggtggtgggaaaaacagtagcaacaacagaagcacaaaaaaccgattatcatcatcatcatcacattttctcataaggtcacacacattcagcattcatcaccaaaagcatcaaaggctaaatcgatttgtatcatcatcatacataattaggtaaataataattatgtaatttggctaattgtcccgcaagaatgtgtcattatctcgtatatttttagggggtttcgaggtcgatgaaaacagttacgccatccttttgacctataaaaaacaagaaatcgaacaaaatgaatttagtaatagtacggatcgtaccccactttttcgaaaaaatgtatttctcgagagtcgacacaatgatagtcatgatcccaaacgagagacttgggaacacaaaaaaaaaaactctggacttttctcaagaaccgagaccgatactttcgagcacagcacagggatgtcaatttaccctttgattttctccgcttaaccaaccacaaatttcctttctactacgcacatatgcatgcattatgtaaatgtgtgagtgagtgccgttgtggaaagataaaataattttggatggcaaatgccgtcgtcccgtgccgtgtgccgttggcacaaatttcacacaacggcagtcagcagaacattagagggcaaagaggaagtttttcttatttctttttctattcactccgcaaataatttttttttttcaaaattaattatttcactcattttcttttcttttccgggcaattttagtgcgtggcacttttagctttacactnnccnnntnncncnttcttggctttttagagatcccctccaaaacctccctcacccaagttccaaa

SEQ ID NO: 17894 - DNA, 2883 bp, Heterodera glycines
tctcgagaaaatttcgcggctcgaacagcactaccagcaggtacaggtcgaactcaatatgtgcttaccctttattgagcagcttgccgcaaaacaataatggtgatcttttttgcaaactccaatgtcgataatgcattttttgctggccgaatggatcatgccaatcttgcacattggcacttaacaaaattcatttttattttattatttcgtgttattctgatgccagaatttgaatggaatacctgaatttttgtgggaaaatttattcttactctataagccgagaaaattttttttgtttgggaaattctttcaaaatgagcagagaagcgataatttccgttttgaattatttaaatatttcacgctttttttggtcttaaataataattgtttaatatttttatgtcaaatggaaaattaattttttttttcatattcatttttgaattttgagggttttgaatcaatcacaaaaaaaaacccaaaatttttctttacaaaatgaaaaaataggtattatgcgtgaaacatttaccaagaatgaatgctgaaattgaattttgaggggtccactgcgtttcggcgccagcatgtttttggctataacttttttctacctaatccaaatccaatattgttgatatcattcgaaagcttaacatgtttagaagctttttctaagcgattgcttcgcgattagacaattaccaaaaaagttatacatgaaaatttcgaaaagtcgaaatttttgaagttttttcttaataaaattttttacaggcttgaaaatctatccgctttttgtaaggctaatagagcatgataagagctttcgaatgataccaacaatcttggatttggatgccaaagaaaaaagcttaagtggaaaaacgagctgcgccgaaacgccagcgccaaaacaccggcgccgaaacgcgtgggtcccgcatggaaatgggtcgatcccgaaaaaaacgtacaactgagtacctaagtcccggttttcccagccaaaaagtcccggtttttctcaaacttcccggtaccgtacaactctagttattcccatcacatcacccacttttcagtcctatttaaaattttagttggacactgcattgctaatattgtcaaaaatattcctttattttgaaaatattcaatgaaaactcatttgattaaaataaataaccaaagaaattggacgaattgaaaatgcaaaggcaaagaaaatggagagatcggtggggggatcaaaaacattttcaatgcgcttacaaaaaaaagaaaggcaaagtgcgcaccaacggagggagaaaatcaaaagcaaaatgagaaataaaacgcactcaaccaaaaagaaagtgagggaaaagacaaaaaataatgtgatcatccggagcaagaaattcatccattttcagaaattgaataaaaccgcgtcagaagcaacactgaagaaaaaaggaattaaaatttgcaaaataatgcaaactgtgtctatttccctgccccaacacctttaaattcagcaaaaacagtccaaacctcaagatttctgttgtgcaacaaaggacaccttaatgagaggcccattcagctgaaaggcgtgattcggcggcattttctatcatttaacagccaatttataggaaaatttaagcaaagcaaaacctctccggtggggtatttgttcaataagtaatccttctgcccgtcttggcgcatttccatggtcatggttccattggcgccacaactaatggagaattgctcgaggctgaactcgcattgaacgcgcacttggtaaatgttgtcgagacgatcctaaacaagaattattgcaataattgaagaaaagcaagagagagagagaacagagggaaaagtgggagaggagaaaaaaagaggggaaagacctaaacttttgaactaaccgattgcaatttgcgaatccaactcgtggcaaattcacgacttcggggtcgaatgagcaacttttttgagctttttttcgcctttttgccggtcaaccattttgtcaatgctttactttcaatcgaagtgatgtccaaaatagtgaaattgagctcctgaaaagatgaattttagctattcaaaaattcgaataaaattgacaccaaatgcaattcgtcgattcgttcgcacgcggaggactgaagcagctgcagatggtcgccggtcatttggagaaaacggcagttgctgaacagtgcagacgaaatcgcagtcagatttttaccgccaacaactgaaaaacatagaattaatattaggcgtttaatgatttaaacatacgacagtctccagggaggcacaacaccgaggcaccttttccggataagaatttggctgcgttaccaagaaacaatgccacttcgttggtcaattcactttcttcaagtccacctattacgatgatctcataaaggtccgaaactgaagaaatgccttcctaaattaagaaaattataaaactaaaattttttataaaaaaggtactttgattgtaagcttggatacttggccattgaccttcgcttttacttccacagtaagtgggccagtctccctaaatttaagctaacaatcaatcaccaaagattcacttgttaattcattttttactcggccctactgccaattcataaaatatgcaaaaaatttaaaagcacaaagaaaacttaaacaaacacacacttcttttgtttggatggtggtggttcatggtcttcatatccattttgccggacgttttcgtgaatcataacctccttaaaacatgaaatttaactttataagaaatataatagaaaattatatacctccctgattgccatcatcgtaacttct

SEQ ID NO: 17895 - DNA, 2698 bp, Heterodera glycines
ttgtacctcttctgatcacagttgtacctcttcttatcactcttctaatcactgttgtacctcttctaatcactgttgtacctcttttaatcactgttgtacctctcctaatcactgttgtacctcttttaatcactgttgtacctcttctaatcattttgtacctcttctaatcacttttgtacctcttctaatcacttttgtacctcttctaatcacttttgtacctcttctaatcacttttgtaccttttctaattactgttgtacctcttctaatcacagttgtacctcttctgatcactgttgtacctcttctgatcactgttgtacctcttttatcacttttgtacctctttctgaggccgcgaagcggccgaaaaggcccaactaaatttaaaaacgggcgcgaagcgcccgtctgaacttaacaaatttaaaaaacgggcgcgaagcgcccgtcaaagcaaaacaaaatatgaaaaacgggcgcgaagcgcacgtccgatctcaacaagtttaaaaacgggcgcgaagcgcccgtctgaggccgcgaagcggccgaaaaggcccaactaaatttaaaaattggcgcaaagcgcccgtctgagctcaacaaattaaaaaacgggcgcggagcgcccgtcagagcaaaacaacatttgaaaaacgggcgcgaagcgcccgtactatgccgcgaagcgggcgaaaaggcccaacaaaatttaaaaacgggcgcgaagcgcccgtcttgagcctcgatgtggactaaaaacccctaataattttttaaaaattcaaaaaaatcactccaaccaattcgatcaatttgaatcgcttcacagcctaggtagcgaagctcaagaagcgcgaagcgctttatcccaagcccagatccgacggttcacgcacccgctagttatatatatgttatataggttttgagtttcgtttcaaaaaacaaaatctcccggccgaaggccgggagtgccctgaaagtggtggaagggccttacaactttttgaggcgcatctgggaaaactataggtttttttctccgagggccaactgagtcccggcggctaatttctcacttttgcttgcgtttgatggcccataactttttttggaaaactcgaatcaaaaaatgttcgctgtgagggggctaagttgaagtgttttctaaaaaacaaaaaaaattccaggcttctacctataataggaagggctgcagaaaaatggagaaattcagtaccaactttgtccacttcagtcccaggcgaataactcgccagggtttgaactgagcgagggggtaccagcagacttattgtagagttcaatgagctggatttttccagtttttaaaatttggaaaattttcaaaatttttcgagctaggcctaaaaaacggttttcgggtttttgaattttaggaatttttaacgaattttcccagaaaaacggagaccacttccaaaacatcatttttcgagttctatcgactggtatttttttcggaaaaatttcgattttttcccggaaatagaaaaaaaatttggcctgagcgggacatttgagtcccaggtccataactcgtcaggggttgattttagcgaaaaattgtcttagaacatttttgtagagctttttaagctctatcgaacggtgtactacatgatgtaaaattttcaaaaattttcgagctaggccccctagaaattttcggaaatttttttttggacgaaaatgggggtgaaaaatatttttctggggtaaaataaggtgctgagtacgaatatgatgtctattttaagtttcataatttttggaattttttaaaaattcattatttttcgggaaatttttcggccctcagagattttcgggttaaattttgaaaattcataacaaatcgaagggttgatcatttttacagtaataaagccttaaaaatagagaaaaatcgggagaattttatgagatttatttggttttataatgttcaaaagaaaaaaagttattccagaatttctggaaattttcgatttttcagaaaaaaattcataactcggttctgaaaagtcatactgtaaaagtaaaatactaaaaaaatccgcaattttttactctattatataaattttatttggtagttttatcacttctttaaaaaaagatataaaaataaaagtgattttgtgcttcgggtccaaaggggggtgaccaggatttttgactggaaaattttttttcacaaaaatcttccaaaaacatgtcattatggctatttgagggtgctgatcacgaatacatgatcagatttcactttttgacatagtcaagacctcagaatccctgtgtgattggggattctgaggcatcatttttgggggggggggggggggggggggggaagttcgaatccggacggggaacattatattaattagatattgtttggtaattaaatgttttaatataaaattaatttcttatttatttttaaataaaagaaggaatttattttataatttttaaaaaattattaacacattcaatttttaattatatttttttataaaaccatttccttatttatttaattttgaaaccatattttacccttttaaactattattgtaccattcctacaatttttgagcctactaataacttctggactcttcgaatcact

SEQ ID NO: 17896 - DNA, 2585 bp, Heterodera glycines
gaaaaatgaaaaaaaaaacgaaaaatacacccctaaagatcaacttttggaaagttttgaaaaattacaccccacaaaacacgaaaaatttgagttttcgtcgtcattttggcattttcaataaatattttcgtcatttttttgcgaacatttcttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgagatttttgggggtttacaacatatattttggcattttttatccatattttggtccatatttggccatttttggcctttttagtccatatttcgggcttttttagtccatatttaatgtccatatttcgcgttttttagtccatataatttacaaccctaattattacaaagccaattataaaaacaaaatttatttcaaaataaaaaaatgtgtcaataaaaaaaacacccgtaaacatttgttaagtaagagctctcaaaatgttgcgcagattttcaggcatcaatttcaaaaaaaaaaaaaatcagaattttttccgtctcgtcttgtgcacgaagccgttgccgttggtggtggcgctcacgctcagttggttgcggtggagtggctggcgctgaaactggcgattcggactgaacaggcgagcctgggccgccagctcctggttggacgggctgtgaaaacacacaaatgcatggagtggggaataagaagcggccgcattggcatttgaaagcattgggttgtgccgggacgggccggaacccaatctcgacaaattgggcgggatttgtctaaaaatttttttggagacctgattttttggcctcctgattttttcaaatgaaatcccgatcaagatacgatggaaaaaaccaaattgactaatccgaatcatgtccaatttgcacccccaaaaaatggcaatccaattttttttaaatccaatcccgatctcgtttggagataatcacttccttcccgctttttctgctgatcccggtaaattcccagtcagcagcaggtggtgggcgccgtcggaaaaattgaaaaaaatttaacgaatttcatcaaatgtttttttgccgcttttttttaccttccatgcctattttggcacgatgaaaatttgaaattgctcactccacctgtaagtgccttcgttggcacgctttcgccgtgcacagatcacgaagaagtagagcagtgcgaccaggcaaacgcacagcacaatcagcacaacaccggcaccaacaaaattggacagggacaactgatgctggggttccacctgtaaaaaattgcaaaattctaatttttaaaagaatttttttttttttttggaaaaattttggaatttggttgcatttgacgagaagcttactgtactgggtcaagtatctcggaaagaagcttgtaaatctcagttgattggtcaattatttcaaaaacttaagagcgtccctgcccccctcctgcccttaaatgaaaaatttacttatgaattgggtaaagaattttttgtttttttaaatttggagcaacaattaattgactttgggaacctaattattaacagcgggtactgtagccccctatatgttctcaattagcctgggtaatattgagaaaatttcgctgattctcaacaaaaataaggccaaaaatgttatgctgaaaactaattttggaagttttttgatcataacttttttgaaactcagtgaaatttttcaaaattttgtatgttaatatagaacatatagggctatcaaatattaataaaatggttcaatttggataaccatccatgaaaggagttatttatactcaaaaactggactaaagttttcataccaaatgcatgcacagctcgccagtgaagccttccatgcactcgcattcgtgttgaacaaactgagaaattcaaaaaaattaataaaattgttaccgatcactaaaaactacttagcagagtgatcagagctagttagcttgtcaagacagatcagtaagcctatgcaaatcacagcgatcagcaggataaaggccataaaactcgattagaccaagaaaaatagagtgctgatcagtccgttcacctaatcagaaactgatcgctactgatcatcaagctaatactagtgatcaggggatcaacgagaatttgatcgcaacacatctagtattatttgagtcagttggtgaatcagtaattgagatccaggggcgtatcaagaaaatttttcgggggggggggacccgacccgaagacctttgttttctcttttttttgctcttcaactgaagatttttttttgtttgcccaataaaaaaacttttttttcccgctgctgggtgaaaaatgcactttttcactaaaaattacccaattttggccgttttaaggcaaaaaacgtgtcaacatagtggaaaatggaggtccggcggtgccgataggcgcggccgggaaaattttt

SEQ ID NO: 17897 - DNA, 1940 bp, Heterodera glycines
atattttgcgggtaattgatcaatatacaaaaagtaatacctaaatcaaaaaaaaatttagaaaaataccgtattttatactttacacagatattgtaacagcaaaaaaaaaaaactgtacctgtgaagccgggaatgcatgtgcagcgaaagtcgtcgccgccgtcgctttctgccgactgcagtggcatgcatgtgccgccattctggcacggttcctgctcgctgcacacgtccacgcgctgttcacagcgtgtgccgcgaaagttgcgcttgcagcggcaagtgtacttattgttgttggtcttgttgccgtcgtctgcgagctgtacacactcgccaccattgcggcagggactgtctgcgcacgcgcccgccaactcgcagctcaaatgaatgaaaaatttttttttgaaaatttcagaaaaaattatttaaaacatcaaatcaaacaaatatatttaagacatttttcgacaattaatataagtttaattattttggttttcatgatttcgacaataaaattttgttaggtttttttttgctccgacgaaatttttaaaattttacagaaatttattttcaaaaaatgcatggaaatttttgaaattttgcaggctggtagcattatgccaaatattttcctgcaaaatttcatactaaatttctgacaacacaacattagatttgcttgctcaccgatcacccaggtagaacggcgggcattggcaacgaaatgcagcgccaattgcagcgttgtgggcagcggcgccaccactactggcggtggtggtggtgccgttttgctgctgcagcgcaacgcatgtgccaccgttgacgcaaggcaaatcctccgcgcacgcgtcaacgcgaacggagcagtcgcggccgcgccacccgttgtcgcaaaggcaacttgaagaattgaagaaaatgcgaaaagaaactttttttttttactatttattgttaattatataattaaaaaatgttatagaaattaataaaattttaaaatgtatcagggaagaatcttttaaaattttttaaaaatttaaacaaataataatttaaaaaaatttttttgctatcgaaattacagtaactattaccaacaaaataatgaacaattaattaatttccaataaaaaattatttaataaataaaataattcgtgattattacaaaagataataattaccaataaaataattagtaataataactaagaaaataaattgtaattaattacaaataaaaaaaatagtgattaattagcaataaaataattaggtatatcaatagaataattagcaattaataatcaattaaataattaaaatgtttatttgcctaccgatgcccattccacacgttttcgcatttgccatgccccgtgcacgctgcacgcgcacccagtcgtgaacacgtgtctgccaactgctcgcacaacgcgccctcgaactcacgcgtgcagtcgcaggtgaacaataatgacgaggccgaccgcggtgaagcgtgtggcgttgctgctggcgtgctcagtaagtttggcatgcacattcccccattggcacatggctggtccctaatttttttaaaattaattttaaattataaatttagaaaaaagcgtttttaatatttgaataacatgaatttaaagtttaatcaaaaatgggcaataatataaaaaaatctgtaaaaaatttaaaattaccaattttaaaataatttttttattattttaaaaaaagtgagaatgaagaaaatattttaatatcttatataataaatttattaaattattaaattcgaattagatgaaaaattattaaataaataaaaataatttttaaataaattgattaataaattgataaaagtttaatttaaaattaggaaaggtttgtttttaactaaaaaatgaaataaa

SEQ ID NO: 17898 - DNA, 2669 bp, Heterodera glycines
  misc_feature (24)..(24): n is a, c, g, or t
  misc_feature (2612)..(2612): n is a, c, g, or t
tgtaaattcatataatttataccnctactaataattgaccgaaatggttaaaagatattaaatatttaattttaattaattaatctttgttttttgctcagggcactttcctttttaattacctctttttgtaattcaaatccttccctgtcaaaggaaatctcaaaattgattatttaactaatgtttcccctttttcccaagtccgtccatttcgggcggataaaaattacaacgtaaaattattgcaatcactcggccaaggaaatttgaccctttaattcccgtgaataaagactactaaaccatatatttatgactttaacagaactttttcgatgttttttaattaatatttattttacagaaaatcctcttcatgacaaagtgccgccccgaatcaaaaaatgccgccacagcaaaatattatttccttgctcataaccgagttcccccttttcaattaaaatgataaagctaagaaaaatcccaatcgaacttattgctgaaagcgcccgctttgtacggttcaatcgaaaatgggcaaattgtcgcgtgtcacattcatttgaccactttttgcttgaaaagcatgggaattggttgaatctgatcaaagaattggtcgggaggaggaaaattaaacaatttagctaattagacaagcataaaactattcaggtgaccaaatgcttttcatccaccgagtcactgttcaacaggattgcagaaatcccagacggattgtttggcggaaggaccccgctgggcggacaaatgtgcgcaaaacggttcgaagcggaaagcctttacataggtaatgtactggcacaaaaatgtgtgaaaactcaccgcactgtcaccgatacgggattgagaaattgttgaaagaaattatttattttaattaaagtcagaatgattagggattgggttggtttttggcaaaaaaaactcgcatattctgattttgataaacccccggatatatataattaaatgaaatatttaataaatgtaaagatcaaaattattttggttgcaaaaatttagcggttgtggattgtgttaataactgcccgagttttccgaacttttgtgacttaattgacctcggtctgagcccgaacgatgctaactacgcaagtttttcattatcagtatattaaatgtaaattatgatatttctttaaattcacaaaccaattaattaaatataaataataaatcaaataaaaaaaaacaattcgttaggttgttacgctgcttgaacgctcccgttctgctgtgcaggactgcatttactcacacgacgccactttggaggacctgaaaacacttggcctgtgtaagtcaatgacgtatgaagcatagaaagaaatataatcataaatttataattaaaaaaattaatttatttttttcacaattaatattaatttcaatatatttatgaaagaataatttgacagaaataattaactcattttttacagttcttcgtacagagaatagtcgcattactcgtggctacaaaattggaattggaatggcttagccacacacgacgaatacggctttcaaatgaagaaaaaacattgttttaaatatataattttcatcttaaaccgtaagatctcgtctcaatggataaatatataaaaagtctcaaagccttatttgaaaattaagaatgatgacctttttgtccgttttttaactcgattttttgaaattttatcacaaaaataatataaataattgaaaaaatgaacattcacaaatgaacacatttctgtggcgggagagccaaatttaaaaggccgatcactttcgctctgatcacttccattctatttattccgctggaaacacttcgggctcggattctttcggcattttgttgcagctaacatccggcattgaattgcaaagaccttttttttgcttttaaatacgcatttttgcaatccgcgttttcaaaaaaattttggggaaaaaaggggaggaggcgacgcctataggcgctgccgggaaaactttgcaaatttcagtgtattttttaacaggttttcaccaaaattgcggaatttttgcaaattattttattttttgattattttggatcggttgcaaaaaagcttagcattaatgccgaatgatttttactttttctattgtctgattaattttagtgcttaattaatgataaatccattcttttgtacatacagggtaaagatataaggcttagtctcattttaagtcaaaaagtctcacatttacaaaattttatcccaaatataaaaaacagtaaaatggtcaaatttatagttatttttcaaaacccattatcgcatattttttgtcagagattcttgtataaattttgaaaggaaaaatcatttgactttgatgctggctaatgacttcttgtttatgttcttttccaaaaatttttaaagcaaagtatataaatgagtggattgatttatcgtaattaagcactaaaactaagcaccaaaaacaaaagaaatattaaatcattccaccaaaaaattcttaattgctaagtttttgcgtggctggtcgtttcctaaaacccgccaagngctaggaaaaataaaaatgcaaacatataaattcaaaacttggctcaatttcactaa

SEQ ID NO: 17899 - DNA, 1561 bp, Heterodera glycines
ccccccccccccccccgcccttcaaaattttgaaaaataaataaaataataggagactcagaatttgaaaagtttttataaaaactgatgacaagctaatgtgataaaacaggttaattcttttcctttcagtattcctgcaaagtttggggcgcttctgataagtttctgaaaaaaaagttaagcctaaactttttggcctgtttaaaaaggaattaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaattttttctccatcttcctttttgatactaaagcatcagagtgctaaaattaacttgtaaataaaatttggtgcgctttagagcactttctgaaaaaatatttatgaaataaaaaaatcgatttattcaagtgtccgtttggggtactcaaacaattatggggagggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaagctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaaaaaaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgat

SEQ ID NO: 17900 - DNA, 2852 bp, Heterodera glycines
actgataatcgcaatgctggtctttgttttcaattctttttcgctttaccacatttctcgcgtatgtttggtatattttattagctacgcttttttaaataatatagtttgttattctcgttgcgacattaaatgatcttcgtgaactttatctctgattcacttacataaaatttttaattgttaacaaattaccatcatatttacaatttcaatttccatataaaaacaaatagtaataggctgaagcagatatatttacaacatatgcatgaaaaatgaccaaaatatgcacctaaatatacaaataaaattgtcaaatatgcatcaaatattcacaaaaatcgtaaaatatgcaccaaatatgcataaaaaagttgaaaattagggggtgtaaattaaattaaaaaaatttcttcagcataaattttatcggttgttttttgcaaatgcaaatcaaaagtttctcaaggttttcggcagtgaagctcactgttgatcagggcgcggaacaaaaagttttcaaaatcagaatatcgggcccaaaaaatcagattttggggtcaaaaatcatgacattctgcaaaattgctttaaatcaagtcatttttaaattattcgatcaaaaatgtattaagtattatatttttcgcctccattatcgaatttaacaatttttttttcggcgcatttttccaaaaaattctggtgaacgggcgaggggaggggctccggaagtgccgatagccacaaatcttatattttcttgataaaatagtgacattctgccacaaaatttaaacattgcgaatatgtttaagaaatcaggaccaaatttggtcgatacaaccaaatcaggacgaatctgataaaccaggacagatccgcgccttgctgttgatccactcgcgcatccattcaaatttggatttaattttagggcataatcaaaattttttcctaagagatattcaaattgtaaaatatttcacaataaatggcaaaatatgcaaaaaatctgaaaatatgtacaaaaaatggcaaaatatgcatgaaatatgcagaaaaacccaaaatatgcaaaaatatgcaaataaaagtcccggtttttgtaagcaaataccaaaaagaaggtgtttttcgtactatttggactacgtagaatccaggaaaaaaatgcatttgcataaaattttgtctttatttgtgcgtcatcatcatcttagtcgaattcgttattttcttatataaataagatttgatattaatatgatacttaaatgatatacatacttgatgttagatcatcatcataaaaaagaataatatatatatatatatatatatatatattatttatttaagcatttgaactacaaatattttttgttcctcttattgcttttttattattttgcatttattttcttaaacattttagcttttgaattattaaactgtgaattgggttttagcttttttttattaaatttagtgtaaaacatgtaaattttaattagcagtaaattttatttgttgcaaaaatgtacttttaaacaaattaaatcacatagtttttaattggctgatctatttatattatagaatacattttttattataaaaaacttattttttcatcgttttatatagcacatttctaaatttttatgctaatgaatatattttagatgttaatcaaatttgtattttttaaaatcaaatgagaatcaactaaattttaatagtgttaaattttaaatatattattttacctaaaacaaaagttttttgatgaataatcattgttttgttaacttatttattaattgtcattccaatatcaagtgacaaataattattattaggttttttcttctatttttaaatgaactaattatttgtttatttgggtcttttacaattaccaattgtcaaattcttcatgttcgtggaaaagtatcattttcaggaaatgatctcgcgacatgcgaaatttcatttcaaatataatgatttaaaaatattttattgttaatatacaaatatgctctttgggtttgcctaaattgagtttaaattatttaggtttagttagcttattaattttgttgtttctgttgataatattattatttttgttatgaatttgtttaaattttcagtcccaattttatttttcccatagtttaattgattttagtattatcagtattctgtttaattaactttttggaattttgtcacatttaaatatttgttttttgatttaattcattaatttatttatcatttctcttctgttatttgcctcactgtttagcttattatatttggattatttaagtattatttatttattatatatatgttatataggttttgagtttcgttgctaaaaccattttctcccggccgaaggccgggagcgccctgaaagtggtggaagggtcttacaactttttgaggagaatccgggaaaactatagagaaaaattcagcgcggccaactgagtcccagcggctgatttctcattttttcgtgcatttgagggcccctaactttttttctaaaaccctgaccaaaaagtttccgctggtaggattttaagttgaagtgttggctaaaagttaaaaaaaattccaggcctctacctataataggaagggctgtagaagcgcggacaaattcagtaccaactttggccagttcagtaccaggcgaataactcgccagggtttgaactgagcgagggggtgccagcagacttattgtagagttcaatgagctggatttttccagtttttaaaattttgaaaattttcaaaaattttcgagctaggcctaaaaa

SEQ ID NO: 17901 - DNA, 2103 bp, Heterodera glycines
aaaaaaaggaagctcccaaaaattcaaaaagcacaaaaaataaatgtcaagttttcttcagcgtatattggcatcgctttattatgaaaaaatttttattttctttcacatgtgatttatgttttcagaaatcttcccaatccacaaaagatttttttttgcaaaaaaatattttttaaataattaaataaacaaaaaataaatttataaatttcaataattgtctatttcatctttattttagtttaaggtatcagttattgttggcgttcaatttttatgatgaaatgataaaaattaatatcaaaaaataattttgtgaataccacaaatatttatttattattataataattctctttcatattattacaacttcttcaattgctaaattgaatttttatttattttttaaatacttttcattttgttatgccacgaacgacgaatcatttgttaaaatgtaattttattctcttggctgttataatagccgataacaagattttcttggatgctttcatgaagattaaatatattgtatttgcacattattaaattacatttcttttttttaggtctttacctattttttcctcaactccacgtggcttgaaacgcactaaaaacatgttttttttgggggggggggggttgttaatttgtaagctacgtttcgagttattagcacctattttctaggtttttattttagcacctaaaaacctaaaatttttagaaaaaacttattttcacctattttagagttttgcccaaaatttgttaacaaaaatgcaataaaaaggaaaaatacaccccctaagaatcggcccgaaaatttcaaaaacacacccctgagaaatgaaaaatttctcaaaaattcacctccataatttatttgtttattttcttgacgagatttgttcttttgaaaattatgtatatccttaattatttggcataatatttttgtttttgatgaaattttcgattttacacccctaaattcggaactttttggcacctattttcccattttagcacctaaaaattggagccctagaaattactaacttaaattcagtaaaaaagatttcgcgaaggacactaatgacaattaattgattaataaaaatttcattataaaacttatatgtaccgcaaaaattagtctaatgattaaaagaattaaaaatgttaatctatgatagaatacattatagttagataattttgaaaaagtcccaccaaatctgtcggtgctgttacacactactcgtgctttatcggcaatcgccgtggtgctagtgcgtttcttaaaaactgccaccccccccccctccactcattttatgaaaattcttgaaaaattttaaaaaattgaaaaatattttgggaatactataaaaattccgggaaaattaacagttttaagaaatgcgcagccccattttggcagtttttaagaaacgcgtcagcacgaattcaaataacaaattaaaattaatatcttttatataataatatttttttgtaatttaattataaacattggaaaatccaaaccttaatattttaactaagtaaaataagttaagaagggaacaaaaattaagaaaatgtggcttgtacacaagaattttggaaacttaaaattaatatttaatcatattatttttttatcaaattttaatgaaagataatatagaaaatataccttcaataaatttatttcattaaaaattaaaaatcaaaaaaaaaataatacttatttaaacacatttaaaaaatatatattaacaaaaaaatataacaccagcacatttgatttatttttttttaataaatattgtttattttaatttttttttataaagcaccaaaattttctagaataaattttttgaaatttataaatatcttaaagatatctgaattaaatgaaaatttatttaaatagcactagaaaattactgtttaaaaaataattttaaatttaatatttgtaaaatgatacttaaatccaaattagcacctttgaaaaaacaagtattttaactaatatctctgttaaaatattatttaatttttcgataaaatata

SEQ ID NO: 17902 - DNA, 1475 bp, Heterodera glycines
ttttaagtggtttttcctagttaagcagttaaggtgaatgaaaaattttaaaatctatagttttggaacagcaaattaatttaaaatttttcaatttataatagaaaagtatgatgtgtatattaaattatttatttatttatttatttagactaattaagaaataaacagtaaaaaaagtttataattcgtattattatcatggccaatttttttataattaaaaacttcactagaaagaattgactttaaaaaatttcaaaaagagagtttattattaaaaacccatttttattaactatttcactagatgttaaaaataataaaacatgcattaagattaaataaattttgcaaatattattttattttaaaagtaatattttgacttatttatcaattaaactttaactattttatgaatgaattccgttaataaaatatgtaaaatataatattattaaatgagtatgaagcagatatgattatttctccagccaagtcggtcgcttaataatgacgggaatactttcggtatctgtgggaatgaagcatttctggaatttgggagaattggggatggtccaaaatacactgtagttttgctttaaccaaaaatagaaaaaatgtttttaataagtcatgctgggacatttcttaaaccctaataaattaaaataaacttatttcaacaattgcttaataaattatttaactaattgtttaaatatattttaattaatttgaccttaaagctaatttttaaaataaaacatttaaatcaaaaaaataaaataaagaaaataaaatttatttttttcttaatacacgaaatgagtgtgaaaaataacagacaagagaatttcaaaataattttaatttttaataatgaatatattttaaataaaaaatttactctattctattaaaaaaatataaatgaatataaaactaaaataaaatttaaaactgaaaatgtataacaaaattgacaacaataactctacccacacacaaagtaagatctgaagatcatttcgagaaaaatgacaattggcgcttacggtgcagaaaattgaaaatattttggtaagttaaaaattttaaagcttggttcaaataattcaagtaaaaataataatttcaataaacttaatataattaattttaagactactattgtaatttaaaataattaaaactttaaaaaaaaattaattaatattgaaaaataaatgttatacaagaaaaaaattgacaatttaaaaaacttgttagaaaatttgtttttgtttttccttaatttttctattttgaaaatacaattttttttttaatacataaaaggatggcaaatggaatattaaggaaattgtccgtttttaaattgtcattattttaaaataaaatggaaaataaaagcaatcagatatttatatgaatgtgtttacaattaattattttaaagtaaagaa

SEQ ID NO: 17903 - DNA, 2967 bp, Heterodera glycines
ataggaatatcagtacttattagtattgcacaccctcctcccctgttacttacccgatttgctaaaatgggtatatatttgtcacctatagataaatctgatgaaatcgaatttctggtatttaaccaggtctcggaaatgattagaatttttggttgcttattttcaattacaaaatttaagtctgggatcttgttagagagtgagcgagcattgaaaagcaaaccttttatttcatttataattttttgcggcttgctcgcgcacccctacgaaaccctagtcctgagtggttttgggttggacaaggttttgagttccaggtcaatgacgatgtatttatacacgccagcggcctggtttgcctcaaaagccttttttcggaggtcatacaatatttgtagttcatttatggtcatatcacgtctagcggtcaaattatgaggaatcacaggcattttgagaagtgtggagcggaatttataaaggaacaaattgcgggatttttgggaggaaaagggaattttaacaattctcggttttgcattttcctcacgtgccgtccgcggatgtctgtgaacattgtcgaggtcaatttcgcccagcagaccacattcttcagcaatttgtttgacaacgtccttctcattgaggtgttccggcaggcgttcaacaactgctcgctttgacttttctttgatcagttccgagtcgacgatggcactgttgagcattcgggcaatttgggatggaccaaattgcggaggacagccccatgggatttttggcgtaactgtgggagtactgttgttgtatccattaatttggggatttgttgccgtttgtgcgacaagggttgccaccaaaccttctaacttttctaagcgtaaatttagctgatccaaagaattggcagcaactttctcttttccatgggcttgcaaaagttgttgaagcaacttttcaaggttgtcaattcggtgagagaatgccgcgaattgctgctcagacgaacttgccgaagtgttcgccaagtcgtcgtcgtgtcgtcttttagatttgggcattttttgggattttttggaggagagaaaagggtttatcgattggtcaatttgatgaaaaagatgagggaatgatgaaaaagatgagggaatgaaaaagatgagggaatgaaaaagatgagggaatgaaaaagatgagggaatgaaaaagatgagggaatgaaaaagatgagggaatgaaaaagatgagggaatgaaaaagatgagggaattatttttaatgaaacatttgcaattttcgtcgaaaaaaatgcttacgcaggagcagaactcaaacttcagaataaccaatccaggtccaggtccaggcttttttcaaaatgtcgagctctaggaatgaccatcattaatagtaaaatcgatgagaatagctattgtcttggatgaggctgggttattccatccattcattctttccacttactggttataaagccatttatcatgtcttgtttatacagttattagctggtattgccaatgataaatgagcttaaacaaaaaatttaattttttatataaaatgattaaggggtttttgcgcgctcagcaacttgagagagaaatcgcaagtttacacgagcagaatagtatcctgatggcagaacgagtcgaggtaagtacgattgggcatgtgtctttgggcttgagttcacactgattccaagttcccaattttttacctgcttgtttgtccataaagttatacatataaagaccaaaaacagctaattttggggttccattttctatttaaaacgcaaaaagaattgtgctttgtttattgaactattctttattttttctcttttagcgaaaccgcgacattgaggaaattcggcaaactgtgggcgaaatgcgcggatttcttttggagctcgtacaacaagtaattcgtagttttcgacatgaaaaatgggatgcctacgtttcagggcttcaaaaaatagtgaaaaagttatcatgattagacatttaaaaaaaattgttgagccctcttttttgtttttaataactcaaaaagaccgtgtttgcactattacaaaatttttaaaattaatagtataaagctctttttcgacatagaaaagatttttatataattacagcgcgagaatgaattgggacagctgcgtcaagctgttcagcaagtatgtttggtgtattcacttgaaaagggtgggtctttacggttttatataattatagcgcgagcgcgagttgcaacagcgggaagaagaacttggattgttgcgtcgcttctttgtccaggtatatttagttcaaaactccttttttaccagtatgaggatagttttttgtggcaaaaacccttgaacaatgctctaaagtcaaaaataagacattacttaaaatttgcatttttattctccgatttgttctccttcacccttatattttttctattccttgtttcatgttggaaatgttggtggcattgtaaccggtggaacaggcggcactgacgggaacagactcggcggaagtggaggcatttttggggacggactcctccgaagtggaggcacttcgggagacgtactcggccgaagtggaggcacttcgggggaaagtggaggcagtgggaccggtggtactggcggcactgacgggaatagactcggcggaagtggaggcacttttggggacggactcctccgaagtggaggcacttcgggggaaagtggaggcagtgggactggtggtactgacgggaacagactcggcggaagtggaggcatttttggggacggactcctccgaagtggaggcacttcgggagacggactcggccgaagtggaggcacttcgggagacggactcggccgaagtggaggcacttcgggggaaagtggaggcagtgggaccggtggtactggcg

SEQ ID NO: 17904 - DNA, 830 bp, Heterodera glycines
cagcggaatgaggtttaacggggagacataaaaaaggaaaagtgggttgggtttaagtccgatggaagttattaaaaccaaaatgactattatttgcagtcatgaatataacaccaatttcatcgtctctccctcatcattggttttttataagtttcgaaagagtccgcttttgacttttccttttttgcttcccttttggtctttttggcgtttcgttgcgttctttcgttcgcttgtgtgaagtgaccctttcatttgttcccctctctgcaggaatgggagcgtattgagcgtgaacgtcgccaatacgaggagacggagttggagaagcggcgcgaattggaactcgagcgggcggaggcactgagacgcgagcagcagtggttggagcagggacgggccgaacgggagcgactggaggttggccaagcgaactccatgccgaaaacagaccgccttttacacagattgaacgcattaagcgggagcagcgagaaaaggaggaacgcgccagagagcgtgcaaagcaagaagtggaacggttgccacgcgaccgcgacgagtttgaacggttggagcgcgagcgaatcgaactggagcgacaggccatggaactgctggtacagcggaatgaggtttaaggggggggggcataaggaacgacttgagaaaagtttggaaactcagcaatgaaaatctttgcattccattccttcccatttcgaatgatcacagttaacttatcaaagttgggtttttcaaacgctttgttgcggcacattttttgattttgggaaactaggggacccggcagcgcgatagacgtc

SEQ ID NO: 17905 - DNA, 929 bp, Heterodera glycines
tctcgctaaaatagcttttttggcactttaatcatgaaatttggctttttatttagtacattcgcgacagtttgaaaatccaattttgctcctttccttctccctttagccgtggttgccatggcacgtcgactcggagctgtacccgcacaagtgctatcccccatttgtgcaggtcaccttagcaaaatctgttcaataaccattttaatattcccaatttttcagggctccagtttcgtaatttcgcgtgccgctgctgcggaagtgcttcggcacgtgtgcgcctttcacggctttgccattcatctcgacgacattctgatgggactgctcaccaactgtttgggcatttcgaacagtcaccgagacgggtacacatgtcttctctccctcattggttttttgtagagtgaagcgggaccgggacctagtagcggacaccagtatcgaggtcccggttttgaccagttttgaccgggaccgggaaattcccgtgttttttcccggttttcccagccaaaaagtcccggtttttcaactcgaaatgtcccggtttacctcaaaattcccggtcccgaccaaccctaattttttgtaattttcaaatggttcatttttccactatatttctttttttcctaaatttggttgtacatttgtatctactgtataaaatgattacttttaatgcctaatctcacttacaattaattagttagctaacttttatcctattccgccaatttttccaaatgttcttcgctcttcgtaattctcttctcctccactttcttctgttagcatttgccgtttcttccattgcttttgggtcgcccattgttttccccgctgacaatcgtacggtgtccgatgaccccaaccgtaacagttcgaaggtgccttggtcatatggcacttttccctcc

SEQ ID NO: 17906 - DNA, 1926 bp, Heterodera glycines
gagtcgggtcccctgttctgtgggcaattcccgaaagggttttttttattactcaaattttcttaaatccgggttaaaaaaacggaaatccagaatcagaagttcaagttttggtaatactatcgatggtgccgcctttttttggaagaaattttttggttctaaaaaggccgtggaaacatgtttacgggggtttttagggttgttgatcatgtatctagcatggcgaatagaaaataaattgttggattaaaagtgattgccgtttattaacaaaatgccatggaaccaagtcgatcagtcgaccaccgaccaaccgatcagaaatatcaattgtacacaaacaaattaacaaaaataaataaatgcccaaatttggacgatcattaacaccaccgtccgtcgccactgttaatgtgtgtttaattaatgtaaatgattcgattagccctctttgtcctacgccgctccttctgctgatcatcacgcctcacgctgtcaaatctgatcaaaccaagtccaactgaggaggcgttgtgttttgctcgactgatcattcattcatttttcattcattcgtccgttggcagtgatccgaaacaccggcgtggcgtggcgttgttcttgatcatttaatgttttatttatttttcacatttcagcatggttatttacgtactatgtatgcatgcgtttaattgatggaaaaaaagaaaaataaatgaattaaagtgaaaaaacgaagaaaacccattcatcaataatagatttttttattctcgatacgatttattcattttttgaaacgaaacttcatcattagaatgctcagttgcatctgcaggttaatggaaagaattttaagcaaaaatatttacaattttctattaaaaaacaaaaaaatttcggaatttcaatttggttttgttagaaataggtctatgtacaacgagtcactaataacagttgtggaagattggtacgaggcaataataaatggaaaaaatgttgactgtatgcttttgttagattcgtgatcagcgaccctgaaaacccctgtaatcgcgtttttaacttttaaaatttatttttcaaaaaataggtgggttgtcattttggggacaccctcgtttcggcgccgctcgtttcggcgccagcccagtttttggactataacttttttctttgtcaaccaaatctaacattattggtatcattcgaaagctctaagtgttctctattagcctgctaagtttcaaaaaaaatagttaatgctcaaaaaaattatgactagaagatcaaaaaaccaggccacatgtgtacttttgaccataactttgttcaaaattgatcaaattttttggaattatgcaaaataatagagcatcagaagggctctcgaatgataccaacaattttgaaaatttttcagggcaccgccggaccccctttcccctaaattttttggaaaaaatgcgccgcaaatttttttcatttcgaataaaatttgagaagtgctaataaaaataccaatttagtggtggttttcggggggccttttacataaggtttatcttatgactaaagagtggtaaataaacacagtctttaagacagcaaaaaatggtagaggggggggggggggagaattgtgaagtgaacgaaaaatggaatgccgaaatagtataattctcattattagggcttccaaaaaaatggatataaaaccgcgaatatggcaatagaatatgaaccaaaaattgcgaaatattgaattagttttccaagttgagggtataatttctgaaaatttcttcagactgactaaatataaaataaaactttctaaatggctaataaagcattcaaaatcattttataagagagctaaagtttactaaaggggaaaaaacaaacttaaaggcg

SEQ ID NO: 17907 - DNA, 1927 bp, Heterodera glycines
  misc_feature (1907)..(1907): n is a, c, g, or t
taaatcagagtcccaagttttttttttcaaaataagacaaaatggctcaaaaactaagattcagacctcaaaaataatatttttttctaaaactaatattagcgcgaaagaaaaccaataaaataattttattaacataaatcaattgaatattttttcccgctgatcatttttttcattttaccgcatatgcacttttttgcgtcgcttttttccaaaaaacttatttttaaaaaatttcagaaaattgtaaaatgttctttaaggcattttgggcaattacactatttgttaacagattttcaccaaaaaatgaccaatttttacaattttgagccaatttttttaagaaaacaaaagatttgggggccggcggtgccgataggcgccgtcgggaaaagcctgaaaataagggcaaatcttacaaataaggacatttttaatttctaagacctagcacctccaaataaggacaaatcttacaaataaaaacacttgtgaacttatgctaaatccctaatgttcattcggttattttaagcctgacaataaaccaatcgagtggattttgcgaattgtcgatggaattgccaatccgatcagtcgctttccggaattggaatatgtttgttctaaaaaattatgaattaaaagcagaatttagcgcaacaaaaaaatcagtatgtcaaaatccaacaaaaaaacgaaaagtgtcaaattaaacttctctcaatgtgaagaaaatcaaatcaatgcctccgctgattggcaacaaattgtgagtggtgcgacgactgaccaagacaatttattaatttatggcactttagccaacatcgtccgggaaaaactgcagcattcaaaataccaaagatgacggaattactccatttaattccgattgcgagaaggatgatgcaaatttcgagatgaacgaagaggaacagttgatgagcatgttagatttggcatacaatctcgatgggaatatcatcaacgaagtgatgagcacaatcgacaaaactttgaatggcaaatgtgccgtggatgaactttcgagcacatccgatccgacatcgataaatggggaatgtgcggaaaatggcaacagcggaatgatttgcacatccgacccaactttaaagggagacagttttattctcgaagttccattttcaccgataagaagggacaaatgcgttgatgaaatggatgatggagagattgttggtgataatcaaaatgacagcggtggtgataatgaatgtgatcggagagcgattgtcagccagcagcaggtgaaagaagaagcttatgttcagtgaaatggctgtaaaacgttatcagaaatcgaaagaattttcgtcagtgcaagcggaagaaagtgagggaaacgacgacgacgcttttgtgcctgagccaatgactccgcctcgtccgaccaccccggcagactgtgagacgggcattccttcaccaaagacgccgccaccggtcgcttcctcccacccgacacgcatcaaagaagttatcgaaatgcgggagaatgaacggaccgtgcgcttgttggacattataacactggattgtgacgatgaatggtgatgctccctatttcatacattgttttccaaacattttcatacggttatgcttatttgtcgacatttctattttttcggaaattgatgctgtgttatattgaatattttttgcttgtgtgtttaatttgattgagcagcgaatattagagccccccgactctcccgtttttctctgcaatgcaagatacgcacgaaaaatgtttttctttgtggttgttaagcctgcttttcgagttattcgggactagtttctaggttttatttttagagcctaaaaattttcaaaaatcttattttggcgtnttgtccaagtatttatcaca

SEQ ID NO: 17908 - DNA, 1158 bp, Heterodera glycines
  misc_feature (1153)..(1153): n is a, c, g, or t
aaaaagtaaattcattacaaaagcattgcaactttgcattttgttcaaatttctctgttttaaggacttcttaacatcgctcgagaggttcggatgcgcagtccggtgacgggctctcaattcgccgcgtggggtgggatgttctctgtgatcgactgcggcctcgtttatatgcgtcgaaaggtaaatttccatggcatttgaagaaattggacaaacattaaaatcatattttttctgcattttatgtgacttattggaaggaattttctgataattaacaaatttttcctgggtcacaccttaaatagggggggggggggcggggtcgacccgctgactgttcgtatgagtggccgaaaaatgggggggggggacttcatattttgtggacaacgacctgaaccttgaaatcctgattttccccggacttaggtttgcatctcatgaaaacccaggtaaatctggaaatcaaaacccattcatgaaagtatggattttaacattttatcgtgaaaatccctgaaattggcgcgagaaattgtgattaatttttttgaatgatcaattttatagggatgataaaaagttaattaattggcaaggcaccagggatggcattccgaggccccaaaaattttcggaattctggggtcaaaaaaatttcggaaatcggaattccgactccaaaaatgtcggaattccgtgccatccctgattggcaccacatttacgggctggcgccaaaatgaattgttcccaggttttatgtgcatttttttaaacaatcaatgtttctgaatctacaatttttcttggccgggtttggcatggaattcatttacaggctttttcaaaaatatttgtttataatatattcaaatacacacactaattatgcaatgccttataatgttaaaaattaagaacagtgacaaacacccaaaaataatgatcaaacagcaattattaatcgtattctcatgactcggactttccgtttaggaagaccctctaaattcgatcgctgctggcggtctgaccggcggtttgctctgtgcacgaatgggttggaaaacggcgctggtgtcggctggtttcggtgcagtcattctgacgatgatcgaaggggtgggcattttgatgaaccgangtgat

SEQ ID NO: 17909 - DNA, 3349 bp, Heterodera glycines
tccccgtgtttttgccttctctgttccctgattttctgcatttattgctcaacaaatgcttacgttgttcatcggttgctcaacctttttgacagcgggtgccatttgcggcggtggaggccgtgccaaaggcgggggcggcggcggaggagcgcccggacggcgcataatcggcggcggtggaggcgctgaagggcgtttttggatttcctgaaaatggcattatttgagtgtacaaataaacctaagcaatcgaatgggcaattgaataatttgaccaatttgtactagtttaagcataaaatgatcactgacacaaagcctacctctgtacttcccgttcgccgcaacgttgttcttttctcgtccgaatttggctgcgttttcgttggtcgaagtgtttggaattggttgtgctgcgagagggggagtttgctgggctgtagagcaatggtcgtcttttgttttggcaatttggccggcaaaggcggtggtgcgccgggaactgctgtcgttgaaaccgatctaaaactgaaacaaagttaataagtgcgagtgctaatggttgggagaaggggaacaaaaaatgaaatcaaaaattagagtgaagggggagtactttctaatagtggaattaaaaaagaacaaaaagaggggcaaatactaaaaattgcgccagggaaaaggtaaaaaacagacaccaaaaaaaagttcattggtttggtctctcttttttattaaatggaattgttgcaaaaaaaataaaaataaatttaattggaaataatatgattggaaaaggggaaagaaataatcgtcagccttttcacataaaaatgcatttgccctgtccaaccaacacccctcttattaattagttagattttggtcaattagttaatgtcctccccatacttttgcaaattcgcaatggccgccgccctcgtcgatttgtttgccgttgcgtcgtggggcggcggagtcggcgagtgattgttttcgactgtcttcacattttccgatgcaattgccaccggtggtgcctttttgaccgggctgctccttggcttctgctgcccattgttcctaccgagcgtattcgatgcgacaatttggccggcagaggacgatttttggtttttcaaatcactcggctttctcgggactccgtccctaaacaaatcgcccaaattcatggcaccgcccggcttcggcgctgcgcttttttgactgacagtcgaaggggcagtcgccgttcgacccgcacaaggctttgtttcttcgcctgaatgataaaatgcccacaaataatcgaaatacattttaaaatctgcgagtgcttaccgacgacctttccctccactgctggcgccgatctgtcattagtgacagcctttttgagacgcgtccctttgtggatttcgttcagcaacattgcccgttctccggtcgctttttgggttgttaatggctgggaattggttgagaaggatgggggcgggggaggaggcggcggaggtggcggggccggcattgcctcaatatgagcttcagaaacggattaaagtgaatgatcggaagaaaagtgaataaaggatgaccaaatttacacgatgaaattgaacaaaataaacagagagcaaatggctaacagaaacaaagcctttgatgagaaggcggtactttggcaatcaaaaatttaatttaccaatattttgcaacgccaaaaattaaatttaaccgcaatttcaaattatttttaggttttcttaaaatttctgaaataaaattcgttattaaattaatttttgtttattcatctcaattagcttcgtatgaatgtgctcattgtcgcaaataaagctgcttggtccagtttgtattcaaatcatgtgaactctctgtgccttttgctgtgcccacgttctcccaaccgatgcaatgccattaagtgagtttctgagttcccccccccatccgtctcaaatttcctccgttccatttttaagtttgctctctttttatgtccaaaaatcggaaaagaatttgtacgatttactcggagttaaatctgatgcttcacaatacgacatcaaaagtgcttacttttcaaagtgcaaaacggtattattttgggcaaagtgagttcgcatcttttgttaattggggattctctttgtgttgttgatttttagaccctttttttttgtccctgtaaattgagtttggcttctaaaaccgactttcttgaaacttttctcgtgaactcgttctgtcaattatttccttattttgtttaattttctaaaggtttaaatcttttagctccatcctgacatgaaatgtgatggtgctacaaaaaacgattttttggagctaaaacaagcttatgatgtgctgaggagacccgccgagaggcgaaggtattgtattgattggccatccatccaattcaatccttttttgccaaattgcacagatacgacaactctttgctcctccatgttaaacagatggacaattacgccaaatacaacaacggttacggaagaggacaacaccacagccaaaacggagaagcatttgacgggtgcttttttcgattcatttccttaaatcttctggctagactcatctcctttcaaaatatcaaattttgggcgacttaaaacttttaatttttcggtttactgaatttatactttggataggttcaattggtttttttgatacattttgctaaatcccgtgcatttctatggtgtgcctcactttggtgcttatttgttagtccaaatgaatccatctttcccatttaagcttttctacccacaaatggcgttctccgctggccaatgacgacattcattttgtgttcgctatttttatgtttggccttgtgttcgtttttctgttttactttgctcaatggtctctctcccctccgttttctaatttattttcaatttctctccaaaggtttgccattcgtcgtcagaacaaagagttagcagcgatggacggtgccgacgaacttgccaaatgttttatgaggcagcgcggaatggacgcgtcgatgatcaacgacccgatccaagtgagtggaggaggcgaaatgggcataaaacttggaccagaattgtaaaagtgccaacattgaaacactttatccacccaatttttacactttagaaggaacgattcgcgcgccttctgaagacggacattgaagaagcaatgcaccgccgaaatgagaacccggaaaagcacacagatccaatgggaattcgggaagagagaacaaatgattggctgggggctgtgaaaagtgtggaaggaagtcgcagat

SEQ ID NO: 17910 - DNA, 3291 bp, Heterodera glycines
ctattgattaaatatccattgatagtttttaattttcaattcatagtgtatacatttatttatttaatgaattcataagcgtttttttattgattcttatgccttttgattgtattaaatcataatttcggatcttacatcccttgtttacacagtgtttatatgtggttgttgtacgttctgatgtaaattttttacaaatgtgatcatagtcattaaagtttctaagtgtaattttttatatatatttttttttgtaaattttccattgatctttaattatatttttcgcggaattacatgaatgcgaaaatttttaatcaatttcaattaattttttatcttaaaattccgaaatattttttcttataaaacccaaatctcgagtagggactttaatgattttaaaatttatatttttaaaattttaatgttttttcttttacaattaaatttaaaactattagaaataaatgcgtttgtttcatcagatatttttaatttgtatagctgttacggtaccggagcagaagagtacgctcgcaccctgattagatttttataaaagaattaatttatttttagctcgcttcctttcgtgaattagacaaatgtgatcatagtcattaaagttttaagtgtaaattttccatcggtctccaattatattttattcgcgcaattacattaatgcgaaaaatttttggggcttattaccacatatacgtagcccaatacacacactaaaagaataattatattaggaaaatttctgtttttcgaattattcaaaattttattgatgatctttataattatttaaaataaattttttacatcaatgtggaatttagatttaatatacgtaaaaggatattggaaaatttttttgattattctttgattgcggatgaaactttattttttatttttctaccggattttaattttttaactgataaacaaatgaaagaaattatttgtaaacgaccgagatgtttttttgcttttggacactcaatttatttccggtcgtttatcaactttaattaatttcctttaaaaaattaatttaattataagattttttggagaattataatccttgggaatagtccaattactaatttaaatattctcaatgtatcttttgttgattaaatttgcagactgcccaaatgttcagttctttttttctttgcatgctcgttgcttattatttatttctcttaaatttcaaataaatttcaatattgtaatttattctataaaagagatagtgtttatgaaccagaataaatttttatttgtgaaatttcctaaaaataaaatacatattttttccaatgtgcttattatattattgctaattccttcatttgtaataagcagttcaattaattaattctatgttccttccctaaaattttagcttatgatttctgagttattataaatcaaaaattcgattttaattttcatattattattcaccagtataccggatcattagttatgacattgaatgctcagtaagcatttataattatttttttattattaatattttggtcgatatttgattaactctgataatgaaggaaaaggagaataaagttgttatacagaatttgatctttttgtgtttttaaagttggcttcgtttaaaaatttttagtcttattgttacgcacataacgcatgtaaatatatgtttaaaatttttgcatttacaataattatattttttgttacttagggtattaactattttttgctgtgtaattgaataggcaattgagacaattattaaacagcatttgcatttctattataacgtacaacatatagtttttatttgttaaagggttgtattttatttatttattgtctataatcttatgttgaaatgatgatgcttttatgtttctctttgcggggacatttatgatatgattatattatatggcactaaatacattttcgtcttttttagaagaaaaaaaggaatttaaccatttaatttattaaatacaagaatggaacattaatatgactgattatgaaagatcattaataaatgcttttgattgtttatgacaggtttttctcgggaaaaatgttttattatttgttgaaaattatttattggctaattttttaaattattattttttattaatttaatttcttttttattttcgaggatgaacgaacatctggctagaaaaactttacgggtggagtaccacgcgcctgacgccaagcgcgccgttcctgatcccatgaagtttgggcggaagcgcccagcgatggttgctggtttttggaatttgccatttttagagctcaatttattttgtttgtttcgtcggagctaaagtcttattatgattatttatatttcatattgaattccaaaattactaataaattaatgggattcaatgtagcatttgtatttattttagtcaaatgtgtattttataaatagcttcatgcaatggtcaaggtctcagcgattgaagtgcgttgtcaatttcaattttgcccatgtatattaatgctactgtttaaattacaatttagtttattatttatttagataatttttgtgttttatcttaatcttcgtataaaatgaaagtatttattttaataaattcatttgaagcaataatcaaattaataaccaaccgaaattctgccagaatatattaatatttaaaatatcataattaaaattttataatggaaattattatagttttttcctcaatttcaatgaatcgcgttgtaaaaaagaatacaaatctattaattaataaaattcaattttagcaaagtgtcatacgtggacaatgcgtatagtgcgcaacaaaatttcttgccatgcctatcaactcggatgcctgtgccacagtttggcactttctcaaatccgcctgattttttatgatgctgtatttcagttaattgttctcttatttcgtttttgatagatttatttgcaaaaaatttttaaatttaaaaaataagcatatttatttttgaaatagtttttccaatttaatattatgttttataaaattaaatttgttggctatcagctccatatatttgccaatattagagagtagcttagtattattgtttaaaattattaataaaaatttcaagttaaattaggttttttgcttaatcaattttaaatttagacttttcgtgcgggatgcagcgttaatcaattgaatatcatgcacaacaaattttgatgctaatattgtataa

SEQ ID NO: 17911 - DNA, 1074 bp, Heterodera glycines
ttctccctcccccctcccgaagatgtaaaaaaaacttcaccgtctaaaaatttttcagaaaattcttcgaaaacccgagaaagtggcagttctcgcagattccctaagatttcttgggtttaacaatttttagttgtaagaatgtttcttcgtttttcagtttctttcgacttaatgctagagatagaaaaaacgtttatttgttcgaaaaaaaattataggccgttttttgctaaaaaattggtatattttttcgctttttttcggagatacgacaaaattaagtgcaactttatttttttattgtactctgattgatgtaaataacattatgtccaacaaataaatacttgttgctgctgttgtggttgggtgttgataaagatgatgaacaagatgaacacacggaagaggaggaggacggcacgtgcccaccaccgccgaccgagccaaagtgccgattttgggccttgcgcaccgaatggaggaccatgccgagcacgcacaatgccaacccgacaatgttcacggtggacaaatggtcgttgtgcaaatagtgggccagcagcagactgatgccctcctggaaaaagggccatgaaaattggaaaaaatttctaaaattttggtgatttttttttggaaatcgccaattcaatctttacctttacgatgccaagaatggacaaagtgatgccggatgtgttgacaagcaaaagatacctttttggggaaaaatgggaataaaaaccatgcgataaaagaaaaaggaacgggaagcacaccgtttttcaagattcttgaacatttattgacaaatgagaaagatatccggtttatatggtaatgtcagagcagcattgtttggggattggacatttggagaagaagagggatggaattgatgaggaacccgggttttgaactgggattaaaccggaaaatttttgaaattttttagaaaaatcattttttcaagtgaaaataaaaaggaaccatggattattgggactaggcaagatgaaagagtgtaaaattaattgtaaaaaagactcactcagcaattccatcaaa

SEQ ID NO: 17912 - DNA, 1032 bp, Heterodera glycines
tttccaaccccctaatatcaacactaaaggttttccttcgcccctccgataccttttatgataggtgatagatttaaaatggacgagttgttagccctttttctcgaaaattctttgaatgtttaagtttttcaataattttgaacacaaacccccacatgtccaactgtgtggaccgccacgtgaacaggaaaaggccaaatgcgatgagaaaggcggaggtgcccaagctggtacgccaacgctccaatctttaaaaaaaaagtgttaaaaataaatatattttttattgttggtactgaaaatcgctataaaatttcaaaaaatcacctgagcatcagggagaagccgacaatgaatagaatggagctcgacttggccattgtgtacagcgaaatggtgacatactccaaagacctgggcaaaatttaaaatgaaggtaggcagtggaaataaaaaaatttgaaaaatccaagggggtgggaaattcaagaaaaagtaaaatttcagtcctgaattccaaatcgcgtattttcggacaggcttattgggaagccacagattaatgagtgaggggacatcacaattgggattttagctcattgtcagtccgtttttaaattaatcgaattttcgatgattttgggtccaaaaaaggtatagagatttgttgacataccaattggacagtccgatgtccaacgaggcgcaaaagccgatgggcatcagccagcggagctgttcctgcagcggcacgcgcacgcgacggtttttctgcgcccattcgaccaccgaacgaatggtggtggccagccaatattttgtgaggtaatggccggccacaatcagcaggggcagtcggtagtgctaaaacgaaccgattgattgaactgtattttggcatcaattgggttaaatgcatttacacggcgaaaatttcaattttaacatgaattttgaaaacaaaaatttttttttaagtgaaagcaatgaaaatgtcggatgtgccgaattcgtgtcaattggagtcaa

SEQ ID NO: 17913 - DNA, 1437 bp, Heterodera glycines
  misc_feature (19)..(19): n is a, c, g, or t
  misc_feature (1076)..(1076): n is a, c, g, or t
catgccaattcataattgncttcgtgttcttcaattcggactatgataacattgatttgctttacgtcaatcaattcgaagcaggagttagcttcgcaaatgattgccatcgcttctgggtctgtccaattaggaaaaacgatgaccgcgtaatcgtatctgaataggtcgaaataaaatatgaaagattttctaatcgactcattttttgaattaattttgtaaattgactttttgtttaggcagacttttttggccaacttttttggattttctaaaattcaattctgaacgatcaacaaacacataatatttaaaagtttcttgatcatactgtgctcacgaataagcactcaaattcacttacatttctgcacctaattggtcaacctcatcctttatcttttccgctacagattgatactcattttcactctctgcgatatccgaatcaccaattgccgattttgcacgagtgcgtgaaattgttggccaagtgatttcctgatatggacataaaatgccagatatggacaaaaaatgccaaatatggacataaaatcccatatatggacataaaatgccaaatatggacataaaatgccaaatatggacataaatcccccaaatatggacataaaatgccaaatatggactaagaccgaaatatggacaaaaaaccttcaccaaaccaaaaaaaaaaataacgtagaaatgctatttttgagcccctttcttcatagcatatgcgcagaaaaaatatgtgttaatccatataatttagaagcctacttatttgattgctttgtaaaataataaaagataatctttcatttttcaatataataaggtctttttaccagcatttttgctatccaattagccaaatgggcagtgatttcttgcagccttaatttgatggtcctatggtcaatatcaatatctgtttgtttgcccgcataaataacgttggcacaatgtgacgcgatcaaagactaaaaaaagaatcaaaaaactaattcattaagtgcgaaaaaccataacctatagcaaggcgtgtataaagtgggggggtnggactcttcctaaagggacaacattccgtgggttccaatggtcacccgttgttttcattgctccttttcggcccacctgctgcagtgtgtcgtctccgttccgttcgtcctcttcgccctgtgaggcgagcagtgtccgttccgtgtggtacgactgctgccgcgtgtcgtcgtgcccattttccacggtttccattaagaaaacctcctcgtcgtcagcgccaaaatgaaggcgttcatgggaggagcaagcggagcaagacgaaaggcggagttgtggcgactgtgaaggcattcccccgctggtggtgctggctgacacgtcttcttgccagcgccctcgaattttctgaaaaatgat

SEQ ID NO: 17914 - DNA, 952 bp, Heterodera glycines
  misc_feature (27)..(27): n is a, c, g, or t
  misc_feature (86)..(86): n is a, c, g, or t
  misc_feature (107)..(107): n is a, c, g, or t
  misc_feature (112)..(112): n is a, c, g, or t
gaggaaaaattaattaatttatttctntaagccattcgctcccatgtgcatacttagtggctaaactttctgcctttcattatttntcgtctgtgttcaaaattctncactngggatagaataattttcatattttctttacattatcttaattaaaacttaattaattaaaaacattccaactttttttaaacagcctaaaaacccaaaaattaaccaaatattgggtcattttttgggtaaaatctgttaacaaatcgtattataaatttcaaaaaatttcccggcggcgcctatcggcaccgccggaaccttgttccctaaaagttttttggaaaaagcgccgcaaaaaaaagcatttttaaaagcgcaaaattcttgcaatttttggtgcaaatctgttaccaaatttcagtcaaattttcaaaattttccccggcggcacctatcggcaccgccagacctcgggttagagaaatttacattgaaaagcgcgacgcaaaattttttttattgattttcattcgataaaaaaattcttaccgaatttgaacatattaaaaaaatttttaattgacccgaaacccgacttttttctcgacccgaaacccgacccgatatttttctcgacccggaacaaccccgacacatacgtattttctgcataatgaaaatccgagttcaatttgttcaacgcttgccacacctcatcagcactgtttgcactgtttaggactaataaaataaaacaattaagcattaaaatggtgctaggtctgttcttaaaaaccgccattaagggcgtttcttaaatccgccaaggggtaggaaaacaaaaaatgtaacacatataaactcataaattggcttaaattcaaccaaattaataattcttggtgtcattcaatcgctttaagtattgtctatcagaatataaatttctgttctaaaa

SEQ ID NO: 17915 - DNA, 943 bp, Heterodera glycines
ttcccttcccctgcacttccaccgcttcttccgtcgccttttcgcgctgccgcctcaccacaaaaggcaaacaaaacacctcgaagggcaccgcttgctgcaattcatgcaaatcggcaaatttgcgcccatgcaattcatttgcggagattgccgaaggagaggcggcgagaagacggagcagcacatcatcgggcggagttgacgaggaagacggggcggagagagaaaaacagagaaaggaggaaaagaaaacggagcagcatcacaacaatgagttaataaacggaagaatagaagaaagagggaaaggaggggaaaagggaagagggggcggaagggaaggcgaagagataatgacaaaataaggacggaagacaaagaaaaggcagagataaaagaacagcagatcaatttcattatttttttgatttctttttctttcccttttcgtctctgatcgatcattcgtttgatttgctttccgtggccacctctgatcgaattattctcctcatttgtcaaatgcttctgatctcataccaaaattcgctcaattcctcccattttgcaaatgctttttttgttatatcggaacaaagccagaacaaataaataccggtttaactaacccccgacactttaataaagaagaagaatctggtaaaaatagattaattacatcttttctagaattttatttattacttttttaattaaaactttttatataaaaaaaataagaaaagaaaagcaaaaagaaaaattcaaaatatttttatatttattgcaattcttatttaagtagtaaaaaaagaacaattatattttgaatttgttaaaacattatttgtggtttaaagtttcattgcacataaatcaaattctttttaaatttatcgcatcaaaatttgtgagagcgacagacacttcgcttttgaaa

SEQ ID NO: 17916 - DNA, 861 bp, Heterodera glycines
ggtggcgcattaattccctctctttgtgcccaaacctttggaatattatttaaactttcatctgttggcattcgcactgactttgacactttttccgggcctcagcacaaactcttgagggaatgagtacacaatttcgcgttttccgtcgatgcgcctcttcaatttccattcgccgattggctcttccttggatcggtgggtgttctccaacaccacgtatttcccctcgggcgatgtctccaaaatggacacattgcctttggccgacctttggtacgattgtcgggaggacttttcgccgcgcaaaatgcgctgagactctgaaagaatagaaggaaagggcaaatgcttttggacatcaactgctgaccagcttcgtcctgacggcggatgttctgcgtcttcaccacctgctccaccagctgataaagccccgatctgtcctcctccccctccagcatttttcggtaaatggcaatttcggcgtccaatgtctgcttggtgtccagcaacatttgcagctccaacatcagtgcctgcgcttcgtcgcgcagcttccgaatctgtgcgtccttgtcgttcagtgccgattcgtacgccctttggtcgtcctccacttggtaggccaattcctcggcctgtctctccagcagagagttgcgtccctccaaatcggccaactttccgcgcatgtcgcccagctgcgtgcgcagccgcttcacttcctccttggcgtagttctgctccaagttctgccgcgcactcattgtctgtatctcctgcactttcattttgtaccacgactcgatgtcgcttctgtttcggttgttcagcacgtcataatcgttgcgaatttcg

SEQ ID NO: 17917 - DNA, 3034 bp, Heterodera glycines
cgaatgttgtcatccccgtgctttcgtccctcccgtgcttccgatcatgttctccctcgtctcgagcatgccgtcgaatcgggtatgtctgacgctcccgatagtcgtcgttcacgtgagcctgctgtttttcgatttttggttgcatcagtgccggccgatgggctgttgctggggggaacgcccccatctcgtctcgatttcgattgatccattctcgcgctgtgttcgtcactctcatgctggcgatggacggcactttggcacgccgttggaaaatcccatccaaattcggcatgacgggtgtcgcgactcgttccattggtcttcggttgtgttgctgtacaacttgtccgccgttctgccatcgtttggccgccacttggaaggatctctcacattcttccatgttccgattttccagtggaggtgggtcgtcccccaccggatggctgttgttggtcccgaatgacccgctcaatcgagaccgcgcgattgcttcttcttcatcctcgagtgccagtcgcatcgtccttaagtctccgatgtgctcgtccgcaatttgaagcagttcagctggtgttggatggtttcgcaataacggcacctgtttgccgttagcttctcgaattcgtgctcgttggtcgctcgtagaccgattgttggtggctgcagttgccccctgctaacggcaccagtttgccgccaatcttttactcgggcgggccaagtgtgtggcttggcccagctgaggcgggattggttcccgctcctcttcaccgctctcgtccctttttcctctgctcactccgctcgctgtgccgtaaagggaatggccccctctttcgccgttcgtcctgatgggtctgatgctgctgaccgatccgatcagcgccaaagggggacgagaatgggaggggggaggggtgacaaaattgaactggtactgttggatgttatacagcgatttgctgcttgcttaacggcaccaccgacaagattttggtgaagggcttgtcggacccctttgagcagctccgaacgggcgggagttgctcgacaagattggttgtgaagggggcttgtccgaccctttgagctgctccgaacgggcgggagttgctcttcgctcttgactcgatgaaacgggttttgactcccgtttcctgcggcggatgctccggctggcgggagactgaggccgaaccgcgagactccggctgcgggaatctgaactgctcgaatacggaaatttaaaatttcgaatccgggttcgcggttcgaaatagagccaaaagaatgttacatttgtgattagcacctcgggctacccctaaaaataattttcacaaatttaaaaaaaaaaaatttttcgggaccaatgttctttaccattgcccatcaataatacaaagactttaaacctcttgctctggaattttactgtgtgaaatgtccttttgagagttactgtatgtccttgaatttttgtattttgaagtgacagtaagcacaaagttcgtatgcgttatgaccttttttactgtctgtcttgtgtaagctcatttaccaatttcgaaattcctttgtttgcttttttctcaaaaaatttaataccttggtaaaatgctttgcctttgtattgtcacaaactgtgcataaaaccattacacgcaataattttgttaaaacgatgcccccccccccctcttttgggataaaagttttgttctaaaaaatcgtgaaaacatgtttatgtggattgattcgcgggcggggggggggggggaggtttcttcggtaaaatgcattgtttttaaacattttccagcaagcattcttcctttcctgtccgttcttttccaattgacaaatggcaaatgaaattcttgaatttccactgaaatatgacaacgatatacactatttaaaagtccgacgtactgatacggtgcgcgaattaaaatttgtcatcgaggcaaaattgaaaattcccccggaagaacagagattgatgattggcagtgagtcaattctttcataaaatattttactaaatcaactccatccagactgtgtgcagccggatacccgccttttgagttcaatgaaagggctggatttggtgcgtgagacgggccctgctgctcctccctaaattggcaatgctgagtagtttgagaaagacgaatgattattggcttttgactttgtttgttgcgaataaaaattaaaaagcaaaaagttctcaaaattttcatttgtttgaacacaacattatgtcctttacataatttcgtaaaactttttattatttctctctatgctcagatggcattttaattgaaaagaaccggcgagacgttccgtttgctgtacgatgtgaagggacggtttgtcatccaccgaatccaaagtcgtgaaggccagtacaaactgtgcaaggtgaagaaacaggcggtcggtgacaagcaagtgccgtacattgtcacgcacgacgcgcgcaccattcgctacccggacccgcacatcaaggtttattgaccgtttagacttaccaagttttatatgccaccaaaataatattggcatccagtatagttttcggtaatagtgacaaatagctcatttacaaaattaaacaataaaagtaaaaacctaacacaaaatcagttatgtatgcactgaataggaaagtgccgagaattcgctctaaaatgggggccgtgtcggattccgagtccaaaaaatctccatgcatcatactcaattctgaaaagctcattttgattgttagtttttatgtgtatctgaattcttgccgctttttcacaaatactgcccagcaattgtcaaaatgtcatccaaatttgttttttttaggcggacgacaccgtagtgattgacattcacactggcaaagtgacggactacgtcaagtttgatgctggcaacatttgcatgatcactggtggacccaacattggtcgtgtgggcattgtcggacatcgcggacgtcacccgaattccttta

SEQ ID NO: 17918 - DNA, 3058 bp, Heterodera glycines
ttttgagaaaaagttaaattttatttcatttagtatccatgcatatgtggtgtaatggttaaaccttctgcctttcattatttttcgcttgggttcaattccccactgggatagaatattcttcatatttttttaccattatttttactgaaatttaaatttaaaaaaatattctattccaactttttttctttcattttaagcatcctaaaaacccaaaaattaatcaattggtctttttttacaaattctgttaacaaatcgcattaaaaaataaaaaatttttcccggcggcgcctatcggcatcgccggcccaccttgataagttggaatctgtactactgtggtataattgctttaaattataataattttttatttggtctgtttgttatctttaaatttaatattgcatatccttgcatttatttgcattgaatgttcatcgtatatttgttgaatttggtgaaattttgtttagcataattaaattgtattcacttatatttacaaatgttttaaattcaatgcttttgatctcttttaatttattattcttataattatatagtttaaaaccttgtcgatttccattaaaggttttaatttattctgttttatgtaatatgtaataatttcggttttataataacatttttattttataaggcaatgttaaataattaaagcaagtcgaataattaaattgttttttttaatgagttcttttgtttttatggttttttagagaaaatttatataactctttttcaatcgaagtcaatttattataccttttagaaaacttatttttatactactccggatttctcgttcataagacctgctatggcttaatattttgccaataaatttcattaatccgacaaattgtatgataataatataacttattattttaaatttattttcttgctggttcattctcccccgcgttattcaatttcgcattctccaataactgctgataattgtcaagaataacaaaattattaatataaaaaataacaagttattttatctataatcttatgttaattgtgttttatttttgatcatttcttatttcctattattcatagaaaattttgtttttgatttgttaatttttttaattattttgacaattatagttttatattaagcttagtttttaatttggaaaaataaaaatttatattcctgctaatactattaatttcaaattgattcttttcaaaaacaattttatcacgcatctttcatcaaattcatgacctttcaaatttactatgcagcattagtttataaataaatttaaatttaatacttcattcctattacaaaaaagaacaagttctattcaacgcatgaaaatactattagataatttttcattcaattaattgtttaatattcgtttaattgtctctttatatgttcttgctatatccataaaatttttattcgattttgttagtgttaacttgctacataattaattttcaagcatttttcttttttattaatttgcagcatcagtagtcattataaattatttggttttcttcatgtagtgtttaatctttattttttcttgtttaaattatatttattttaactcgtttttgtatttaatttgtctgtttatattttttagtttgatctgcgataaagactttttgtttaagttttgaataatggtgaatttaattattttggtttcatataaatgtataacttaagaaataatgtttaaattaatatttgtatttatttgctaaataaaaatctaaatttttgagattaaattattagaatagatttactcgcgctttagctcagaggcaagatctgaaaagacaattgcgcgttaatcaaattgatcaagtaatttatcatgaatttttataataatttttttcatttatttaattttgagtcattttttaaatttattgtaaaggcattatagtatttaattgggtatttttattccatgacattctaaattctgggttcttatgatgtaattagattttatataacataaattatttaaatatgctttataaagattgttatttaattattataatttgatttattaatatttctgattaaaatctaaaatattaatattatttttctttttattaccattcatagttattagtattttatttggttatttacgaataatgttgtttcattgataatttatatattatagttagttccctccaaatatataaatctgaacatgttattttttaaatatattaggatttttattttaattgacataatgaatttctttttgtgttttcatatgaaatattattcatcatgagaattatttattttattaggcttattatttcatgttgtctataaattccttttttatttttattttaatagtgttatttaaggatttcataaaatgttttgagtttttattataaaatgttaatttatgtttttagcatcacaataaatactttcaatagtttcacaagtaaattggtatgctagccgacctttcagttatcaaaataatataaattatttttattttatttttcttcatcgagaaagcgagagaaaatttttgattgacccttgatcacctgacttggctctcaatccttgtattcttttttcctccccggcgattgccttttttcagccaatagttttcgcttatttaaaaaagaaattaaaaattttcaaaatttttattcatctccctttttgatagtaaaaagagagcctttttaacttgtaaataaaatttggtgcgtttcagagcagtctctgaaaaaatatttatgcattaattttgcaaaaattggaaaagtggagcatgttataacttctaacttttcactaggttattagttttaaattaggaatagttttggcaggcatgttgagtttcatttattcaacttaattaaatatttttttattgttttcaacaaaaatttttagcttgcaagataaataaagaattttagaatataaaaagattgaatttcatctttttggttg

SEQ ID NO: 17919 - DNA, 2834 bp, Heterodera glycines
  misc_feature (1655)..(1655): n is a, c, g, or t
gatccacttgggaagttcattgagcaccgtcttcagagcgatggagctgacgtcgcgcaattgctcattttggctcaccatattggcacaaagtgagtccaccaaagtctccaactgagccaacttaattttgtgcacaagtggtccttaattttatataatttattttttgaaaaaaaagatggggatgaggggtaatggtaatactgccgatagttgccccctttttctgaaaaattttatttgcttccaaagtcatgaaaacatgcttccagggtcgctgaccacaatccggcttccatttcgacctatttcgaacccggactcgaacaaaaagtcgaaaattcaaaaaatttcaaaatgcactttagaaacaaaaagcgaattttggattttttaaattttcgactttttgttcgaattcggatctggagttcgaaatggatatcggattcgtgagcagcgaccctgaaaaccattggaaacatgttttcaggacttttgaaaacaaaaaaaaaaatcttcaaaaaagtggggcaactatcggcagtattatcaggataatccgacagaatgtcaaagggataaaagataaacgcaacctaaacaacgacacgccagattttgcacttctccatttttgtcctgtatcagagtaagcaaagccctcacaatctaacaaatttaaagtaagacaaattggcgctatttaaaaagagtaaccttttgaattctatcaaaagcaaaaggggtgaaccgtttctcacgcagaaattttgtgcgagaaaaacgctgatgtgatcgatctacaccgctcccgatcagcgatccgatgttcgctgcaaactctacatcgtgaagtccgccacaaatttggacactacacaccaatgaagaaggaacaactccgacaacaacaaacaatccatgaagaagatgcactgcttctgctgtcacaacttgggactcaaaaagcgtatgagaggatgaaggcacttttgcgtctgatcggtggaaaatttgatgttttcccaccattgaaaaaagtaaaaatgtttttaattcaaaaaaataaataaattttcggtcacaaaaatcaaaaagactatctgcgcagtactccaatatgaggcgatttcaacgccgcatggaattggatttttttgttccgacattgccggggcactggaattcagattgtccgcggccaaggacaatctgatcaacttcagatcagacgaattgactttaaaattgagcggcgacaacgggcagggctttacgaaattgacaatctcattgccccatgcggcgcatgcaaattccacggccaacaatttcattgtggcagcatatcccgcaaaagactcaagggcaaacctgagcaaattctgtggcaacatttggcaacagatcagtcaaatagatgaaattgcggacaaaaaaatcaaattgtaaaaattaataaaaattttctgaaatgaacttaaatttccagctttctcggtggtgatctgagctttttgtgggcaattattggacactgtggctcagccgtaacgacatttccctcgcctatttgcgaatgccgtcgggaccaattgttggacgcggaaaagtgtaaaatgaggacgacggaggaaacggtgaatcangctgagcagtttgggcgtctcgtgcaaatggagagaaaccaactgttgctgcgcgagcgttgactaagggaatcgtcgatgagccacttttgcgatcaatcaaatttgaccgaataattctggcgccttttcatgtcttccagggcattggaaatgctcgatcaaagagctcgaagcatcaacagaaaacgcggaaattgcaaacgaattttttcggaacatcggggccaggagggaagcgttcagaaaaaaggacatgacggggaactcaatcagaaaagtcctgattcatgcggaccaattggagaggcggtactcagctgaatggccaaaaatcatttgccaaacattggggcacttggcaaaaatacaaacttttacaaaagtgcttttttatttgatatttttgaaaattaattataaatttaaggcacaacccctgtcgccacgggatttggacgaattggaaacgtcgattgatcaatttcggacattcctcaacgatcagccgcggatgcgcactttgctagccttaaaaccaaaggtccacttgctgttgaaccattttgtgccgttcgccagacaacaccaatttttggcacttttagacgagcagggtcaaaaagcattttgaaatttaagtcctggattttttaggtgatgaagcattgcattcggtgtggaggcgattggaacagctgtggaagacaatgcctgatgaagaacaaatgcggcaattgttggaacaccattttgtgtcaaattggcttctcgacacaggaaaaatcgacgaaatgaagcgggtcagtttggtgaaaattgggtttcaaataaaattcccatgcctcaggaccgtgaagaacaacaggaagaaatcggaggccgggagagcgacgaagaaagcgatggagaagaacaattcgattttgaataacagttggataaaaggttttttctttgtttttgcaggaaataaaattattaaaaaattttgagcttctttaaaaactgtgttaccatttcacatatatttatttgctttaaaaacctcaaaatacagctataacatgcactggattcgaacctgagaccccccattttttgactaactcacagaccactaagacgaaaaaaccaacttaattgtacttggagcccaaaattgactcgccgtgtgta

SEQ ID NO: 17920 - DNA, 2273 bp, Heterodera glycines
aaatttttgagtttttcggtttttttcgatttcggtttttttcgggtttttaaccaaaaccgttcgaccgaaataattaaaaaaccgaaacaatcgaccgacttttttgacaaatcagttggccattttttaaataaaattcattaaaaattcttaaaattttcctccggcggcgcctatcggcaccgccgaccccccaaaaagctatcttttcttaaaaaattagccaaaatctcaaattttggtatttttagacaaaatctgctaacaaatagcattaaaattacaaaaaaatttcccggcggctcttatcagcaccgccggacctaaagttatggcttgagctcacaattaaggcaccaaaaagcgcaaaatagcactgaaaaaaggcacaaaaatcccgaaaaaggcatgaaaaaaggcatttaattttttttttggctgccttttctatcattttccaaacctttagtatgcattcaatagagtttcaatagctctacaattttactcagaggaatttttgctttttctattaatagaatattttattgcttttttgaaaaaaaaaacagattcaaaaaaaaccgaaaaatcgaaataaaccgaaaaatcgaaataaaccgaaaaattttcttcggttttttcgatttcggtttttttcggtttttaaccgaacccgttcgaccgaccctcttgtccggtctctagtttttataacattttttgctttttttccttatttaattaagctatagtccgtttttccttttcatatgaatgactttttacatcatttttttgcggcgctcttttttaaaagaacttttcgggaataggggtacggcggtgccgttaagcgccgccggggaaaatttagaaaatttaagtgtgatttgttaaaatatttacaccaaaaaattaccaaatttggcattttgagctaattttttaagaaaaaattgatggttttaggtgtctccgggtgaaaagtgtaaattttagccctatttattaaataaaccataattattagggttgtaaattatatggattaacatattttttctgcgcatatgctatgaagaaaggggctcaaaaatagcatttctgcattaaaatttttagatctgatgaaggtttttagtccttataaatccatattttggcagtttttagtccatagtttggtccaaatttggacatttttgagcttttagtccatatttcgtgcttttttagtccatattttatgtccatatttcgcagtttttagtccatataatttacgaccataatacataattacataatatcgatttttttattgttgatttaaatttaaaagcactaacagaatattaaatttatttttaattttccattgaaaaatgggtggcggcggtggcgataagcgacgccggggaaagttttgaatttttagtgcaatttattaacttatttagtccaaaaatgacaatattttacgcttttaattgttaaagttgtgattgaattctcatcggaaaaaggaataattttgaaaaattagaagaaaaatgaaccacttcaaggggaactgatccaacgaaaaaacgaagaacataacacaccagaccacgcatatgttaacgaaatgaacaaaaaatggcctaaaattcattttttactttttccgcattttttgcgccaaattcctttccctaattatccccagccatctctcccaaatttggaatgtcgtcccaaagatcattgccaatttcatccgctaatgtcccttttgtacaccaccgttgtcccctcagggctaaatttacgtttggaatttcaatttcacgtgcaataactttttgccgtcgccgtggataaataaatcttcgactttttctcctcctaaatattttttatgctatgcatattttgggcattttttgccttgttggcactaattttaaattagaagatgagcagaatttaatatataatcattagggctgccaaaaacatgtacaaaaagcggtcaaaatatgtaaataaatttataaaatggttattttttgaaaaacaaattcttcgtcaagggtgaaataagcacaaaataacctattgtaaatatgctaaaaaacattttagtattttataaattaaatttttggtataattttggatttttgaggatttccaaaaatttccgttaaaaatcctcaaaatctgtaaaaatgaaaatatgtaagaaaaaagtctaacgaaatatgtaaaaaaattaaata

SEQ ID NO: 17921 - DNA, 2500 bp, Heterodera glycines
ctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtatgatttctgcccagtgctctgaatgttaagccaaggaatcagctgacccgcggtcgtaatagtcgatatttttttttgcaaatttcatttaatacaatggcacttttggcttcattcatcattatctttcgttgttttgctcctcctcctcttcctcccctctggcccatctgtccaataaaaatatttttgtctccgtttcgccccttttttggccaccgattggttcggactttgaggttctctggtagtaatgatgccacctttccatcgcattgccttgcctcagctcggaaagtcctatctgcaaatcaaattttgccagtttaaaaaaaagcgattttttgggaatttgtgccgaatttatatggaatgccgcaattagtgatgaaaaatcaattcccggcattttactgcgttcattcaacacttatgcaaatcccctctcaatcccgagaatgaataatttgcccgactttatctcgacaattgaacccgatctctggtctgattaacagattttgtctaaaaaataactaaatttacgaatttgagcgattttttaagaaaattggatttaggatccggcaacttttttaggattgaaaaataaattttccttaattagacggcttagaaaatgccgattaaaaagttgtttttttgggcggcacctctttgagcataattgctgttgggctgacagctgttgatacggaaatgaacgatttggaggcagctcggaccctttcgcgcgctttggccaattgatccgctctttgacggcacttttctcgtcggccaaaaggaaaaaaaattctaccatatttactaaaataatgcacgcaccccctaaaataaagccccccccccttttagagggattgaaaatagagccaccgggggctctattttaggaatggtaaattaatctaaatctcctgattaccgtactgcgaagcctgcaaaacagcagcacacataccgtagcaacaaatcacggtaaagctataaaatttgagtgattttttgggttttatcccataatttcccacaaatttttaatttttactaacctggggataagcacacaaaattatgacgaccacccaacaaaacaatatgaacaggccgagcactgaaaaaaatagaaaatttttacacaaattttctcaaaatgggaaatagaaattgtctcgaccagctatcactttcacaattttctccattttttactgataaatgatcagaacagtcagtcttttcattggttgttccgatcatatctatggaatttgttcagactaacttatttaatgatgtgtaataattgaagaaagcatctttatctttactgatcagttgacataataaatcagtgccggcacgaaaaaggtgactaactttgacgcattttatacatttttgtgaaaaatttccaaattttctaggccttttctaccgggattttccggttcgagactcccgatttttgctaatatttattctttccgtctcttccctattccctctggatcaaattttcccataaaactcactgaacagccttttctgcttttcattgtcatccacgagcagtgcgtcgtcgatggatgtgttggcgtggtgctccattttttacaatttattttctaaaataatttataggatttaaattaaacaaattcaatgggctgaaaatggcacaaaaattggaattaacggtgcggaaaaatgctaattaagaggaaaatagttataatttaattatcattttaattgcttctccggggctttcattgtttgggaatttttacgaataaataaattttcagtaaaattaaaatttatttcttttaagatttccattaaaaattagcctcaaacagcacaaagtccttaaatcattaaaatttttgataaataattgaaaaatattgtggaatagatttaattgaattttaaaataaaatttaaaataaataattttaaacagattttccactccccttaaaacattttaaagtaaaaaaactaatttaacatcttacgaaaatgccaatgccgcccaaatttagcaaaaacggctgaatttgccctttcattaaaagaatgaaaagca

SEQ ID NO: 17922 - DNA, 3099 bp, Heterodera glycines
  misc_feature (59)..(59): n is a, c, g, or t
  misc_feature (102)..(102): n is a, c, g, or t
  misc_feature (104)..(104): n is a, c, g, or t
  misc_feature (112)..(112): n is a, c, g, or t
  misc_feature (118)..(118): n is a, c, g, or t
  misc_feature (123)..(123): n is a, c, g, or t
  misc_feature (146)..(146): n is a, c, g, or t
  misc_feature (175)..(175): n is a, c, g, or t
  misc_feature (180)..(180): n is a, c, g, or t
  misc_feature (243)..(243): n is a, c, g, or t
  misc_feature (265)..(267): n is a, c, g, or t
  misc_feature (269)..(270): n is a, c, g, or t
  misc_feature (272)..(272): n is a, c, g, or t
  misc_feature (275)..(276): n is a, c, g, or t
  misc_feature (280)..(280): n is a, c, g, or t
  misc_feature (282)..(285): n is a, c, g, or t
  misc_feature (289)..(289): n is a, c, g, or t
  misc_feature (291)..(291): n is a, c, g, or t
  misc_feature (295)..(295): n is a, c, g, or t
  misc_feature (304)..(304): n is a, c, g, or t
  misc_feature (310)..(310): n is a, c, g, or t
  misc_feature (315)..(315): n is a, c, g, or t
  misc_feature (317)..(318): n is a, c, g, or t
tgtcccctatttcagtttacacgaccacaaaaattggtctactgaggttttaaatgatntataagatagtttttcagttctttgtaaagaattttttggtgnantgtatttnttttanaaaangtttttttgggaaatattaaaanaataaattataattataattatagtgaanaaatntaattaagatgtagattaaaataattaattaatttaattaattaattaaaatgaattaaaatnatttattgggtagtgaaatgannngnntnttnngatnannnnagantnatanttttttaanttggtngtagnanngaaaaatttagggtttgttcgaacatgaataaagttattgtataaaaaccaggtattgtcaattgattgtattcataaaataccgctggactcataaagtgcattagagcccttaaaaatttcggcatttaatttggcgctatttaatgcgattgctcgttattttcaattgtttaggcatttctccgtgccaccaccagcacttcggcctgctacacaattaaatttaatgttcacgagtcaacgctaattgtgccatttgaattggtgaacggacagacccaagaaaagttgacactgaagaaagaacggaaaaatgatttttataataattattggtggctgttgaagcgatgcccaattagtgaaaaagtggcggcggatcaatgggaaaacgacgaaaattccgccaattttaacattgtccaatttgcgcttaacagcattgacaaaaatcatcactgcattgggtaggtgagcagaggaacacagcttttgcttttgttaatttgagattaccaattttaatttgttgcatttaattaggtcattatgtccaccagcggcgggtcaaatcaaaggaaagggtcgtctgaaaatgagtgccgggcccagtggcaagagaaagaaaaagtgaatgcaattatttgagaaatgatcgatcatttttaatttaatggacaaaaagctaatttaatgctgtattttctctcaaattattcctcatatattattttatttattggttttccttctctcttaaaacatttattttattgtttcgaacaaatcagaaaaattcttcaaaaaacaaatgaaagtgagagagcatttctgatgagagaaaataaattagcatcaaataaatttcaattggtgagattgatcatttctcaaataaaattaattcacttctgcgcagtcattaaaataatcactcattccgctgattttttattgaataattttttcaagcaaatataccaaaaacattgttgaaaccaccttttacttggttaagaattttaaaatttagcctattaaatttattttgaaaatgttattaggtatatttttcaaaaatttccgatttccgacgttttgggggtcggaatttcgatttgcgctttccgaaaaaaattttttgagcctcggaattccgaaaatttttggggcctctgaatgtcatcagttattgcggccattagcggtgggtcagagcaacaaaaaagtcctctatctctgcggaagagaattaattgaaaaatgatcgattgctttgaattgattattggctctgatgatgctttttttcttctttttgcagtttttttaaaatttaatattattttttctaattatttttaatgattttttcccacatttgttggttctttcataatttcgaatacatttaaatttatttgctttttctcatctttttatgcttcttctctatattttttgaggttttctgcatttgatatgtaggtttatgaaaaaatgactatgaattatgtgcatatttaaatattgtatgctttttatttaatttaggtattttatttattgctcgtttagtctcgcttctattggaaagcaaaatgggaagacgtcgacgtcgtttaaggaaaatgtaagcgaatttgtggactaagttagatcgggaattatttgtcgaaaatttcagttggatttgtacggatgtttggatggacatgttcccgttttttgaccgtccccaactcggcctcaaattggcacttctttcgcctcgttttgatgttttagtggacaaatatttcgatggcaaaagcgaattgccaatttggagaccaatcgaaattcgtaaggacagtgtcgcaaaagtgccaaagttgcgtgtgcttattgatgccaattctgttgaatttccattgcccgaccattcgctgcacaacaaaattcgctttgaggacctttatattgggtaatccttaattgtttttgacgaaaatttaaaaacaaaattagttaattctaaataattaattaattatttaaaattaaaacaattaaattaaaaaagaatcaaaagcaatttattttccaccatttttagtttcattgatcactccgtcatcacttttctccgttccaatcaacaaatttgggacaaaggcaccaatttggatttgtggatgcctacatcataccacatttatgtcaagcggtgttggaaagttttggtcaatgaaatttggcccatttttgcgccgaacattcacaacttttccaatgctaattggttgttgtacgaattgcgtcgcctcatctcaccaacaatcctcaccgatctaagcccgctgaattcaatactttctgggaatctgttgcccgattcaattgctgacgatggaccaaatgcaactgctgaccaagtgttgtccaaatggttgcacactccgcgcactgatggccaactgaaccgattgttttgtggcaattatcctatactgatgatggatatcaacaaatggatcatcaatttcaaagaggtcaaaaaagggtactacttttcggttttggggcctagattttaattttaaaaaaaccatcaaaggacgcgcagaattgaaaaaagtatgcgcgccaaaaattattatattgcgggcatatttcgaatcccgaactcgaacaaaaaaaattttttcaccaaactcctcctttattgtccaaattgattcaaatgcactgaaataggatccatggccgtttcatgcatttgaattaaagctggat

SEQ ID NO: 17923 - DNA, 1086 bp, Heterodera glycines
  misc_feature (1015)..(1015): n is a, c, g, or t
cgatttttcaaaaaaaaattgtaaaaattttttccccggtcgatttttgtaattttttgtgtgcgctgtttttctccttaaaaaagatatttaatttttttaccatttgtcaaatttatgaagctaaacaaacaccgccaaaaagcgcaatttaattatttaagaaataagggttgtaatttcataaaactaacagctgctgcattttcatttcttattcaaattaaattactttttgccaccaaattaaaaattaattattaaatggaatactaaaaaattttcggagaaccgatggacagacagaaaatcataaacatttccgattcaaaaaaattaattaaattttaaggtgaacgaacatgcactttttcaaccaattcatcattgtcattggcattattaaattttaaaaaagcttaaatgaatgcctcagcgaacaacacggtatcattaatataattaaattattttaaataatttttaatttagttttatttggccttcaaagatgtccatccaagctggtcactaattggatgtggattgatttacggactcatcgctacagttgggattattttgaattcttctgtcattcttgtgactttgttaacaaagtatgtgcttaatgaaaggcgtgggaataaaatgatttaaattttttgaaaaactttaattaggtcattccgtggcaccgttaattaccttttggcactttgttccctttttgaattgcttcatcaaagtggccattttctgtttgtgtacaccgcattttctggacagaatttcattgagaatcgtctggcagcaaaaattcttttcatttccacgattggactcggtaatatatgtttaaaaaattaaccataataattcaaaaattatattaaaatataaattcaggtgcaatcactccaacaatgtttttcactggcattgaccgactaatcggaattgctttttcggaaatgtaaaaaaaatttttactaatttaatttttattactaantttagtcacgataaattaaaaacgcgactgtatttggcaatgactactgtcatttccttgtcatatggatt

SEQ ID NO: 17924 - DNA, 1687 bp, Heterodera glycines
  misc_feature (77)..(77): n is a, c, g, or t
gactaaataagcactgcaaagaatgggggtctgggtgagaaaagagaagggaattggtgagggataagaaattttgnataaaaataaattaaattatttattttcatttatagcatatatgcatatcataagtggtatagtggctaaaccttcttactttcattatttgtccgtcggttcaattccctgatggaacagaaaatttttttatattttctttaccattattttaattgaatttaattaataaaaaatattttaatttaaattattatttttttcatttttaatagcctaaaaacccataaattaaccaaatatttggtcattttttgacaaattctgttaacaaatctcgctcaaaatttcaaaatttttccggcggcgttttccggcggcgcctatcggcaccgccgggccccgccccctcccaatgttccaaaaaagttttgaaaaaacattgccacaaaaacagcgatctaaaagcaaaaaatttaaaagattgttaatttatttaaaaaaaatacagaattttgggactcagaaaattccaagaaccccccctgataacaaaaaacgtaaatacaaaattttatgggtacatttttgaatattggcaattttcgtaacaatgtgcacttaaattttcaatttttttcaaaaaaaattttcacttgggaaaagtcccggttggtcccggtcccgggttttttcgcggtcccggtcccggtcgaaaaacttggtcccggtcccgacttttctggtcccggtaagtcccggtcccggtttttgtcaaatttcccggtcccgctcaactctagttctgatagatttcataaatcctttggcatttttaacaaaaattttcataattttttgtaaacaaccaaagaccaggtttcaaaaaagattcaatataattttttttttaattttggcgtttttgttaatagaggacactcaaatctatcgaacaataccaagaattgtttaaattggttgcttaggaaaaaattatggcaacttttttgtcggatattttaactgtgttatatttttcagatcattcctctgtttgttacaataagtaacttgtttactataatgacttttgccatttatatctttcttggcattacaatacgtataaaagcatcaggtaaaacatattaaatatgatacaccgccggtatttttatcgaaatttttgtgcttttttactggtgttttttgatcctgcgattcaacctaataaatggtaattaaaataaaaaatataggcttgccgtccgctgattcgtttaatcgtcgcacttttcgtgcccttttttgcattatcactgtgaatatcggcggctatttaatctcagcaattacttactttctgctaattccaattgcttctccggtcaatgcttttttctgcgctttaatggccgcaattcctatgaacattggcgcagtgtcaaacggacccattttatattttacaaggtgtaattatttaatttaaaaattatgttaatattttttttactattagtacggaatatcgacaggcatttcaaatagtgtttccatttgtattcaaacgaatttccaaccaaaatcaagtcgcacctcagcaaaatgggcctcctattcgcgtgatctcacaaccaagaataattgacagtgttaaccataa

SEQ ID NO: 17925 - DNA, 3389 bp, Heterodera glycines
ttgttgtttcacttcttaatttgaaaataaagtatttcttttaatttatttaaatttttgttttttcaaattttattttctaagttaattttgttatgcttttctattgttggcacctccactgattgcctttgcttcttcttcttcctcctgtgccgttctgttcctccccgcttccccctttgcttttcctccgtttgcttttccttttcctttttcgtccgccatttccgtcccattttgcttctgctgcttcttctgtgccgcttctgtcactgcttcgttttcgtccgtttctccttccactccgccaaattgggcttcctcctctccctcctcctcccgttgttgtgcccgtaacaattgggtgaccagctccaactcctcgtcctcgcccgtcactttcgcgccatcttcatcaacggcatcatcaacattgtgatgctgttccgcttgtgttgtgatcaccggttgctgctgtttctcagcgatggtccgtttccgatcacaatttgtctacaaagaacaacaatgaattgttggaaagttaaaaaatttaatgctttacgttttaaacataaaattaaacaaaaatgattttttttttttttggtaattatttttaatttatttctttcaatttgcttttgtttttcacccgtgggcatggcgttatcgccgacggcgtttttccaattctttcctcacacctttctacggtacactcaaagtggatgacgctgccaatgttcaatcttcgttgatcaaattgggtattgaaaagaaacatttgcgggaattttcgcagtcgctacagtaaccaaaggcagtttttggtttgcggtagtcaaactttgcgttgattgagttctttggtttcgctgaattatcattgggagaggcgtggaggaaaagctgttgaacagcagacgatttgattgctcaaagtcggtgatcaaatgcttgtccatgctgcaaccgtcggagtcgatcagctaaaaaaaggggcttaacaaagtcgaaattgggataaaaataaattttgatattaaaataattaaaaactggaattaggttaaaaatgaaaacaaaaagaataagcatttatttataaaaattgtttgtttaaatgaaagggcaatttcaaaaaatggtaattatttattatttaattatacagtttcaaaaaaatgttattttttcattaattatttattaggtatttttaattaatgttgataatctatgttcaaaatttgagtgatgttgcgcaactcattccaaacaatggccaacaaaacccaattgtttttacgtttttgcccatcagtgaatggcaaacgaatgggtattgtggtacatggtcattatttgtgcctgttggtcaccaacagcagaaggaaaatgcaaaagttgaagctgttcttttattgggtgtaattaggcatcatttggaagcctaatggacacaaaaagagtaattatcgctaatatgagcaaaaaacgaatgtgcattcgaacaaaagcaaagggagttttgtgctgatgaagcagcatttgatgaaaagaaaaaagaacaaaagtatgaacaatttataaaaacataaaaagaaaaattcttaaaccaatgaaattaattaaaaatatttactatcggagaggcttataaaattaaaaaatatgagaaaattaattgaaataacttaaaagactttaatttgcaagagtcgaaaaattgaaatatatttattttttaatattttaattgaaaataaagtgcaaattatggtgtgatttgggagaagctgttgctgaaatgattgtgctcgtggtgtcgtcgtatttgctgctatttgcctctctttccgtgcgcaaattggcgctgcgcgacaaaagttggtcgatgggcggaggagcgaagcggggtgagggtgggcacaacaaatcacgacaaatggggggaccaatgcccattaaggggttatttgcataatttaaaaagggtaaatggtaataaaatgaacatttttaatttttggtgatacgaacggaaaagagaaaaaaaaataaacgaacatttgaacattcgctggccaatttaaattatttaatctttagtcacaattttattcacctgcactttcatttgctgatcagctgcgatcgctgcacaggaatggacaaaaatgctggtccattccattggttgaacagcttgcaccgacagattgtattcagtgccaaaaaaggcgatatcaacagggaaacgagaagcggaagtgccattggaagagacaatggccaagcgaaagtcactaaattgtaaaactagttcaaattcaaagacgtagccagggtgaaggaggccaaccccacagaaaaagccaaaaattatttctttttttaaaagaaaacgtttgaaaaattaaaacaataacagaaaatttttgtaatattttaatgaaggccaatttgaaaataaaactattacattaaaaggaaggaattcatcaattccccacaaaagccacctgctgggttgatcagcagaagaaggaatgtcacttgatgaatgggaccagccggtacaggaaatgttcacagttctgtcctgtttcagcatcaccagcggatgttcatgtacttcgagcagtacccacaatgttgaggtgtccttaattttttgaatttcaaatgcactcacaacaacaagcaatcaatcatttagccaacaaagaaatgcctgccggggattccccggcaggcattgaatggtatggcatggcaattccatcacataattaggcgtttagagagaaaggaaaagcttttcattcaaccgaaaatttatgccattttaaagcattcttcgacagtccttcagcagagaacaaaacaaagaaatgcagcaatgatttctttacaaaattaaagggaattccaacaaatggcagcagaggataaaggacgaggccctcaaaattaacaattttcatttctctgatcgcaatcccttttttcaagtcagaaaaggaggggaaacaaacggcgcaaatcgagtgcaaattgttttgcggcaatagcgccataatttatgccaaactcagcagcctaacattacgattttaggaatatcctaaatacccgaatattcatctattgttagtgctgttcgtgagttttgaactcgagttttgtttcaaagtttgggttttttgagtcttaggtatcggtctcatgaggtcaaaaaacggtcatttaagcactcttttatcttgccgactttcacggcaattaagagagacaattatgaaaaaacagatttgaggaatgtcttctcaaaaaatttagaaatagcaaatgttttataaaataattagggattagaa

SEQ ID NO: 17926 - DNA, 2062 bp, Heterodera glycines
cggtgctaggtcgttccacaaaaaagctcagtgtgggcgttccacaaaagagctcactgatcgataaaattaaataaataaatttaattattcaattcaacaaaacacggtgccgtccggttaatactaatgtacggcgggacgcaagtcattttcaaattttttaatttttcattttttgacatcacttctcgccaattttctccatttgtagtagacctagcctgacgccattgatataccgttttttagagctcatcgagctgtacaaaaaagcggctggtaccggcaagcttagcttgggttggccatcgacagggtcgggggcgaggctgagggtcatccggcagatgtgcccgaccaatgacgggctccaagtgaatggatcaagaaccggacccggcctgggagatagcccttgaaaaactgaacaaaaaattgttcttaaccgggccggtccgggttccggatcaggcacttttggtgccccgaaagtggtgcgataggcttccggaaaatgaccaatcaatcactgagcttttttgtggaacgactcaccacgtcactggtctattataaatgtcttaaagcaaaatcaatgcgatcagaagcaatcactatcaaacaaaaactatcagatgccattcattagcgttttattggtcattatttgcaaaaatgccgtgcgctttcagaggcgggcgtcgcattgtgtgccatgacgaccgttacattctgaagacggccgccgagaaacaggcggtgatcgtgtccaacgacgagtaccgcgacttggtacgcgagaatccacggtggcgcgcggtggtcgagaatttgttgctgatgtacagctttgtggacggaaagtgagtagggagagagaagtcgggaaattttttggctaaaattgccaaaaatcggaaattttgctgaaaattgggtaaaaattaattgggatgttatttatttgaaggtttatgccgcccgatgatcccctggggcgacgtgggcccaaattggaccaatttctgacctttgcgcacactccgctgaatgctcagctgtgcccttacgcaaaaaagtgcacatatggcaacaaatgcaagtgagtgaatggcacggcatggacaaaggcgtaattatgccaaaaaaaataaatgaataaataatttaaatatatttttaaagatatttccatccggaaagagtaaacggcgtttggatcagtgcaaccgagcggttggccagcagaatagcaaacggaattggcatcgaaaattcaaaacagctgttggccgcaagtgagttattaggggggggggcaattaaaaaggcgggttattaagggtaattaaaatttaattaccgttttaatgtttgccttcagggccctcaatgatcgctgaacactcgcagagacaaaatgcttcttcttcgtcttcatcgctgttgccgacgacagtacggcacaacaacgtgggacggacgcggtcattaaactgcggcggaggcgtaactgttgcgccgccactgttggtcggattggcatcaccaacgacggcacaaatggaggacgagcagcgaagcaaacagcgggaagagaaccaacaaacatcgattacggtgggtgtggatactgtacgcatacagtcgggagtggaaatgcaggtggaatgatactgtattacgggagggaaatatccgaatttccgagagtttggcttataagggaggtgtagaagctaatcctggatttattttagcccaagaatcgagcccagcttaatagtgcttttcgagaccgaaaatttcccgaaaccgaaaccaaaaaaaactcgagacttccctcgagtcgagtgagactctcgaacagcatacagtcgagaaatatcgcgctttctcaagaccaaccgtagaacttttgtgccgtgcgttcatgatcgaaattttatttcaatttatttgcagcacgatcagcaacagttgctgctatccccgccgttcccgcgccatggccatcaaacgctgttccgtttcgagtcgagccccgcaggcgccgtcg

SEQ ID NO: 17927 - DNA, 2741 bp, Heterodera glycines
ttggctccggcgccaaaaatgatcagaaaaaatattgccccccgttccgaaaaataaaaaaattgaaaaataatgatagcgtggatatttgaacactcacagttgggtatgttcccgtgttagaggctcatttatcccaacattttatagcgtcctttttccgaacgtttggatttattaactttacctcaacttttttctcacaataatttttaattttgtttttaattgtttataattgctttttcctgactggtttttacgtataaaatttctgagtttaacacacttacaggttgcacacattctgcaatgaatctaaagttttacaataaacatacgcacatttttggagaaatggttgttagagaaaaaatgtggaaatctgctttcggtgaaaaagcatcgcctggatagtatgtttttgatgaagagggggacgaggcggatgatttaacgtaagattagtgcaaagaaatttcattcataattaattataaatttagcctcggagtttcggattttttgcgccttgaatgtgtgctggattttaaaaacaagaacatttcttttacaaagaatgttgtaacgtattttgttgactttgagattgacgaccaaccggacgatgagaacgccgcttaatgttttgaatttttaaaattctatgttttttttttactttattggttacctaaataaatggattattttttcccttcatttcattcattatttcttaaaataattaaatactttattatttgaactcatgtaactcgatctttgtcatttttaaattttgcttttgcatagaaaataatgaccgttgaaaaatcggtgtcaaaggctgagagacggcgctgcttttttgacattcacatcgatggtgagcctgttggacgtattgtgatggaactgtttgacgagcttgttccccgcacgaccgagtttgcattcaatggacatttttgcgtattttatttgaaaacaggaattttgtgatgctctgtactggccaggccggcattggcaaagtgacgggcaaaccgttgcacttcaaaggctcaatgtttcatcgggtcatcaaaaactttatgatccaaggcggcgacttcagcgccgcaaacggcacaggaggttcacattttttacaaagttattgtttttggtcggaaaatggaagtccaaatttgatagttttgaggaaaaaagggtctgtccgcaattgcattggcattcaaaagaagggttttttggtgtgttaaaatattttgtgacgcccttcatctttgtactatgattattcatgacgattatagggttgggcctacgaaccagaaaattcgtccagtattttttgttttgtctttgtgctgaaactctccctggttttctgaccttatttgttttggactccgtcaatgtcccccaaattgaatgaccatgtaaattccaatttttatgatttaggcgagtccatctacggcggtgtgtttgatgatgaggcatttgtggccaagcatgaccagccatttatgctgagtatggccaaccgtggcaaggacaccaacggctcacagttcttcatcaccacaaaaccggcgccgcatttggacggaatccatgttgtgttcggcaaggtacaacttttagtttttttcgcttcagtttttttcatgtcgttctaccgcgaaaatgtcgtgcagttacaaaagttttttaatttaaattgggttttggctggttttcgggcagtttttcgtggtttcaattcgttttcgtccatccaccacaataccaaaagtttgcccttcatttttcgaatttagttatttttagagggttttccgaattatttcttcaatttttaaattatttcaaaatccaaattttgtttcagctgatctcgggccaagaagtggtcaccaaaattgaaaatctcaaagtgaacgcgaagagtcgcccgttggccgacgttgtcatcgccaacagcggccaattggtgaagaagcgcagtgcgtcagcccatgacacggaagaggagggggaggaggagaacgaagacaggttttttgggggaggggacgtcaattacacattcagatgacaataaatttgccatgatttgggatttcgaggcttgggagattgggtatccaatagggatttgttttttcaagaaattgggaagggtggaccgaatatgaaacaatttttttttgcatgcgcatttcgatcccaaaaattcataaaaattgaaattttcaagagaaaatggcaagataggcaggaacagatgatcatttgatttgcgtccgtcataatgaaatttaaaaaaaaaattagaaaatatattttcccaaactatcccccatttagcaccaaaaaacggcaccatacgcgtaagaaggagcgcaaacggtcttccaaacggcacgacgaagaagaggaagaagaaaatgcggagccaacagcagtgcaaattccgaagaatgagccggagaacatttcgtcagtgaagctggaggatttgccgcaggtgccgaccaccaacaaatttttgatgcgaaggtgcgctttcattattcgaccattttgcccactaggtccactatcgacaactctgcatacattcacaggggtgtctcagcccaacggccatacgacggacgattgggacaggggggtgtctcgggaccgatttatcatacgaaagtccacgtttttctccgacgacg

SEQ ID NO: 17928 - DNA, 996 bp, Heterodera glycines
ttgttttttgaaattttaagcccaaaatgggtagatttgtcattttttgtggtctgagaaaatgattaaaccggaaatacagaaattttgtggttttcatatcacaacctcttaatatatgacttagactattggtaaaatttttgaaaaaaatttcgaatttcgcttttcgcatattttggctattcgcatttcgcatttttcaatttcgcaaatttcgctttttatttttcaatttggtccatctctggtgcaaatgtcttttttggggcacattatttgttgtggagcttcataactttattcacattcaaaatgattcacaatataatttaaaaaaggagagaattttgaacaaattgtgaggtgtacaaaaaaaaatcaaaaaaaaatataactactgtggttcatatgtccttttaaagttgccatgttaaacgaggcatgagcagcatcaacacgaaatgtggaggagagctaattttaaatgaacattttttatatttaaataataattggtgaacggaaatttttatcttcccatcccaaatgccgaaaacgaacccagttatcactaaatcaaaagggaaattgtttacgatggtttggatttaaaaaaactaaagattgtatcggttcagatttttcgaacatatgtaatcaaattttcgttattgtgattttaaacacccataaaaaatgggccaaaattatttaataatatcacgaattgaaagttagcgactctacaattaaactctaccgtttgcttcgagttccatttgaacaatctcaatcagcttagaaaaagttggataaatcaaagcttataaattaggcgaaaattgaataattatgccataacagaaaaaacttttttagtttcaattgactctcatgcaattgaaacgctgaaaaattgtttgcgtcattgtcaatttacatttagagaaattttttcaaaaaattatgctagcttttagcaattttcgccac

SEQ ID NO: 17929 - DNA, 1608 bp, Heterodera glycines
  misc_feature (1557)..(1557): n is a, c, g, or t
atcggattaaccttccgtattttccgttgccgttttggcgaccatgatgatcaggttgtgccaagatcgatcaggaaagatcaaattccactgtggccattcgctgaaattctaattaccgttgttccggtgccgtacgatttcgacttggttgccgggcggaatgctaaattagcattaaaaaataactttccaaaaattagcatattccaactttttttttaaatttagaattagactaaaccctacccctacctatactctttaccccccccccccacttcgccgaggcgctaatgatttattaccaatgttgccgagcgggattgggccgtccatgatccgttttccaagtccgagtgcgcactgcgcagtttttaacccacatgctgctattgaaatttttttaaattattaaaaaaattttttgacagttattcccgtaaaattatttttgcatttatttttaaatttactaaattaaaattatttcttgctatcccaatatcaaagttcctttccttcgagaaatttaaaaatgtcaggagcaactctgtgaagacatttaaaaaaaaccgaaagaaatacatatagaatttttgtaatacaaaaaattctagtaattcatctagtaattcatttaaaccctcacatccgattttgaatgaaatagaaaacatttgcaatttcccgcatcgggtcggcaaagcaacccgaaaataatcaaacttggaggatcagtaaaattcaagttcagttttcaaaatggtaattatttagtaaacaatttcatttccgaataaatttttcgtttttgattttgattcaaagaaaatttgtcatttttaagtctttcgcggtttttaagtaagcaataatgattagaggaacttaaaaaacatttttttaaatatatttggcctaatttattgaaagttaataaatttttttgaaattttgtaagcaaatagagaacctttaaggctatcggatgataccaagaattaaaaattcggttgttttatgggggtatgtcattgaaaagtactgtaaactggaacttaaatttatcttcaatttaattttttcaatttttacccaatataattttgtaaatgtcgtctaaacaatgtgctgctgccaaaaggacaaattgtgaagaaatcagagaagcagtactgttcggtccgagggtttaaggaagacaatcaataaataaatgtttattgacgaacaataaataaaaagcgaagacaatttggtcggaggcaaataacaaaataaaatgaatgaggggaaagaccaggagggagggaatgaccgtctatttatgggcgagtgacaacaacaaaatggcggggatttgaatagacagatcgccaatataattcaaataggctcatccgaacacctccccttttgagcggctcacggcgagtacctttgtggggcacgtctattccgttgcgggtatcggcgtggctgaacttgctgatctgcttcttcggccactgattcgtcgttgtctaacggactcagatcattctcgagtccctnctcttgggccaggggaaggggctcatcctgagcttccaactcatggcaatt

SEQ ID NO: 17930 - DNA, 3297 bp, Heterodera glycines
ttatgccttagaaaatttaaaaaattgtttttcaaaaaggtgtataccatcgacaatattaccacattttttatttgtagtgttattattattattagggctttaaataaaaaagataaaattgaatttataacactggaagcccatgggatttaagagcatgcatcacaaattatgtgtgttgcggaggtctacgtcagaaaatcgggcacaataagataaaacgctatgatagagagagattcttaaaaattatttcataaaaataaataaagatgaaaaattgatagcggactatttttattgaaaaaaacccgggaaaaatactgtcaaacttttgcttttaatgattattttggaagaaattcaaaatagtaaattgaaattttgtaatttcaaacatatactaattcatatattcatacaaaaataaatcaacaaaaaaaaattttgctcccaacaaaaaataagtaaatctattttaaaaaagctttattaacacagcggcccaattttgggctccaagtacaattatgctggatttttcgtcttagtggtctgtgagttagtcaccaaaagggggtctcaggttcgagtcctccttatgttgtgtgttaatttcaatttcttcttttacagaagaaggcagaattatttttttattaataaaagttttcgtgtcaataaaaatcatattcaaaaagcgttggttacgtacaacatcgacaattttatgaaatttttttagcttataacttggtgaatagtagagcaaataaaaccattttatgctcattttgaagggaaaattctggagaatattgtaaattttatttggtttggccttaaattgtggacttggctaaaaaagaattaaattattgaaatgttcatcccttgtaaaaaaatttttcctattgcttaattttcttaaaattttgcataggccaatattttgacctcctctagcgattccaagtttattttatggaacttaagtttttaactcgagatcggctcttctaattttacaagggaaaatcccaaaaaaattttaagttttgcaaagttttggcgttctgattactaaataaataataaacctatttgcactgagagcccaaaattggggccgctgtgttaataatgttaataaaaaaaaatcccataaatttctttaaatgaaacatttttaattgcatattttcttttcctattttagaaattaaaatggcttagtgacgagggcagcggggcacagcgggggacaaaatatgccattctaattgttgtgcacatatttagcacatcaatcgcttgacagaacgggggaccaaagcaagaaccaacaacaaatgaccaccaatctttaaacggcacatttgttctgccaaaaaaaattaaaaattcttttacgcatgggagaaaaaagaaataattcccgcggggaattggcggggcatacccaaactcaatatggcacgggaagccgaaaacgaaatgagaaggcaacatcacaaaccattggcacatatttatagttagggcttatattaggggttatttttgaaaattttagcgtcgattcttaggggtctaatttttgttgggcataatgcccaaaagacgctaggtttttcaaatttttggacttttaggctctaaaaataaaaacttggaaaataggccctaataactcgaaaagtaagccctatttatagttattgagagcaaagtttggccaagtgttggtggacaagcaatttccacttttagaaaaatggtggacgacgaatggacgagtgagtgaatgaatggaatggtcgcggatggcataagcaaatgggggtggaaaggggggtaaataatttggtgccaatggtcttccgaccgacccgccgccagtggttgcccgggcaacccaacccatcggcacaatcggcagaaattggcacagttatttgagacaaggttgggggagggttagggacaagcgaaaaatagccacaaaaaattgagggggaagtgaaaagtgtaagaagcggacggtaatttaacggaaaaacaaaaacaaaactttttgaaaagacgcaaaattttaattacgaaatgagagaagggcaaataattttttttaggggacacttaaatttctttgctgaattttatttaaaagatttgttaaaaggatatatttataccaaaaaaatgtaaatttttgacacggttcaatttttaaaatttttaacagtttgaatttatcaatgtttataggtcttttttgaaacaatatccaactctttaatttctgttttaataaaaataattttattttgattactctaagaaagataaaattgttttcgattcaattaaaaatttgaagaaagtgtcaatgttgtgacagccttgagattaaaagtttttctttcaccaataaatttccgttcgcgagggattacatcgacatttgtgacgacattgaaggattatcaacagtcagtcacaatgttttgccacaattttgttcattttataccaaataaaatgccattgggataattaattctctcgtcaatttttttttttgcccagtttttttttttcaaattttatcctcgtaatatattgaattttgtcaaaaagcaagttttataaagaaataattttaacataaaatccttaatcagaaatgcaattagaattcataaaaatttaaattgacaaaaattttaaaataaataaaaatttacaaatattttcaaaattccaccatttattttccatttaatttttaaattaaatcataatttgtgtgaagatttatatttttgggctttcaccgaaacaaatttataatttttatcaaggttcgaggccgaaaatccaatgtttttttctgcgaggaatggctttttggctttctaatcctgtgggtgcaatcttttgctgccccattaccttggattagggtgactcaccatgaccaatttttaatcaaacatatgccatcagcagaactaatggacgcattaacgggacaagcagcacacatatttataagcacaccagattagtaggatttgggtgcaaaagtcaagaagtacgatatgttttcggacattggatgagacgagcttatcccttccctaaatcataaatccgttggccagcaaaagcagcaaaatccccgggggctttaatggcaggagagaagcggctttgtgtagtcggaaaagcgatttgttattgggtgaaaaaggcttggccgtcatatgatgacgccaggtgaccatc

SEQ ID NO: 17931 - DNA, 946 bp, Heterodera glycines
attttatgggggtttatttggggatttctatcctcaacaagaaaaaaagttattccagaatttctggaaattttcgattttaattataaatttcaataccattatcaaaaaaaattttcctttcttaaataaaagaaacaaggcaatagcagagaaattataaacagtaaataaattgatcaatcccaaaaatcgcagataaaatattataaaaacttttaaaaagatcagcaactctgaacgcctttcccttcttttagcggctcgttaaaatacttttcaacgtattctccatccaaaaattctctctcgaataattcctctactaattttttccatttttcctgtaaataggggtaattattattaacttttgaacttacaatttacattgatttccttcttactgagtaaaatggacacttcaagttcacagctagaaattattttttgcgccgccgaatcaattcgattttttaattctggacccgggtctaactcatcgtcaatctgaatcattaaaattttttcaaaaaattaaaatattttttacgctaatgcgccccaaatcatcgctgaagccatattttttcacggaaaggtaggccaactgaaacaagaacagaaaaaacgataaaaataaacacaagctactttgttcgcttcctttacatcgcccgaacaagccgttgtggaatgtccattccacattatttccgatattctgccggccaaatatgccttgatgttgccgaataccttctttttactcatcatcacttcgtcgagtttgggcagcccatacgactaaatagaaaaacaaaatcaatatttaattcttctaaagaataattatttttacctctcctaaggcaccactttttggtatgattgtgacgtatcgtagcggagtcgcatcgccgtcaagcaccgctacccgcgcatg

SEQ ID NO: 17932 - DNA, 2785 bp, Heterodera glycines
  misc_feature (18)..(18): n is a, c, g, or t
caattctgcgcgttcttnttacctcaaacttgggtaaattaaaccaaaaatttaaatacaaaatgaaaatgtaaaaatacaatttttacagtaatgatcgatggggtgaaaaaaggaggaaatgggagttttcctcaagtgtgatgcgaatgaatgtgccgataggggaatttgatcggccttaaatatgagcaaaaatgagtgggccgataatgaattgcatgtgaatggaagaaaaaatgcgtaaatgagtgacaggtgagacgagtgaacaaacaaatcctacaaaactttactagggaaaatggggtgatagcgtaaatgggccacaaaatttagttactaaaatagatattctcattaatatttcaatttttaaatatttattccatactttcaaacattctgggattgcccaaacaacagtagcaataaaacttttgggcataataataaaagaatatgccaaagccagaggcgttcagactgtcatttttcatattcaaaaattattgcaaaccatccaaactttgctttgcatataatccttaattttcggctttctgagggaaatcttagcaaataaatcaaaattaatttaattattactacaataatgaacggaatttttttaagatcgatccttattatcattatattttatattatttccaaacgattaaacattgcttgaaaaaaggattgatcttaaaaaatatccattcattattgtagtaataattaatttaattttaatttatttggtaagctttaaataactatttgggcagttttagcacttaaaaatttcatcccaatttataactgtttaaatttcacatctataaaaaattgtggttgcaaaatgcaaattaggcgattgatttgtcaatgattcgactgggaaacatcttctctactcgcgatgagaaagagccaaggtatggccattctgcgctaatttatttatccgagtggtgaattgggaaagcaaatgtcctatcgttaatttatgcaatggaaacgaatatttttcaattctgcgcgtcctttttttaaattctaatctaggccccaaaaccgaaaattacttcagggtttgatttacttttttcctcttttgattttatttttcttttaatttttatttactcattttgctgtttattttaattcacaaaaagtaaaaataattataatttaaaaaatatacagttttatctcgtgatcataaatagggcatagaattatatggaaatccatattttttcctagactctgggaggcgcctgggatgtatgaaaaacatgtttttagcttggtttgaagcttctagagtggatttctatatccatatatttccatatttcgccatttatgtccatattttggtattttgtccatattttatgtccatatttcggcatttttccaaaaacatctattagaacggccctatcagctaaattggcctttttgacccccaaagatcggaaaaattcccaaaagatcatttttttgcaaaattttctcgagaatattgaatttaattttaaatttgtaattttatgtcaaaaataagcaaaaaagcgaaattttcgctttttgtttaccttacatttagcgaatttgaagaaatttggagaaattacaccctcaattttgaaaaatttatgcccatcttttgtcattttatgtccatatttgagattttcgcaattttatgtccatatttcgcgatttgttgtccatataattcaacgccctaatcataaattaatttaatttaaaaccttaaattcctccgtatttcttttatgatttctaaaagttttattgtcattgttatgtggcaattttggcctttttcggttcaaaaaacaacacacacctttaaagaagggatcaagatacaataatggacaatttttcaatttctcaaaaaaaaattttcttttttttcgcctgtaaagtcactaaatataacaaagactatcaacaaactcaaaatgcttagtaagaaatagaggtggaacgcggatagaaaaacccgcggtcgcgctccaacacagttaagaagtgaccggccgaaaatagttgataatcgagcaaataatctttatttttgaatttacatattatttaatatattttgaacgaatttatgaattattttttgtattttcctcaacatattatattaatcaaattcatcaacacaaaatattagcactaattgaaaaataataataatttacccaaattgccaacaaaaagtaaggccaaaattaaggatgccatcaagaaaacagtcattttggacgagttgaacatcatttttaatggtcaaatgttgaggcaaaaaaggcaatgatgagcaaaaggaaaaggacaaattgtatttaaaaataataattataataatatttttagagcccggacgggaccggggccccgcggggattttgccgggacccccggtcccgggttttttgggcaaacaaccgggaccgggagtgccggaaaaaacgggagtcccggtcacggggccccgtacgggtccattttctaagtcccggtcccgttcccggccatttgggccggaaaaacgggactaaatttcaccagtgaaactgccccaaatttgaaaaaattaataatttttttggcgaaatgtttttgtttaaaattttgatatgaatgtaaaaatctataaaaattttcacgctggaccataaaaattcatgtattctcaaaaaattgagttaaaatcgcaaaactttat

SEQ ID NO: 17933 - DNA, 1501 bp, Heterodera glycines
  misc_feature (6)..(7): n is a, c, g, or t
  misc_feature (20)..(20): n is a, c, g, or t
ctgcannggtcggtcaaaancggacgaacaaaaaacagaaaaagcaaatgcatttgagagtgaacacccaaaccaatttggcaccaattaatttgaggattttggaaagacatgtcctggggaagccaagctcattagccgatgttggtctgtccttattaataaatcagttcctttggtgaatcacggcttttaagaaccaaaaaacccctaattttctaaacaatcttacaaatgattcaaaataacccaatcattcacctttctctgcaaataagtaattttctcgccaaaatagtaaaggacgtattcgcgactgaaaaattccgagaacaaatagcacaaagttgagccgagagtggtgagcacacagcacaaaagaaagcccagccaaaggccgaacacagcgccggcggcgatattctgagaatggagagaaattagaagggaaatgccaatttattgtcaaaaaagtgcgggaatttgtgagtccgtctcggatttgtgaatgtcattttctaaataaataaaaagtacggaagcattgaatgaatggttattttttagttcatttgccagtgaattcactcgtcgccaacggtcacaaaaatttggttttagcaaaaaccagaaaaaatgagccgggaatagcgaatgtctgtttgtagagataggcacagatgaacagtgttgtgatgtaggaagtgtgcctagttttgtacgctttgaactgttcggccattgtggtgaaattctcaaattgcgtcggcaattcaatgggcacggaggaaaacggagcatctgacagggaaagaagcctttcagaacaaagctgaaagtatcagaaaagggacaaatgaccaaaagattggccgagagtctcgactttcaataattgccagatataattaatcacgcggtacggttacaaactcagcacactgaccaaagcatggccaagggagggaaagtcgcccctttttaggcttttgccaatcattcgcccattggcccgtcacatttttttgttgttttatgctcacttctgccgttctgctcctccttcttttggtgaatggctccgaccatttgactttcgtcgccccattcaggcgcattgcaaatgagcagccacagggagaaagtggcggccacgaaaattgccgggaggatgaaaagtctcgtcattcattcacagctacggtagtgacgggaggaggcatacggtaaatattttatgcgaattttaactgagactgtttggatttagtttattcagtgcgtcaaaaagtttttaaaaaaacattcatcagcaaattcatttgggaataatccgcgaaaagagtgggcataggacaaagggaaataaaaggggggaggagaaggggatgcttttggtttgataataaatcaaaacttggagataagacgagctctgctgataggcgatcactgagagcggttgatggggaagtgatcatcggctcagtgatcggaaatt

SEQ ID NO: 17934 - DNA, 949 bp, Heterodera glycines
gggcgaatgaaaggggggaaaaagagaaagggggagagatcgccggggggtcggatgctaatggacgaaatcgaaagaaaaagctgctggacaagcagttcaatgcacggagtttggctgaggaaggcggaaaatgcgccccttttagcgggacgaaaagccgccgcaacagcacaaattgaggaagcgaaagagaggtcatggagagggatcatccgaacgaaacgaacagccgaaagaagaaatgaggcgagcgaatccgggacaaatgggaaggaaaatgaggatcaaaggaaccaattaataggcaatttcagcggacggaggaaaagccaacgaacgatcagagaaaggcaatcaattaattgggacagtttcccccgaacttcgacgttatcagtgtacacgagcacaaatcacagcaaaacaaaacatttgctgtcacgtcatttgcaatatttaataatggtgccagtcaattagtgaaagaacgaacctatcaaccgaaaaatatttttattaaataataaatacaattaatgaataggataaatacatatatacatttgtacaaaaatgatgtgaaaatcccagcagtatttaataattaatatttccatagtttttaagtggttttggggttgggtaccctaaacggactcaaattgtgatttttgtccgctcccccaaaattcaggtttttctaaattttacatagagctcgagcccgggctttcgacaaattggaaatgcggggacaaatgacagcacttgaaaataagcaaaaacaaattgatcattaaatttcctttaaaaggattagaaaatttgaggtactaattgcttaaaattagtattggaaaagatcggtgaaatattttgagggatggagaaaatctcgcttttccatgagggtctcgccccatcactgccaataaactctaaaatg

SEQ ID NO: 17935 - DNA, 1785 bp, Heterodera glycines
cgaaatgcacaacagcaggcaatgattgaggcgactgctgttgtgcagcggaaccggcttggtgttgggccaaaaatgcacgaacatcgtcagccaacaaaggctttttgttgaaattgaccgccacttttgggcccttttgcatcgttggctgctgttgatattgttggtttgcagaaaaagatgatgatggcaagcaactaaatgaaaaattcattaaaatttgaaatggaaacgaggaaaattttgaaaaattttttttttggttttaggtctgattttaaattaaaggaaccaccgacaatgccgataaagagccaccgatggaaaaattcatgaatttacaataaattattaacaaaatggtgatgagtttttttaaatctgtccgtttttttccaaaaatttctcacctatcgggactcaaaatcgtaattgtattttaggaatttgtaattaactccttgcccaacttttatagtatattgtttcacttctgctctcacctggccagggtggccaagaaagcgctttttcttcccattttggtgccaaataagcattcggcagcaatcaataaatctcgtctttgttgccgattctcatccgtgccgccgtcgtcgtcttcgtcaacatccgttccaattggcgcctgaacgcacacaaccgacccgattgaagggctctaaagaaaagataatcaaaaaatttaatgtaaatttttaaaatttgagaaaaaccggtaaaaaacttcactttcccggaaaatctcccattttccgatcactaattatttgtaaaacatttataaccaataaattaacatgcaaaacacacttctccactgtccgcaaacatcaacagttggtgcacattgctgctgctcatttcgcccattgcttttgttgggttggcatttgatttcattgtgcactgatgccacaaatggtcggccaaagcagtcaactccactcggaacacgtcccgttgaccaaccaccaaatatgcgcaatggtcgcaaaattctgtaaaaaaagaaaatgtttttttaaatgaatattgcaaaattaatgggttacaccaccaaaagttcgccgccgaaattttctttatagaaacagaaaatttccaagaaaaaaaattcaaaaattaacagcgattttttgtgttaatggcaactcgtagtactagtccgaaatagtgacataattttcagccaaaaattcagaacataagcgaaaaatttcaacacagaaatgcgttttttgcaaaacaaaatcaatataaggcgaccctaagaatatcaatacgcattttagtttattaaaattaagaactgaaagtgtcttctaatggcgcaatttatgtattacatacttttagatttaaagtaatagctaattaaaccttctctacgatggttttttgtcaagtatttgattttcaacaaaactatacaaaatgctaaaacccgagcaattttggcctgtctgcaagagggaattgagatatgtataaccgaaaatatttacaatttgttctctattcttgaattaaaaatttcttagttatttgatcaaaaattgattaaaatcccaagattaataaattagaatatggtacccccattttcatgattgccgatcaaacatagggtagtcaaaaaaaaccgaaacattcaaaatcctcttttccttttttgtttaaaaatgcgacagaagaaggactccaatcgtcaacaaaatgtgtaaacctccttagccgtttgacgggcatcctccatgt

SEQ ID NO: 17936 - DNA, 1505 bp, Heterodera glycines
  misc_feature (22)..(22): n is a, c, g, or t
  misc_feature (1409)..(1409): n is a, c, g, or t
  misc_feature (1425)..(1425): n is a, c, g, or t
tttgtatcaatgacgcattttncactgacgcattttccactgacgcattttctggtcacgaataaatatgtgcctcaattttaatatattttggtcacagcaaattttccatttttgttcaagatttcatgaatacttttggatttttcagtttttcgtaaatatttcgaaatttttcataaatataaattcatgccctattcagctttgcatgtaatatcgtttcgtctaaccacaaatggaatagatcactggattgaatgaatatattgattcttcatttatacattatatattatattactagacaaattttcattttaaaaaaagttaacattaaattcgccaatcttttcagtaaatagttctgccagaccgccaacaatttcttcaaaaaacaatatataattctactatttcaaacttttcttaccaaaatttcctcaaatacaaatttttcttcagctcctataaaaaaccaaatttccctttgctggagttctgacttttctgcttctccaatccaaatgtcaattgtctttttaatatcactattactcatttgacctcatttctaccaaaagtgtaagcggcacgtgcccttcttttggttattttatttttgaataaataaatatgttacaggcgcaaatgtgccagttccgttttaataatgattttccgggctaaaaatgtttttttccgtgataatttaaataaaaaacaggtaaatacaaatgaaacctaagaacccacacatttttataacattgtaaaaatggctcgtgccaacagcatcagtttagtggggtcactgtcgacgatgtgccgctgaagacaaatgcaaattgtttttggtaagcctttcgatagtcggtgctaaattaatttaaaaagttttttaaacatttttttaaataaaaataatgcctcgtaaaatagagaattggcgcatttgacatggcacttatgccgaacacaaagtaaatgatttgtgtggcgcaccacaaaaacattgggttttcaattagcgaataaatgagccaaaagaacaaaaccgccgccaaatatccgccaaaattcactaagacaattataaaaagagagcgcaacactttggcattgaattgggcagaattggcatttgaaggagcaaaaaatgaactattaaataaaaataaatttaattaaatatgatacttttgcgaaagcgaatgagaacagaaattgctccataaatgaacatgatgaacagaaaaaacagtgcagtgaacatcattccatatggattttgcttctttaaaataattgacaaattactcaatgaaataatataggtaataaataattattattttttaattactccgttaaaagcaatgcgcacgatttcggaaaaactgcccaanatttcgaatgcgtatnggttggtgttggtcaaaatatatttgccaataaatgttgccaatggcgcataaacagctgatcggcaaaacataaaaagc

SEQ ID NO: 17937 - DNA, 1435 bp, Heterodera glycines
  misc_feature (1354)..(1354): n is a, c, g, or t
  misc_feature (1364)..(1364): n is a, c, g, or t
  misc_feature (1403)..(1403): n is a, c, g, or t
cataaacagctgatcggcaaaacaataaaaagcaaaaagttgaatttcaccgctctaaaatggataatttatttattttttatgtatttgctttcaacaattgcttttaaatcttaaaaactagggtgctcgaaaacgagaccataaaaagcccccagcttttctcgagccgagactctcgagcttcttctctgtacaaattcattacgagcgatgggcacccacccaaaaacaaaaagcacaaacttaagcgggaaaagcacagcgaaaagccgttcaatggcgatgaaaagcattaacaaaaaagaaaagggagcgaaaaaattaacggggagcatcagacgatttgcgagtttaaatggcataaaataatggccagaaaaggcggagaaagttaacaaaaagaaggacgagcagggcgcaatttcgctcaacgaataggcggccaaaagaatgttgacggagccgcgcagagtcctaaaaatgcactggaaaaagcttaaaaatcagggcaggatcagctaatatccttttcaaaggactgatacgttgtgttcaaaagaaaaagtgggaaaatctgtaaattcaaaggacacttcagaaaatttaccaaataagggttaagcagcgatttttattttttgtttttgcttttccgcgactttatttaggcccgcctttttcaaaaaatttttggaatttaatcaggatgaattaactgactttttaaataaattttgaaggtttttacggaaaagttggtccggcggtgccgacgaggcttttttcgaaagctcatcgaccaaatcatataataaaaccatagataaaagaacatatttttgcagttttgacgccatgttttgatcagcgcctaaaagtaccctaagaaaaatggcatctttgaaaaaaggacggttcagaatcaatgcaaaaaaggacgtcctttaaaaaaaagagatgaacccgggaaaaataaaaaatctttttcttaagaacccatggatgctctatctacccacaaaatttcattcagagatcccacggacacctggggaccttccttagtcagtaaattaaggattttttatttttgggataccatttatgcgagttttcccatcaaattttaaaaaatgctattttaccaaagaaaaaataatagagccttttaaagtatgattttgaaaaaaagtcctattttttaagtgttgtcatccaaaagtgacagtattgaaaagtatgtgacaatcacatttaaaagaagctttttttgtagaattaaggtaattttaagagtgcttttgcagtgattttcttattttggaaattttcgaaggcttttctaccgtanattgaaatanataaacaaatttaaacactttgttctaattgtgacgtanagcagtgaaaagtggcacaaatctccgacgat

SEQ ID NO: 17938 - DNA, 2017 bp, Heterodera glycines
tgatctcattgtattgctactgctgaatatgagaagcacttgcggatgtgttcgtcgctgaagtctgcggcttgtcattggacggcccaattgcgatcggagcagtgacaacagccgcctttaagaattaaataacaagcatttatatgatgcaaactaacgtaaggaggaggctgctgcggcatcgacgggtgccccatcaaattctccgggtaattgaatgcggtcgcagttgagttgagttgttcacgaatctgacgtgccacctttttttcggtcaggtaaccatagcaacgccaaacaacagacagacaccaggcctggagcacagtgcgcaacagattagtgagaaattgcctgtaaaatgtgggcctaatcttaggaagaatttggtaaaagaaatcaaatagaagtaaacttacactttggcggctcgactctccgcctcattgtttttgtagacgctcgtgtccaaatacaccaaatcactcataacctcaaaagagtaatttgcatatagggaaaaggacacagctaaccttgatcgaaccagccaaaactgcgatcgcagcatacacaataaaaggaagcaacaaggacttcttctcagccttcacaccgtggaccataagtacgacgacaatcacttgcaaacagatggacatcattgcctgtgcttaaatggaccgatggaaagaaaagaaatactgataaaacttacacataaagcgagcagtcacttggttaatccaatggtcggaggacaattggccagtgacggcctagacgaacaaaagtgaattaatgttcaagcatcggtcaaacacccaccatcatgtattggtacgcaaaaaagagactggacactaaggagaccaacaaccgcatgtaaccaatgtacagagctgccttggaaacatgaatgcttcggcacagcactttgtacttttcattctctgagtcccaaagggggtcggcatcaccaaagccaatacgcacttgctaaaaccgtcgttttatttatgtaattaataacttatactaattttactcccaatggacgaccacggatatgcttcaccattgttgggaatgattcagcaaaaataaatctttggtagtttgacaattgaccttaaagaacagaaaaaaaattagttaatcttacaattaattctcgtttttgaaatatatatatttccaccgccggcaattaataaagaaaataactgagtggaattccctctaacccttccctacaccactatgggtcaagcccagtgtcactatgggtacgcgccagtgtcagacaaaattgctcataacgccaaatagcgcatttggcgtaaatttttgcgcgctatttcaaaatttacactggaaaatgccttttttgtattttttattttgatctgccataactcgcttcattcccaattaaactgaacaaatttggtatctaaaaaaagtttttgaaaaggagaatctttttctaagcgaatgctaagcaatttgacatctcagaaaaaagttgtgggaatttcaaacttttatcatgttataacgcaagtcctaggcagctctttctaaccaaaatgctaaatttattcttttttttattgattctaaatgttcaaagtgattttgtacccttataaccaaaattattataattttcgaatttatgttttttcatgtgttagagacatgaaaatagtacgccaaaacgagagaaaaaagaaatacgttattataattatttataacttttgagtttgagcacagacaataataattgagcatagaataatgcagaatttttttctctatcgctatgcaaaatttagcaaagatttaacataacgaaaaaaagctacacatagaaaagtaaaagttgttttttacattgttaaaaataaagagatagtacgccaaagtgagagaaattacaaagaaaaagagaaacgacgagatagtactaggcttttctctgcacagtgtgcttgacccatagtgc

SEQ ID NO: 17939 - DNA, 1698 bp, Heterodera glycines
ggtttattaaacttaagtttttaagaaaaatgaaggttttcggccttatggtattgtcgaaggattcatcgacggcgaaagttcgtttgttgaaaggggcttttgagttgaacagcttcagttttttcacaaggaaaaatgtgcaggtatttaaattctacacgagtaaaagattgcattttcacttacacttaaattaaggaatttatgcaatttactgccaaattaattgcggagagatcggcgacaccaagccgaagttcagtgaaagagggcgaatatttcatccactgtatggtgcgacaagacaatttagtcggtgtttgtataacggacgaacagtgcgtgaattggtttttaattgaaaatttaccattaattatattcattcaactttataccaacctaaaaacaagataatgagatagaaaatggttacaatcggagtcgaattttgcaaactgaaatttgccctggggcgggaaaggtgtcccaatcggaggggttatatcatttatattaagcctcaatctgtacaactccaggtatcaatctcgggtcgctttcactctgctcaacaaagtgttgtctgactttgccgaacgaattctcgaattggaatggaaacggatgagcggcgagtccgactgttcttatagcgaattgcctggatttctcacccggtggcagaacccacgtgaggcggacgcactcacccgagttcaggtgaaaacatttaaatagaggcggggcaaataattaaatcgaacgtataacaggacgaagtggaggagacgaaggcggtgctgcacacgacgatgcaagcggtgctggagagaggcgagaagttggacgatctgatcaaagccagcgaaaatctgtcggatcagagcaaaatgttctacacgcaagcgaggaaaatgaacaaatgttgcagctacacctagccaagacagagcattccgtgattttatacctatattcaggcctgtatagtgaacacaattgttggttgaggttgggcgccatcataattttttaaaatttgtaaaaaaaacggtgggcatttttaaaggcatcgaagtgtttattttgaagtcctcatttctccccggatatgggcctgtcaaaattcgaaccaacacaaatgtttccatgagattcctttccattatgtctcttctatttgctatttatattttctacctttggtcacattcccgggatttcttcaaattgaataagggcaaaacgtgtgaccctttcatatttatagaaatctccttgtaatttagtgacacatttttcccaattatcaataaagtagaaatatctttttgacttaaaatattattttaaaatttttcaacgaattttaggaaaatttttgaggaaaaaaacttaattccgagggaaacgatttaggggtaactgatccgtggggggggggggcacttgctccccttttgttctgtgtaaaaaaatatttcgggaaaaacattgtaccatatttgtattaaacgttaaacccttgccacttccctcctctaaattaacaaagagtctcttattcatcaacaaattctagcatagaaaattcatttgtcaacaagaaatatcagattcgcagtgttatttctgcagagaatattttaaatgtgctcgtcgtttgcatatcggaaattggaattgtacgat

SEQ ID NO: 17940 - DNA, 1598 bp, Heterodera glycines
agtcaaaaaaattgggacaattttctttttaaattttatcggtaacctaaacaaaatcctttaaatgattcgccggttggctatttctaacggcaccaacctttaatcgaaattctctcttctcgaagctttttcacaaaactttcaattatttccgtttattttattaatcgacgcttccaaaacgttcatcatttctaatctttcttcataaaattttataatcattattttttcggcatattaatttgatattttaaaaattaatatatttattttttatattctttaataaaattatatgtctaccattttaagtggattgatgatcgtgttgatctcgattttttatgagcgcttttttaattgggaaattgtgtccggcaattatttggttggcaattcattaattaattactcgctcgagtgggtcccttttttcgtgttgcaggtcaaaaatacgccatttcgcgcgaaaatttttcgatggattgggccaacacggaattttcaccgcccaaattttcaagcgcagataatggcgcattacaagtaattaattaagggaaaacgagatattgtggattctcatcttcttcatttaaccgagagtccacgtcgaatatgaaaaaaaaatccaggtccaacgttaggcacggaaaacgtggatttatttggaaatatctttaaaaaaatccaagctctgacaagctggaattccgggacctggatttttgtccaggaaaatcgaggtccaggtcctgaattcaagtccatgtttttttcaaaatgtcgagctctagtaattcagtaattaaatttaaatgattaaattttaaaaaatcaaaagaaaaacaaattctttaggaaaaaacttaaaacccaaaaaaaaaacaaaacaaaaaaacggtataattttatttattttttagctgcacattctgaaaactgttataccgaatgccaacatcgagattaatgtaaagaatatttcaatatatcgaatttcctataaaaaaaatatgcctcagaagatttatttttcaaatgtagtgagactgtatactgtattttaggaattactgtatatgtggcaatgtaataaaacaaaaatgcatattaaggcctgcacaaaatattggcaacgatcagaaaattatgacacactgatggcatatacgacttgtgttcgttcggcattgggtacagttgtaaatccgattttaaaaattccatcgcgaatgagataatatataatatttaattaaattatttgctaaattagccaattaactaataagaggaaattgatgaaaaaaaaattactaaaaaggcgctcaacgaatttgggcaccaaaattgcgcattttgagaagggcacatggcttttgccgcgattggttcatcacttcggacggatgggctgaaaatgatttcatgttacacggtaaaaaaaaattgaccatggaaattcggatttgtcaaatccaatttccccaggattaaccactttatttagcagattttgccaacttttgtagattttggcaagaatttttataagaatttctatgggaatcactaaaatatgggaccca

SEQ ID NO: 17941 - DNA, 1447 bp, Heterodera glycines
tttgtttttgtctacgagttgcctattattagctttgctttttgtctgagttgtcattccacctggccaaacgatgtcataacatgttgttcattttccatctctttcgcattgacgtattaatgctaactgtttgtggttgtacatggccatgcgaaagttgagaatttgctaatattattttatttttattttgagaatttgctaatattattttatttttattttgagaatttgctaatattattttatttttattttgagaatttgctaatattattttatttttattttgagaatttgctaatatcattttatttttattttgagaatttgctaatattattttatttttattttgagaatttgcaatttttgagaaaataaatatttgccaatttttttaaaaaatatgtagcaataaaaaattttctgaaaacaaaacccaaaaagaagaaattaaaattaaaaaaattcttcggattacgccctccgacatttttttctggctaagggcctgggtgacaccgataggcgcctgtcaccacaaaaaaatgttttagagaaattaaatattttcccagggcacaagaaggctcaaatttgtcaattttcctatttcaaggatggaaggcaatgaacataaattttaatggatggcaatcaccatttgataaagtgccgaatgcctccgaatgcactgacggctatttgggatggaattggcgggccgataaggtgcaaaattgaataaaggatttaaaaattaatttataattattcaaattgaatttataattatcaaattgaattataattattttcaaaattgcgtcaggaccaatcaactcaactagatgatgatgaaatccatttttcaataaaaatttttattttcgttgaaagctttttttgataatttaaaaaagggtttttaaagtttttcttttaaaaagtagattaaaaaaaatatatatttatttgtattttcttttgaattgcgaaaaacttagatttttgaaaaagctagcgttttttttagagaatttctatcgatgcagtccgaaagcaattagccgcaattgaaaagagttcggcaaacggttttccaaaaaaggcgcgaattcatgcacatttatcggagcctgaagtgggcgaatgctacccgaattgtgacgatcaaatttagcaaatttaaatctaaaaaatttttatttaatttttctaattaagacatgtacgaaccaggcatggatgtgacggaattttttttcttttcttggtactgagtcgacaatttaacatataaaccacaaatttccatggaaaaactctgaaaaaaatgactcagtaccaagaaccggaaaaaacccctcctggtacgaacgggtcccatgttgcactaaaacaattaaatgaatttttaattaattttttcttggaaatt

SEQ ID NO: 17942 - DNA, 3488 bp, Heterodera glycines
  misc_feature (1024)..(1025): n is a, c, g, or t
acaccgccaaaatggcattccttaattataaattattatatattttttaattttaaacgctaaattttcattccaaatttccgttttcatttattttttctaacgaaaatttttggaattattatcaatggaattttgtgattgtcaaaaaaaaacaatttcttaaatttaattacgttaagaaattttccaaaaagcattaaatgtcggcaaaattgtcaattaaattgctacttttgaccatttgcctaattaatttgattattattaattgagtttaccaaatggcaagcagactttgaagtccaaacggttttcgtgagcccatgatcagtttgatggagaaaattgtgacaacataaaaaagcacacattttatcagaaaaggctcatagtcgatcagccattgttttgccgtctgatggttatacggagccaagaaaatgttcatattatgtcgaatttgacccgattatgatttttgtaattagcgctaaaatggaattttatgaaattttaatcagcaaacaacatttttgagttctaaaagataaataatttgatttatatttatttaaaaacaaaaatacgaatttgaatcttaaaaatattgaaaacataatttattaatgtaagcattaattattaaatgggaaatttattttaatttttatcaaattaattaatatgctttgtcagtgcaaatggtgtgattttttttggaatgataaaatttttgggactgcacaactgagtgacaaaatgatcgtaatagggcaattataaatattgtgactcctcattaattttatcagccaaaatttctttccacaattaacgattttttttctcttttaataaaacggtaaaataaaaaatgaaaatgaatcgcatgtgaattatttaatgaattgttatttattttatttttttaactttcatattttaaatgcaagatatatattaataaaataataatgttaaaatatttaattgattttaaataataaaatgttaaattacnnataaaaggatatcttaatataaaaataataaaaaatgaatttaaaatataatattaagttttatttttgttattattataaaagtttactgcagtagaactaaaccagcgcattttgttcatttaatgaattactgaaagtgaatttatctaaaaaaaccaattaattagtccgcaacgtttggttccaccttttcaccccatcaaatgtcatcatcatcccatcaaccaaataattgaccatggccaaaaatcacaccacccaaaaattcatttattttaacctttctgtggttgaaggaatttgatggattaatttatagcaaatgagaaaaaagaaatcaaaaattgttggaaagtaaaatctaattttatagacaatattggtattaaatatatattatatttgaatttatatacatgcataaaaatattcaaaaatgagaaaaaacattgatttattgtaaaaaatgaaaacaaaaaacaaaaaaaagctttttttaaatttttacattattattaatgaaaaaaacattataaaaaattttggcatttttttctcctattttaataaatttttggggtttaaacaaattcaaattcagagggcgggcataaattataatgatgctattgtaataaaagtcttttcagaattataaatgcaattcccattttcttaacaattcttttttgtcacaaacacttttattctgaaatattatttcgtaattctttatttatcatcatagccaaatagtattttaatttttgcatagaaataatattaaaaaaaaaaataaaataaatttcatactttggcagccctacttttgtttaaaattatgctttttaaaagatgtttaaaaatactcaaaatgagaaaaaacctttggtttctaacagaaaagaaaaaaagcagataattttaggaattacaataataaatcgaccgaaagaatccacaaaaaaaaaaaaaatcatttttccataattaaagcagctgtctttttcaaagttttcagagttgtaattccaatttccaatttcttagcaattttttcatcgctaattttcgggttttcttctttaatttcgaaataatgcttcaactttttaaatttgtcttcattgctatatttattgcatgctaaataaaaatttttatttttattctctcacttttataatataagtattttataacttaaaaatcgcttacttttgttgtattttggcggtgaaatgttctttcagaaatgcccaattccattacaaattctttctgtttgccttggccatataaatttttgaattcatcaattctttcaatgaattcattctttttctcatcataataactctttttatataaatttaattcttttttccatttatatatttttttacgcgcctaataattttccaattttgtctcaatttttgtttgattttttcgttgaaattttcacttttccttaagcttttctttaattgcttcaaatttgattatttctcttttttgttgatcatttgggttggttcccatttcttcatccatttgatcaactgccgcagagttatcattttggtcaatttgttcagtttttataaaaacttcatctcttttttattgtccattcgttgccgaatatttcgtcaaaatttggtcgaattttgccagataaataactctttttatataaatttaattcttttttccatttatatatttttttacgatttgcgcctaataattttccaatttttgtctcaatttttgtttgattttttcgttcatatttacctttttctcttaacttttctttaattgtttcatatttttgaattaattctctttttctttgatcatttcatttgagtgtgttccattttctgcgccatttcgaacaaaagaatgaataaattccgattgttcgatttgttcaatttttattactttttgttcactttcatttttgtcccatccgttgccgaatatttcgtcaaaatttgttcgaatcttggcggtttcaattttataagcgaagaaaaatataataaatacattcattttacgatttgggtgataattgtaaagtgaattaatatgattttattgaatcgttatcgcttattttgtcctcatcgaaagtaattaattagaaaatgtcctgatcatttttaatgaattttataatttatatagccaaggcaaatagaaaaatttgttgggcatttctgaatttcatatttcgtgaataaaaaaaaattgtggcaaaataacctaaaggtaaaagaattactattattttttttattatttagctcaatatttcaatgagaaaatgttaatgaaacaaattttagaaatattttgaaagggaagtaaagtttttggaccaaaatttaaaaaacatataaaaggaaatttccaaaaaaaattcgacgccaccttcttcat

SEQ ID NO: 17943 - DNA, 1269 bp, Heterodera glycines
caacagaatcaaagtgcactaggccatcaaatacctcgactggtactcccacatcaacaatgtcaacatccaaactgctcactcccggtacggcgaatatgtgtttaagcgtgaagggcaggtataccaagtggacggctacatcaaaggggaaaatgggaggcgggacaaaataatcgaggtgaatggttgtctgtggcacgggtgcgaggagtgttttgaggacttggacgacgaaacgaaaatgccgaccggaaagacgctgcgggagattagggaaagggaagagaagaaacatgaaatattgagccgctacgtcgacttggaggtgatctgggaacacgaaataaatgagaagctgaaaaaggacacagcaatgagggagtttttcgacaactggaaggaccattcgccaataaaaatcagagacgcgtttcacggaggacggacaggaccaatgaagctactccacacagcaaagccaggccaaaaaatcagctacaaggacttcacaagcctctacccgtttaccaactttacgaccgactatcccctcggccaccctaaaatcgtcagtatcccaccaaatgagcagacggttaactggcgttctccatccgacaacccctacaaaggtctgctcaaagtcttgcttctacctccaaacaacaacattaacgtcaccgttatgcccataaaatttgatcaacgcctcctcttccctctctgtgagaagtgcgccaaatacatcaccgcaaaatatcccaatggcctcaaagacaacgactactcctgcccacactacaacccaaatgaccgggccttcgtgtccacttgcacccatcttgagttaaacgcagcattggaggccggctacacagtccgcaaagtcttccacgtcctccaatacgaccaatggagcgacaatgtattcaagtcttacgtgagtgaaatgatggccctgaagatccacgcaaccggcttcccgtcatggtgtgagagcgaagaggagaagagtgaatacattgaggagtgctggatgaaatttggaattcatctggagaaggagaagatgaaagctgaaccggggaagcggtacatcgccaagctctgcctcaactcactttggggccgcttctccatgaggaatctactttcgaaggcggtaatcaacaatgacccttgtgttctccgccaatacaccgacgacaagaaaattgatattatggacattgagctgatggatgaggacaacgacgtattcatgct

SEQ ID NO: 17944 - DNA, 1581 bp, Heterodera glycines
ttgtcatttttaggtagaaaagtgcataattaaacacattaacatgtatgcagaattaagcaacggaagacacaatattgaaaattattaagcatttgggaacgtcgtttttaggtagaaatatgcagaattaagagaaagaagttacaatttgtaaattattaaggaatagaagatacaattttaaaaaatacacgaacttgtcatttttaggtagaaaagtgcataattaaacacattaacatgtatgcagaattaagcaacggaagacacaatttgaaaattattaagcatttgggaacgtcgtttttaggtagaaatatgcagaattaagagaaagaagacacaatttataaattattaaggaatagaagatacaatttaacaaaaattaagaaaaataatgattaaatgaaggaattactcaaaaatgtgtaaaaattacacacatggggtgtgtgtgtatgcgtatgtatgcatgtgcgtgtgtatgcgtatgtatgcatgtgcgcgtgtgtgcgtgtctatgcgtgtgcgtatgtgtgtgtattgtatgttttttcgagggtgaggataaagtgtgtttgaaagttctgcataatatttattaacttatataaaacttgttaattttaatcataaacacaaagaatgctccttgcctaattcaacgtaaaataattctaattataataatgaacatttacaattccattgaataagtaatattcaaaggaaacaagagaaatagacaattttgaatctaagattgaaccgagaatagaaagtaggtttgaaaaacagctgactgactgtatgtgacgagaaagggtagataagggctaaatgtatgcgtgaagcaggtcttgtaataggaataaatggaaatcatatgaggatattgtagtgcaccatagaatcaaggacaattaataatgggtgtaagagatagagatagagaactcagaaatgtggttgaagagagtcaatattaaatagtgagaatttaatatgagttagtaaggcaaacattaggtaatgtatagggaagagaatagtttgataaagaacaagaatacgaacacttggaagataacggttcgagaataaaacatagtgttggaagaaaagatattgaaaaatagctaatggaaacgattatttagacaatatgtaggtctgaaattaataaggaataacagtgaaagtaaacagatatagaagagtagagaatgtgtattacggagaaaaggaaaataattcaaataaacccgaaaccaaaatctctaaatataggattttgttaagaaaacagttggcgttagcctctttccatttgttccttttagaggaatcgatttacaggataagatgacgcagtgacctcacccccctctccttcacttatttggtttcctcaactctacccttcctctccaacacatattcggtcattattgctccttaccatcgcaaactcagttattggctaccagagagccgagccttgtgaggtattggttactggcgggccaagcttaattaggtattggctaccggagagccgaaccttacgaggta

SEQ ID NO: 17945 - DNA, 3120 bp, Heterodera glycines
  misc_feature (3069)..(3070): n is a, c, g, or t
  misc_feature (3084)..(3084): n is a, c, g, or t
aaagtcctgaaaccaagtacacgggtgttttaaaggtcgctgatcacgaatatgacaattatttgggcctattaagcaaatttggcgctagttataaagtgatagattttgaattttatcaaaaaccataggggggacccttttgttttgtaaatttttttttggataaaaatcgtgaatatactttttattcaccataattgtgctgttaatacttaatattcatcattatgtgtaaaaaaacaaaaaaaaattttgaccaaaaaaaagttgaaaaaattttcaaaatagtgctctttgcaagtagcgccgaatttagtgtacaaagggcatctcagttagctattataaaaaatttaaaatggcttgaaaacagtaaaattggaaaaaagagaaccaattgagattttgcaaatttacgatctgtactttaattttaattgtctcggagaaaaataaaaattatatttagtcaatatttggaagttttaaaaaatcagtgacatttccgccgctttctttgtcaatccatccgtcaatttcattttctgtgacgaattctccccgtggaattggccgtcggtcgtccgtttggacaccacttcactacattttcaaaccaattctgctttctgatgagcaatacaaaagtgctttgataattaaacaaattgacttaatgatggtgtttcgatgttcacaacaaataaaattattgtcttacaagtattttgaagagtaaacattttcaaaataaatcacgatgaattttttcctcgaatgcattcattttgctttttaaaatgcttattactaatagcctcaagtggctctcatttaaaggccaaataaatgatttcccccctccaattttctctttctttccaaataaatgatgctccctcctccaattttgcttttccttttttgctgtcactttgactcattttcctcttttctcgttctcttcgacatttctgctgctatgaaatgcccaagagtgaatatttcgtaaccttgtctgacactttcatcgatttacttcaccattccatcctttccttctccatgcttcgttttccccgtccattgcctttaaatgcattctctggtctttgcttttgccttattcatttattgtagaaagttgggacggggatttgaagctatctcatttctgtgtttctaatttaaattttcggttgttattaagccaaaatcgggaagggtcattccccgcctctgccggccattttcgctgcccgatacattattaaattgttagtgcgagagcaacactccaaatattattaaaattaaattgctttttaattaaatatttttaaattatagcttggatttcgcatacaattctaatgcttccatgggttccattttttgtttgctctcaacagcagccatcacgaagggcgaaacatcagtcaaatttgttcgaacaaatgcttgaggtcagagcagtcggaacaattatcggaaaagagcaggatgggccgtcgtacgaaatgcttttccgtttaacaacggacaaatagaagcaaatctgctccttttctgggcaaaataccgacaaaaactttgaaaagggaagtcgcaaacgaagcaaaaacggttcggtcttttggggaacaaattgaaatatcaaaggaaattaacacattgaaagaataattcaacaaatgatgacgagaggaaggaggaggagcaattcgcatctctgaaaaaccgttgccatacaatcgcatcgacaagcgcaccttttgcttcgacaaaagtgcaacagaacggcgtggacagcaatcattctctgtctgcaaaacaggcattgtttggaattaacacaaaaatacatttttaacatttttactttttaatggtaattagcaaaattattttttgtgtatagaaatgcatttaatttaccattatgaaattcagtcttcgtcctcttctcccgttgcatccacaaaaacttttcgacggcggactgcctttgaaacttcggaagcaatgcgtgaaattttcggtgcatattctcctttctcatcacagaaaaaagagaattccggagaatttaatcggaaaaaaatggcattggaaaatgggaggacgatgaacggaactcagcaaaacaataaaacagcgattcgaccgtcggagtttgaggatgacacggagaacagagactttgaaaatttgtccatgtcagtgtcggaggcatcgtcagaagtgggaagtgtgtccatccaagacggagcaatgcaaaaccaaaatgaacggccaatgcttgaaaatggaatcacgaaaaggaacgtcagactgaaaagtggtgagatagaatatgaaaaaatttacgtacaggttaggtgaaaaaatttacgtacaggttaggcaagaaacctggattttctgggtaatattttagagtttgttcattcaagtggcaaatgttgaccaatattttatttcaatttatcaaaaagtgattgaattaaattaattaaatattccaatatttttcagatttaagaatttcgcccgcaagttccggaagttgggagagggcaattcgtcccgtagtgaacaaacatcacaatgccaatgctgcgtccgttggacggcgacctgcggcgaatacccaacgatcttcggtgtgttggtattgtggtgtgaaaggacatgccgcggcccattgtcaaaaaaagcgcagaaaaggccaatgagaattgcgagcacagacccaaaggaatgaatgtgcgagacaaatcggaattccagtgattgattatcgaatgtatttcacccatttttcactaattaaataagtggttcattttcttttttttcttgaagttgtttgaccaatattggcgtcataattcgtttttatttttctccgacaaccgaatttaaatttggtgtgaaaaaatgcttaaaattgagagggaaaagaaccaatatgtacatagtaagaaaaaatgagaaaaggaagcaagcaaaaggatatagtgggcattggattgtattggttttgttttgaggagagcgcgnngggagaatcgatgnaatgacagaccaaaggcagggcattcgcttattcct

SEQ ID NO: 17946 - DNA, 1645 bp, Heterodera glycines
aacttagccataatttgggtccaccgcggtacttaataaatcaagaacttttaaaatattataaatttaattcaaaaacgataaaataaaataactgtatttgcaataaattatttaaatcattaaataaaacaaaatattaatattttctcgaaattctcctttcaaatagccaattataaatcgacagatagagccgcatggacggtccttgaaaaacaaaaggcagaccacaacaagaaactttaaaatgcaagtaaatcaaggaaaaaacaacaataatttcaaaacactaaaaaaacaatgaatgcaaaactttaaaataaataaatatactcatagaaatattatatataaatatatcattaataaaaaaataccatcttttaaaaaaaaacgattttattttccgtttattcaataaattaaataacacatattttaaaataaatcccatgtgcaaacttttaataatcgatatatgattgatttaaatgtgaccaaaattttgttacatatttttaattgtaatctttattaaataattatttgaaatagaaattattttgtcctttgatatatttttttataaaatggcttttttataactgatattggtgaacacaaaacgaaatttttcaatttgaggcattagaatagaaaaatctaagtaaatgatatataaaactcttgttattttaaaaatttaaaggctacgaacttataaatcatttttatatctctcaaaaatatgaagaaatggtgcttttttgttttacaaattaattttaaaattgtcttcagtatcgcatttatctgtattaatatattttaaataatatatttatttttatgcaattttgaattatgttttctaaagtttgacttagattttgtaaaaaatatttattataagctctcctttattattattatctgtgcttttctatgtacaatatcttgagtaattgaaacttctgaaatgcttgtttgcttatcgtttacttattttgaaaagtttttaatcataaatatgcttacatttttttgagagatgaacaaaattttattttgcattggttgttttgaagttgaccattttagatgatggtattgtaaaggttttatttataatgtattgtattgcaagtgatttttagcttctcaatcttttttacaacaaaaatgttaattttaataaattcaaaccataaaaatcaactttcaaaattttgtttttaaaataaagatatgtttattatatttaaaaatataaaaagcaaaattttaaattgaataaaattcaaaacttgtaattgtcaatcttgaaattctctttaaatcgtcaatgcttaaacataatatatgtaatcattagggctgccaattttatataaatacatatttttttgctggcttctccttgctctaaatagcaggaaaaacactcttttttgtgtttgcgaacaaaaaccgggacttttatttacatatttttacatatttcgggattttcttacatatttgtacatattttggatttttttctatatagccattttgtgtctagttcatattttacgggggaatttctttcccaaaaaaaactataaaaaaaaaaaaattttatttacttatttggggg

SEQ ID NO: 17947 - DNA, 1399 bp, Heterodera glycines
aaaaataattcgatataacatgtcttacacgcattaaaataaaaatattaaaaatcaaatattagaaaattcgcaattaaaaaaacaaatatgcagttaatatattttactagatttagctgaatatttatgacgattaacatacaaaatcatcaaaaatataataattaaaaaattgaaagggaaaaattattgaaagtattataatccatagaatagaataaatattctcagcaagtaaatttaaataaatatgtatttttcatttaaataatatacaaatgtgaaatatataaaacttttttaattcgtaattgaattattttgtcaatcttcaatgtgaaacttatttcaaattcattaatctatctatagcaattaaatttaatgaatatttgatctacaaaaagcaaacaacattaacaatataaaaatacatattaaaataatggaattgattttcttttaacaaaaatttattttaaaagcctctccaactcgaaattttaaaaactaaatatatttaacgaaattaaaaaatcaataaatataaacacctatatcttgaaaaaacttccatttaggtattgtaagccgggactcgggtctcggctaccgattgggattgaaggggagaggctcctccccattggaacgcccaccgggattccccttttaagcgatggctctcccagccgtcgaggtcagtcagtcaattccccagtcatcactcccactactggccctccccctaagccgaccgatgggacggagcctttccgcgggggctacggcccagtccaacaatccgtcggtggacggaggagatcgatctccggggttggaattaagcaggccgtatcccgaaacccggcacggcttaactgtattttatgtcgattgcccattgaaacatatttttcaagaagatgttcaaagaactttaatataaaaccacaagaagagaataaaaaatcaaagtgcaaaaatgttttgtttatttaagcaaaagataatctgcatatagaataaataaaaattttaatttaaaattggctaaattgctttaataaacaatcataatattcatttgcacagtgtcaaattggcacacagcagaatttgagcggttgctgccgttattcttcaagatgaagctaaaaaatttatcaaatattgaattttttaacattttttaatgttttaatcttattttaaacttttcttatttattaataatagctgaaagaatttttattttttttattcgactttaaaatttaaattatcctaattacgatatacaaaaatacctatgaaccaaaataccaaaagaaggtccgacatatacatcatctaattacaccatcagagaatagaacgtgaaaaatgaatgaaa

SEQ ID NO: 17948 - DNA, 3171 bp, Heterodera glycines
  misc_feature (33)..(33): n is a, c, g, or t
caggggtatggggcggaccctttttgacgcttntgtactctggtttcgcatttgttggcagtgtttctttgcttgttgtgtgtgctgttggcttacatacccttgatgtttgtgaccctcgtccagtgatgaggcgataaatgtcatatcacgcagtgccattggttggttaggccttcgtgacctttggtttggtgttctcggtgcttgtacaggtgctgctgagacgacttctgcttttggttggacgtagtgatggccatattctcccatcacttcttggacttctttccggactgcttcggttagcacatcccggaatttggttgtcgtccagtttgccggatcctctcctttctttgtgaggatgcttcgtaggaatggtggagtcagcttcttctccagcatgaggaacacctgcggtccctcgatgtcctctccggcattgttcagctcccttgtaaaccgctcaagttgaagcagaaagtctttggtctcacggaggcttcggcacggcttgagattggccagttcgaagtgaagacttctgatgtgttcctccggagctccgtacgtgtcctttaacggctgaaggaccgtctcgtagtttgcgtcttccaaccggaagcccgctatgagttctcgcgcttctccgcccagcagattgcggagcaagttcagcttctgcgctttgctgattgattggctgccgattgccgatttgaaggattcgtagaattcgggccatttttgcttttggccaaaaaatttatccagttgaattggttggaattggtagagcggtgctgtgaatgttggcactgtcattggtgctgccatcgctggtagcatgggcgcttgttgctgcggattggccaattgatccgcctttgcttctctgtcggctctgcctctgtgcagtttggctgcggcactgagcgttgcttcgagatctcgcaaatcccgaagtttggttgttgctgcgtcgtatcggtcggcgattttttcattcttgtcgaatttgacgtattctttttcgccgttgtctttgtcgtctccgatcagacgaccgagaagttcgatccaagcattggatgaatctcgtagactgtccatctgcatttccatcgagcgaatttccttgacgacgcgatcaaattgagcctccaagttgatggcattttcccagtttgacaggtccgggtcggggtgtagaaggagtgaggtggcgcttttggcattgtccagagctttgagtgcattgatgatccctttttgtattggcccagacattgtgctgtttgattgtgcgtgtgtgtgtgtgtgtgcttgttgttttgtgtctttttccgagatcagtctggccttggtcctggaccttctgtgactaaacacctgcctcggaggacaaggtgtttgccttttgccttatggctaaactaaagcctcggaggactgttagtttgccttttgccttatggctaaactaaagcctcggaggactgttagtttgccttttttccttatttgtcaatggcctagtgcgcgaaaacaccctttttgcacgaagtacttcctcgaagggcaagtacttcgtccactacacaacaccttccaaccctctgttcggacgaagtgcttcctcagagggtaaacacttagtccgctacgtccctcgtgaagttatgcctcggaggacaataactacacgaaactatgaacactagacaagcctcagagggtccttgtctaggctctctaatttgcttttcccttcccctgtgtcaccgggattcgttgagtcaatccgtggttcacagatccacccaggagcgccaatttgtcccgattgcgttcggggccaaaggtcgggcactggggtcggggtaggcagggacgagacacagaattaataaaaaatttattccgggaaatgacctcaaacttgggtaattaaaccaaaattttgaaatggtgaacgaattatcacaaattgatcacagaaatgccatcaccggggaattatcacaaatggaattgggcaccgggatgggacagaaatttcagaaatggggcaaatggaaagatcacaaaaatcaatgatagggaccgggaggaacagaatggaggataccagggggtccacaaaacgaagaccaacaaccggggatcaaagaatgatcacgaatgggggttatcacagttaaaggcaaatggaaggtaggggagagaaacggcaaaaatgcctaatgaattttggttgtgaaattgggggcatttttggccgcttaaataacaataaagttaaataaaaagtggcaaatgtgagcagaacaaaaatgggccgaaaattgggcacgaaatgaaaaacgggggacaaaatgaacagatgaacaaaatgggcggaaaacgggaaatttgggggttcatcgttctttggagtcgattcgccaaattggggacgggggcagaaaagttgcggtttgatgaattggtaattaatttgtgcgcggagtgggggaggaacacagaaaaacaattaacaatttgaaggaaaaaagggacagagggatggaacgccgaaaacacgtcgcgcggcggggggagttggtaaagggggcgccttccctcttaattcgccgatcattgattggcgatcggaattgaaattccgacagtcccaaatttaaacaaatttttttatttgtttaattcttctgaatttatccgagaaattggatggacttgtatatattgattggcacaatgtggatagcctttgggtagaggggtaattccggctagagaaacggaaggtatgtatatgtaaaagagtcaggtactaaaataggtgctaaaaaagtgcaaaataggcgctaaaaacgccaataaatattggaaaaatccagtgtatttatgcacaataattacaaaagtgaatcatttctgatcaatttcgcccgcacaattgcaacttctcatgaaaacaaataaattttggagacgaattttgggaaattttttcatagggaatattttatgaaaatttgttaaattttttgggagaaaatgaccttaacaggtttataatatctcattttaacattttaaaaattatttattggtattctaaggttcaaataaaaagttttaatttttcacaggaaattt

SEQ ID NO: 17949 - DNA, 1949 bp, Heterodera glycines
accgtttcggcgccgccaatttgaaaaaaaaccataacttttttcttggccagttcacattagcaaatctggcatcatttgaaagctctagtgtgctctatatttaagaatgtttcaaaaataaaaaagttatggcaaacggcggcgaaaaagtcaacaaaaaggcaacttttgagcttttttgcccattttttaaagttttgcgggctaatagagaatcctaagatctaccgaataatgaataaaaaaaataatttttattcattcgttgcaggtgaaaatgagttacatttccttaatatttccttacaaattagcaaatgttgacattttttaaatcaaaaattttgtcaagaaaaaaatttgggtatgaatttttgagaaaattttccaatccaggggtatatttattttttgaaaattttccgggtcattttggggagtattttttagaaattttttaggtcgattcttaggggttgtattttttttaatttattgaatttttgttgagagattttccaaaaatgttgaaatagtgacacaacgctaaaataggtagtaatagtgagttttaactattttagtgacgaatgcgtttcttgagctccaaattctgattttttttaaaggtatagataaaaaatttataaatatactctcttatttttgtagtgatttattaataatttaaataaattttaaaaaaacatcgacaatgtttggcattctgttggttttgtgatttcattgtccatttttcaatattttttgtacacaaatgtgccaaatgagctctgcgatgcgtcacccccgggcggtgtcgtcgtcggcggcggaatgccatgtctgctggagatggagtagtgctggtactggccgccagccaccacgggtgccagacttttgtacgcgtccgggccaagggcggagctctggaaaagtccttgaaaatcataatgctaattttcataatttaaaaaatttcatttaaatagcaaacagtatttgttttgagaatttcttttattttcttggcaggcgaaccaatttttgaatttttaaaattttttttttttttggaatttttaaattcttttagaaaatttttatgaatttagcgaattgttttttgcctgaacccatccgggcaaatatgcccgcaacgatatgccaccggctccatccccgtcagttgaccagcattttgccgtgatcagaagtgccaacacgctgagacagaacggcacagaagccagcgcgagaagctgaaaaaatgggaaatttaaaattttctttcgaaacgaattgctgaaatttggccaaaaagacggacggaccattgaactcagccacaacacgttgattggggccaactcagtacgacaattttccatgtttacagtaatccgttccgccttgaggtcggccaaaaattcgggcaacgcaattgatgccgccgccgcattattgtccaaatcatcagttccagcagatgttgatggtggcattttgccaaaattggcggacacatagtgggcaatggccaagtcttgggcctagcaaaattttgggcattttaaatattctgaaaatttaatcaattttaattaaaaatttattattgaaaaaataataaactgaaatttgtcacaaaaataacagtgccttgttgttagttaagcataatctcctcatccaaaccaagggcgtaggagggggggggggaggttatggaataatttcgggatcgtgctcttcgtctgagagaaggttcatatcgagggaaggtgtgtacagacgaatacatgcgccaggggtattcatcatacaaatttctttgtcagttattcgtgattgccccaagtcctgcgtgatccctcgcaatttgatcttgtactcgtccttaccggtggcgttgtcgcttagtcacaggtcgtacatttttg

SEQ ID NO: 17950 - DNA, 613 bp, Heterodera glycines
  misc_feature (604)..(604): n is a, c, g, or t
aaatagaggatacatagggctatcgaatgacaccaacaatgtaggaatttggttggcaaagaaaaaagttatagccaaaaacttgtgctcgtacgaaaacggcccgtacgaaaacgaccccgacccgatttgtttaaaccatcatgaccaatccgtcttactaatccaagattattaaatatcacaaaagtcaacccgtcttaaggaagatatcaaccgtccgattattccatttattatcatttattaaactgtttgctagatggtttaagcccgtccccttcgtttcccactttgcggagcagttcagctgctgcatcattgttgttgtctcgcccaaatcggccacccgtctcgctgtcctcctgctgcaactcatcgcctgcctgctctgctgctgctggtggtgcggcggcagcaacttgtccaactgttggcggactcgcaagctcgccaagtgcgcacgcatatactgtacgatagtagttaaaaattactgtataacacaggtaatgaagaaactatatatatagcccgaggaaaaattattattcttttattagaaatcttgatgatatgaaatttatgagatttataaaaaaanaaatttttg

SEQ ID NO: 17951 - DNA, 1573 bp, Heterodera glycines
gattgcagttgcaaatgagtaggactgggatttttaagaccaaaaaacccaaaatagttacctcaaaaaatttttttaattaaaaatttttgccaagaaagtaaatttttgagaaaattttttttcatttcataggagtatattttgaaaaattttagctcgattcttaggggtgtattttttgaaaaaatttttagatcgattcttaggggtgtattttttggttttattgcatttttgttaaggaattttccaaaaaatgtcgaaatagtgaaaaaatagtgacaaaacgccaaaatagtgatttttaactattttagtgacgaagtcgccaaaatagtgatttctagtgaccgatagtgacatcagaatcgaaaatttttaatgcagaaatgcgttttttgagctcctttcttcaaatcaatcgagcaaaaaatttagttaaaacctaaaattcacagccctagttattatagatttgaaaattaaaaaaaattgttattgtattaacttattaaaaacctctttttaaatggccatattggaatataaattaaattaattaaaaaaatattaaatatttttttatttataaaaaagaataaaataatcaactttgtccaagtgtatttcaactaaataataagactctaatggaaagacagactctttgagactctggaacatcaacatatttgaattgaaaagatctcctacatatttatttttaatttttgacatgaaagttaccctaaaatattttttcatttttcaacaatcgaattacgtaatcgtccagtagacgggtttttaaatatataaacacaaaaaatataatttaaagaatttaacaaattttgattaagtattctttccaaaattagaaaaaatgagtaaataatatgaaatgaggatgaagtcattactattataaatcttagttatatgttgaaataaataaatattaatgtaaaaaattacgataggtgcaaaaaagattgattctaaagcttgcaaaaacagaaaaacataataattttagcggttttataactcgctatgatttaaaatttggaatgagaaaatgttttcttgcttctctcgaatgaaaaataagaaactaaaaaaaatcaacggcccgttatcatcgataataaatttattataattaaaattttaaattaaagagatttatcaattattctaattgccaaaaaagaatacaaataatattgtggaaatttaatttctaataaaaagatattcatggaagttttgacaaaagaagaggaggaaagcgagataaaaaaagaaagttattttatttatattgaaataaatttaattatcattttataagcttgagaaatggcgtttaaactctgatagattatattttttcaaaatttgggcaatggtctcattaaataaaataccttgtactgtatacgcaccagaaacaataaaagaagtaatagaacaaacgaataaaattgtttcacttaataatgcaattaaaggaaaataaacaaaaatcttaaaataatcgaaataaggtgctaaaaagtaaata

SEQ ID NO: 17952 - DNA, 4059 bp, Heterodera glycines
  misc_feature (225)..(226): n is a, c, g, or t
  misc_feature (286)..(286): n is a, c, g, or t
tttttttaaaataaatttttaaatttttttttcttggtttaaaattttttttttttcgattttcaaagaaaaaattttttttttattttcaattttttaaacaaattaaaaaaattattttgcacaattttctcgaggtatcgtctcatttttttcaaaaatattccacattaaaatttcggtacaccccaaaaacacagccgccgaaaacacagcgagacatanncacagccggaaataaactttaaaaaaaattttcaaacagaattttcaaagaaaaaaatcntatgaaaaagtttctttgaaaattctatgagaaaaaaaaatttttcaagaaatcttcggcgattttttttgaaaatttatttctcggctgtgttttgtcctgttccgttaaaatttttaaatccctccaggcaatggcgatgatgaagacgatgacgttatctttttggctgaaatgaatttgcgaaaggaatgcgacggcggtggcaatgcccaacggcgggaggacgacaatgttgagcagcagcagcaggagacggcggcatgcagcaacaacgtggcgcaacagcccgctaatgatggtaacattagggggtgcttttttgacaattttttggttgctgcatcatatatatgaaaaaaagggggggggggagtcgacccgccaacccttcctcgcttgggaaaatttgtttttactaaaaaaaaaatttcaacaaaaatcatagagttttttttgtaagaaatccaaaacaaaaattttttgtttgaattacttttcaaaaatgttccaataaatatttttggcactttgagtcggaaaatgcatataaatgataatataccattgaatagagcaggttcgatatgttcccttgttagaaatttgaaaaattgtaaatattttgttcctttttttcttttaaattaaaagtactatactagtatactgtaattatctgactgatcggcaacgatagtcactatttcggctgtgggtagggggtactgacaaactttttttttttgctttaaccactgcgccttcaccattttttcgctctgtttttaaacaagaatttcggtgaagagaagaggggaagatttatttttgcaaataaatgattttttttaatttacattttccccctattttcaggcaccgacggggatgatgaaattgtatttttgggcaaacagaaggatgaacgtcacaatggtcggcggcggcggcaatcgttgacacggctcattacggaattttaccgcccacggcagcagaggatgaggacgatgatgatgatggccaaaccaattttgtgtgcaaccggcaataatgccgtcgatgtaacatgatggattgtttaaatgcattaacttttgaagtaaataccgcatgaattaaaaattttttaacttaggaattaatgttttttatgcattatgaaaatgaatttttatatattaatctgtttttccattttgagcaattgctgtaccatcaagcgaacaatttcctcgagggaaaaaagcatcaatcgaatactattagacaaaaataatatttaaaatataatataatatgttaatagtgctagggggtgtcttgaaatttccaggccaattgaaaaaaacttatgatgaaattatgattgtcggcacgtatttgaattagcctagttggaaagcactgaatttaataaatttacaaaaatacaaaaaatcaaattgatgggaaatatttaatgaaactctgctcttgcttctcacagcagtttttttatttaactattttttagcctgcggttcccgcgcctgatcctgctcggccatttgttttccagctgcaacggggcaatgagctgtgcggcgtggcttttgccagcttgctctggcaacgcaccaaggcatcgtcaacaccgctgacgagcgcggttcgccctttcgttgcccgtaagcaaaaattatgaaaatccattaaaataaaacaatcattgagttttatattgttttttattcacttacgcattttccactggcaatttaggtcataataaatagagctatggaatatgtcgattctgtgcacaaaattgtgattatttgttttaaaaatacaaatttggcgatttttgccaaacaactaactcattcattgtcagcatgtatttgaattagcttagttgaaaggcactgaattttctaaatttacaaaaatacgaaaatcaattttgatagtgaaatatttaacaaaactgctcttgcttcgcacatcaaggtcctattttgaaagcattttttagccccctgctcatgcgcctgtggaccctgctaggccattcgtttgccaccttcaacggggcaatcagcggtgcggggccaattttggcaccgaacatgcgcttcaaacgcacgaaggcattgtgcacaccgcggacgagcgcggttccctgtttcgttgcccgtaagaaaaatttaaaggcaccggataatgcgtcagtggaaaattcttcttttgaatttgtcacattcaatttaaaagaaaactatagaattttgaaaatccattaaaatttaacaatcactaattggattattttaaatgtgttcctgtgtcaatttaggttaaaatttaaaaaaaattgatttaccaacgcattttttcagtgacaatgttttctttcggtcatcaaatttaatactatacatatgaaaaaatgaaataaaattatgttgaaaaattaattcatttttattttcatgattacagtatgctttaattggtacttttttaaaattaatttttttatcaaataaaaaaaaatatattaaataaatgtataaagaaatattatatgttatgaaaaatattaaaaaacagctttttagcaaattaagcgtgcctggctgtctctttggcacaaacagcgaaaggaattgtgatcgtcatgtgcgaacagtgcatggcggctacttcccgccggtgatttgtctgccgggagaggcgctgtgcatgtcggcggtgcaaggtaggattttgaaagtttttgaaaatttcaaaagcaaattttgggttttgatctttttcaaaatttccgttgttttcgtttcgtcctatcgccactttttgagtttctttttgtgtttcgttgttgtccgtcaaaaacttttcgtttcggatttaaaattttctttttgttttcttccaatgaaatttggacgaatatattcacactctaagaataacttttttgataaaaaaagataattgatctcattgaaatattgtagtctagtagtgcaaactgcagattgataatgtggtgttcattatgagttcggtcctatatccccgcactttttatttatttagaaaatttttgataaaaggacaaaaaattctgaaatataaatacatggaataaaaatgaatttttaattctttaaaattttttaattggttagaaggccaactttttgttcggggcacatttgtaatggaggcacaagtgtcgcgccgcaccaaaaacgttgaccggcttacactgctgagcaactttgaccaggaagcgacagtaagtaaatagcaaattttatcccaagtgctaaataaaatttataagaaaatcccaaaaaattcttttttataagttggtgaaaacttgttttacatcgatttttgaaaaattttagacggcaatccaaaatgcttgcgtcgcggccatcgggttctccgagcccgggagccggagaactcgtttttcgaccataataaggtcgttatgcgaacacgaccgggcgagggctgcaaaatgggctcctgtggatttgccgcctttgccgcatttttgtcgctggcgagggtcgtgccgctcccggagaaggccatgagcggggccatcgacggcgtcagtttgagggtgcgggcagttgtgcacatcggtctcccaagctggccggggtgttgtcagctggctttcaccaagcgatcctgccagccgtcaacagcagggatgtaggtatggatgatgaaggtgtgccactgccggaaat

SEQ ID NO: 17953 - DNA, 2203 bp, Heterodera glycines
  misc_feature (2099)..(2099): n is a, c, g, or t
  misc_feature (2106)..(2106): n is a, c, g, or t
  misc_feature (2155)..(2156): n is a, c, g, or t
aaaatgaaattaccgttaccggtttgtctagtaccggtaccgccggtaaaaatttgcactggtaagaatgggggtctggtcgagaaaagagtaggaaattggtgaagaaggagaaattttttgagaaaaaaaaaataaattatttattttcatttaaagcatttgttcatatgcacatgtggtgtagtggttaaactttctacctttcataatttttcgcctgggttcaattccccacttggatagaatattcctcacattttctttaccattattttaattaaaattttaattttaaaaaatattccaacttttttctttcatgttaagcatcctaaaaacccaaaacttaatcaattggtcattttttttacaaattctgttaacaaatcgcattaaaaattacaaaatttttcccggcggcgcctatcggcaccgccggccctccttgttccccaaaagtcttgagaaaaacgtgccgcgaaaaaagcggtgttgaaagcaaaaaaaggtcattgatttacattaatttacatggccggagaccccttcgcaaaattggaaaattggctgctgaccccttgttttgcaataatctgaattttagtgttctttatcctgaatttgaaaaaaaaacttggtcaccctcaatatacatatacttctaaacaattctaatgctaaaaaacaggcactcgcgcgaaaactgaataaaaattttgtatttggaaaattttgtccaaaaatttaaacgttggaaaattaccggtttttaccggtaccggtaccggtaccggttgaaaaagttggtaccggtaccggtaccggtttttgcagtaccggtcagtaccggtaccggtttttttgcaattaccgattaccgctcaactctagtttttgggatgtcgaaaaaatattcaaatatatatattaattaatttgttttttatttagcgcatataaatttataataataatctttctgaacatttaaattttaaatatatttaaataaatttaatttaattaaaaaatataaattttatatttgattttctcaccatatttttgttgaatctccatcaatgttatcatatgttttccaccgcctttgacaaaacaaaaatttttattgccgccaatttttcgcctcgaaaattgccaatagaaaatatttttatcaccaatttgaccatttctcggcaaattttgcctcctcctgaagtcattgaaaataaattagaaaaatatttaaaagcaaatgttttctacaacaaaatataaaaaaacgaactttatttatcgttattttttatttggataattattcttaaaatttaataaatatatttgttaatttaccaaaattctattagaaatcaaacgaacaattaaaaaaaaagtttaatttttgaaaattttgtcgagcgatacagctgctcaaatatgggagataaggtcggaccaattcgtaagacacacaaaaaccgaagttactgaggccaggaaacggtcggtggtttggattccaaaaaatttaaaaaaatgggaatatttgtattatataaatcaaattataagaaaaatattaaacttattctaaaaaatgggaatttagggtcaggaaatttaatttatattataaaaatccaaatttaataaaaattaaattaaaaaatggacctctttttgtaccgctttaaactcccgcacgttgaactgctttgatgttcctcatcagtgctgctgaattgtgagcaggaggaggaaaattcatctgaacagcttgaacttgacgatgttgacgaacggcagagcagcgaatgttgccgaaaagtcatttcttcgatttgaagtttgacaataaatttttggtatttaacaaatagtaatattgtttgggactaaatgaattagccaggggtaggtaaagcgatattttaaatatttttattaatcctaaattaacgattaaaaaaaatgaatttaaatggtaaaaacgatgctagaacgaattccgaatggagaaaataattaaatttaatgcaaaaaatgattttaaatgtgccagccctatttagattttttttaaaaattangtaatanaaattttccttaagcatcaaacattaaaaatatattacgcattaagaannataaaattatttgcccacgcgtaaaatgttttaataataaaatgaaa

SEQ ID NO: 17954 - DNA, 1963 bp, Heterodera glycines
ttaaacagtcccaaaaatggcacatatccaatttgccatttagctttccactacaagacaattaatttacccaaaaccaattttcacacgccattcttttgactttctaaatgggttttgttgtgtgagcacagcaaaacagtaaacatccaaaaaaaaaaaaaattttagcagcccaaaaaaaatgaaaatttttaatgggccgagcctttgtccacaaaaataagaaaaacccgaacccaaaatcaaatgttagccacactctgaaattaacattttcattttgcgaagtgttggcacacacctcaagccacgagggtggcaatccggtgaacttttggccatcatagccaacatggattcgatggaccacgtcgctgggtgccgaaatttcgttgatgctctgctggtgccatcccttttcagtggactgttgctgttgcgttgtgccatcatcggagttggtggtgttgttggccactcctccgctgctgaaaattcggccaagaatgtgccgtagtcggacctttgagcttttgtcacgcgacggtgtgccaatgttgctgctgttgtccattaataaaagttcttagagaagatatgtcaattggacattttgcaaactcttaaaaaggagcgaaaagttcgtttagtaaaaaaagagagtaattttcttcccgatttttgagttattttcattactaaaaaatttttcttgtaaataatggaaattaaaaaaaaaggaatccggcaaatttttcctcaaaaccagcatcggcagcgagaggatcttcgtttttttttgtaatttttaaaagtacgcattctggcatgatgcccatttaaataattaaatttaaaaagaaaaaatccaaacgctgacccacaaaatgtccagcccacgaaatgtccaagtctcgaattttagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgccaatccaaaaaataaagaagagactaggcaaacatgccatacaaaagctagcaaattcgctgaccaaatcacatcccccaattcaagctacataaacaaatacatgtttaatcatttaatgacaattagcgcacaattcagaaagattctatacagtgaaaagccaattttacgcgtaaatatgcaaaaattaattagaaaatgtaaaagaattaattaggcaaaatgaaatcaaagcattatcattgcccaatttgcttctggcaatataaaatggattagtgataggtatgtgtgtatgtttatgtaataaaagagcgagcataatcactttttgttttacgagtgagtcatccatcccctcccctttttcacccccccccgttaattttgtctcgccctcgtgtgaaagaaaagtattcaatttattgacgtgtttatgaattcgttcgccatttagcccccctccccatctctgttccgtaacaaattaattgaaatggtcagttgaagcatgggtacactttcctgttttgaaggcacactccatttttaaaaaatacaacaaagtttcaaatttaaattctataggaaaataatgttcggcgagttttgttaacccaatggatttttggtggcatatgcagagaaagccgcgtgtcaaacatcatctttgtgaaattttcacattttagctcattttactctgaatatatctgtataaatgttagggatgtgcgagagtctcggttcccgactcgggaaatttctcgggtttttcgcttcccggtctcgggtttttagtctcggaagccgagaaatttttacaatgttaaggatg

SEQ ID NO: 17955 - DNA, 1058 bp, Heterodera glycines
tccgtttccgtcccgttatttgtgcatccatttccaattgactttttgacttttgtttgctctctttctcttcccgccctccctctctcaattttgtttactctctcacgccctctctgtcacatttttttttgacttttgtttgcactatctaactgccatttctctttttttaacttttatatcttatctcttttatctttgtttgctttgtctcactctctttttccctctcccttcccccactctctcatcccttgctacctactcttttatctctcgtccctcattttctcccaattcccacttcctttccccttctatctctattgtccttcttttctctctcactctctctctctctccctctcttcccccccccccaatttccctcttctttgcccctctttctctctctttttcctctttctctcctctctcttccctcatctttccccaatttttgctttcccctctttctctattttccttcttcccctctccccactgctctactatctttttgctcttttgtgtgtgttgcaattaatggtacaccacagttgtgggttggttgtactatttccatcccatcttctcctatcacccgtccaattttcccacaaacatttccactacatcgcttggagcaccacccaacaaaatccacccttgccccaatgaccaaaaatggactcttttaccttaatttttcgtttttctaattttaaaaaaataataaaacttaattttcgttttttcatttgtttctgccaactttgttcgttcattcattttgtcccttttacttaattcgtataatttttcagcgactttatccgccgaaagtgcgtattttttcccatttttcaaatcaaagatatgcacatgatgccaatctgtcacatgcacatattcttttgtccaaacgcttgcctaaaaatttaaatgcctttttaatattagtattagtgtggatgaagaatttttcgttacgacacttatgattgaattctcattattttaaagactgagtaatcgataagatttacgtgatc

SEQ ID NO: 17956 - DNA, 1336 bp, Heterodera glycines
tgtgtatgtgtaacggacaaatttggcccattttaaattccgaaaaatttcaaaatgccgtccaacagcagctcattttctttcttcctttctattttattgcaattttatgttcatgccaatatggtttaaaggtggttttaaaatttgtattaaaattatttggcatttaaaaattttaatttatgatggaaaatttaacgtaaattaattttcaaaaaattgaaattcattttttacacttaagtggtcggccgctatagaaattgtcaatttgcaatgttctgtcctatgctttatgtctgcttaattagtgcttctccttctctatttatccgatccgtggacacaatcatccatcatcaattacactcgattttatgaggccaaatcgctacttacgtctggcccataaatcactttcttttctctctctctctctctctctctccttctttaccctaccctctgcctctctctctatcttaatacactctctctcctctgtacctttctcgctttcctcacactatctcttaaaattaatgtttcttacatcagcagcttgtttctgctgatcaatggtgatcgctgaaagacagctttctgtgattttaatcactttgataatcaggtaaggcgccaatcgttaattaaggcccattttcggctaaaacagtttcataatttatgtactcacaaatcaggccagtatctcagtcctccctttaatgaaaaaaattggcaaattttttaaaaatttcacaattttcttaacaaatttcccccggcggcgctttcgcacagcttctgactccattattttacaaaaaaattttttgttgttgaaaatttaaccacaaaatgacaaaatttctcatttttgtcgcaaaaaaacagctacaattgtatattgtccatttgtacaattacaaaaagttcgcattgagtgctgctgctacaagagcagtagcataatgctgtttattaatccacatgcacatattatgcaccaataatcccttccctcatcatcataattaataaataatacccccgggggaaaattgcgggcggacacagtcaattagcggtagaggggaacacttctaaaaatttcatagctgggcgcgcatgttcaatacctacacaattaaaaatgtaatcaattttagaggtgacgcgggcggagtgcggaaaaaaattggaattttagatttcgcaaaaatttgaaattttcaatgcttttttcgtcgctaaacgccttttttgtaaatttatcgattttttcaaaatttcgatttaaaattaaaaaaatgactctctagaatagaaa

SEQ ID NO: 17957 - DNA, 2366 bp, Heterodera glycines
agtgagaagaaaaatgaaacacaatttatcaaaatatttatgtatattttatgcacttgagttcgctaagctttatcaaacggttggacgtgaaaaccgacatattatgaaaacagggaaaaacaacacgaattgggatggtttaaaatctgttactcaatttttcgccgtcaaaaatctttttgtgaaagctgtgaggtgacattttggaccaaagaccgtcaccaaatggaatgtagggagcgctgcaaaaagtgttgccggatggggttcgggttcccctgtttggatgtttgtgaggcgatacactgtggagaatgcaatcggaatttctacaacaatgattgtttcgagtctcacaaaaagacagcttgtagggagtacaagaaatgcaacaaatgtgtggaaacacacaatacgcgaaacaaacacacgtgcggggagaaattctgtagaatttgcaaagtctatcatccgggtcggcaatgtttcattaaaaaaatcaaactccgacagcagaaagcataccgaattgtggcttatgacctcgagacgacgcttgaagggggcgaacacaaaccaaatcttgttagtgccgcgcatacttgtagtgtttgtgtgggagaagagatggaatgcgaaatttgtaatggtccgcggatgatcacttggtctgtagcagctgggtttgaaccgatgagcgaatttgttgattggattttgggatttaaacaatttgaaacggttgcttttgctcattatgctggaaggttcgactcgcattttgtgttaaaagagctgactgaaagaggggtcgaaaccgagttgatgatggcagacctgaagatttatcaaatgaaagcgcgtggtatgtattttcgggatttctggctgctcagccaaaacaagttggcagatcttccaaagactttgggtttgaaaaccttagcaaagttgtacttccctcataagtacaacaaaaatgtgaactttggaaaaaaattgacacacctaccaccccttgaagattattgtccggacaatatgaaggaggaggaatgtgctaaattggtaaaatggcacaatgaaaattatagaatggaatttgagctaggttagagaaaatctgttttccttttaaaattgaattttaggagagcagctcaaggtttattgcgaaaatgacgtcgaaattttgatggaggcaattttgaaattccggcaattgtttttggagattactgatgggatggatgtgttgaaggacagtgtaacaattgcgggggttgtgatgagaatttttcgaacaaaatttttgagagaaaatcatctcccaattattccggaaggcggttatgagagagccgagaatcagagcaaaattgccgtgaagtattttgaatggttggctcaaagcaaaagagtgagacttagacacgcatgcaatgggggtgaagtggaaataggggattaaaagtggattgtatcatcggagctgagaaaaaaatcattcaggtaggcagaatttccttccctattttattttttgctaaagggatgtgcgtttcatggatgtccaaaatgttttttgccctggaccataggacccaatgggcgttgtatggaagtaaatttccgacgaactgagacacgaatggagtttttgagggaaaaatgtattaaactcctcggtgggggaagtttgcgtgtgttcttttctaatgtttggagcattcgggccattcgtgggtctacgacgggcgcgtcgccctcgttttttttagggatagggggacgtttctccgcttcgcggcctcaggacgggcgcttcgcgcccgttgtttaattttgtggggaacatttggccgcttcgcggcctccggacgggcgcttcgcggcctcaggacgggcgcgtcgcgcccgttttttaattttgttgagaacattcggccgcttcgcggcctcaggacgggcgcttcgcgcccgttttttcttagtcggccgcttcgcgcccgttttttagcttgttatgccgttcgcggcctcagtcaggcgcttcgcgcccgtttttcaaaatttgttgaccttacagggattataagaggtgcaataaatggtagaagaggtaaaatagtgattagaagaggtacaccagtgatcagaagaggtacaaatgtgattaaaaaaggtacaaatgtgattagaagaggtacaacaacggggaagaggtacaaccacgggggaagaggtacaacattattgaaactggacaacattattcaaaattaaataaaataaggaaatgtatttattaaaaaataaggttaaaaatcaaatgctggagagttacaaccaagggaggtaca

SEQ ID NO: 17958 - DNA, 1734 bp, Heterodera glycines
ccacatcttttcacacgcttccgtgaaaatgaagacactttagtggctctgcgatctgtccaagcattcgcaatgttcccctgtaaactctggaatgtagttgatcgagttgctgaagggttgggaagaaccaataactcagttgaggtgaatgattggcaattgcagagatgccatttgtatttatttctaagtttttgtttatttggaggagctaaatcatagaaatttaaaaaattcacatttcaaaacattcatattttgtgcattttttatcagtgcggtacttttgaaatttttaatggcatctctgttctattgcaagtgtggtttaggcttggcattgcatctggaatgttcatctgaaaggaaaccagcgcttgagctcattcattcgaaaaatgattgaagaggataatatgtgggcggacagaattgctgattttcaggcagctccagcggatggcataaggggtccatatgagcgacggaaggcaaaatacataaggcaagacaacaacctgcaagctttagtcgctgattttgatcaacgtgatccgcttgaatacctacgcgcatgtgcctaccacttacacttttaaattaagaaagatcattcaaacatacattcaatttgaactaagaaatttaagaaagttaatccatgtatttgtgcgataatatgcgataaataaacatgaaaattaaatggaattcggttaaaagaaaactaaatcaatgataaaatgttttgtaaaattaataataaaaattcttaattttatatggttaaatttgtccatgggttgaattttgccttatctggggaaaacaatcaccggcgagttcaattactggcgaaatcaaatacagacggcgagaaaaagagaaatagttcactggcgaaatcactcactggcgaaatcacacactggcgaaatcccactggcgaaatcactcactggcgaaatcactcactggcgaaatcactcactggcgaaatcaactgacatacttcactggcgaaatcactcactggcgaaatcacacactggcgaaatcactcaatggcgaaatcactcactggcgaaatcacctggcgcggttggaaacaaatttgcagacatttttttggtttaaaaaatgtgagcaataactgattagaaagttcttttcgagctctacaaaaaatggatattttatctcttatgaaccatttgctgaaaattccgaaaaattagtaattttttgaaaactttttgctttaaatcctagaaacaccacaaatggaatgattttttattttaagtgagaagcaacaaaaatcaacagatcataaatgcaaaattaatcctggtctcatttcttgttcaataggtcctcaacgccatgtgctgtctttgttaatggtacgactgacgaagacgacgaggttccttcttcgtccagtcccttcttacttttgtcctagtttttaaaacaattaacggttggagagtgataattatgaataagtcggggatcgtaaagaaaattcccgacaaaagaaatttaaatcaaggtctagaggaaatttcataaaaaaagttgaaaaaatcattgtcacaagaaattaatgttgtttagttagtttgtatctatgcttttttaaataaaatgtgtataggtatccagaaaacacaattaataatcccacaaaatttctcaaaaccatgaaaactaaaagccccccct

SEQ ID NO: 17959 - DNA, 3475 bp, Heterodera glycines
ttgttacgtcttatttactgttataataaattaagtgaaccttccctggtatagctgccagaggaacccgaatttttacaagcttaaatgaacaatattaaattatttccctattgattgaaaagcccaacaaatttgctctttatgcttcaactgacagaaaaggcaaaatggtggcggttaaataacagtcaatttggcctccgtcctcgctttatgattagtcatttctttctttctttttccgtgcttcgtcatcgctctgcgaagcgatgacactccggccgcgcgaattaaagttggggaagtgatggccccggctcgccttcgttcactacaaatgccaaaagagtactgtagaaagcttccattgacagcaacaaaagggccattggtggattccattggcgcatgactccagcaagaccaaaggcatgatcccgctcctgtgctaatcggtgcaagaggacacgacgaacttcgactggaatttgaattcggggaaggggattccatggccaattgatagggagttgtgtttcctgttgttccctaatgaatggaagcgaagcagttgttcggcctccataaggatgagagcgattcgggccaaaacgccgcggtgtgaatcggctttccccttcaattgccctttggcgttgattctgatgcatttggtggtgttgctgttgaatttggtgttgtggctgttgctgatgattttggtgttgtggttggctttgatgttgcggctgctgctgttggcatggagttacgatcatttctccattggttggcatcaattgtacaccattaagtgaactgctcgaacaactctgctggttaaagggcaccgccaccgcagtacgcaatatctgtggattggggtacaagacagtgggcgggggtatgagttgatgcatctgggcccatttaagggcatcaaatcgaaacccattttgaggcaaacccgtttgtgcctttgcctttggctgcaaatcagtgtgtgacctttttactgcctttgctgatcctgaatcattttcacctcgaattttaaccaaacccactctctgatctaccgtaccattctcctttggtgccacagtttccacaccaattactgtacctccaaagctcttttctgaacccgaattttgagtgttcaaacatattatttgctgacccgccggtgtggaatgtgccgtcgaagttgatgaatttgcttccaactctaattggcatgccctttcactgttttgagtattgttggccctctactcattagcatcgacccccacaggtacaataccaaaagaaaaatgcttccctttattgtgccgcgacctttaaccttaatcacagcctttccttcctcattttgtgaacccaatttgctttcataatttaattttaaacccccgtccttttccgttataatcaaacccaaattttggctcagaatttcaattcttttacccgttccgcttacatttctatttatcagcccactgctatcatttgcaccgcgctcgcccgcactctcaattccattacccgccttttcttccttctctttcataaatcccgcaaaaaagtcgccaaaatcatcgaattcgtcccggtaatgatcaaaaaaaactccgcccagaggataaaagaattcaccggctaacaacattggtccaagggcacttccctgcgtccgtttgattcttaaaatttgaaaggcaaattggcgatgggagactcggggtcttaacccaagaaagggcctgtccggagtcaccgtcaaattcaagccgtttaaattttcgatgtatccttcatccaatcgataccaaagggaagacccgcgattcaatgcctcggtgatccgtttcttcagacttcttcgctccgtggcactcaataatacggttccgaggtcccgtttattgcactcgagctgctccgcagcaaagtcgatcaattcttttgttgttttagttttggaggacatttttgaattttttaaaatattggaacaatggtgcctttcccgaatttcggtccatttaaatactctcctttgttccttctcgttttggataatatgaactgattcatcaaattttatcattccattttgatctttgatgctccgcatccctcccgtggacaaagaacaagaaatgcttacaaatttgcacaataaaattcctatgacaaatcggtaacccataaaatagggcagaaatcgtaagaaaatgtaaatggcacccattgctaataatagcattaaaatgagaaatgtcatatttttaaaattattaaacgggttgaataaattttttaaatcgatttctaataaatcctcccatttaataccatctccatcctttattttaagtttctcagaatttcgcactttaaattttctttcacttattggtacatagataagtctgcctttgattttaaatgaactttttcctcctgggcacacgacttgacaattcctattaactttagctttagcaaatggaagaacatcaatttggttttcgccttttttattacattttgccaaaaaaataagaccccctggacatttaacttccgcgatactttcaccccaatcagtccagcaagtatagttgagagttccccctgttcggcactcataacaacccgtcaattttccgatttgctttgccctgcatgtatttccttcaatttcagccacaatttttaaattttaaactctcactaataattgtataggactataatttgtctcacttaaaattttgtttccttctcttctcaagtttaatttatcattggtaaatggtagtttaggttcaagatttccaattatcagatcttcacagtcacattgaataagttgcccttcctttaatgtactatttatccaacattctctacacacttgcttttttaaaatacattcaaagttcatagcactgttttcatctttacaaaataatttagtttttatatcttttcccggtatattatttctttttctgatatgtgaaaatagtcgtcgagaatcggtgaaattggcggagttactcctaagggcgtaaaggaaaattcgcgccaatcttctgtgactcccgggtacagatttaattcattctttaccgaatttttcccaatttttaattcaatcccgatttttatttcgtaatcccaatttagacatctcacttgtctccacacttttccagtaatgggaaccgctattattttatagaaaaagcattcattaataccaaatgaaggtaaggcacattttgacccccatactgtctctccttccatacagtaagaatttcctgggtaatcccagtagttttttaattcttcaatgttttcactaggtcttatatttaaacattttccgtttttacatgatcccattgtcggacaccttctttcagatttaactcgtataccgtaatct

SEQ ID NO: 17960 - DNA, 1021 bp, Heterodera glycines
tattgtattttattgactttctttttgttgggattataagtttataattttacaaattttctcgtctgttgtttatttgcattcattacattacctatttcacattttctctctaattcccactccagtatatttttaagcgttttttaagccaaaatgtcaaacgagttttattattcgaacaaatacgaagacgacgaatacgagtgagcgaattggagttcacaaactcattctttgacatttgctcctttgcaggtatcgacatgtccacgtcaccaaggaggtcgccaagcaggtgcctcacaatcggctcatgtccgagtctgagtggcgaagccttggcatccaacagagtccgggttggttctggagtcacctttgactccatttgttctgcttcaggatgggttcactatttgatttggccagctgagcgtcacattttgctctttcgccgtcccaagccgaaggtgaacggcgctcagaagacgatgatgaagacgactgccaatccgagtcaagtccgagttggctgattttgggatgccgatcgatcgagagcagatgaaaaagtaccgcaatcaattccaatactcccactcatcacaccattcctacgtatcgccgtcgacagtctttctatccgatcaaacaccaaccaatgtgctcttaattacctgctgctgacttaaaataaattattttgcttttttttttttactttttttgtctctctggaagagcgctttgcagtaattgagggcaatcaaaatttttatttggaaaaatatgctgcgaaattttgtgaattaccctcccttcccccgctcacctttgctttgtatttgcgccaggagtaaaaagatggaaaaggaatttgtgatttcgtcagccatcccaaagtgtttgcctctgtttgctcattggcaaatacttcctcaaatttgttccgtttttggcaaaagaaacatttcctaaggcacaagaagaagaggaaatggtgggatggtaacctttt

SEQ ID NO: 17961 - DNA, 1904 bp, Heterodera glycines
  misc_feature (832)..(833): n is a, c, g, or t
  misc_feature (1675)..(1675): n is a, c, g, or t
gttctgtccaattcattgaacagctcgaaatttctccattttttactgagttttattggctaaaaatggcaaaaagcatttggcattgccaaaacaaaattgttttttttccactcgtcttgcacaaacggtcgcttaatcggacaatgccccgcccctttggtcatccaaatgacagctgattttgtcattctcataattatttgtctttacatagcacacattttaaggtcctaaatacgtctatggcatttgaatgctcaaatcatttctttgcccccccgttggccattttcagttccttggcccaaataagcggacattccgtatccccagaggattataaacgagtcttccgttaagtttgtgaaacggaagaacacattaggccatcatctttgccatttgtctctctttcgccaaagatcgatggcaccgataaaatttggtgcgagtgaaaagcaaacggccgaaaatggagagaatttttgtgacatttattgggtaatgactggattaaaaaaggctttgtccgatgcggtttcgttctgctccgactgttttgcccactgaattcccctcaaaatgccccccccccaaaaatttgcattgattcgcttttcccgcccatgccaatatttttccggtgcatttcccctgcttaaagaaagggactttgttgtatgctaaaggcacaacgaccccgaaatgccaaatgaatgaatgaatgactatgtaaatcccccccccccgtgggtcaacataaaatgaagaaaatcctttgcaatttcagcgggaaatgcccttgaattagttggccgcttcccttgcnncagggcaatgctttgctccgtccgtcgactgtttctccctcttctgtttctgctcgtacttttcttccaaaaggcaatcgcccgacgacgaaaatgtccaggtgggggagaaaaatacgaattaacaataagggtaattaatgaattattgttattaattaggggataatccatcattgattaagggacactttctgaggacaaaattgtgcgggaaatgtttcgaaattacaccaaaaaactgccggacagtgaacacaaagacgagagtgttcatgtcgagattgaaatgcatgttcaggtggtcatttggctgagatggcatctgccaaaccattgagacaaattggcaccgattggggaattaatgaaaagcataaaaagggaatttaaaaaggtgccatccctccaaaaaaattactattgctttatgaacaggacatgggttcgctgaacgaaatctcggccgacttcgaaattgacattttgttcacccaactttggcacgacccgtcgctgtccttcgtcaatttgagttccgaatgtgtgcgcaacatcacaatggagtcacgttttttgaagggtatttgttccaaaatacattaaaattaattttgtcggaatttcaatttgcagacatttggacaccgaacacggtcagtacgaggcaaaatttacagaaaaaattgaaaggaaattaattggctatcacagtgcattatcaacgcaaaacggacatcagtgcacgcatctccggcggacaacataatgttcattctgtacgagaacggcactgtttggacaaaccatcgattgtcagtgaaagcgccgtggcgcattgngtgggccaaaaggacacaaaattaatgggaaaatcaaaaaagataatgggaaaaaatgaaaatgctaagtatttctaatccatactttaatcaggatttaattcagaaaaaatgccaaaaaatggccatggggatttgaatcatccatccatcaggaaaaaacagaataataaaatttaaaattgggaaaaccaattgaaaatggaaaataaaattaaaacaaaaaagg

SEQ ID NO: 17962 - DNA, 1064 bp, Heterodera glycines
taccgaagtagtgacgtgaagaacgttggtaaagactgtccgatttgagcacatccaccgcacacattgaagtgaccgaaggtttgctgtgacgaaaagcaatggaagggatttgaaagtcggccaaagggtcgaggaaaagcgaatggtcttcactaagaagagaaaggggtgggaaaggacgaaagggacgaacgcacagaacggagctgaagaagcagcaggtgaacagggaggaggagggcacggccaaagagacggcgagggaagcggacaattcggcacggagagggaaacggtgggcgaagggccagcgacggtcgcgcaacagttctaaacaggcacagcgatttttggattggcaaataacgcaactgcacagacttttccaactcaaaaattaattaattaattaaaaaacatacccagagggtatttattttttatttaaaaatgaaaggtaaacatacaaaaaacatgaaaattaattttagatgtattgaaaaataggacaatttaaatttacactttaataaaaaagaccctttgttacatgcaaaagcaaccccaaagagttttcgtattgttttggcttactgtgaaggaccagcgaatggcaattgtccggcattccccgcaggcgctgcctttcgatgccaaaggcgtcgccgccgatcagcacccaattcagtccgatcagtcctgaattaagcaaagttttccaatttctcattggtgtcgcacactttcgacctcgttccattccgttttccaccataaattctcccaaattaaacatttcgctctcttttttgtcgtcattttggccatattttacacgcattttgtcaattgtcgcattaatttcgccttttaatggctcaaaaatgagcacggccaacggagtgggctgctggggacgaaaattgtcaattgggcgaataggacggacaatctgagcaaattgtgacagaataaaatggaaggacacagaataaagaagtaattctgtaaaacttagcaaaagagctaaacaagaatagaaaaaataatagtttaaatta

SEQ ID NO: 17963 - DNA, 2152 bp, Heterodera glycines
  misc_feature (43)..(43): n is a, c, g, or t
caaaggacgtgcgaggggatggccgatcaacaaattagttttnggcattggagacacttcgaaattgtggccacaggcacggtaatggcctttagtagaaggaaagcttgtatgacactgtagcaagcggaagagatacggtaccggattgaggacgaaagaggaggcgaggaaacacgcgaagagtggccaggtaagcgttggtaaaagtgtggacgcggaaaaggcgcgagccgaggctggcaaaaggggaaagtgccggagggttggcacaaacgatggcattctgatcgggggggggataaatattttattaaaattataatataacttcgatgggtgcttctcactcatcctcggttttcattttattcatttggccaaatgaaagtgccaatttgacaaatggccaagcaaaaggtcaccccttttaattgattgacatttggccatccctcgtcctcctaagaaaggtcaattgttttggagtgatcggtcaatttaattgtccttctgctgctgttgacagtgcacactttggtgccttttctcatccatcttcccaaatttccctcacctccccccttttttgccctttggcattccgtccccctcttggccatcttttctttttttgcccacccctctggcattccgttcccgtctcttttgctgcaaatgccatcctccgcaattcatcgtccattggtctccgaaccaaaatcggttcgtttcccgtgccatccgtcgtattttgtccacacagtccaaactctcttcacaaaacggttgttggtgttgctgctgatttaaattataatcataattttttgttactttttcattttttatatttttttcgtttgaagttggaaaatggccaataaaaagaattaaaagggcggggcaaaacattgaaaggctgaaaatgaaaacgaaatgccacaaaataacaaaatgccatgccattggcaaagccttaaattaaaagtctctcatccccgatttgcgcttttctatcgcttcgattgatcgattcgcttcgttttaagccttagccgatgaattggcatctaaacagcgcttaacagttccgtgcttttctgcgcagaaacaaacaaaagaattaattgggggaacgatcagcagcaaatggaggaaaagcggagaagggggaggagtaaagatgagcaaataaagagggagagagagagagaaagaagtggaggacggagggatggggaaatggggggggggggaattaaattcagtggcattgagaaaagggcaaataaaacgaatggtcactctctcctccccccccccccccccattctcttcgcttttcaaattccattataatatttattttcctttgcttccttcggcttttcgcttaataaactttgatgggcttagcatattttttgagttaaggaggcaaaggacggcaaattcaaaggggaaaatgagaaggataagaacgaggagaaaggacggatgagaaaagcattggagggggggggggggagaaaaagaacggatcaaccgaagccaaagggaggggacatttaacggaaggaaagtcgcggttttactttcaccatcactcattaaatcaattccccaggcattttctttttttctgatcacatcgacaatttagtaaacaaacgtcgatggagtgatcgtagccaattgtcaaaggatgggaaaacggggggggggggttaagagaatttctatggattgttattgtgcatgagtccttcgcttcaattcccagtttatcttataatggcagataagattaattaccccgatttgctgtacaagtggtccaaccacgcttgctaatagctttatctttacgaagagagaggcgagtaaaaataaaaggtgcatccatatggaatttttttttacattgaagcatttggatgggttgctgcttacagttggctaacttttctttgctggaaatagcacaacttttgtttgggccagcgaccccaaaccattcgaatagcaatcgattgggctgactagactccatatttgcaggaatagcaatggcaggtctatgttagaggactgacgagttgtgtttcgacaaaccatcctgtacacccataaatcgattagcaaattt

SEQ ID NO: 17964 - DNA, 4108 bp, Heterodera glycines
aaaagcctcaaagcctcacttagaaaatttagcctcatcgacctatcaaaaaaccacaaaatcgagagctaaagcctcagatctgcgaaccccggatcaacccctatttttggtatcattcgaaagcacaaagtctcaagaagctaaaaaataaaatctcagcgtttaggcaatcgccaaaaaagatttcattaattaaaatgactgataatttttgtttgtaacttctttaaatgtttagattttcttgttttctcgtattattacattattcagactatattcttttgaatgcttccaaaaagataagatttgttcgaatatgaacaaagttattgtacagaaagcaggtattgtcaattggttggactcataaaagtcgattgggactcataaagtgcactagagccattcggcttttctgggaaaatgaaataattttaaattgactatatttcaaattgcaattctcggaaactgaattatttttagctcaaaattttgaatcgcatttgtaggcaccagcaccataaaatcatcaatttactcaatgaacgagttcccatttgttttcatatttctattttgttaaagctttttattttgcatatcattttattcgcaggtatcttggcctatagcagtgaaactactccaaacttggagaatttaatagttttggcgaatgtctgtaattcaaactgccagcccctaaaaattgacacaaaatcgcaaaactttgtcatttttggcaaaatctgttaacaaatcacactcaattttcaaattttccatggcgacgcctatcggatccgctgtgccctcggcgccgctataccgtgcttttcccccaaaaattatgccgtaaaaaaagtgtcttgaaaagcaaaaaaaaggccgagttacatggccgcccaggcaaaattttggatctgggcccaggccgaccgataaataagctttttttttggtcgtgccgcccgtgcccatccattatcaaagccggactgcgggccggtgttttcaaaattccagtcccaagttgattatttaaatttggtaatatgtttatcaaaattacctaattttagatttcgccgtggccctctatatttaaatctgtttcatcaattattgtactgctctttaaactttcagcgattattaattattttcttttaccattttatttaaatgcttaattttattcttaaaagataatttctacagttcatcaatattataactgatctttgaacttttcaacgattaattattttttaccattttatttaaatgcctaatctttttcttaaaatttcgcttcgacacttgcgcctcccatttaaaattgacatttgcgccgtcctacaaaataccccgttcaaaataatccaaaaaatttatttaaacaaaattcttcatatattaatgcggtttattattttgttttccttggcattaaatttgtctttgctgctgagtttgacatttaaaacaatgcaaaaaagaataataaaacattggcataacatttcaccttaattattacagcattttttcaaatatactgtaattagataattagaaatacttattaacaaataaagcaaatttttgatattaaataaaatattaaaagcaagcacatatttcggagttttcattctcgccaattcaattcgtttttttttcaatcatacattatttctcccacaattgttcggtctacgtcagttgggccccagcacgtttgggccccagcatgtttttggactataactgttttcattgacatccaaatcaaacataattggtatcattcgaaagcccttcagatgctctattagcctgcaaaattccaaacaatttcgtccattttgaacaaatttatggccataaaagttggaaaatctggttttttgagttgttctggccataatttttttgaacctttacataatttttcaaaatttgaaggctaatagaggacatttacagctttcaaatgataccaacaatttttgatttagatgtcaaagaaaaaagttatagcccaaaaaccgctggggcccagctgacgggttccgcaattgttgcttccatttgaaaaggcacaatcgatcagttttcaatgtttttcgcgatttctttgtcactcatttttggattttctttttttattccccaataaatgatcattcaattattttactgttaataacaaattttcttttccaattgtcaattgttccattgcttactccaattttcttacaaatttcgtcataattttggctccattcttttcttgatgcttaaattcatttttcatttcaatgaatttttgtacaatttcaaatttttgttagtcggtttttgattaataaaatttcttttgattaagccccaattctttgctccatttttaaatataattaccatccctaagatttttgctatttttatttcattctttttttaaatattttcttccattttgtttaattttttcttttattttattatattgtctagagtccggaccgggccgggccgggtaccgggttttcccgggcccggcaacccggcccggcgatttttgggaaaatccgggttgaccgggttttgagaggccgggcccggaacccggttgcttctgaaaaagtcagcccggccctgcccggcaaatttgagaattccgatctctaatattttctaattttttctcttttattctcctcatactttctttttctcctttttctttccatttttctccaaatattcatcaaatgtttttttgttgctgctttttctttcatggcccaattcatgctctacttataataagaaaagggtattaaaataaaaactgatttaattacaatttcttctctcctgatcacttttatttaaaataaaaattttggcgctatttaaaatgagtaaacttttgaaattttttcactttttttttggtcaattttttttgtttatttttaatgcagaatttgtttttttaaagatggtacgcatttcacgggccaggacgttttcgtaccgggtcgttttcgcgccagcctagtttttgaactataagttttttcattgccaaccaaatccaactttcttggcatcattcaatagccctaagtatcctctattagcctacaaaatatcaaaaaatttcgttaattttcaacaaacttatgaccaaaagtacatcagaaaccgggtttttcagcttttttggccttaacttttttgaaccttaacgaaatttttcgaaattttgcaggttaatagagcatgtgaagggctttcaaatgatatcaagaaaattagatttggttgacaatggaaaaagttatagttcaaaaactaggctggcgcgaaaacgaccccgacccacctatttacctatttgtttttgtcggataaatctcaaaaaaaaaaaattgtattagctaaatttttgtaaaattttatttttttcaaattttaatatttttcacccgcaatgcctataattctgaaaaattatgccgttaaaaactttctttgaagggccgaagggcaaaaaggtcttcgaattttcccttccaaattttctagttacaggtctgatttttcgcttacttaactcgtttatcttgattttaaatttaagtatcactgatcacacttttccaaaaccgtttagtcacccatccgaaaatgccaaaatagctaaaataaaaattcgttttaaataataaatataattttaattaatttgtctcccccactttcgctgttgtgcaccgccgcaatgtccagccgattgcgtacagccggcccggggatcattcgcagctgttcccgcgcattggcactgatctgatcaaaaatggttgattgacgcgcaaatttggatgaacacggcgcatccgtgagctcgacaagtgtgatcggcagcagacggttggggtcggcttgcagcggtgcaaatgcgggaagatttagcggaatgcgcgactcaaagctgccactgtacaactggcatagcgatttgttctaaattaaattttaaaaattattttagtttacctaattaggataatta

SEQ ID NO: 17965 - DNA, 2930 bp, Heterodera glycines
  misc_feature (41)..(42): n is a, c, g, or t
  misc_feature (60)..(60): n is a, c, g, or t
  misc_feature (62)..(62): n is a, c, g, or t
  misc_feature (68)..(69): n is a, c, g, or t
  misc_feature (73)..(73): n is a, c, g, or t
  misc_feature (83)..(84): n is a, c, g, or t
tttatgaagaaaatgttccaaaaaatctttcttataaaacnncagcaaattcaggaaaanantatcannagcnaaccttgttnncttagaatggactgggaattttattactaaaaccctcgctgcaattttcaaggaaatctgctaaatacgaatacattcaacacgcatatttaaaaaatcatataataatctattttattatttttagagaaagagggtgtaaaaataaattttatagtaatgtttgaattttctacagaaaaaagttaagaaaacacaattgttcataaaagccaggccaaattaaaaaatagcaaacctttgtaaacctttacttctcttttctcgtttcacaagttattgccagaatcctcttgaggttgccaaggaaatgcatttgatttaccaaaatacgaccgtgttttctcaaaatgtatttcgtatttttttatttctttcttcagaacagaagtttaaatgataaatttcttaaattttctgctagttattaaacataaaatattttaataaaaagaattatttaatgcaaaccctacttttcaacaagttctcttctaaaagtgtttcgtcctgtctgggattgagaaattataaccgaaattctgcaatgacttttttaactattctttgtttttccgaaaaccatgacgggctacagccaacgtgttgttgcggaatgctgaaaagtttaaaataatttttttattgttggccgtctgatcctgataaaaagtatttcttattattcgttgtcgcctgaatatcgtttttcttgtaaaagcatgctaatgaacgaaatttgttcgcttttattaatttaatgaagagattcatgttgtttaaggttcaaataacggctccgaaataaattttgtaataggactgtttttctcagaaagaaaaatgtgagaaaaaatgatttcgttagaaaggatcggctaatttagaaataaactactcaacgcaaacattcttttctcaattatgaattcgaattttattgccagaattctcgctgaaactatcaagaaaacgcattcaaaaaccataatttatgtaggagtattcctttgagtaaaaaggtttcttacattgttagcttaaaaaataaaccaaagaaaatcacttcatatgggtgctgtaattttatgaagaaaaatgttccaaaaaaaatctttctttataaaaacccagcaaattcaggaaaaaattattcaaagcaaacctttgtttcttagaatggaactggaattttattactaaaaccctcgctgcaattttcaaggaaatctgctaaatacgaatacattcaacacgcatatttaaaaaatcatataataatctattttattatctttagagaaagagggtgtaaaaataaattttatagtaatgtttgaattttctacagaaaaaagttaagaaaacacaattgttcataaaagccaggccaaattaataaatagcaaacctttgtaaacctttacttctcttttctcgtttcacaagttattgccagaatcctcctgaggttgccaaggaaatgcatttgatttaccaaaatacgaccgtgttttctcaaaatgtatttcgtattttttatttctttcttcagaacagaagtttaaatgataaattttttaaattttctgctagttattaaacataaaatattttaataaaaagaattatttaatgcaaaccctacttttcaacaagttctcttctaaaagtgtttcgtcctgtctgggattgagaaattataaccgaaattctgcaatgtcttttttaactattctttgtttttccgaaaaccatgacgggctacagccaacgtgttgttgcggaatgctgaaaagtttaaaataatttttttttattgttggccgtctgatcctgataaaaagtatttcttattattcgttgtcgcctgaatatcgtttttcttgtaaaagcatgctaatgaacgaaatttgttcgcttttattaatttaatgaagagattcatgttgtttaaggttcaaagttcaaataacggctccgaaataaattttgtaataggactgtttttctcagaaagaaaaatgtgagaaaaaatgatttcgttagaaaggatcggctaatttagaaataaactactcaacgcaaacattcttttctcaattatgaattcgaattttattgccagaattctcgctgaaactatcaagaaaacgcattcaaaaaccataatttatgtaggagtattcctttgagtaaaaaggtttcttacattgttagcttaaaaaataaaccaaagaaaatcactccatatgggtgctgtaattttatgaagaaaaatgttccaaaaaaaatctttctttataaaaacccagcaaattcaggaaaaaattattcaaagcaaacctttgtttcttagaatggaactggaattttattactaaaaccctcgctgcaattttcaaggaaatctgctaaatacgaatacattcaacacgcatatttaaaaaatcatataataatctattttattatctttagagaaagagggtgtaaaaataaattttatagtaatgtttgaattttctacagaaaaaagttaagaaaacacaattgttcataaaagccaggccaaattaataaatagcaaacctttgtaaacctttacttctcttttctcgtttcacaagttattgccagaatcctcttgaggttgccaaggaaatgcatttgatttaccaaaatacgaccgtgttttctcaaaatgtatttcgtatttttttatttctttcttcagaacagaagtttaaatgataaattttttaaattttctgctagttattaaacataaaatattttaataaaaagaattatttaatgcaaaccctactttcaacaagttctct

SEQ ID NO: 17966 - DNA, 2288 bp, Heterodera glycines
cacaataattaaatggagacttaaaataagacaaaaaaaaatattcaaacgttaaacgaagaacactttaactgatcatttttgaataaataattgttaaaaaattattaacgaaacaaaaataaataaaaattcagaaattatatgaaaaattaaagttgcgcttcaaaatcgtatgtttaggaaatttgaaaactctattctaataacaatttaaaaaataaatgtatttgtaagtttagctcagcaaaaaacaatgtaaacgaaaatttaatattaaaatattactaacatttttaaaataacaatcaaaaggctgacattaaatgaaataagaataatatttaaaaaaatcttctattcaatttcttaccgaaaataaggaaatgataaattaattaaaaaaatacaagtaagacgaaattaaattagcaaaaatatttcgggataaaagatcaatggttgaaattgattaaaatcacgtttcgtaattttaactcctttctgataagtgatttaatcttttgaaacaatttactgtttattaatgtctgcgttattgtcacgtgagttgtcgtaacttacaaacctaattatttttaaaagctaggcagatttatataataataatttgtaaaagattctcaatacacaaaagtaaaaataaaaaatatttattaaataataaatatatagaaaatctgtcttttcgtaaatttcggacaccctatggcttgtcaagacaaatatttggtatgcaaattttgataaaataattataataaaaatagtttcaaaatgtaatatgaaaattaagtacaatcaaaatgtgtctttaattaatttaatttcataaaaatagttaaaaaatgaaaatcttagaccgaaagcttccagggtaagccctccaagcttgttataaaatatcaaataaatccatttaaaaatataaaaatcttatccaataatttgtaaaaataaatcatttattcggtggcaattttttctttaattttcagtccaccccccccccccccctagcctcccctttccctcttcattttagcacttaacgcacaaattgattttcctttttacactttaagatcccattttttagcttttgacaattgaaatggagtcttcaaaaataataacgcattctaataattataaagttttttgtggtttcctttattttctccaaatttattctcctttaagtttcctgttataattacgggtactttcgggttttgtgtcaacaaaatttttctctttgttaaattgatttgaaattaataaaaagtcgtttctatgggttttcggggtcgtagaacccgaatatgatgtccatttcgacccatttcgccggattcgaacaattatctaaattcaattttttttttcattttttctcctaaaaattattatcatcgaaagaaatcatattaatttggtggcatataagcaacgatgttttgcaaatggtcttcgaatgcatcacatctcttcgtttgacggaatgacgccataaaaactcgcagaagtaactttccagcatctgccgatgcgtgccactctgctccttgtttcgacgttttgcggaacgccacagacgctcaatgttttgggtatgcgctcctgtttggggatccacaaagttcagccgatgattaacacgcaagaggttgaattggcctccagcagcgatctgcacaattaatcatatacccgaacaattgaactaacacctgattgtacgctgcccaacaatccgagtggatagtgcttcatggtgcaatgcgctgcgcaataataggaagaagtgttgctgcagtgcggtccgggacagccaccaaaaaacactcgcgtttctctgcaaaatgcccccaaaaacccattgttcaggaagttgtcggccttggtgatttttgtgtttggtgaatagcgcttcgtctatttccaccgtctggttgggtccacctatctgattctgctgctgttggatgacataattggcacaaacttcgcgcatgtacatactccattctgtcacagcattgtcccaatccccaattcctttgcacaaaactttacagatgtcaattcttgtgaccaccagtagatgaacttcaaaattgtgtggaacggcagtgtggacggatcaaaccaggtgtctgtgacgggagtgtcgtaggagtttcgcgcactaaccaaagggtatggggggtaattaattaacgggaccgtcgtagggggggggggtaattaattaatgggaccgt

SEQ ID NO: 17967 - DNA, 1745 bp, Heterodera glycines
  misc_feature (1178)..(1178): n is a, c, g, or t
  misc_feature (1365)..(1365): n is a, c, g, or t
taaattcaatttttttttcattttttctcctaaaaattattatcatcgaaagaaatcatattaatttggtggcatataagcaacgatgtttttcaaatggtcttcgaatgcatcacatctcttcgtttgacggaatgacgccataaaaactcgcagaagtaactttccagcatctgccgatgcgtgccactctgctccttgtttcgacgttttgcggaacgccacagacgctcaatgttttgggtatgcgctcctgtttggggatccacaaagttcagccgatgattaacacgcaagaggttgaattggcctccagcagcgatctgcacaattaatcatatacccgaacaattgaactaacacctgattgtacgctgcccaacaatccgagtggatagtgcttgcttcgtctatttccaccgtctggttgggtccacctatctgattctgctgctgttggatgacataattggcacaaacttcgcgcatgtacatactccagtctgtcacagcattgtcacaatccccaattcctttgcacaaaactttagagatgtcaattcttgtgaccaccagtagatgaacttcaaaattgtgtggaacggcagtgtggacggattaaccaggtgtctttgcgaatccctttcgaagagttgtagaccttttctctactctctctatctctctctcttctctctctctcctctctcttcgtggttccgtccttttaggacgttaacctatggaattttcttcatccaattttgaaatcttttttaaaaaagtacattttacaaattttcaatctctctctcttctctctttcatggttccgtcatttcgggacgtgaaccgtacggtttcgtccttttaggacgagacctgtacggttccgtcctaaaaggacgtgaacctatggaattttcctcgtccaaatttgaaatctttttcaaaaattgcagtttaaaaatttgctctctctctctctctctctctcctctctttcatggttccgtcctttcgggacgtgaatcgtacggttccgtccttttaggacgagtactgtacggttccgtccttttaggacgtgaacctatggaattgaattttctctctctctctctctctctcctctctttcatggttccgtcctttcgggacgtgaaccgtacggttcncgtccttttaggacaagaacctatgaaattctttctccatataattttgaaaaattacttattgttttttttaattttcatattctgaaaacttttttaccgacaaattttgaaaaaattttgcattttcatttattttaaacaaatattcatttttataattaaaaattctgtgtatccccccccnccttccataggttacgtcctgaaaggacggaactgtacagttccgtccttttaggacgagaacctatggaatactttctcttttttttgttagccatgaatcaactggactgcttctgcttggagcctttgtacccgccggcaaatgcacctccagatgagcgctttcaagccgttgttttgccgtgttgcaccggcgtgtcacattttgcatgcattgcccgccagcttcgtcaaaccggttagaaaaaaaaattaaaaaatatttttttcaaaaattaaaaaattttcagcagctcggacggcagccggagttcggcttggtggaacatgcccttactgccgtcggagggcatttgcggaggatgcggtggcgactga

SEQ ID NO: 17968 - DNA, 3745 bp, Heterodera glycines
  misc_feature (112)..(112): n is a, c, g, or t
ctcaatgctggtcacgtcgaacacaacgataacaccatgagtgccccggtaataagtggaagtgattgttcggaatcgctcttgaccggctgtgtcccaaatctaaagttanagctaacttaattgttataaacgagggatgggatgggccgcttatggattttttaaattttttgctcatcgggccaaaaatttttttagtgatatttttaaaaatgttcagcagcgccagggcttaaaaggattctcggagaaattcgacaactataattgagattagttgtatttattttttgtgatttagattggtgatagttttaaataaaaataatgtgcttaaaatttgatttaattaattggaaaagattgggcttataaaaaattgatttgactcataaggtgccattggactcataaatgtcgatggactcaaagtgcagagtcgtgttattttgtgattgttaaattttttatgaccgtgtaacggcaatagagccaatatatgtacccatttagcccccctccccgcccacaaaacaaatgtcgatactccacctgaagtttaatctttttgcccatcacggtaatcgtccgtattttgaaatccacaccaattgttgtgatgtaactggctaaaaattaaaattatcaatttaataaagaaaaaggttataaactcactggagaaagtgttgtccgaaaagcgaaggagcaaactgcttttgcccactccactatcgccaattatgagcaactattaaaattaagggattccgagaaacaatgccattgtacaccttgaacaaatggtcatagtcacgaactggagctgcagcatgtcgcatcacgtagttttggatgataaaatttttgtactaatcgaacttgtgtgtaagatgggtctaaaaaaagagataataacagcaatagttagggcttcttttttttaggcaaatgcctaaaatttttgcgcactttatacgcacaattaagacgaaaaacgagttttccggttggtttggcgtgtctacgatggcttttataatgcctatttttgcctatttcggggtttttgtgcttaatgcctatttttgtgcctatttcgccctttttggcgcctttttcaggattttcggaaaaatccttaacaaaaatgtagtaaaaaaaatacaccccctaagaatcgacccgaaaaaatttcgaaaatatacccataagaatttaaaaattttctcaaaaattgatcgccaaaattcgatatttttttccttgaaagttttggtttaaatttgtccttactcaaaaaaaaacttctaaaaaagaagccctagcaatagtaaatctcacaaatcagaatcacttaaataaaaaaattattatttaatattggctaaatatatttcttctattttaaattcaaaaatcatcaaatatattgggcgagaatgagggtcccgttctctcgcttttgcttgaatgtacagttttgttcggaaacgaataatgcgggatttccgcaggggatccccttaccgcgatttcttaattccattttccgcttctgcatacgtttttaatttattccagcttcttttcttgaaaagcagtcaatgaatttgcgcaagaagcctaaggtttaaggatgttctttttatttaaatagcttacaatttgttatccaatttttaggtcgaaccaatagaagatgagattcctgagaatgagcagcaaataaacatctctacccgttcacataactcttcttataacgcaagttacatctttttaactttacgatttaatatttacagtctgatcgtgtcaatgaaaatgatttggttaaatcgctgtctcaatgtcttctggcaaagtatgagttgcttaaacgcacttcatttaaaaaagaattcagcgtttctaaacgagggtttgttcgtgatgccgacattggagaaatgttctcagaccgaagagaacgcgagttgcgagcgaatgttctgaagaagagtgagaaattgctgatggatgttcttggataccgagtcagaggaggaatttctgaccgttttttattcttttttagttagatcgagatgaggaagggaagcgtttttacctctcgacaaatttatgtaaaggcattgcaatggctatggtgagtgattcttttataatcatgtggtgacgccagtttttccattttaaaaaaatggaaattataaaattgtaaatcagaaaaagcactcaaaatattttgaaaatatatgatactaatttaaaaaaaaagaaacatttgaaaattgttttgcacgctcttttattacatttttaaattttgaggtcaaggcacaaaacaaaagtaccctattccgaattcctgacccaaaatccgaccaaaataaattctcttaattttagttgtgactttttgtttgggacatgttttcgactaattaagtagctcaaaaatatttaggagatatctgacgacacacaccgaggacttaacgaatttgcagatgaagatgcgtttgaggaagaatcaactgtaaattcagccggggaggagaactaatgaaacatttaatttacctaaatatttcagcaaactgaacaatttacaaattgtcttcttgaaatggcgttaatgttcattttcatgtcgaagcgacacatttcaaataaaactgaaacagaaaaaggagtggaccaaatgctcctaaagagtttcttggttaggtctttattttttaaaggatttctgctgacagtaatgggctattttttgattttaggatgatttattcgatgcttttgaacggagacctctgtcaagtaaacagttcggcgaattgtttggtcccgctaaatcagccgaatttattgctcacgttagcgctctaaaatttacatgttaattcgataatgaccaattaagggttggttgcgttgcgacattcaaagagacactgtaaccggaagtgaacaagttttgtatcactgggggcctcgatcagaaacggtcgtcagcaaaaaagtgaataacgattatatttacaattagacttgaaaaagatatttgcaaatccatttcccctaataaattcaaattaaaaataatttacaattaaatatatttgttgtgcccttttcttcaagatattgtttttaaaaattaagagaatgctcgaatctttctgtgacatctacggaacaaatccgaacaattttccaaaccatgcgaaagttgcaggacttcgagggaaatgaaactcgaatacatgaattgaagaatgatctctttggttactaaatttattgaaattttctttgactattaatttactgattaaccattctcaacgtgtttcaaaatgttttaattcgcttaattttctttacttttatgtgaaattaaattactgattatgtttaagaaacaaacaatgggttcgtctgcattaaaacaaaaaacaaatgggtctcaaccactccggaactctgtcttttggctgttcctggcattttgtatggttttagaggtttgttgtttttgggcggtagttccgcagaatttccattgctttcgttgccggggttcaaattccgatggcattaactggcaaaggtaaagattattggtcccgaaaaattttttttaaataagttttgagaaaattattttcaggggtaatccgaggcgcttagtacgaatctggcctttagcaggctcaatttcgaaccc

SEQ ID NO: 17969 - DNA, 2963 bp, Heterodera glycines
  misc_feature (1947)..(1947): n is a, c, g, or t
  misc_feature (1982)..(1982): n is a, c, g, or t
tgtcgatcggtgggggagggagtgcgaagtgtgcacgttgcattcccttcatcccctgcttcacgccgcagtgtcgcctatgctactcctgcaagaaccccaaaaccaatctgtgccaaaaaatacggtttgagtcatttcattggcagcggagtttgaccgtttgttttccgtcagtgccacccaagggaaaggactgatgccggacggaaccagccgtttcacgtgccgtggccaacaaatcgcccactttatgggctgcagcactttcagcgaattcaccgtctgtgccgagatttcccttgccaaggcattcatttgtccccctcccccccccccccctaatttgccacccttttccatgttgacaaatcggctctccttgacaaagtgtgtctgctcggctgcggcgtctccaccggttacggcgccgtgttgaacaattgtcgggttgagcctggcagcaccgtcgccgtgtgggggttgggcaccgtcggattggccgtagtaatgggcgccaaaaaggcgggcgcctctaaaattgtcggcattgacttggaaaccgccaaattcgagaaaggtgttgcggtcgtctgcttggttttgtccaacagcgtcattcatttcaagcgaagcatttcggagccacagaatttgtgaatcccaaagaagtgccagcggaacagactttgcaggcatttctgatggacaaattcgacggaggtttcgactacactttcggtgggcactttcttttccattttccaatttacctctccgtcactttgcagaatgttgtggaaatgtacaaacaatggtggacattcccttggtttttgtttctttcatttttctgacttttagcgccaagccctcgaggcagcccacaaagggtggggtgtttcgtgtgttatcggagttgcgggggccggggaagagatcaaaacgcggcccttccaattggtgacgggtcgaacatggaagggcagctcattcggaggttttgtatcagtgatacgtgaaatcacttatgaaaaagtttttgtaatttttattgaataggtttcttaagggtggaaaagtcgcgaccaaattccatcgctcgtcaaggaacatttggacgggaaattggaccttgacaagtttatcacgcacaaattcgccttttccgacattaacaaagcattcgaatgcatgacaaagggcgaaaggtaatcagaaatgaccaaaaaggaaaaggcgggaagttttggagtttagcctccgttgtgtcattgaaatctgagggccgactaaactgtgaaagaaagggttcttcgatttcgtagggaataaatgatttatatcttatcacattcgacaagaaatattttttgcattttatcactgcctttttatctaattacaaattcactttaataaataagtacccgaaaatgtcacaatgtgcataaaacaaagcagggaattggatgatctaaccaaattcgaagtgaaaagtttttccaattgtatgaactgagaaaattaatttttttggttacgaaaaatgaatttttgtaccccaacatcaccaacaattgtcagtcggtttgcttctgttggtggcggagctgaagcacgaaaagtgaagtcgcaaacgggcgctccgtcgacgaaaacctcaaaagagagaggcaattaattgtcaatggaatgggagtgaaatgaatgccttaaacccttgcgcaacagcagcaattttgaggtccgaagtggcgcccaaagtgaacggaaaacggcccaattgtctctcttcgctttgccaaactccgtccgttgtgctgtttctgacgatggctccctgcaagagggcggtgtttctccaaaattaacaaatggaaaaatttgatcgatttacgcgttttcgatcgatttgatttggcagatcgactcgcatgtgaaaantgtactcggtgccacgcaaaaccattgatggcganataggaagcgttgagcagaggggtcaaaatgacaacacttcgcgagacggcgcaaagccatcgaagggaagcgaaaaaatgaacggaatttcctaaaacaaaaagggacaaagtcaatccatggaggaaaaaatactggtttcgaaatttcgatgggttcatttaaattcgaagaatcagtggacggatcggaaagcattggggaagaaggacggggacactgaaaatggaagcgaatgatgggaaaaggggagaaaaaagacggaacagaccgtcccttggtattcgatgagctcaatggcgacacatccctgcacataaatgcatttgatcctaataattggacaaaaaagggacgttttgtaagaaaaatttgcaaaaaaaagaaccgatcaatcggaattcgatggataaaatcactcaaatgtttcccatttaacgaaacctaaaaagggaagaaaagaaccaagcgttatttcctactttcgtcgaatttcactttgaaatagtcgcgtaaaatcagaattcgaacggcgaatggtcggcccttctcgagagggttggcacagcgctgctcggccccccaaacgttgtttatcagcgaattgagcacaatgtctctgtcgggtttcgaaaatctaaaaaattcgaatagggaataaaagaaggaacggcggaagaacagcgaaatggcggaggagtcaaagcgaggattgaagtgaagagcctaaaaagggaaggaatggaaaacaatcgcaaagggaattaaaaataaaagccaaacgaaggcttggtgcggcgaaaaaagcaatttgtaaagcaaaatcggaccttatcgtcgcgatggtcgccattgacgagaattccacagcacaaatcaattgcaaagcgctgatcaggaacagatgcgagaacagtgcccttgacgaggatggccttacccggaaaaacaccgtcgagaatgtccgatgcgaacggaac

SEQ ID NO: 17970 - DNA, 3912 bp, Heterodera glycines
ccattactaataaggacaaacattttttgtcatttctgtcacgttatgatcacatcaaagcctgatcatttctttcaacattgaataatgttgacaatcatgcggaaaataccttctacgatcaaccgagcatttgccatgggtttttggaaattacaaaaatttatttgtttttaattatttttagtttgtgaagtttgtttctttgaacatttattaacagggcttccttttttatgtaagaaaaatcgcgaaatatgtaaataaaatatgtataaaaaatgataaaatatgtttaaaatatgtacaaaaagcagaaattttttgggatacattttcaaacaaaaataaattctcaaaaatcctctaaatatgtaaaaaaaatgaaaatatgtacgaaaaatgcgaaatatgtataaaaatatatacatatgtaatatgtataaaaaccccgaaatatgtaaaatacgtaaataaaagtcccaacgtttgttcacaaacacacaaaaaaaattctttttcctactattcagagcatggagaagccaggaaaaagaaaaacatgtatttacataaaaaaggaagcccgatcagacaaattttagggcattttaatatttctaaaaaattgatcaatgcgcgtaaaaattggacaaagttccttaggggcatggtgatgtaatgacttttgcttgagagcacattcttcccttctgcagctgattgtgagaccgttccatcacattaatttaattactttcgttgattgatcactctgtcattcgttgtcccccggcgggcgatggcgagaagcccacacggaaaatacggcgctgaaaaattgggtgctaatcattcattcattcattgatcatgttatgctaattatcataattttgttgcaaaattttattgtaatttttgcgtattttaatcaatgccttttgtggtgatcaaaagctgatcaaattcttgcactgattctaatatttcgcgatgaggaactatgctaatcataatacctttttgctgataaaattatcgtaaaatggtcaaaaaaactgatcaaataatttcaattatcgtataattcacaaatgatcaatagtaaactcaatagtacacatttttgtgaaagccgaacaattcaggattaaaaaataacatcactttcttttgatttccattttcaattaaggaattgcgggcattttgcatttttatttaccgatttcctgttttcaaaataatctgactgatcagtttgcaatttttagcatttttcgggcatagagaaggccgccaaaatggtttcggaatattccgccagcaccaaaagtgacggaagcggtggtgcaacagcggcagcaacagaaaaccaaaatggaacggcacaacgccaacaacaacagcagcagcaacagcagcgtcgccaatcagtaaccacgctgaactgctcggcaaacggcggaggaagtgccaatggcggcaacaataaaatgccaaacggagggcggcaagtgtgccaaaatgggacaatgccaaagttgacggacaacaaccacaatggcatcatcaagaataatggcaacagaaactcacacagcagttgcggcacaacaatttcggcactttccggactgcaagataccggggcgtcgaagctgtacagcattaatcagcagcaggagatgaacatcggcagcaccgtggcgacgatgaagcataacggggagaagcagccaaacggcaatacaattcgtgtcggcagaggaccaccaaatgcagcaacaattgagacaagcggaggaaaagtaagcgaaattaaaattaattatagaaacaaaaaattttttaatgttactgggcaattcctcaaatttaaagcaaattctcattttttttgtaaactaataaatttctaagcaatgaacaatttcaaagaatttacacaaaattgtgtaaaattttttgtttcaacttcgtagtgaactgtttctgtaattaggtggttcagggagcagtaaaaatacaaacactaaactgcccaatttagtccaataattatatttaaaattatttgatcagtgaaaaatagaataacaaaacggggatcataaccaatacaccttcatgaggatttaatttttattctatttacatttttcaaaccacaattcctaaagaggggaatgaattatttgtcattggatggcaaactttgttcctgggggggggggggattatgatcgaaattttattttacaagaatacccttaggtttgaccaagattcaaagacaggaggcggtaattggtccaaaaagtgaggttgagaccaaaaccaagaaatttctcgactcgagaatctcgagcagccctaataataatgtccaatctttacccgcgccgaaacgatttgaaatgattatgtattgtgaatgaaataatagggccaatcctgggaatatttgccaacatttttcaggctactactttttattttatttgtccgttcttcatgtattttttgaattctaccaatattctaatttttttatgcggcaactattgccaaatttggtttatttttttaaatttaaaattttttaaatcactcaaaaactgcaattttttaacaaaaaaaagaaccattgtcatgacaactccgctttatgcagaagctatcgaagaagcgaaggaacagcaaaagctcacacaattacctactttttaagtttgtatttttttttaatttggcgttttgttagcactcttttaaaaataagttgccattatgctacgtggaggaaaagacaaaacgtagaaaagcgagaatgaacaattagctgtttggtctggctgatgctcgcatataaatttagctcccgactctacaatttgggagtaaacccacggaattattttttttttgaccgtgattgttattaatgttaatggaatgcaatttttaaaatttttgataacaaacaaatatgtacattttttagtttaaaaattgctaatccgcttaacatttttctattctatgttccgttccgataacttgtgataactgattaaatgatatatttgtttttggccctttccttttctaaatcgccttaatcctatgcttaatgtttgctctcatgtttaaaatcaattcattcaaaaaaaacaataaacaatcaaatcatagatcggataaagaatatgcttttcaaatctatgattgttaagtgatatattctgggcatggaatcacttgactcctattctaataattgtttcaattaggtacctcattttatttccttctaccattctctgtccgtaaaattgcgttcattcaatctcctaccattttttttgattgtttctctctttgcttccagtttttgtgccgtccaaaaatattctttgctttcatctccctcctccccatcatcccaattcgtcgtcgttcgtttgcattatttaccgagtcatcctgatcattatttactatcacctccaccaacaaccactttcgtcgcctatcaccaacaaattggtcgttatcagcaatcatccgccaccgccgctccgcttctgttgctgcggttaagacgcgtgttctgtggtcgttcttccgctcgctgctccgccccctccgcgctcgctttatcttttcgtctccgcctcgcccctcctcctccccaatatgtcctcgtcaccgccgctgctccgttccgcgagcagacgacgccatccccagcaaccaccgccgcacagtagcggctcaacgaatgctaatcggcacaacagcgacgagaacgacgacgacgaggaagaggcagcaccgttgttacaacaacgaaaacaacaagcaaagaagcatcgaaaaacgtcgcaaaatttgatgaaatgg

SEQ ID NO: 17971 - DNA, 2458 bp, Heterodera glycines
cccccccccccggggggtaaacactgcccaatgaatgcgatggaatgaccaatcccttccatttgcgtgccttctttgactttgtttctcctcttcttctaattacccaaaacttcttcattcagtggaaagtctttcgtcagcggaaaatgcctttggctacgaatttcgcgtttggacagtttcgctggtgaacggtaagcaaatttaggcaatttaacgcgagtttggcattccgtcttatttgtaggtctgcgctcggccgtcccttctgcggtttctgagccgatccgacttcactccgattggccaatttctgctgatcagattcatactgcggcaagcagacggcccccggaaagaccatcggcccctgaatatcttggtaaatcagggattagtagggattgtcgactcatttctttgagtttcgacaacatcaccttaccttacgcatttttcagaatacaacggtggcaccagtctgaccctctgttggttgccggccaaaagtgttcttcctgtccaggggtacgaagtcgaattccgtgacattatgcaggacgccacgcattggtaccgtatgactgatcagttggtgcgcgcgtgcaaaaccaccgtcggctatttgctcaacggacatcaataccaattccgaatcatcacaaaaaacgcggccggcctttctgagccgagcgatccgtcgccactgatcacaatcgacgtggaggacagcggcgtccggtcggctgagcaacaaatgtcgacattggacagacaaattggggtgccattggcagacgaaatggtcagagagtcgccgccactcccggacagagacggtgagtgccggaaggcatttccaagtgatttgcatatggacaattcccgatcagattcaccgccaccgatctatcgccaaaccgagtccagcctccagtggagagacccgacactgaaggaagtgattgactacctgaagagtcctgaccagacactggtgctggacgcttccggctatcttcagcatttgaccttcaataacgatttgatcaaggaggagacgcggaattacggtaggtcgggatacagtggtcttttccaaactcgggttacggtagagtgggacccgtctcttcctcagaatgcccttttctgactcattcttcaccatttgaggtggcattgaatgtctcgtttctctgctgcacttcccaaaccccgaaatccttcgcaatgtttgtggctgcctcaaaaatttggcttttgggcgtgccaacgacgtgaacaaacggctgatcaacacaaagggcggcgtcaaagcactgacccaactgctcagacaaacgaatgtgcctttgacggtgcaggaggaagcgactgggggtcggttttggcattttgcttttcctctgccactgtttttgggaacgaacttttaagggaatgtaaaatgaaaataattatatcattattataaattatgtgattgccttttgttaaattgcagcactttggaacatttcttcggctgacgaactgaaggaatcggtgctgaaccaagctgccgaaactgtggtcacgcacattgtgtgagcattgtaaaatagctaaacacatttttagcatgccttattttacttacataccacctaccttctgcttatagtacaatatgatttaccgtaccttgctcgtttttcagaccttaccattgttagcttaccgtaccaatttttaaattaccataccatttgctaggttaccgtccgccgcccatttgtgccaatcccatcaacatcaacaacagctgaatcctgcattgttgcactcttccggcccttcctcttccaatgctcgtaaatccacgctgactgtattccgcaacggagttggcattctccgcaacatttccgccgtcaatgattccgcgcggcgtttccttcgctccgcgcccggtttggtggacgcactgctcgacttcctcgacggatcggttctccgggctcaattggacaaccgatcggtggaaaatgtagtgtgtctgttgaggaatttgagctatcggtgagcggagtttctctgaattcaatacattttccgttcatttggacagagttcaagaagtggtcgacccgaagtacgacccgaaccggcacaaataccaaatgcatggcggagacggcacgtggggccacgccccgccccagcagaacggacagggacagcagcagggaaagaagtcgccggcagtcacatcggcacggcacgaacggagccgttcagcccctgcgggcagcccaaagacggcgtccggcaagaagggtcggctgttccgcaaggggaagaagaacacggcagaagcgatggactcagccaccggcgcaattccgccggcaaaagtcagtgccgagaacaatcgaagaaaattcgaaatttggaacttagcccgagaaat

SEQ ID NO: 17972 - DNA, 2316 bp, Heterodera glycines
  misc_feature (2048)..(2048): n is a, c, g, or t
  misc_feature (2213)..(2213): n is a, c, g, or t
tttgaggggggagattttccgtggccaattacccgggggatttgatgggcgaatacggccttgccaatgtcttgtccgctggggttggagggggagggggagaagcgcccgtcctttcgctccccgtcccttcgccttcctcttcgtcgctttgttcttccccctcttcctcgtcctcctcttccgagttcatttcctcctcttcctcccctctccccggttcatcttcagttctattctcatcttcttttctgccactttcttccggctcccgcttgacctccttcagcggctgcgtttcatccgttttcggttcgttttgcggagaatcctcgacaatttcgaacatcgttttgtccccaaatgacagtgtgtacacgtccgagtcgtcctcctcctctatgcctcccttttcaatttcctcccctcgcgttgctttttccgtccatttgtccatgtccaaagtcaccgcctttgatgccatgccaacattcagctgactgtgcgtggcactcgtcagttcttttcccgccgcctctttggtggccgtttcctccttgttctgctcgtccacttcgatcacctcctgtttcaccgccttttccgttttgttcttccgctgttccgtttcgtcttcggtccgtctcttttttgactgttcattttcacaccgtttttcttccctcttcaatgtccaatttagcattttcggcgtgcatccgccaaccgatccgacaaaaagcaccgaagaattcggcgactgttgtgcttctaccgaacgccttttgcgcaatgctgtcaatgacttgggctcgtcatcgaccaggtcaggactcgcgatggtaaccagaacggggggactcgcgtttttagtctgagaaattccgtttttagtccggtaaaattaagtgacggacaatggattgaataactcacctcctgaaatgctcgacgaataaagaagtcctttttcgattgctgctgtcgctctaaaaacgaattggaaatttgttttgttttattgaaagttcacctctccacgcgccaatctcttcaacgaactccttcacaaatggccaaatcaaagtgacgtcctgaatcccgcgccggtcattccgcttcagttcctccaattttgcccacatttcgtcaattatgcttctgtacagcatttcatcacatttaactaaaagaaaaatcatttttatcccataaaatggcaactgttgaagctaaacctgtcttttcgtttgccttcactaaaatcgccaagacgagttcagaaaaattttcgagtgcctcgaactcaaaaaatgtttttgagtcttttcgcaatgctttgcattttgcggcaatccaaccgagaaaatcagctaaaattaaattggaaatttgtgcttacgtttgttttactcgtataccttttgaaagttcgccttgctcgctaatcttacgattccctgaaatgtcttcgtcgctgcaagacgaagtgatgctctttgacataaatttgaatgaacgcagtcagaaataatatgtaagctaaaaggtttgctttcagtcagtttcaatgttcaatggagttaatttgaagcgtaacactttcgagaatgaacaatttctcggcgttaaggcaaaattcatcatttttcgtgtatattcaacaataactttttgtctgttgcctttatcccagaatatttctatataaaaacttctgtggactttaagctctcaattgataccaagaatataagttttgagcaagaatgaaaaaagttatgacataagaaaccgaagatagtcattgattggacgcgtaaaagtcgattggacgcgtaaactgcattagagccggataggaatacggcaggaaggacaaagtttacaaaaaaaaagtatggcgtaataaagcgctattttcaaatataaaaaacgaatatctttgtgatcaccggttaatttctaatctcaagtaaagactccaatccgcttcaaaccacttaaaacacggcgatttccaattttggggctccaagtacaaatanagtttattatttatttagtaatcagaacgccaaaactttgcaaaacttaaaatttattggggattttcccttgtaaaaatggaagagccgatctcgagttagaaaatatattttcaaaaaacaaaatagatttcgatagagtgggtcaaaatactggcctatganaatttcaagaagattggtcataggaaaaatttttttcagggacaagttttttcttttctctcatttgacgcactatttcatgtctctacatataaataacaca

SEQ ID NO: 17973 - DNA, 1338 bp, Heterodera glycines
aagtttttctttttctctcatttgacgcactatttccatgtctctaacatataaaataacacatggttcatttttttgtcaataaacaatttttttaaacttttgactaattaagaaatattcttcagaattttccctccaaaatgagcataaaatggttttatttggtctattattgaaaaagttataagctaaaaaaaattcataaaatcaagggtaaaataaaatgtttaccttttattgtttgtatttgttcttttggcgttctgtttttattatttttttatttatttgctttaaaaaaatgaaatttatacacaaacacaaagaggatttgaatctgagacccactttttggtgactaactcacagaccactaagacgaaaaaatcaacttaattgtacttggaccccaaaattgaatcgccgtgtaaatcagatttttagaaattataaaaaagtgaggcactgactgattgagtacattaaaagatatttagggcgaaaattttccgaaactttttctcttcaaaatatcgaggaatttattcattaaatacaatttcaaaaataatttcataatggctggcttggcatgtgccaccggtgcttcggctgatcacctctttctgtctgatcactttccttttcctctttctgatcacttttcttttctttcgttctttcctcctccgcttttccgtcgccttttcactttttccccgcgtctccgagtcggttcagtgaggcaaagttcttcaaaatgtggttgaccaattcggcattttttctcttcgccattacaattctttctttcgctccttcttctcctcctttctcattttccattcgcttaattaattaattttaattttttccccatttttccttttccttttcttacaatttcttttggtggctgtgccgcgagaaaaattcgaaatgggcgaatgttctgcttacttttggcgtcatatccgagcaatgatcggagcattgtgtcactgatcgggtcataagcatactgtaaaaggaggggggcggcaatttgttacggtagacaaaaaagaaagatgtttactgtacttgttccatgggccaaacgaatgaatcgtccgccggtgccgacgaattggcgaattgtgcagtgaacagaaaaacatcgagaacagttaagagaatggcggaggaggagcagaaggaacggaaaattggcatctttaatcgggtcaaattctgaaagaatttcagaaaaaggcaatacagaaacagaaaagcggagagagcaaacgccgaagtgtagaggatagccacgcctcagcaaaaaaaagtgacgaa

SEQ ID NO: 17974 - DNA, 883 bp, Heterodera glycines
ttcgcacactctgtttttttatgtttgaatgcattggccttttgttttttacgccaacgatttattgacgattttttccctttcatcttccatgcatatgttctgtctggggattttcgagctctcaaaacacggatatgatgtttgaatttttccgttttttctactttccggcttcctaattggtcgagtgatttagtggccccgaaaagccatgaaagccaattcaaaattaatttaaatttaatcaaaaataaattctatacaaaaaaattttagattattatttttttaattaaaaaagctttggaatggaacttagcattttggaaaatttcagaaagttgctcaatttaggaatgttctattgtgttgtatccaaagtttattacctgagccagtgattgaatgtatttaccgtattatgaatgttgcatgcttgtttttagcgaaaatggagcgtaaatgtttaaagaaaaatttgcaaaaaatattaaaagtaattttaaaaaataaaatttaattaaaaaacgaaaaaaatttggttttgtaatattagagaaaatcgccaccaaataaatcatgtgttttttaaattactattttctggtgcaaatctgctgttatgtttcccccgcctccttcgtttcccaccgaaaaattaaaaaaaattcttttttcaaacttagaaatttccaaaaaaaaaaattctatgaaattttttaataatcctcagcagcatcgtttgtcggcatcgccggtaagaaacatccatttctccatgtgaacaaatcctaccaaaaaagcaagtattttgaaaaacaattagtgtggctaatgagccattaaagcgcattcgttttttttaattgcttcggcttgg

SEQ ID NO: 17975 - DNA, 1665 bp, Heterodera glycines
ttttatattcaccgatctgttgaaaaatgcggtggtgctaccttgttcattcattaccggttaaccaccatcaccaacacctccaccatcatcgttatcatcagcagcgtgttggcggtgctggtcagcaagttgcagtgttgccaccccgaaggagcaggaggttggcaaaaaattaaaaaaattttgaaattttcctctagggttgggtagaccgcctccggcaggcccccgtcctgacgacaaatactgtcaattaagataggaccgaatttttcctgatttttgatactgagttggcagtttaactataactcaacaaattctcaaggaaaaattttgaaaaaactcaaaattttctttttaatataatacatacttgtaaaaaattctgactgtgctgaactaatacaaaattccgttttccgacacggcgcttaaatggaacaatcggcaaaaaatcgagtttatatccctggtaccctccctccacatcccccgtcttcaccaatgaagatattcgtcaaaattatgttctgacaagggcgtagcgaggggggggggcggggggctgaatttttttaatgaaaaatggtaaaattttgaaaaagtataccattttcttaagaaaatttaatcgaatccctaaatttacccggcgacgcctatcgggatcgcgtagcccaaaattcccttaaaattttcaaaacttgacccaaaaatcgctaaggagtagcctcccccccaaagccaagggtctggctacgcgcttgcattccgagcccgtaattcaattttttcgttttcttttgaattttatttaatttttagccgccggcacaccgggcgcagccgctccgggagctggtggaaccggcacagggggagctggagcaggaacaggcattcagactcaggggagggatagggtgggacggaattgggcgccaataaaaattccaagactaactttttttttcaaatttgttgcccagtacaacaacaaaatctcatagcatgtttggtaaaaaaaaagcagttctgaagctttttgcacgaaattttgcctgaatttcggaaattttttttcgtgccaccgtaaattgttaattaattattattaaaataaaagttttccaggcatcggacacatttttatccatattttattgactttgaatatattttcaattgctccaggtggtggtgctcttgtgaacacgattgcaccgtcaacgcaaattgcgactgtgccgcccggcggtgctgcgccgggcggcacatgcggcaccgcctgcacgtccgattccatcgccacactgaccacccatgatgccatcaatgcccagctatccacagcaatccaggtcacaacaccaacaaatgcggtggcggtgaatgcgggcggctgcacaacactgacgcccagctgccccgctggacaagttgtaagtgtatgtgtgtgtgtgtgtgtgtgtgtaagcgggtgggtgattgttggtacggtacatggaatgtttccggaagtctaataaaaaaattttcccggatctgtccgaaattacgactctagcggcagagaaaggcattggaattctggagcagcagccccctattaggtactaccgcttctactattattgtatgtgtggtattgtttgtttg

SEQ ID NO: 17976 - DNA, 1356 bp, Heterodera glycines
  misc_feature (1349)..(1349): n is a, c, g, or t
taaatattggtccgtttctgaacactttctgaataaaataattatgaaataattttgcaaaaaataacaaataattaaataaaaaagaaagcctttgatttttgaaaaactttttaatcccagctagctcggcgctcatttcagtgtaagttactcctttcccggggagtttccctgcaaagtttggtgcgcttctgatcagtttctgaaaaaaaaagttaagcctaaactttttggcctgtttaaaaaggaattaaaaatttttaaaaatttattcatctccctttttgatagaaaaagcatcagagtgcctaaaatagcttgtaaataaaatttggtgcgtttcagagcactttctgaaaaaataattatgaattaattttgcaaaaaataataaataattaaataaaaacgaaagactttgatttttgaaaaaatttttaaacccagctagctcggcgctcatttcagtgtaagttagtcctttaccggggagtttccctgcaaagtttggtgcgcttctgatcagtttctgaaaaaaaaagttaagcctaaactttttggcctgtttaaaaaggaattaaaaatttttaaaaatttattcatctccctttttgatagaaaaagcatcagagtgcctaaaatagcttgtaaataaaatttggtgcgtttcagagcactttctgaaaaaataattatgaattaattttgcaaaaaataataaataattaaataaaaacgaaagactttgatttttgaaaaaatttttaaacccagctagctcggcgctcatttcagtgtaagttagtcctttaccggggagtttccctgcaaagtttggtgcgcttctgatcagtttctgaaaaaaaaagttaagcctaaactttttggcctgtttaaaaaggaattaaaaatttttagattttttattcatctccctttttgatagagaaagcatctgagtgcctaaaataacttgtaaataaaatttggtgcgtttaaaatttgatcgtccataaataatttgtaattgatcaggggctcaccaaattttgcagggatacgtatcggaacactacaaatgcttactaatttttctagattttttaaacccggtgaaaattttttgcagacacccaccactttttcacttaaaaaaatttcaaaaaatttgatcgtccataaataatttgtaattgatcaggggctcaccaaattttgcagggatacgtatcggaacactacaaatgcttactaatttttctagattttttaaacccggtgaaaattttttgcagacacccaccactttttcacttaaaaaaatttcaaaaaatttgatcgtccantaaataa

SEQ ID NO: 17977 - DNA, 279 bp, Heterodera glycines
cggtgtcatctatgttactagatcggggatcgatccccgggcggccgctcgagcaggacctgcagaagctagcttgatggggatcagattgtcgtttcccgccttcagtttaaactatcaagagagggaggagagggttggagaaggaaaggaaaaaaaaaatgaaggaggagaaagggtggggggagtatgagtatgatggtcaatatggagaaaaagaaagagtaattaccaattttttttcaattcaaaaatgtagatgtccgcagcgttattata

SEQ ID NO: 17978 - DNA, 902 bp, Heterodera glycines
  misc_feature (799)..(799): n is a, c, g, or t
  misc_feature (814)..(814): n is a, c, g, or t
ttggcgctacttgcaaagagcgctcttttgaaaattttttcacctttttttgggaaaaatttttttttgtttatttacacataataattaatattaagcattaacaaaactattatggcgaatttaagtataattatggcgaagaagatcacagaaagcattaataatagtttttcctttagccctagcattaagtcgaaaaatttgttcacacatgtatgaattcgttagatttgtgctggttccatgtattcttttcgtcttttgcttcaattgagcccagagtccttcacatttattcgtgttgacgttgaattcggtgccgtccgggagcatgacaatttttgagaagccaccaccagtcgattttttgtgtctgatgagcatgtgttcgtactgtggcaagtgaagagccagtttcaggtatgccggccattcgtcgctgatgatcactgagcctggacggatccatttctttatcaatttgtacaacgtaactgttttttatttttatttttttttacctttcttacgctcgatggctccaaaaaaccacttgctgcagcctgcttttttcggctttccacgattgtgtttttgcttcacccaacatgtctaatccatctccaccacgacgttaacaccgccaattttttgttgttgaacacattgtgtgcgtcaataattgaaccaattgacgcaagttgattctgcgattcccatttctttgatgacatttttgtttctgaagtcctccgttcacatgtatattagtgtccacttctgtgcaacatttaanatactgttgtggaanaattgccatcacgaatggatttcctgaccgagctatctgagcaatccactaaaaaaactttaaaaatcttaaacttgtgtttaccaaa

SEQ ID NO: 17979 - DNA, 975 bp, Heterodera glycines
tggatgcattataattatcaaataaaaaaaatccttttacttattaaaaataaagttagaaatttataatatagtatatttatgaaattgaaaggaattaatttctcgaaaattcaaattaaataaaacagttattcatcagaaaataatttaaaataaattaataaacaatattaaattaaataaaaaaaaattaaataatttaaaataccccttgtgatttttcaaatattcgcccaaattctcgagggccaaaaaatttgaaaatattttcgaatttttaaaaaattttaaaatgtacaatgattgattatttattgtatattaatttttggacaaattctaaataaaaaaacaaataaattcttgttgaaaaattaattttattttgaataaatataaataataatatgcttcaagttatttttaataaataaaaggtttaatttattttaaaaattattaaaagttattaatgcattcaatttttaatcttttcttataaatcatttccttattgatttcattttaaccatggttctacatttctatttttacatgtaaatatagagcacacatagagctttcaaatgatgctagattggctaaagctaactgacaaataaaaaagttatagcatttcaaaatttgcggcgccgaaatggtccgcgccgaagtgaccccgacccttcacgcacccgctagttattgtagttacattgatacttttttattagagtcccagcagagtttggcattccattttcggcactttgagtttggggcctatgataatattttccgcaaaaacttttaagaaaaattaaaaaataaataatacatattttttcaaaaaataataaaacttgttaaaatgtattgcattaaatccaaaagtacaaaaagcataaataaagaatcacagtcaacttgcaaaaaactatgcatatacgctggaaatcaatatgagaaaat

SEQ ID NO: 17980 - DNA, 3364 bp, Heterodera glycines
  misc_feature (3342)..(3342): n is a, c, g, or t
ctcgattggtttaattgcgccaatttttgaaagacgatcaatttcggcattgacttcatccaatgctccatgaggaacaggccgagccttgcagtagaccggcttcgcctcctttttcaggatcagatgagctctgaatttggtgcaatggccaagttcaggtccaaaagtgttggcgtaattggtttgaagtgccgaaatgagtaacttttcatcactgatttgtgatgaaattggcttcgttggcagtgaattgacgatttgcgacgaatttggaaacatcaattccttcgggattatttccaattcttcaatccaaggcatgccgagcaaatcctgatggatttcgtcgctgacgtaagcaatcaggcttgccgtccgtgatttgggcagcggtgtcgacattcattgggtgatccatcccattgatttggatgatcacttcccaccatttgttgctgcttccttcaatagccatacattttggcttaattgagacggtgtgaatgtgcgtgtccttcacggaatcagtggccactgcacgaacacgtcggatctctgtgccgcttttgcatgctttcgcaatgtgaccgttccgtccgcatttttcacacgtcgagtttttgaaccagcagtctttttgccagtgacttttgcctccgcatgaatggcagggctgatcaggcaggtccacttccttttcaattgccgttgagttattcggctggaaatgtcctttgtggctttgctgtggcttcgttttggacttcggtttgtcccggatttgctgcggtttggctcggatggcactggtgctgcagggatttgagccgagggagagcgcgctttcctttagaatttggtatttgcggcactcttctcctagctcttgcagtgaggttgaccgtccgctcgttcgactgtcttccaaacgctgaaggcatttttgcctcagatctgtgaattcgttgcaatgatcagtatcatgcatttgagctcctctttgctcagcgaaagatcggcattttcgcaggacgagttgatcaatgcgatcaaactttgtacgtcctgatgcgcgtcttgacgaatttggaagcagtcgaaacggcggagaaacaatgatcgggtttctccgaacaaatgtttcaattttgcagtcgtctcgtcccagttgaagtcgttttgcgacttaggtgcgatgctgtcgatgtaccgcttgtactccgcttcgcccaatttgccaatcaatagctgcactttggactggtcgctgagtgcgtgtccgtcctgggcgatggtctgcccatagcgcttgagccaaacgtcgtatgtatgccctaactcagggtcatactcaaatgtcgaaaggcgcgcatcgattgatgtcgccaatgccgcagaattgttgacttgtcccgccgatgccttcaaaacagcctccaaaatcagtttaagctgattggggtccatcaaatttgtttagccaaccggcttttgaagaacttgtcgagccgacccggcttttgttgaattttgtcgagccgacccggctttagaagaataagcagttcttttgcctgtttttttttgacaaaattgacgagccaacccggcttttgtcgaatttttgctgagccgacccggcttttgacgaattttgatgagccgactcggctttagacgctaacagtttcttttactgctttttgaaaaatggccgactcggctttaacaaaactcagagccaatcccggctttttgatgagttgttttgccgtctcggcttttggtccttaaaacaaaatttgatgccttttctcacccgaagatgtagagcaggtcctttgtttgtgactgcgccaaattgttgtgtatttgctacaacaataaaaatgtttggtttttaaccaaaacaaatgttgtccaataaataaataaataatttattaaacaaataaatgaggaggaggacagcaggaaataaataataataaaataaaataatgaaatggtggaatgaatgggagaatgccctgagtgggggaaagggagacatatttatggagctggtcaaggggcggggcgagagacaatgagagagggagagaaagggaaaacataatcaataatgggttgttcccttatccaacacctcccttctttggaaaaatccctctgcgcgagatcatggccggaatacatcgtacttccgcttcgacgggtccatgttcagctgctgaggtgccctcttggcgcgtgctgatcttcgcggcgcattttgattttggccaattggagatttggctttttcaatctccttaatgggggtccgatttggttggttcccagccaaaatatttccatttgcttggccaatttgcgatgtctccatttccattgggaaacgacggcgaatttggttgcatggcgatgtactgcgcgacggagcgtcggaacgtcgactcgataagtcggagagttgccaactctctcgataatcgtcgcggcaaccaatttgccttattgcctttcaaattccaaatgaaaactggctctccattttggaaagtgatgggcttggcgccgtatttgtcgttgaattgcctttccatattttggtgtttctgttgcaatttaccaaaatttttgaaattgactggcggcattttctgatgcttcattggcaccgaattggtgatttgcgaagaatttggaaacataagttccttcggaatgatttccaactcttcgatccaaggcatgccgagcaaatcctgatggatttcgtcgctgacgtacgcaatcagtttcgctgttcgtccgttgtacgaaacttggcaattgaattttcctttaattgcgaatgccttttcgttgcagtttttgattgcgatggtggtcttgcccagctttggcttgccaagcttttgccacgaatcagttgtgatcaccgtgatttgtgcagcggtgtcgacattcattggtttatccattccattgatttaccatttgttactatttccttcaatagccatacatgttggctgaagtgaaacggtgtgaatgtgcatgtcattcccagaatttgtggccacggcacgaacacgtcgggtttctgtgacgtttttgcatctttttgcgatatggccaattcgtccgcacttttcgcacgtcgaatttttgaaccagcagtctttttgccaatgatttttgcctccacatgaatagcagggctgatcaggcaggtccacttccctttcaattgccgttgaattatttggctggaaattgtggcctttctggctttgctgtggccttgatttggacttctgcttgtcccgngatttgctgcggtttggctcgg

SEQ ID NO: 17981 - DNA, 1135 bp, Heterodera glycines
agaaagaaagaaatgcaaatgccaagagagaaagaaagaaatgccaatgccaagagagaaagaaagaaatgccaatgccaagagagaaagaaagaaatgccaatgccaagagagaaagaaagaaatgccaatgccaagagagaaagaaagaaatgccaatgccaagagagaaagaaagaaatgccaagagagaaagaaagaaatgccaatgccaagagagaaagaaagaaatgcccatgccaagggatcgaaaagaggggccgattttcaaaagaccattttgactctatcaaaaccctgaaaatagcaacaaaagttaagcaataggcgcaaaaaaatccaaaaaaaatcatcgaaagatcaaaccaagcgaaatacatcaatttccagttttaatttgattcatttaggtgcattatttattttcactgctcgacttggaaagggcatatgtcaccgaaaggggccgtcttgtcggagtcgtggcactgagagacgtaagtcggcattttaataggctttttgatgataaatccttcgctattttttgtttagcttcgcatggcaattcaaagtgcacaaaatggcatttcccttcggcataatttgtacgattccgctgattcgtcatcgactggcactgaaaatagcttagacgaattcctttccattgatgtggaaaaagggatggcacagaaaaacgacgaaatgccacaaatgacactgaccgaatgtgacgaaaagcgaacggcacaaaaattggcaaatcaaacggaccgaaacttcggcgcaaatgcttttactgtccaaaattcagtgccgcttcaaataatcgaggcggaaaataaattgcaccaacgaaacagaagccaatcgacgcgaaaccgatggaaggaaggggaagaaagcgaagcggcacgagcaatggcatatttaagacgcaaatcagtggcattggaggatttgaaagcgttggaggaaacgccacttccaacgacggcagcggagaaagaaagggaaaaataaacgaaagtgaagaccaacccaaagcacttttttgtttttacttactgaataagccaaaagtgtgtaaatttaaaatccttcccggtggcgtctgtcggcaccgccggag

SEQ ID NO: 17982 - DNA, 1379 bp, Heterodera glycines
taaagaatctgagttccaattttgagtaaatcacgataatttaatatagttaaaaaaacgaaaatttatcggaaaaatcttaatttttcggtgaatatctgttagaaataaatttaaaattcgtccctatcggcacgccggcccgcaaaaaaatctattttttcttaaaaaattacccaaaattccctaaatttggttattttttcgtcaaaatctgtgcatttatgtcaaaataaatagaatcgaggcgatcaacgaataaaggaatgtggagccaacgaagtcattcataaaaaaataatttttttgtgagattttttggagctaattcaaagcaaacccccgcccccgcgggggcggaattatcgtgcccccgccaccgcccccgcgaaaagccacccacgcccacggcgctcgaaccctaattaaaactcaccaaataaattatggcgtaaaatttgtattgtcgcaaaatcaattcgaaatttgtccacagcaaataataaacgtagaaagacaaaggccatccgccgaagaaaagcggcaatttggcgacctaaagccgacaaaactccgatggcattttcctttgttttagttggttttacgctcggaaggggaataatccgttgcagcaaaaagccgaagaaaagaacggacagagaaaggccgagcagaactccgaccaaataaaaggcggcgacactccgcacaaagcgacgcgcacttagaaaaacgaaaacagcgccaaaacaaaaggcatttggcagattcaaaaagccaatgggcaaagacatcgccgccacctcaaaagacctgtttttgagattacttaaaagactaattgactcaaaggttttcattcaatcaaatgaagcaacaattcgaatatcgtttagaggagatcaataagtcacatataaccgaaaaggacaaaacaaatggaatgacccgcgaaggatgagacaattaagagaagtgaggtcatcagaacaaaagtttgagttaattctcatgcattattacgttagttcgtgggtttatttatttgtgatcgtttttactcctcaattctccattttctccgcagccgccgatttcccctcagacctccgcaatttgtaaatgtacacgttgatgccatgcgcacacaagtgctgatccaacaattctcgaacttgtcgctcttcgatctcgtcaagatcgaaccaaatacgcgacaaatgaacactgcaggtgaaacgtcgcgcgaacaaacgaattcttaacagacactgctccagggcttccaattgcgtaccaactgcaagaagaaaagtcacatatcgaaaacagcaaacattaaaggcgattgaccccgtaaaatgcaaaaatgagga

SEQ ID NO: 17983 - DNA, 2890 bp, Heterodera glycines
cttagaaaatgcattataaatatcttctaacacatatacagctttctaatgataccaagtttgtttgatttggccaataaagaaaaaagttatggcttcataaagttgtctcagacgcagttgaaccctaccgtgcctatgcaccaatttttcactgcaaaattgacacgaaaattcctatttaaacttggcaaattgcattcttcgcctcattccttcgatcattcattcagctcgtttcacttttcccttcaattcttaaatcgccatgcttttccaatattaattttttttctaataaattttataacatccttccttccttttaagcctaaatgggtgaacaacgggatgaactcgtccaacgtgccaagctggcggagcaagccgaacgctacgacgacatggcaagggcgatgaagaaggtggggggggggggggggaaagaggtcgctggcacgcctaaccaaaatgtaattttttgtttttttcagctggtcgaaatggacgccaagttggacgaagaagagcgcaatttgttgtccattgcatacagaaaggcggtcggtgctcgtcggacttcacgacgtatcattacctcaacacaacagaggccgacactgacgaagaaacagaagcaaattgccaacgagttgaagaagaaggtggagcacgacatggaacagaagggccgcgaggcgttggtcggtggcattggcaaattgcgcactttggcaatctttcaaaaaatgaaatctccgtcattttgaacagttaaaaggatggtcaaagtgttcaattagttcgtgtggcattttctccgttcaccttaaaattgtttttgctgtttcaggacttgctggacaaaatcctcatcccgaaggttgacgagcccgtggcaaaagtgacctacttgcgaatgaaagccgacctccaccgctatatggctgagatcaaagaggccgaaaatgacggtaaaaagcgatcaaaccaaaacggtttttggatttgtaaggtcatctcccactttttcagatccccagaaggcaaagcagtcgtacgaggacgcgtggaatattgcgcagcagaaaatacggccatcgcatccgattcgccttggagtggcgctcaattttgccgttttcctccacgaattcatgaaaatgccagaagagggtcgcaaattggctcaaaaggtggtggacgcagccgaacaaatcgcattttaaccaccaatgtatttacatatcccaattttttgcaggctcatgacgacggaaatgctgatctgctggcggacacgagcggcggcgattcgtacttggagtccatcggaatcctcgagaagctggacgagaacatgcggatttgggcatcaacgcaagaacgggacggatcatcagaacgaggaaacttctaggatatgccgtcccttgtcacacatgtacaaatattgtaaagtaggcatttgtatcccatgtctgtatatattgtaataaagcggaagaatccctcctcatcacgttgatatgtaatgtaaatattcgttgtttggcggtgtgataaatgagaaagaaaattggtgtcattagagaagaccaaatgtaattataaaaagttaggtcagaaaaagacaattaaaaaaaacgattctgaaaactaatttcattttgaaggtttctgtcgaaaatcaaaattttcgaatttcagatttttactctaaaaatggttaaaatgatctttttagaatttgaattttcagtgagctagtatttgttttgtcttttttaaattttaaagattaatttttttgtttttttttaacttttttttatttgaaaaaatatttttggttttggtcaaattattcttattggaattgttgatgcgaggtcgaacctacatttgtttttgctggataattggtcgtaataatctgtaaacaacggataaaacatcaaaatgcgccaaaaaagcgcgcgcttttgcaaagtttcgaacggaatcccacgtagtgagaacaaaaaattggcgcaaaaaaagcgcgcgcttcttgaatttttgctatgaaaatactagaaatatttaaattatacgttcatacgaatagaaccaaaattttatctttttgtttgcttttttcacaaaaaaaacataaataaaaaattttatttaactattttttctacctgattttaatacctattcgcgatttttcttacctaaatttcccagccctaattatagccaataattaaaaaaaaataaaatgcttgtaatcagaataatctacagaaaacttttgtctcacattgtgccaaagccagtgtgtatggttctgcgacaaatattcctacggttttggtgataccgtaggaattggcgtcaattcggccagtcggcagatgatttttacaaagaatggagaacgattgggttggcaaatacatttattccagtacttaaaatttgtcaccaaaatttttcctcaaaaaaaaattttgttttctcttctgcaaccctaaaaaaaacaaacaaccacttttccctttgttggaggtctgtctgacttttctaatttctgcttctccattcaaaatcaaaaatttggaattttaaaaaattccttaccgtttgtttatttttgcggtattatgaatgaaaaattctgtttgacatctttatatacacataaaaaaaacaaaaaaaaataaaaattttcaattttcgactttgtcgttttaagcaacaaaatttaaaaagaaaatcaacaataaaagcacgccaattcacacaaccgcggcacaatattatttaaggggctcaaatggatcaatatacgggggtgggggaatcaaccgctccctgagtacctgaatttgcaataatg

SEQ ID NO: 17984 - DNA, 2993 bp, Heterodera glycines
  misc_feature (45)..(46): n is a, c, g, or t
  misc_feature (228)..(228): n is a, c, g, or t
  misc_feature (2920)..(2920): n is a, c, g, or t
aaatctcgaaattttggatcgagactcttgaatcgcaatgtattnntacaaaattaggggaggccaatggacgctgcgattggactgatgcaaatgtcgtccttggaacggacacaaaacaaagcgtcgtcttctgcaccattaatgactgacccaattacaacaaccaaccaataccacaccacctgaaatcaacaacagttaccgtaccctcaactacagtaaccncagcagcagtggttacggtaacatcagcggaggaagaaactgtcatgaagcaacaacaaccacacaccaccagcagttgcatcggcgtgccaagcagcccgggctgctagggagagcgcagcagcaaccgcgcgcgtacgggccagccttgcgggcactacgggaacggcaccggaagcggctcgaggtaagcaatggattttggtatttttgcttagcgcttgagacggggtcgaattgaaatcaagactcattaggggctaattaatggatttagtactggattttattgggacgagataaagcccccattttggcacacaaaatcaaaatagtggaatggcattttcaggctgatggtaagcaacgccgtctgttgccaaaatcggtgttcagcgggcctttgttagccccaaatgacggcgatggcaaagacggcgcccttccggaacaccatgaacgccagtttggcttgcgcaccgcggagctggccggtccggaagggaatgcaaatcggctggagggtaatttgtgtcgatgaatagaacctgattttaactgttcaagagtctcgagcctcgactcgagtaaacgcgaggatttttattccttgtaatgatactcgagaccgagagccaaaaaaaaccccgagatctttctcgagtcgagaccaagattctcgagaatgactatttaggccttaatctgaagcgaggtgatgttggtagcagtcattgttataaaacattttgttgcatccactgcatttttgacgaaatccatcaatgggtttgcacgaaaaggtgggacccatttgtgagctaatgaaaaactgggaatatattttgaaccttttttgaaaccattttatgcagcgagctttgcagcttttggaatgctgctttggacgatcatatgttttttcacaacttagacaataaggtttgccaaacaagttgccgcttcgttgtacaccattgaaatgattagcatcaaagtaaagtataattggtacaacgtaatcctccggcccatatttgaaaaggggcttgtagtgtccagttgacccaaagatgaatgctttgaatttccatatccccatgaaatttgtgccattccaccaatcaatgatccttggcacgtaaaactcagcatcgtaattttgttgtccaaatgaaacattaagagcgttcatcatttcgaatgtttcttttttgagccttcctcccactcctcgaagataatcatgaaacctttgtcggttcaaaccgcctactgcgcggaccattgttgcttgcattgcataaaacaaacaatagttgtcggaattgataatcttaattgtctccataaattaatctttttacttaaaaaccttgataagacattgttcagcttcagtgacttgagcgacagatggtgttgcaattggcacgttatgtaaattttgttgattatttgcttcatcacaattattcgctgatgaagacgacatttttgatttgacaaataaaaaagctataaaaattttgtattttgagttatatgattatggtagttaacaaataaaaaattgaaatagtattatatttaaatatattatagataaattataatacacaaatttatatctttatactcattaaatatgattttgcacttaagcattcatatttaagaagcaccccgtcgtcgctggacttacgaaaaacgccaggacggggacccggtcaaaactgcatatgcacaaattaattcaatatgtgcacatacatttttgagcttagaactgcaagagcaagaaaataaatatgtgagtttgaatctgtgctgcctatttcttgttgacaaaagccccgtccaagcataacagcacagaccgcccttacagttcgcgggtcatactgactttttgttgtttaggtccaaaccaattaattaaacatttaattgtttttgcttgttaaacaatattaaacatatttttgttctaataatgtttttttattacatttaaaaattagaatgaaaatggttgttttttgcaaaatatattcttatccaaatatgtgtcgaaccgctgaagtggagttccacttaccacggtccgaacacattcattttaaaacaaatgttataatgagagtaatgcgaagaacagctgaagtggagttccactttaccacggcccaaacacatacacaaacaatgcagtcactacagattccttaaacaaaatgcgtgataatatttttgcataaataaattagagcaaaattctaagacatacgaattaattttcgtcagaatctgatgaaagctgcgatggaaaaacataatcaggactaaaataaaaaataaatttttggtttaataataaacattacataggtgaggaaagagcagtagttgaagatcctgttttgttatcgtttcttcgaacagcggtattctgacgttgaagtgaagctgaacagcatggaacagatgggtcttcatcaacctcttcttcatccaagacaaattcttgttgaagttcggcatcctcgggatttggctcctcattttcgttggtgtcagcaatatgcaatgcatcaaggtccggttgttctagtctgtagttcttcacccattttccgttcaagtcgcagaatatcacgtacttttttttgtgacgcctgataaaagcatntataattcttatagaattttaaaaagtaaatttaccgatttgcactcataccgcatgctttttggattgatgc

SEQ ID NO: 17985 - DNA, 2787 bp, Heterodera glycines
  misc_feature (16)..(17): n is a, c, g, or t
  misc_feature (2674)..(2675): n is a, c, g, or t
  misc_feature (2677)..(2677): n is a, c, g, or t
  misc_feature (2684)..(2685): n is a, c, g, or t
  misc_feature (2707)..(2709): n is a, c, g, or t
  misc_feature (2727)..(2728): n is a, c, g, or t
  misc_feature (2755)..(2755): n is a, c, g, or t
ttaaaagaaatttaanntcctctgtaaaatcaaattcaactttttaaatttaaatgttttgatgacggaagcaaaaaatgcatatttaagggcaattaattgaatcctcaaatgtttatttgaacgaatttggcgcatttatacaaaaaatttggaaaatgaagcaaaaaataaactgaagtggagtcaatttgtcccattgaacaaaactttttgttaagcgggaaatgaaggaaaaatccgcgcttttaattgcctttgccacccgatcgcccgccagcagaaggaaattggcaaattaaggaggtaaataggagatgcattaaccccgaaaataagtggttttgatctttccgactcgaatttttgggcgaacaattatttgaacaaaaaaaatccaaatagttggccgaaaagaatttaaaaacaaaatacgttaagccagaccaaaaatttcagacctttccattatttcaaaatttgtaaaaaaaaattgcagaaaaactgaataccgtacacattcatttaggcaacaaatacaaaatattactgtacctgctcctcctccttcttcccctgttcatcctctgctgttgttttctgctcttcctgttgcttcgttttcttcagcttcttctttttctgtgccgatgccgttgttgtcgccttgccaatctctgccgatcccttggccaatttgaatggttgttgttggccattgccattgttgttcgttttcagccgttccatttgaaaccaatctttgccatatgtccaatggtggccaaaaatttgaaaaagttttattgaaattattacgctaattaattggaactaattaatttaattcgttaggcggaccaaccctttccaactttgccatgctcatcctttggcaatttgtagaaataatcttgcatggacaaattgtgacgcacagaatttttccagccgtcgtagggacctcgaaaaaattcgaacttctcgcggagaaaattgtactaaaatgaaaaaaaaagttgaagcaaatccaacggaatttaaccaacgattactgaggataattacttcttaactatagaaatttagataaaaatggaagccacccagtgggatttaaacccacggcttcccaatttttcaccactaagccacaaaaagtcatcgatcgattcaagtcccatcagttggctcatcagaaaatcacccacaatttcggtcagtgtggcacgcttcgactcttgtgcctcaatggccatgccgatcagttggatgtatgtctcgcgcggcttttccccccgacggtcatgcaatgcccgccggcggccccctttgccggatttgccgcgtgcccgccgcttctctgacgattttggcacttcgcttttttccgctgctgccgttggcacaggttcaacaaattcgctgctttcagccactgtcgacttcccctcatcctccttgttgtactgcttcatctcctcgtcattgccatccacttcatcctcctcttcaacctcaaattgtcccgggccactgacattgtctaagatcgttgccttaattggaaatgtcactattaattttaaagccattttgagaagggataaatgtcattagagcgtttggatttatatggcattttttggacttattttggcctaaaaaatcaaataaaaacatatttaaaaattctgtttaaaaagaatttttaacaaaaatttgatggtttctttatttttgttaattgaacccaatttttgaaatattttgctcatattttggtactttttatctatttagtttttccatcttgatttttggtaatgaaatttttgtcggtattttagcgttttatccatattttgggttttttttggtgttttggtcttgtcatctttgatggaatccccgttctcacatgacaattgtcccatagcattccattggttgccattggtgcggccgtcgatgtccaccaacatccaatagtgtcggcatcatggcccccatttaataggcatggcacgtagtcaaattgcacaggcacatcgggcggttgtgttgcgtgtacaggttgaaaaccgtgcacactttggaaaaatggttgttgtcctgttgttgttgttctttgccgtccccgctcaccatcagaaatttgttgtaggttgctgaaaaagaataaatgggcattaggattaaagatgattaaaatataaaaattatttatttccaaaaaatttatggcctgaaacttcaaaattttttcaaagggttagttttgaagcttttctgcataaataaactaattgttgattaaaaagcttttaggggaatggtcctaatgttttaaggttccaaattgtccggaattgagaagcttcaaggcacggatcacaatttaataaaaatattaacggaagcccttaacaaattgggacccgtaaacacagtaaccaggaatttccagccgaacaaactcattttataataattaaattgaaaggtgggcatgttttaaacattgaaaggaattcaaatattttgagttcatcaacgcaacaaatctagaatacaacgtcctagatatggtgagcagtatgagcgcggcgactattcttgttgctctgtttgtttaattattaatataacagtgctggcttaccacccaaanncnggaaaanngtactctatttgttgctttcannnaatgatacctaaaaaatnngtacaaataggtatgtggtaggaaaanaaatttttggttcaagaaactcagggcaatga

SEQ ID NO: 17986 - DNA, 745 bp, Heterodera glycines
aaagaaaaaggcgaagaattacctgagcttcggttgctttttagcttaaaagaaaatttcgataaaagtcggtacaatgtaccacatacctccccatacaaatgggcgtttctttcctcccccgtagggccatcccaaaaaagtttttgggggactttctcccctctgttgctagaatggttggtaatggagtggtgggccgggccgtgccttatgtgttacccctcccctactaaatacttcccttccctcattttacagtaacccagacatattagcacagtcaaaggaataattttgaattaatttaaatgtgatttaataccgtatacattgttcatagatttatgtactttttataaggcgccgatgaagctaaattttgtgaatttggaaattaatttttcatcaacttctggcttatgtgctaattgacaatgctcttagtatgctgataatgattccgtcatccactgatggtgtcccaattttccgtggtccatgatggcaaaacgtacctttgtggtggacagcatggaatcatgcggctgatataaatggagaaataaaaccaaaactattttcttatttgttttttttatttaaaagagatttttttctaattctttcaaaatatttattagatcttgagaaagccttttattttactttgtgcaaataaagctattgttaagcaaatgttaaaagattgaaatttttaaaaagctttaacataataaacttg

SEQ ID NO: 17987 - DNA, 2678 bp, Heterodera glycines
ttcaaacgtcaaacagaagcccaaactcagttccagctataagacagctaaagcatgttctactgtggaatttttttttacagtttttggcaataccaaaaagcgaaattggtcatttctaatcagtgatcacaatcaaaaagcgcgcgaattgaaaagaatggcgggtaatagtttaggtggtgccgtaacatttcaaaaaaatgaaattaaaaaaaagttataaaacacatttttaggggtatttgggttaattactgaacacgaatttggcataaccttaaagccgccaatattgaactaatttcatgcaaaagaatcattttgagtataaatggtagtttttcgtttaaatccgggttagggttgtagaattggcgaaactgaatgtcagattcgcgttcagcggccccgataaacgaaattttgtatttttcgaaaaaagggggggggcaccaattaaacaattagcgaatggcgtaatgggaaaagtgatggctaaaaggagccgagcattttgctggtggccaccatttgaatggcaccggcgctcgacgacggcgtcggtgccgcgatgcgttcgacgctttgcattgccggagaatgaatgaacagcaaatagccggccgttttgccgatcagagcggcgacgatcagcgaaaagttgaaagtggagcaggggacgagcacaaaggcgaagatgaacagggaccactgcaggggcaccggatgggagagggggaatatgtttatgaaaaattcctacaaatttttccaaaatccacaaatagcaaattttgagaaaaatgggctccgcaaaaaagaggcggaaaaaacgatcgtcgcctgggggcagacggtacccccaatagaaatcctgggaccgtccctggccatggccaaaaagacttcgtggggagggacgaattgcgcgacagtcggaggaggggagggacccattttgaggggcttggagccattgagagtctttcccacggttgctctttttctcccattatggtattgttgataatgccattctgcgggtctaattgctaatcattgcgggttccatgatttggtccgacccaaactctcaaataaacacttcaaaaatggatattcggttataaaaagcaatttttctgcactttaaagcactaatttgtaagtgcatgcggcacaattcacctgaataaggtaaagaagtgcctgaagcatccgagctcgggtgaaaattcgcctgtaaattaaaatggctttcaacggggaacagttttaaagtcttatagaacggatgcattcaaacagcagggggaacagcaaattaaaaacccaaaaaatttatagaattctcagtacaaacgtcgaaaattttgtcaattttaaaaagttttgccaaatttggaaaataatttttaaattttaactaaaactttagactaacaaaaaaacaaagacatatgaaaaaatcagccgcccgaaaacgtcgcgcacctcctccctcacaatttgtctttcgcttttcttcggccgccgctccccgtccccggtgacaccgccgttcacgtacgaatgccgacgacgtcgctgaactaagcggcaaaacaattttcagcaattgaaccaaatggaattctcagcagcagaggaccaaattagccaattttaattttatggattttaacccgcaaaaaaagcataaaacaagtgtccaataaattttccaacaaatcttaataactaattaaaattgtcatcttaaaataataaaggaggaacaattgtacgagttcaactcgtactgtcccaactcgtaatgatatttaaattttttttaaatggtaattacttttgaaatttgcacacaaatcgaaaattaagagcaaacaaataattccaagaatgttgtaattggttgactttgacaaaagctacgacgattttttgtcgaaaaactctataaatcaagggcactacgaatttggctagaacgagttgagtttttacggtcaattttattaaaattaaatccgtttcggtccccaaaaattgattcaaaacttttatcagacattttaagctcacagagtttcccccatgtttctttttgacagtcaatcaaatccattaattattatccaaaaattctaaaggcgcccgtgcccattcgctttcgggcccacttttctttggcatttaccttcgtatgcgttagtgttatgccggtcgtccgcagtagcgagcagcagcaactgctcgcgctccaaaaagaagcgcaggcccaacacggccaaaaattgggtgagagatttgttagatttgaaatttggattaaaatttttaaaaatgcctcgtgcagcacagcgatcaacgccaccaccagcatggaagcggccaaccatgaaatttgagtttcaattaacaaattgccgaattttaagcgatatcccggggaggggggggggggtgtaccgagtccgctgccaatcttccaaaagccgaccacaacatattccctttcgccaaagtgcagtgtcgggccggcgtagccgccatccgctgccgccggccctcccgccgacatttggacgaaacgatggacaaaatcgtcgggcccccagccgaacagagcttacagcagagaatggggcggcgattcggcatcagcagcagaa

SEQ ID NO: 17988 - DNA, 3199 bp, Heterodera glycines
  misc_feature (1660)..(1660): n is a, c, g, or t
  misc_feature (1756)..(1756): n is a, c, g, or t
tcggaaaatgaatatttttttgagaatgtgtggttctccaccctggaatatttaaatttgattaggtaaagtgccaaatctttatttgctctaaattcaatttgtgtgacgagggcaaaaaaaaaatcaaaaattgtggcttgtgattacggtagctcgacagaggtttataaaggaaatgttacactatggtagggtgctaattccgtttttgattattataaaactgtaccaaacaataattttaattgcctccctcacccaccagtcattgtgaaaatgccgaccagcgtgccaatgttacggccagctaacatcacctgaaaatttcaaagaaaaaagtctaaacatatattaaatgagccaatttatttatatattatttcatttaaaaagcatattactgtattgcaataccgtaacgggatttaattaactatttgcttattgttagccaaattaaacttaaaaaacaactatgtttaattattacatacgctatttactgaaatagaacccctgggggctttatttttaaatccccccccccctcaaaagggtggctttatttcaagggggttctaattcaataaatactatgaatactgtaaaaatcccctaaatctgctggccaaaagtgggccaaccaattttgtgttaaaatgataatccgctaacccacctcttcggtttggtcaccaacgcccgtcttggtggaatccgtcttacgaccagcccaaatgccgacaattaagatcaacacatagaagaaaatgattgcgataatgccaagccaatcaaccatattttaagtacagtagaatttctattttaaatccaaaaaaaaacgattttaaaacgattttcacgggttaaaatggcacaaaaatttgactattgggggccaattttcccttttcacatgatgttccccagggaacaagacaatgccaaaaatgagcagcatggggagaaggaacaacgtcaagttttacggaagtttgtcccctcggggcgggtggaggatcgatttccggggatgggaaaatccatcgtcgtcgtcattttttggtatggcacgggggtggggtgttcatccgaattttgtccgtaaaaaaacattattggatacattttttttttgtttgaaaaatgctcattgtgccgaaatttgtggcataattaatgatgccagagggaataggatggaaatctcatggagaaaggattcaaattttatattgggcgatagtgggctttaagggctttaatttagggggatggagactgtaatttagaaaatacgatattaaaagaagaaatatacgataagaaagaagaagttcaaagataaattaaattgtataatctttagaaaaaatattcgggtgtatgaaatttataagtttaatctaagcctaatcatctaattatggttttcgattcttgcgattattattgctaatcaactaattacaaaacagtcaaaaccgagagttacagcccagtctcgacactcaactaagtctcggagtatagcatttaaaaattgccagattttccctatttttaaagagctacacaaaagaattgaaccaactaaatgggaaggcagccttggctcccatgggccaaacaaaaacaccacaccgccactctngagtatgtgtgtgccaatgatgatgatggcagagaggagaggatgagttgggccaatttgtgccaaaaaacgggtgccaaatcggcgggtacgganagcagcagatgaggagggggcggggaggtgatgacggttaagcgtcagccagtcaatgacgcggctctgggataaaaaaaatgttcgtccatcagcggtgaagatatgctcacggggcggggaggaatagtgccagacggaaggatgaaatgggccccgcgggaatggcacacacccacccactctcgacaacaattgggcaccaaatgaagggggacggaacgggggcggcggcggcacaaaaagaggggggaaggagaaagaaggagttcacaaagctttcctcgagaacggggcaagtcgagaacaagcagggaatgagaggggtatttgagaactgacatttgagaaaaaaaaagtatcaaattttccatccattgatgttgggttatgacaataaactcggcattggcacttccgctttaaaaattgaaaaaagaagaaaatatgtaggtcttggataccggggaaagtaagtacgtgctggaaactttaaatgaaaaaattggctaaaaatgaaggatgtgacacataaaaaattattgaaaaattttaatagggcagagagtgattaaatggagaagacaaacttacaaaaatcgtggcattttttagaattttttttacaaaaaaaatactgtgaaaacagtttttcgaaaaccaagcggttcatttttctttttgacgaaaattatgaatatatggacggtattaaagcggtgccccggccgggcatttcttttaagcaatgggcggcgtgcccagcaagagcacggcatcggcacgggatgaagcaaaatgcaaattgggccaattctttttgctttttttcatgaacgccgacaacgcaatgcggatgttatttgttaacattgaaattttaggatttttaaaattatgacgaaatatgggggtaattgcttttaaatcggcttggcgcatatattcgattttggggatttaaaatatatttattattaattatgtttcgagttttttattatcttaattgggtcaccccaccttaatgagaaattcaaatccaattatgatggtgggaaaatgctgttgatgtatgtacttagtaagtggaaaaaaggaagtaatttgaatcccggtaatatgtctgctaatggtaatatttcaaaaattcaaaatcatgataaaataaattgaaaaaatcaattataaaaatgtatttttggtttacaatatttttttattaaggttcggttaagtattgcgtttattaactttaattttcatcattttttttatttaaataattttttcttaattaaaatttgtcaagaattggaaccaaaacaaaaaaaaccttcagggtataaaaatcctaatttcgagtttccaaaatttttgcgttttttgtcaaatttcaaaacttaaaaaactaaataattggcgtgtcaaactataaaaaaa

SEQ ID NO: 17989 - DNA, 1103 bp, Heterodera glycines
acactttctcagatcgccatttccattgggccatttttgcttgtcatctcattttccctttgttttggcccctttttccccgccgattttgtacccattggcgtcgctttttcgcatcttaatctttgcccccccagggggaaattgtttttggtacttaagtattgtttatcgtctatttggggccattccattccattccattttttgacttcacattcacctctggctcttcactcgtttcactcctcaccatctttttctttttgctgaatcattcccaatttttgaccccctcaataatccttatcgcccttcccttcctccaattttcaccatataatccatcaacatctcgcatataatcatccaccaatttttgaccattttatcatcatcatcaccaataaacattttgtcggaaaagtgttgaaagggtcagagggcaaaaaggggggaaaaattcgctcgggaacgaagcgaccaaaggggagccaaagccccgagaatcgaagcgggggacaatcccttgcagagcagcagcaaaaagggacgggagccagttcctggcggttgacgcagttcgcggccggaagtccaactcttctcccgaacctcaaccgggagcgccgacagctcttcaaaaagtcggtggtgccgttacagcaacaaccgcaaaccccatcttgtttgtcctccccaccccctccccagttcactccattgggcacggacccgacggcagcagcaaatttggcaatttgagtgaattgggcccgagggacgggagagaaactcccgcgcacagaccccctagccgtcagcgccggccgagttttctttgccacaaggttatttgacctatagaaggaggagatgtgggattaattgctatgaaatatatcgataaaattgtaaaaattacaaaaaatttctgtcagttcttccattttttatatacccatgttttccatgaaaatagcatctgagaatccccagttggtcgatttattatcacttttcaataataacccaattacagtatgttcgttttttatgggttttggttttttgagatttcatcaagttttcagcatttttta

SEQ ID NO: 17990 - DNA, 899 bp, Heterodera glycines
aagagtaaaggaaaacaaaatacggaaaacgataaaataaagacattacgggaggtttcagtcggaaaatttgaaatttccgggctctaattttgtgcctattcaccttttcgagattttttttccaataaataaccatttaaaatttttacatattttgagtttttcttacatatttcgggatttcttttatatatttatttacctattttgaccacttttttatatatttttgacagccctattaattacatactttttaggggtcggggtcactttggcgcgaccactttggcgcgggtattttggcgcgaggtttttttggcgcgagcttttttggcgcgaccactttggcgcaggtattttggcgcgaggtttttttggcgcgagcttttttggcgcgggccattttggcgcggccattttggcgccctatataaaatggcttttttggcgccagagttgaaaccgaagatcgtctggagtcgacggtgcgctgcttccgcgatgttgtttgttcgctgctcttcgttaacagtccgttcgtgttcgttccaatagtccaccggaaaacgcggacgtgttcgggttccatttggcaaaggaacgccggtgtagttgataaggaacctattttataaaccaattgttggaaaatccctgctctaaacttaccagcctaaaattgggtctagttcttgccccacgatgtcgttcagtgcagtaattgcagcagttaaatgctgaattggcacaaaagcgagcgcggtgatcattcgagccgtttctgcgaaaacggggtcgcttcggtagcgctaaacggaagacaatttcttttttgagagggatacaatattttttgagaatagaacttacattttgaagtccttcggaaatta

SEQ ID NO: 17991 - DNA, 910 bp, Heterodera glycines
gttcccctctctattcctccctctctctctctccctctcccctccttctcccctccctcctcccctccctctcccctcccaatgacttcctctttgtacataatcacgatgctccaaaagaaggtccaaattaaatgctaattataaatttttaatttgcttttagacaaaaattggagttgtaaatgtttggcaactcttcgaattgtgtcgcaaaaaaacagaattacagattattggagagaattcagcgaagaaagaacttttagcagcaaatcgaactccagctggggatatgacaatttcatttcctttgtggtgagtgcatatcaccctatggaaaggaaacatattttaattgatttgacattgaaattaataaggacaaaaagcagattttacaattatttaataatttgggtttttaatagagcatcaaaacgaaaatttaatttaacccaaattttccaaaaaatattaattaatgaaaatctactaagacctcttgtattctgagaaaccaaaacctctcatatcctcatcatccattacgcattgcaaaaaaaataaaacaaatttataaatgccccgagatgcgtccctcttcttttctgctcttcggtggctccatttgccgacgcaatgtacgcgttgtactcatctcttgcacgctctggtagagtcatctttggaaacccaccgtgaacgagaatccagttcatcacaaggcgcccgttcccatcagcatacgggtgtataaaaacctttgtttgtttgtatttttattttaaattaaaataaacttgtaagaaagaaaaaattatttatttaaacggctctattccagtttacgcgtccaatcaatgtttacgcgtccaatgagtgaccaccctcacttttttaggtcata

SEQ ID NO: 17992 - DNA, 1307 bp, Heterodera glycines
tgatcattagtaggattatccaaatctattttttacttaatataatttgtttattatattaaataatgatgcaatatttaaaaattgggattgatcattagtaggattatccaaatctattttttacttaatttaatttgtttattatattaaataatgatgcaatatttaaaaattgggattgatcattagtaggattatccaaatctattttttacttaatttaatttgtttattatattaaataatgatgcaatatttaaaaattgggattgatcattagtaggattatccaaatctattttttacttaatataatttgtttattatattaaataatgatgcaatatttaaaaattgggattgatcattagtaggattatccaaatctattttttacttaatataatttgtttattatattaaataatgatgcaatatttaaaaattgggattgatcattagtaggattatccaaatctattttttacttaatataatttgtttattatattaaataatgatgcaatatttaaaaattgggattgatcattagtaggattatccaaatctattttttacttaatagaacttattattatttattaaatgacttattttattaattttaaataaggtcgacgacaaacttacttgcatttatgaatggactccaagaaattccattcaacgaatattcaaaacaaaaatatgaagcacaccttggcattttgtattttatgagaaagaattggcaatgtaacaaaattgataaaaaaaaattgaatgaatatgaacggacagaatataaataaaaataaaccaaactgaaaatgaaaaaagaaagaagcacatttaataaaaaaatttccttaaaaatccccataattgcgaaatatatttgtcgctgctagtccattgacaaagcccgaaaatatttcatcaacaaaatatttttaaatacgaattttggcttccctgttgggattccggcgtattctctatgcaaatattcgtacgtcaaaatactttcgatatttttggcattctgtccgttcatatttttcaaattcctgcgcaattttgtcacagtgccaattttttctcataaaatacacaaggctaaggtgaacttcgtatttttgctttgaatactcactaatttgaatatttgagtgacctttcataaatgcaataagtgctttatcatcgtcccttataaatagatggtgtaaataaaatgtttcattaattaactcaaatttaaactcaccgatggatttgcatgtgaaatcccagcgttccca

SEQ ID NO: 17993 - DNA, 1496 bp, Heterodera glycines
atttattaaaaaaattaatttactccatacatttcacaaaatttgttgtcgcagctcttttgtcctatttgcttgttgtagcatctgtaattgaaagattatatttaaaggtttataccaaaattgatgaaaatttatttttggttaatttaattgaaacttacccaaaaaatgattaaatttttcgctaattattttgagataattttataaaaattcatatttttatcaatcccttactcatctgcacgtaacaacaattgttcatccggtcttaatttaatttttaaaaacaattaactaatgcattaaaatacatttaataatttacttttccatgatggacaatccgtgtccaccgccgcttcggtgagtgtctgaattaactttgaaattcaaattttgattttaatttggccaattaattttttacatcggtaatgtcccatttgattgacacgccgggcttttcccattgccatttggtggcacatgaccatatatgttccattggctcatatttttcgcccgaagaatcgccaccataattgttgttgttgttgttgttgttgttgttgttgttgttgttgttgttgttgttgtgttgttgtcatgtgggtagccaccagggggaccagcaccatatttgccatatcgtatttgccagaaatgccaagcaaaaaattgccaaaattgtcagtaccatttttcaattttcttaaattatggacaatttattttaattgctcaattcaaaatgttccctatcatctgatgagtgatagattttgaaattgaaaattatcattttatttaaattgagtataatttcaattaagaaatattttttatatataaaggttattttgagtttaaataaatgagtgaattcatttgaattgttcatttctttaaatgcatttcttttctgcaattagtttgtaaactcaataacgctaatcattcattagttaatcaaagcatcatgaatggactaaaaaacaaaattgttcaacccaaaaaatctgaaaaaataattgaaataacaagttaggtgagcaaatattctcgacgtaactctcccctatctcaaaatgagtaattaatgaattaataaactaataaaataattaggaaaaattaattaattttaagagatttaaaaaacgaattaatgaaattatttgatataaggtcaaaaaacaataatgattagccatagcctaaatgatgagctaacaaataaattaagaatttttataaaaattatgtcgaattaaattaaaggtgcaatgactaagtacgaaaagtgcaagattgggcgaaaagtacgaaaaggtgcaaaataggcgaagtacgataaaagtggaagtgatcaaattaaaagcaaaataataaattattttaaaaattaaaacaaaaattattttatattaattacatttatccgttttagtttttagcaggtaagaattattagcgaaaaacgtgaaaaa

SEQ ID NO: 17994 - DNA, 1679 bp, Heterodera glycines
  misc_feature (1600)..(1600): n is a, c, g, or t
aaagcattgtactgaataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcataattaaaaccgaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtcgttgtccaataaggtacttggactttccacagtaaaatgtggtacaaaattttggaactgtcccgcctcacggcggggcttaaaagcattgtactgaataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtnaaatgtggtacaaaattttggaactgtcccgccctcacgcggggcttaaaagcattgtacagcataattaaaagctaaa

SEQ ID NO: 17995 - DNA, 934 bp, Heterodera glycines
ttcactattttattacattttctaattaattatttctttatcaattcatcatttttcaaaaaaaaaaaaattggccaaaaatcaaactttgtttaaaaatttttcaaaattatttttaattgattttggagtgaacaaaaaacaaattttgcttaaaatcacgcgagcaaatttatggaaataaatagaaaaaataaaatggcgggagagcgcacgcacattagtgcgatgattggcacatggacggacaaatggggagggggcaattaattaattacactaattacccccgctaattattgagcacactaattgccccggctatcacatttgttgaacgacgattaaaaaaaaaataaatgtgcagcattgcatttttgtgatgacactgacttttttcagttttttgtgcccccgttcccaacaatttctcgccaaacagtaccccggtttggtgttacgacgacgacgcccaagacaaggaggcggagcaggacagaaacgggtggtggtggggagcacggtggcgccggcgacgacggcggtcaaattgacgacgccaatcgcagcggaacatcgattggagggcgaagaggaagaagaggaggaaaatggggacgacggaggaggaggaatagcgacaaaattgactacagccgacgacgacaacgacgacgaggaggtggaggaggacattttcagcgaaattgtcatcgacgagttctcgttgctgctgtttcggtcgatggacgactacaatgtatggggcagggggaaaatgtactatataaatgagagatgaaacggtttgggggtgatttgaaatgggacggaaacgacgaacgccaaaaaggggcgaaaaaaagggggagggggcgttaaaaaaagttgtacaaattattttttattgctttgaatgtgagtgactgacgga

SEQ ID NO: 17996 - DNA, 2218 bp, Heterodera glycines
  misc_feature (5)..(5): n is a, c, g, or t
  misc_feature (2198)..(2198): n is a, c, g, or t
ttttntgggaaaatttacaaaatttttttttttttttccctcactagggggctaattaatcccttctcccccttttgtttcctgatgctcaaagagtgcgaagagaacatcaaagcggcggaggaagcgatggaaaagcaacggttgtatgaggaaaatgtgcggctgggccgagtgaagaaaaagggcaggagaagcctggtgcgttttttaaaagcggcgagggtcacggcacaaaaattgatggcacttcctcatcaaaattcggcctttttcggcaaacccaaatttacaataatttttggtttgccaatttggcataaattcggaacgcatcaagctaaaggaagcaaatccccgaaaaaatccatttgaaacactcggtgggttgcagaaaaaaacggggatttgtggcttgctgtttgtttcccgctgagaggagaattcttcttaaaaaactaggaacttgaaaaaaaagttagaaaaattatttttacggttttttcaaaattatatatgatgtactaatattactaattaaaaaaaaatttcaaaaaggaaattttgtaaaaaatttttttttaaaaatctcctttaaatttcaacaacacccgatgaatcattttgaaaattggaaaaattgaacttgcttttaatttttagaaaaaatcttttaattttttccatttataaattcttcatttgtgcaaaacaatttttgccccattttaattttgcaattttatctcgcaaaatgcaaaattgaaaatatgtcaattgggaacaccaagaaaaaggccctcctccgtatctcggtgaacagtgaacacctcaaaattcatgttttttttttcttatttacaatttatgaccggagggaaggggggggggggcgaattcattccgtaattttccatttttccatcaaaaaattgcgattttgggcctcccaaaagcgttgtaatttctttgataaaatgccactttttttcttttttggtaatgaatgccatggtgccatttttgtttttggaaatgcagcaatttatcatccgtcattttgtcattgtgtttgattttttttggcaattgggccagaaaaaagcattagttggccgtcgctccccccgtcccccaaatttcatatttttgtgtttacaattagcgtaaaattggaaggaaattattattacatattgccattagcattactgtaccgtaaaatgatgaaaaacatgtacaaaaataactaacattccttccttcccacggcattttgcgcattcgatggcatttaagtggtgaccgtttccgaaataaaattatccatttttgggtttcacttcattcacagctcatgaagaagtgagaaattgctgcgcgcttttcttcatttacataaattagcattagtaataaagaataatttttttttgttgaaaaattcctaagatttcaaaattttttctcaaaaaacttagtaattcctcatcaaattctaaaaaaatcgcaaatttttaaatttcattataaattttttaagttttttgagaaatttccgcgtttgaaaatttttaaaaaatattttcggggtggggagcctagtgcacccatattccttcttcccctcttttccgtttccaacgcattttttaaattaaatttataaaattgaaatcgcttgcttcttcaaggcggagctgaagcgggacaagaaggaggccaagaagcgggcgcgccagcagcaaaaagagcagcggaaaagggagcgggaggagcggcgccagcagcgcaaattggcggcggcgacgacggcacaaaacggcgtcggcacaggcgcggaaacagaggaaatggcggagcgcagacggcagcgcaaggagcagcgccgggaggcaaagctggcggaaagggaggagcggcgacggcacaaaatgcagcagcagcaacaaaaacaacggcacaaggaggagaagcagcagcaccaacaacaacggaccaaggtgtgggaggggacatgggcttggcaaatggcatggcattggctgggtgtgaaatccgctttccggcggcactttttggcgcgccggaatttcgctttctggcaatttttttttttggcttgtggaggcacccctggaaaggacgaagaatgctccttttacgccccatttacatatttaaatttgggatcccgnataaatgatattttgttttt

SEQ ID NO: 17997 - DNA, 2248 bp, Heterodera glycines
  misc_feature (71)..(71): n is a, c, g, or t
aaaatatatatgaaaaaattaaaaaaaaagtaaaagtaaaaattttaaatataaaaattctaaaataaaanttaaaatggaaaaatgtatgagcatattatacaaattgttttatcattttatgaagctgcacaagttttagcatctggaacaagaagtaaaaaattatcattatatcaaattaaaactttaattaaatttataccttgatggaactcgcgcatttatttttactgtacaatttatctttttcattttaatttaaatactaatcttaaataatatatctactattcgtttttataaataaatctaaataaaataataaattgcggctgagtcgttttataaaaacgatcaaatgaaaatttgattaacatgacattgaatattaatgaattaaactatgaatgatcattattaatcaaagaaatgaaattgaaacaaataataaatttattaagataattaaacgaatattatcaaatagattaaacttaactaataatacttttattaatttcccagaaaaaataattatttaagaataaaatattcgacggatataataaaaataaataaaattagaaacacaaataaaaattacttttacctacttctgtgtatgagatattaaattaaacttataacataccttcttaaaatgaaaattaaaatataaaattaaaacagattttcggcatcaaatttgtccaatttgacagaaatctactgaatattaaaaaagacacaaagcgattgcgaaagaattgtgtcattcgggatttcgcggaagaagtacagaaaaataagaaaaatgtaaaaaaaataaagtggtagaactatataactatcaatagtttattaatgtttaatgtaagccggctttctgtaactcgcaaaaatttaaaattaatctacatttaaataaataaactcgcaaaattaatggttataataaagtgcaactcaaataactgatatttgattaaaagacaaattttgaatttataaaagtatttaaatgctatacatatttagccaattcatattctgggcgactcgtaacaatttataacgtaaataaagaagaggaagaatcatagattcaaaataatacaatacaattttaaataatactactttgatatttttaattataaaatttttgtttaaattaaacatgctttggtataataagtatgatatgaattaacatgcttttaaatcggaattagtgataaacaactaataaaatgaatatatatcaaaatggattaattaaataaatatgcatatattttaataaagcaattctatacaaatattttgtattacttagtacaaataaatttattataaaatttcaaaaaacattttttcttactaaataaagataaaaatttaccattatttataacttaattattttaactagtttttaaaatttgcaaattaaatttaacgagctcttcttcaatttgatgaaaaaatgcaaaagttgcgcacggactgtgacgaattgatcgcagacagagacaaaaagaaagacaaaaacagcaagtagctgttaatatcagtgtcttatcaaatattttatatgtataatacctacatcgtaatttctaaataaattaaatttctaaaaaaatcagatttatcaaacacttttttggaaatcctcaaaaaaaatccaaatttacgaaagtttttgtacatattttattttttctatattatttttgagaatttttgaaaacttatagtgaaaaaatttttaaaaatgttccccagaaaaatacaaaaggtaatttttaaaatactacaatatgtagaaggtgattctaagcctatttaggtcttttttatgtcattttgtgcttgattcatcctttacgaggataaccatttaaaaaattttatttacatattgggcttttttgtacatcgagattttaatttcatatttgtatatattttgaccattttttgtacttattcttggcagccctagctgtaattaggaatgggaattttatgtaataaaatttacaaaattcctaaataaatctcaaaacatgtaggaaaatgtactaaaattcaaacatatgtatatagaaaacgagtgtttttatgacctttgaaaacataaaaaaaatttcagaaaaagggagggggacaaactgaactattaccattttttgttttttgtaaggctaatagagcttgtgaagggttttcgaatgat

SEQ ID NO: 17998 - DNA, 2583 bp, Heterodera glycines
  misc_feature (2450)..(2450): n is a, c, g, or t
  misc_feature (2512)..(2512): n is a, c, g, or t
atattgaataataaaataaaataaataattaaaatgacatttacacggaaaatgaattaactgtttaacatataaaattaattaacaaattaaacaatttcacgattgttatttaataattttagttgctctagttaatagcaattttataaatatatttaagctaaaatttatgcaataaaaagtcaacacagtattctctaactgccgtacattaagtagcgcaagttgaatttattataaattatttcagattaaaatcgcaattaaaattaaataaaatttaaaatattaattgaatttaattcgactattaaaaaataaaaatattatacaagaaaattaagagcaaaaaatttaaagtaatttaaaaagaccataaaaacaaaatgaattttttttcataatgtgaatgaatcaaaaaacaaaactcttacttatactaaagttaattcctaaaaatataaacaaatttatttatttatcgtaataaaatcagtatttactggcacaaagttgatcgaataatgcggtgtatcaacaagaaatagaaattaaaaagcaacaaagtttcgattgacaaaaaaatagtcatgacttttgtcaagccatgattaaaaaaaaccaaaaataaataaatctagtaattttataatgccattaaatgaaaatgaattatcaaactggaaagcaagagacgaagaagaactggaaaatgcctaaaaaggaaaaaaatagcaagaaaaacggcgaaggaaagtgatcacattgtggtcgaagtagctgaaaattagatatggtcaggaaacccttacaaatttaattcaatttttacgtgatcaaaaagtaattgaatgccatgattttgttcggcaacgatttttgagggattgtaaaagtttttcattgtaattgataattttcattcccttgacgccattctttccaattttgcttagagtttcaatttggtccaatgtccatttgctcgttttgaaatgtaaatccactcgacagtcaaatcggcggctgatcagtgcaatttaaggtcaagctgagcggggtgcaccaaatcgaacacgccagccaacagtcggcagagatgagctgaaaatagaaaaaacaaaatgattagaaattaaattgagatttaattagcacatcgctttttccatttttcgctcagcttctttcgggttgtccgacattgttttttgaattggttaataaaattcaaataaaaaaatgactgaaaaataattatccatcttcaaagttaacgatcgaattaaaaatttaaatttagcacgtcaaaaaggatgaatgtgttgtagtaaaaataacggtgtcctctcgaaggacccacagacaaagaaccccagcctattgctattggcggatccttccactactgcgcagtgcgttgccaattttttgggtccaaaaaatcaattaacataggaattaattgatttgatataaaattattcaatgcgcaaataaattatggatcaattaaaaaaataaatattttagggaaaacaatttgaggcaaaactccctctctcttgaaataaattgaaatttaaggacaaaacctaatgtagcgaaaaataatggaaaaataaggacaaaaaaatatatataaattttaagagaaaaaataaatctaattaaaaaatttggtagaaattacattgcttaaatatttcaattaagaatgtgaaaaaaatgaaatatttgcaaaaattgtttttgttatttttttctttttggccgcatatttttgattttaataaataatcaaactttttaaaaattgtattcaaatattacgattttaattttttttattattatttaagttcgtttaaattattttttttattttaatttgaattatttaaattatgtttagaaattcaattttcttaaaatattttcaatcttggagtcttccttccacctctgccgatgcatcttcgcggtattgtcaaaaccaacactaatttcttttttagtacactcaaaagcaaagttttaattttaaacttaatctttcatgttgtaattattaacttgaatttttattaataaattatttttaaatgataaaaaataattttctattctgattacaaataaatattcatttacatacagataaatttatttaatggtgtaaaataattttgaagtattcattttattgaataattttgatttagctcattaattttaatgtaatattattactccaattcttgtaaaaataattgatgtttaaatattttcaaatatttttttcataggaattaaatcatttttagttacctcactttttaaagtttttttaaaccatttgttaggaatattcgattttctacagtaaatttaatggttgatttaactcgtaaataacacttaatcttttaatagataattaatanattccaaaaaaatctgtctaaatttttaaaatatcttcgcgttattgtaggtctcaagtttnaagaaagtagtttatacaattttataatatttgtggtaaatagctttgacgagtaaaaatatacaattttg

SEQ ID NO: 17999 - DNA, 1149 bp, Heterodera glycines
gttttttgggtttttttattttttttaaattttttttcattaatattccaattttaacctcaaaatttttgcatttaaaaataattaataaaaattatttttaaatattttaaataaattatatacataagtatcaagagagtatgagaatattattgtacaaatttccaaaaataccttaagttgtcttaaatcttttaactaaagacatttgtcaaaaatttattaatttttttcaaattcggggtaatttcatggtgaaatttagtttagttttcgggcccaaatggccgggaccgggatttggaaaatggacttgggcgggacccccggctccgggactccgtttttccgggactcccggtcccggtggtttgcttaaaaaaccgggaccggggaccaggcaaaatcacggctgtgtcccggtcccgttcgggctctaataataacattaaaataattaaattgtttaaaatgaaattattttaaaaatattttggcaaagaactcttttaaattttctttcattaaaataatcttcctttattataacaaaataaaattaaagaaaaagctaactttcgtaatataataatccaagcaattaaagcgacgcaatcatttcatcttttcccaacattttaaattaaaaaataatggaatataaaaaatattcaaaaaatctcaagacaagaagcctaaaattaatgaaaaaaaataattaaatacgtacaattaaaaacaaatgcataaaaagagattaaaaggattattattttatgaattctttttttataatttattttctcatttttcttcataattttccaaaaaggctaaaaaaagaaagaaattatttgaaaagaatttacaattaaaagaattcatttgaaaattaatataacatttattgaaaaaacaaattaatgcaaaaattaaatgagaatttaatgataaaataataaatacatttttaacaaaatcaaaaaaaaattacaaatttaatgtccatgagaagaattgtttttgaatatacagtcatggtcatatgtttatgcagtaaaatatttttcaaagaaaaatgtcgataacttttttaaaaccaaacaaaaatttattttgtttacccaatttttgtagctatttttc

SEQ ID NO: 18000 - DNA, 2651 bp, Heterodera glycines
gtcatgtcaggggttagtgtgcacccactgctctattaataaaaaattaaacatattgaacattaaaggcataatgaataccccttaattctccgctgactgtaaaaaatggctgcatattggagcaatgttcttgaaaaatattttgtatttaaaaaaaatttaaatatacccaatgccgttgagtctgcattcgtagtatttaattgtagggaaatatacccaatgccgttgcatctgcattcgtagtatttaattgtagggaaatatacccaatgccgttgaatctgcattcgtagtatttaattgtagggaaatatacccaatgccgttgcatctgcattcgtagtatttaattgtagggaaatatacccaatgccgttgcatctgcattcgtagtatttaattgtagggaaatatacccaatgccgttgaatctgcattcggagtattgtagggaattattgttcggcagaagtcggtcgacacattgagaaggaacaaatttcaataaatttatttaattaattttattaaaattctactcaaaaccattggttgaaaaaattaaaaacgcaacaattcgtctcttctcaaacatgtttttatggtaattaatataaaatttttggtctttcaggtgtacgtccttcaattttttatttttgcgaatttagccttggggcatatttttataacctttgatggaaacgcggaatcgtttttttgtattaaactttagtctggtatttattatgtgacacaacaaacatattattttttgtttttatacgcgtcaaacgtccttgagacattgcatgttccttaaaaattgttcatcaaattatttactaagttatcctaatgcaaaggtatgagaattaatactataacaaatatgataattattttgattagaataattatggaatttatattaaaacacaattgaaacgtaataaatcgaaaaaatatgaaaaatttgtttttctggaggttctaacatatggactgtaaaaactttcgctttttctttccgtacgatatggggtaaaaaatatttcattttcatggcggaacaaatgcttagtagctgtcaatcgtattttattttataacattttcatgtcaaatcgatcattttgcacttgttttaggaatttatttatcttcgaaaaattggtatatgaataattctctgctttttgacacttaaatatatttatttctttgataccaatttctaatttttgcatagctaaggcctgtcttttatattcatgcataataagactgggtaatttttgaattttttcgagcatttctaggaatgaaaagtataaattttcgatttcagatgcacttaatgctaaaatataaaaatttttgcgtgtttaaaaagtttatttgctaaaatttctaacaaatgtgaatgtttaacaatctttcctgcaaagttccaatttcttgtaattttgttttttataaaattaatttttcttgaatcactgtagtcatctgggattatagttacttctaatgttatggcatcatccaaaggatagaaaagcgaatatagttcttcttttaataagacgtgttggaacaaagcctcgaacggcacaatccaatgctaacaaagggaggtggccaagtgtccgtgggatttccaaatgaaacttggtttgatggatagagcacccatgggttcttaagaaaaatgtttttattttctgccgaatgggcacgagtgccgagttatgacgtgccaaagtttttagtttttataattaaagaaaaggaataattatttctttgtccacaacaagttgttggtgtagaggaaatgcgttagtccaaatttttttgggttacaagttcgaatcccctatatgtaaatccatttggtaatttttatttttgctttttatgagcaattaaattatcaaattttatttcattaacaaaatatttattttaattttattccattaaaaataaaaaattgcaataaatataaagatgtaataatatatcctgtcgaattaaaaaatattttttgtctaatatttttactgaatattttaagcattaaataatataaaaaaattaaaaataaaaattttttataaaataaacttttgataattgacggtataaaagacaaaaataaaaaaacaaaatttacgtgaaggggatcccaaccctgggctagaagatgctgactagcgtactacccgctacaccactggacaccgtgtcggaatgctgatcagctgaaactacttttgaaccaagagccaatggtaaagaccaatggggaagaacatggtaaaacagaggaaaattatgacccaatcgcagagtttgctaacctaatgaaaaagggtttgtttttaaaaatttcctttataaaataaattttaaattatttttaatgaagcatatagaatgtcaaaagtctggaattttataaaagtcctagaactcatttaaagactatttattctcataaatggagtgaagtgcgaccaacagaacgcatgaaatttggcagcgaattttggcagagagacattttgacaaaattggcatcaaattttggcattcaaaaatgaattttgaagagaaatggacagaaatgaaaataa

SEQ ID NO: 18001 - DNA, 1840 bp, Heterodera glycines
  misc_feature (43)..(43): n is a, c, g, or t
tttttgtttttttaataatagtaaaaaataaatctttcagatncatattttttcgaaaacaaaatattatgcttattatacaaattttttattatattttcaaattttgtaattaaacattgttttattttataattttttcataagaaatactttattagtttattatttttatatttcatcttttaaactcatgttgcgtgtgctgtagaatgattgaattgccaaggtgttttgttcatcaatttcttatatttataattatgtttattagtgtaataaaataaaatatttttgtaaatataaaatttttatgtaattttttacataagattttgattaattcatttttcaaatgaaaaaattatttaaataaaagcgttttattttatttttagaaaataaaaaactaaaacaaaatatgatcaacttaatagcccaaaggtaggtgtcctttattgagatcctgcagatgaactgccttatgatcaaataaatgcaaacattagccaaaacaggcttgatctattcttttttccttaaatacagattttaaaagtttttttagcacatataaatccaatccatgttaataagtcattaatataatcaatttccggatagtagaaaggtgatttggtttagattaattattaattttattatgcttttatttatctaaatataattttattttagcaagaagcatgcaaatttttatttttggaagaatatagaaatatagaaagaaaacttagattttacagaaaaatttcttgaatattgaatattattcatcaaaattcattaaaaaattgatttaaaaaatttaaaatatatgaaaaatttttaaatagacatatttttattattgtccagaccatctttaattcttctcttttataataatttttttaatttataaaattatttttccaaataaaataattaaagtattacttattttcattgatacttttaaattcgacatgacatcggaatgattgaagttcaaaaatttgattttttaaacttatttttaaaatataagaataaatcatatctttttaaatttacttactttttaatgaattctttttgtctttgctttcgaataaaaaatataattttaatcgaattattgtttaattatatattttaatttatttttttttataaatccagtgtatttttttttgtcaccgagtttagcgctattataaaaattgtttaattcataaagtaattttaaaagaatagtttaaatgtatttaattctacaattatttaacccattattttgtgtttggttttagcatcagataattaaatttttatgaattatttcgatacaaatatatttaaattttttattgtgctcctccatgaataatttctgaagatataaagttgtttaattatgataaatatttttaaatttttgtcagtttgaccacacaaaggtaaaatgatgttatacggggtgtaatattttgacttttcacctctgattttagttttaaattaagaaaagaagaatagaaaattgtgaggcggagtgaggaggggtatattaaagcgtagaaaaacttacaataaaaaattatacacgaaaaggaaggaagacaaaaaattatctataattaattacaaattacaaatattcgaatttcatgcacatgtcactgaaaaaagtaggattaattatataaaattattacttatattgaccgggacgggaatttccgggttttcaggtctcggtctcggtctcagtcccgtcccggtttttgaaaaaactgaaattcaggtcccggttttgccagtcccggtcccggcg

SEQ ID NO: 18002 - DNA, 1789 bp, Heterodera glycines
tttcgtaaacggcccccatgaatactattacccatgcgcgtttcgtaaaagggccaatggttcgaaacaaaaattcatgctatgttttttgcaattatcatgcaaatataattataatcatttaaaatttaaagcctttaaaatgcaacgagccaagattaattttatattcgatagctctaagaattctctatttacctttaaaatttcagaaaatttcattgagtttcaaaaagttctggacaaaaattcctgacttcatattttttgaaattttatcacaataacttttttatacttaagtaaaaaatttaaaaaaataatattatgatagagaacacttaaagatattgaatgataatatgaaattttaatttggttcaatttgagccaaaatataaatttttatttgttactcatttcgaacccttaaactgacaaaaactcaaattataattttttctttgtaaaatattttgttttggcgcaaaatctgttaacaaatcttataaaattctaaaaacttttcggtgttgcacatgggcaccgccggacccgacaatttttagttggacaaagcaaaaattttgaatgaattttcataaattaatagatataactacatttaaatactgtcattagcaaaataaaaaaattattattaagaaaaattgttaataaaaaacaaatagttatgtcaattaatgaaacagaataaaataaactaatggaaagtttttaacatattatgatgaaacttattaataagttgaaaattaattttttaaattgattcaatagcttttaaacagttattttttcagaaagaattataaacaatatataaaagtaagtatattttcatcaataataggcagtcaaataaatctgattgttaattacaaatgcttgaagaaacagagattaaaagataaaagagttaaaaagataataatttaatttacaaaaaataataagtttaaaataggaaaataaataattattaaacaaatataatttttaaattttattattaattacgcatttaaaacaattgaaaagcaaatattgtaatagttttaaaaaataaatgatttgaacttgatggcggataaacagtgaaaaacttccgtctgatagtcatgagattaatggaaaagcacaaaaatattctgttgttgaacaaaaatataaacaaaatcaaacgacaaattaaaaaaatcatttgataatttgtgtacagatttatctttgaaaatatataaacaaaatccaatctttattataaatttaataaaattaatttacttttatttttttaatttatgcaaaacatttaaaataatattttcaaattaaaatgaaatacaataataatctttagtcaatattataatcaaattagtaaaataattttaaaaaagaaaattaatattacataatgatttaatagcaaaaaaacattaaaatactatcggattaaaataaaagattatttgaaattcaacaatatttgtacatataagaaaaatctttactgttgaagataaacgttggtaaaataaaataatattctctaattagatattaaaatgcaatataatatttagaaataattatagataaattttttatttaaagaaaagtttattgaaaaaataatataaaaactattctttagaaaagcaagaattttatttaaatattaaggtcaaaattaggtggtgtaaaatgacaaaatttcttgtgtggggtaaaataaattagggcaaatcattatgagaagaag

SEQ ID NO: 18003 - DNA, 2577 bp, Heterodera glycines
  misc_feature (9)..(9): n is a, c, g, or t
ttataatgntcaaatttcacttataattgctactttttgccaccgttatccaacttatctctgtccatcatcatatttttagctattcttaatgtattagccatccattcatttatggttcacgtgattcatggccactcaatgctctgtggcaggagctaatgctttctcttaaacgagattgttccgccatttcgttgatttcaaactctgcccataatccacagatctccgctcattttttgttcattttcaatatgcttgctcatttatttatattttcgacaattatttatttatttatttttcactttcttttaatttccttttattttcaatatttatttctctttcgcttgtataataaaaataaaatttagctttaaaatgccaaaaatcaaaaagaataagagttctaaaaaatccatctcggcggccccgtcacgacaaatgccactggcacaaaattatgaagacctcacatcatcgcgcgaatccgccactgtcgacaaacattcgccattaactccaacaacgaatgtcgtcgttgaccgaattttttcggatgatcctgaaatggcagatgaggatgggaagcgagtttctcgctctgaaaacgggcaacacattaaaaaaatgtctgtgaactcggccttagggccatccgtcatgattgaaaataaaagtggtggcgataatgagccaaattatgaagagagtgaggtgagaattgaggtcttggacaaaacaactaagacggccttagggtcaccagtcatgcatagcagagctaatttagctataaacaatataacaatagagaatattgaggacattaatagctttttcacaacctttgaaaattattttgctcgaacatatcagattttgggaactttgacagaccctctgttatgggctatgttacagcccaaatctctgagtgaatcagagaatagaaaatctgaaactatttcaacggatgacaaatttattgttattcaaacagggataaattggaccttggcatcacgattaactgaagtgagttcttggcctcattttttgctgatgaaaaagaaatcacaatcagatgaatattttcgattgggtgaaatcatagatataaaagaatttgtggaaaatgagtcaaattctcctaaggcttttagcaaatttgcgacagatctcaccttgcttccagaggatggttgtgggtcaattgctagaattctaaaatgcgaaagaactggtaaaataaatgccgtcgatatctgctttgatgagttagtgcaacggttctattcacaccaatttggttcagatgtcgatgtttcagaaattgttgctgatgcttatgtagaggttattaccttaggttttcgaattcaaggctttgaaaacagtctgtctactttaactggtctaaataccttaagcgatgaaccaatccaaatagtatctcaacccaatattggaaccagcatcgatttagtaatcaagattgtcagacaaattgatccagtagaggaggattaccgtcaatggtgtgagtttctcgtaaaacaacggtctacttccaaccatgatcaagactaccatcaccgaaggtagaattatattgagaacaaaagtaccctcgggtcaccagtcatgtgattttttccctaattattaaaaatttgcagcatttaaaaacttattttaaattctttcttattaaaataaaccattaaaattttgaaccaaaaataagtcaaattattttaattttcgaaatgtattcggaaactatcgccgttaaatataaagaagattaaacccaaggatttcggtccatctgtcaaggaaagtgcaattcttggaaaagcacaaaactgaggcacagctaaatattcaaatcgtagcagtattttatgttaattcgtgtctgcaaaagttctctgcttcggcagcactgtcaagattacgggccttgtggttaatatacattaaattttatgaatgttttttaattaatagaatactaaaaaatcgaccaaaaggaatctatttagacggacatttttaattactcttgtgtcttaataccaaaatttggggctcagatatcgtaaatcccctatttcacatcgttcagtaaagtcgatgataatataaaattttcaatttcgacacatacaaatctatgccatttagacaattctgaatattccactgatttgtagaagattatcagaaaaattataatctttctttttgctaatagatataaacaaaattatttttgctttataaaattttatttaattttttcaaattttgcggcagtaagaaaattctgcatcgaatatatcgaattaattttttttcccaattcgaatttcatgtgagtcaatcgtttatcatttgctttaaaaaacttctcctttttaatagctttgagtgataccaagatctcccaatttttttttactaaaactaatattctcaaaaaaatatattaaaatattaatgctttggaatggactctaacctaagtcctgcctttactatcttaaccagaaccacaaatca

SEQ ID NO: 18004 - DNA, 2842 bp, Heterodera glycines
acaattcgattttcttcaaatccatcagtttcaatattaaataatttttcatcattaaaattttcataatttaaaattccaattttttctaataattttctcagtaatttttctttttcctcaataattttcattttcttttttattatcattttggcttgatttcttataaatttattttcttcagtctttccattggcaattttaaataaatgggcgattgggttaagaaaaataaacaaattcaattggtctttcctactgttgaatattggaagtaaaattgaaaactaaaaactttgaaagtatttttaatgatttaataaaaaataaaaagcaatttttatacctttatgctttctatttcccttttacacaaagggcaaaaaccttttccttgagcagcgatccttatttaaaattaaaatttaaaaaccattcaattaattctcaccaatttatgatacaatgcttgtgaaaaatgtgctggaatagttttaatgtatacaattaattcatttttaattctttttttaatgaaacatatattaataaattcttgaaaagaaaatttaaaaattacattttgaagataggctaagaaaatcatttttggcattttctccaaaagctatttacacgctaatttgaccgaattccataagctttccatataaattgttttattaaataaaaatatgcctttgagttttcgttgtaatcttcatgaaatttgattgtctgtttttcgccatttaatgactcaaaacaaattgggcattcatcttcttcgtcatcattattacgatcacttttttgctttttgtcgttgattgaattttcaataattaaatcatcatttattttatttccctaaatttaattattcaattttatttcgctgaagaatctttacctcatcaaaataataaattttcaattgaagattcaaaattttgtgtttaaaaaagcgttgtacatcatcaatttcaattgataaattgtactcatttaactgaatttaacattaaaaaggttcaaattataaataattttacgtgttgttgcgaagttgatgcttctccgtgtaaatgatttgagcgctaaaacaaattaatacattattatttaccaacaatttaaaaaaaaaataaaaatttaaaaaaaatttgggaatatttttaatttttttttcaatataatttaccattaaatttaattttgccgattgttctctgttcgtagtcaattcatttctatgattttttgccgcagtgagtggcgcgtgtcccagcaaaattttttcatccaacattggcaaatttctttgatttttgttcacggtggcatataaaaagccataaaaattgcccgggccgccgttttttgtgtcgagaaaaattcgtcgcttccaaaagagtccgcgcgggtcaatttggcccaagttaaatgtgtaacgctttgcaaaattgggctcatacaaaacgaaaccgacagatcggaccattgatcgaatgtcgtccatttgaagttggtaatactggtcttgaattgtgaaagttttgacatatccaccgattagctaaggcattttgattaagaaatgctatttttggaaaacgccccgggaagaatatcgtcaaaaaatttaggtgcatgtgattgaattcaattcttccgggagtctaaaccgagccttgcccagacatttgcgccccagacatttgagccccggacatgcgcctcggacatttgcgcctatgtccaaaatcggatttaaatataaattctcaagagctgatacctgatcatgtattatatcttatagtcgaataaatgataatgatttaattcttctctcggggcgagctccgaccggaaacggatgttcttatgtcaaattacccaaaatgccaaatccaccttcaaacggctgatcgtccgatgggtcctcgtcaaatccacccgactggtactcattgtccaatggtttcacaaaaatgcaaaaaacaaatttgaattcgtcaaattcacgaacatttgttggcattggaatgtccaatttgtccccaatttgcacattttgttgaacatctttgctcatcaaattcatgttcaggtaaattgcactcaaattaaccgtaattttccgttgcgtgtcgtccgttgaatgattctgttcatattttatgcaaattttgagcaactcttcagaattgcatctgttgacaacaaaatatattaatagaaaaaaaataaatgaataagtgaaagaataattaaattccatttttctaaaattgaatttgttattataatataatactttttcatttgtaatgaacaattattatccatttaataaatttaaacatttgtgattattaatattataagtccttagttgtttgctatttattaaaaacatcctctgacgtatataatgtttttttcattagcgaattatgtatctttattgattcttgcatttatttattattttcagggatacaatttacgcacagtctatcatttttaaaaataaacaaaaataaaattaacataaaattttttgaattttcttactctcagaaaattatttacccatttggtatattttttaaatttgaaaaaatacattcaaattaaaaatgacctcaatgaacctaaaatcttcaacaaaaaaaaatcgagttcctatgaaaggaagttttcttaagagctttcataatttttactttatataaaattttaaattaaaggtttttggcagtggtttttgtttgtttttttattgtgtaaagtggtttcaggcaatttattttttttaatttgtctataa

SEQ ID NO: 18005 - DNA, 1756 bp, Heterodera glycines
aaataaggaaaatttttaaactaaaatttttatcaacaaaaaaattaaatttgggcgatcaatttttgtgaaattttttcaattcttataggtatatattttttggggtcatttcttaggggtgatttttttatcgcatttttgttaaggtttttttggaaaaaaacaaaacaaaattttttgatttaatttttatctgctttgcaacctcaaaatttaatttaaaaaatttttatttgcctattttttgcaattttttatgcctaaattcccattcttattgattacctctaatttatgcgctttgtccgattgacaacggaacgggccaactccgtcgagcaaaatttctgataatataacttttttgagtgttgatcaatccaacaatcttggcatcatttgaaagctgttcacaggctctgttagcttactatataaggaatatataacaggaaaaaaaagttaaaaataaaaaaaatacaaaattcagattttttggaggttttctttttttgtgagctgcttaattgcttagtactatagctgcttacaaatatcttttcaaacattaaaagctttcaaaatggtaccaaataggttttaacaataaagaaaaactctgttagctttttaaactaggctgattgtgagacgaatggaattggccattaccgtggccacaatgggtcaactccattgtatagactaatgcctaatacctacactatttcgtcgtttctctttttctttgtattttctctcactttggcgtactatctcttcatattttaatagaaaaacagtcatgtacttcgctacgtttaacttttttcctacacgttaaatcccaccaaattttgcatatccgatagagaaaaaaattctgaatcgattggtctatgaaattttagaattttctatccaattttaaagttatggggtgatgaaaattttgcatttctttttctctcattttggcatgctattttcatgtctctaacgcatgaaaaaaacacggaattcgcaaattctaacaattttaattttagggttacaaaattcggcctctgatctctctaatcattaaaattcagcgaacgaattacgcaatgtgcctaattacacgattaattaatagactaatgactagggctggcaaaaatatgcacataaaatcgcaaaatatgcgcataaaatatgcaccaaaaatcgtgaaatatgcacataaaaagtgaaaaatatgcacataaaattttccaattgagggttaatttctcaaaatttcttcaaatttgttaaacataaagtaaaatcttcaaaaatggctaaatgtggtattaaaaatcattttattgtcacttttttttgcactttttcgacactttttagttagtaattatttcgggatttttcgtcactaaaagtcgcggccctacttataaccctactaatgacactgataaaaaatggttgtgataagatgaatgaggaattaatcatcatttgctgctgctgctgttgctataaatatttttggtctctgttggtcacaaaacgacgataattaacccaattgaacgggctaattacctaattgatttttgcgctgacccacaaaatgtccaagtctcgaatttgagttttttattattcagatgggcctaaggttaggcaaggggtaatataaagggtatattcgtattcagcgaccccgaagaccctaaaaatcctaaattagactcatttgttttta

SEQ ID NO: 18006 - DNA, 1050 bp, Heterodera glycines
  misc_feature (1021)..(1021): n is a, c, g, or t
  misc_feature (1028)..(1028): n is a, c, g, or t
caaaaaggagagagagagagagcgcggaacataacataaaaatggagcaaatgggggcggaaaataggcgaacagagcgagtgacagaaagtggggggggggggggggacaactcccagcaggaaatgaatgcagtgatcgacgaactaactgatcgttgatcgctttcgtcgtttcactgttatttgtatgtgattggacggtatgaaatcagtttgttgtttgttgtgccttggcctctattacaacaagacacgaggatgaacgctatataacttttttaaattatcaaatccgaacaatttagtatcattcgaaaactcttgatccatgtttataattaactcttcgaggcgaatcgattggcaaatctttagtgccattttttctggagagttgtctatagtatatccatacaggggattgggcaatggtaaagaacattggtcccgaaaaaaaaatttatttttttaatttgagaaaattattttaggggtaatccgaggtgctgagcacgaatctaacattgttttggctttatttcgaacccggattcgatcatttttcgaaaatataaatttttcattttttacaagtttccagggcgttgattttatttgcagaccaatatgcatgagtaaacataagggttcggacgtggatttcataacacttatattattgtacacatcaaatcaatgccttaacacatttacaaaaaaaatatatggaaatttaaattttcaaaaaatgttcgaatccgagttcagggtttgaaatagagccaaaagaattttagatccatgctcagcatcatggattacccctaaaaattattttcttaattaaaaaaaaaattattttttttgggaccaatgttctttaccattgccggggattgggttttaaaatttgagggcatgtgattttgcagcaggacaaatccccaaaaattttttaaattccaagaaataaacaaaaattttgcatacgaggataactctgtaaatgataaccccanaaaaacngagtggatgagaatatgcaaat

SEQ ID NO: 18007 - DNA, 2058 bp, Heterodera glycines
aaatgggtcaaataaaaaattgaatatgcctatcccctccattaaagtcttggctttctagtgatgtataaattgtcagggtccgggtccgggaagtgccctaaaaagggagttcaagcacttttgatcaggattttttcaaaaaaagaaagaaagggaaaaggttattaaaagggatgtgagcaagtaacttggtggtcaagtggttagtgtgcctgcctttggtcatggggtgttgtgggttcgagtcccattaatttattggattttcccgtcaaatattatatttaaattatttggttttaaatttgtttttaatatttttcctataaaaaattttatgggtttataaaagagaaagacataataacaaaaatttggagcaaagtacttttggataaaaattgattactttcctttctttcctttttttatatgtaatgcacgctcgccagtggtctttgacctcgccttttcaataagcaaaaaatgtctcctccttttctttccccagttcattatcaattgtttccatttacatcatcggttttttactgctcctacttttattcaataaatatttccaactaaattattgctgttttaatagcataaatttttagtttttcctttggtggtggtgggcgacggctcgggtcccacctattctgggtgttttcatccattattttattacattttttgaatgattttatttttttaaaattaattaagtttattaaaataatttattttaaatattaaaaataataattctttcttcctaatttagcccaaaaatctattgtttgaccttttttgtgcaaaatcatttaaaaaatggagacaaattaataagttacctaaacataaaattataaatattttatgccaaaaaagaaggaaagtgaaaaggaaattaaaaggaggcaagcgatccggtggtcaagtagttagtgtgccttcctttggtgctggcttcccatgggttagagtcccatttcttctgattattttaaagcaaatattatattgaaattattctaatttttgttttttttaatttattttttttattaattaactttatggtattttaaattaatgataatgattttttgaattaataaaataataaatatttttaattaatagaataataaagtctaaattaaatattaaaattaatcgaataaaaattaaaaataaacaaatattaataaaaatttaaataatttataaatctcaaaatgagttaattttaggattagacgaatccgggtatttgggcaaaactgggtccggatatttccgggtccagcaaagccgggtccgggtccaagtttttaaaccgggtacgggaggaacagaaagtggaagaggaacagaaagtggaagagaaagtggaagaggaacaaaagtggaagaggaaaagaaagtggaagaggaacaaaagtggaagaggaaaagaaagtagaagaggacagaacgtggaagagaaacagaacgtggaagagaaagtggaagaggaacagaaagtggaagagaagaagaggaacagaaagtggaagagaaacagaaagtggaagagaaacagaaagtggaagaggaacagaaagcggaagagaagaagaggaacagaaagtggaagagaaacagaaagtggaagagaaacagaaagtggaagagaaagtggaagaggaacagaaagtggaagagaaagtggaagaggaacagaacgtggaagagaaacagaaagtggaagagaaacagaaagtggaagagaaagtggaagaggaacgaaagtggaagaggaaaagaaagtggaagaggacagaacgtggaagaggaacagaaagcggaagagaagaagaggaacagaaagtggaagagaaacagaaagtggaagagaaacagaaagtggaagagaaagtggaagaggaacagaaagtggaagagaaagtggaagaggaacagaacgtggaaaagaaacagaaagtggaagagaaacagaaagtggaagagaaagtggaagaggaacagaaagcggaagagaaa

SEQ ID NO: 18008 - DNA, 1951 bp, Heterodera glycines
accctatacttcgttggcacagtaagtgaacagggagcctacacaggacgagacggaggccaacaacagtgccaagtacaacagaaacacacgggagacgaagcgccacagggcgggcctcagccaagcggtcaacagagcgcacacagcacaaatggtgaagcaaactgtccaaaacatatgcgcttttcagggagaaaaatggggaaatgaaataaaaattttttttaaatgcaaaaaaatggaaatttttttccaattttgggccaaatttggtggcacaaaaagccaatatttatgcaaaatcgcggttcaacagagaggaataaattatttgcgtttttttttgttagggcattttcaacagtgcttcgtagtcaaccccgtcgccgtccgcattcagtggcggcggcgcgtcggccggcgccagcccaatccccgacattgccatccgggccaggtcgtacttgtccggcatgtaactggtgacactgcttaagcaacggaaagaatgagttgacattgacaaaattcaattatgaatcgcaggcccgtagccagaaaaaatttcagaggtggaggggggggggaggaatctgtgcatctcttaatgtcttacgtctgtctgctcattggcttaagataatgacttagaaataattttataattattttacagcgactaagatgcattttcattataaacttttggttttttttttttggaattttctgacatttttcattttcaagctaaatttgaattccaagaaaaatgccaaaaaataaacgggttccatcggcgaaaaggaattgaaatccgacagaaattttcctcaaaattgttgagaagataagggaattttcaattaaaacatcaagaaaaattgaacatacttttaaaatgttaatttttagtgtgcatttcagaaaattgtttttaaatttttaatttattaattttattaatcaaaaaacgcttccttttttcattaaaaaattgcttaaacagaaatattcatttttaaatttagacattcaagaaatttgtaattatgggagagatggcacggtggaaaaagtcagcatatggacggcatttatacaaaaaattaagccgaagccaatgccatacgaccaaatacatcttgaaaaagtcatcggccgtttattttcaatttacatccaggatgtacaaaatccgatgcttgtaaaacatcccaacaggatgaagcagttactggtgaaggacccgtgtgatgaagccaaactaaaagtgaagcaaattgaaggggtaggggaagacgacgaaaatgatcagtgatcaaagaccaacaatcagtgatcaacgtcgaacaatttttattttgaaattgcaaatttttatgcaaaattcaccacaatcattatttttttactccgtttcttcatatttgttgcgtagcgtaaattgattgcctaattgaaaattaattgtcattcatcacaggcatttttgacaacttttttccccaaaattaagacctaaattttaaaacaatgcttaaaattttttaaaaactaaaaagcatgataaagaatttaaggcttcaagatccaacttttcatgcttaattattgctgaaattgggattttctacttaatgattagtagggttgctactgctgctaaaaatggataaatatagaaataaagctgcattaaaaagagacaaaataaatgtacgaaattttttaaaattataaaatatgtaaaaaagtgaataagtttttataaatgtgattttcatgaaaatgttcttctttaaaaagcagaaaaagcacaaaaagacctaattagcataatttaattgttttaaattgatctcttttattttggtaaagtttataggaacggtgactgtgaatttatggaaaaaaactctgcatttttaaatttattttataaaaa

SEQ ID NO: 18009 - DNA, 1026 bp, Heterodera glycines
  misc_feature (6)..(6): n is a, c, g, or t
ttaccnaggaaaaacacagttgccaatatgaagtaaattagtgcacaataatacacttttctaccgccaattaaatagagcaaaaggcacaaaaccatcctaaaaattgggggaaaataaatttattttaaaaatgccaaaaaatcagacccggtgaatttgtaggaactgtaggacaatgcgtgccaaatgttcaaactctgcgaaatgttcaacgcgtatttcatcacgaacacaatgccattctccaggaacaaatagaacaacgcatttgtggtcagcatgccaagcttttcggggctgaacctgcaaaaaaaaagagaaaattttttttgaaaaaaaaacttttggttgtggtaattggttagatatgctttataaatttagggaatctaaaataatttactatatgtcgccatgaaatgaaacatgtttgaagatgaaaatatatcgtttttttaaattttatcaatttttgtttaagtttaaaaaaaaaatttttcccatgtctatcgatataacgcctgggtgcactacgtttgtccccctttatcgtttcatgtccgaattttttttttttttttgaaaaaaccgtaattttcttttaattttttataatgaaaaatttgcgcaatcgcttgagcaccgatttcaatgaaaatcgcaacatttgatttaaaaatgttcaatgtacagatctttgtggcaaaaagtgatgggtgtatccccgcgatttcgccaattgaccagaaattttttttttattttcaaaattaacaaatttaaacgaaaccgaattgcaaaaaaaaatatatatatatacatacctatatatatataccttttctgaactccgaagacaaaaccagacaccagcacataggtgatgaacgccatcaacggaatgtacaggtcgggcgcattcacatcctgacagggcaacacgggcgcatcgccctcacatttgttggcccaatcctatgaaaaataatggttttagaaaaaaaaaaaaaaaaaattaaaaac

SEQ ID NO: 18010 - DNA, 2697 bp, Heterodera glycines
ctttcggtatgtccttaacatgcataacttctaaaagcagcttaatactagtcattttattttttgtttacaacgtttccacgaattttttgcataaaaatttactttgtgatggttcaaagtaaaaaattttctacctaaataagcttttttcattctttttaagctaaatgaatttacagtttttagttttacaaaatgttcaactttttgggtgaagcatttgcttcataaaatgagacgcaaaaatttggatttttttattttaattcccaaatgaccatcggaaaattattattttttgatggtctgatcagcgtgaagagtaattgatcgaaacgcttggtttcattaccattgatgggtcgcggaaagtttagtcgacccaaatgaattctttttttttgtcccggtttttaaaatgtttttcctaatttggttttgaatgtttggacaatttcgcttttttgagtttaacttttgaaaatttttgggtttcatcatttttcgggttgctctgatcaatgttttcgtccagcacttaatccgcagcaaaataacgaagacggcgccgatacaaagtggaaacttgcgcgatgaagcgagtccactgtatgattttttctgaaaaaaaactgaaaaaaatttttttctaacttttaacaaagataatttatgaaaagaaataataaaattgtgtacatattatgcttttgaactttgtatgagttgcaactgaccaaaattgggcatttgatccttttgcatcctttgtttatagggctttttccttttatcctaatccttttttaattggcaaaattcgcaattttaaatagtcactttcatagtcaataaagaattcgcgggacggacgcactcattaagaagaaaagatggattaattaatgtaattctctggggacaaaatcccaaatgggagtagtataaggcccaatatccggccccaaaatttggccccatcccctccacccttccacatcctttcttctgtttttcaatattccatttcccatcctttctttgcatagttgcaaacggcgtcagttgctgctgccccctaatttcacaaaacattccgcgcagtaattgacagccctccctcaccatctcccttcgttcgcccgcttcgctcttcttgtcccccttggtcgtactcctaccaatccaattgcgcacaaatcgatccgcaaattcctttacaacttcaataaattgcggagataattctccgtttacattttacgttttatgattatgttttatataattttatttttagcaataccttctaaaattctttttaaaattcccaactgtcttcaacatgtttggatgtattaatggaggaaagagacgcggaaagggaggcgtgaaaggcttttgtaaagtgagcaaaaatagaataattgcaaaaaaactttatgtacttaatttacggcttctattccaaaccacgttcatttaaaacaatttaagagaaaattttatgaactttaaattttgtttcgagggccactaatgcatttgtgataaagttttaattgtttaaatgtgtaaatttttgttgtttttccaaatagtgcatatataattattacctattcatattttagacagggcgtcataacatccaaggcatcaccaagccggtcatccgccgattggcgcgttgtggaggggcaaaacgcattcccggcatgaactacgatgaaattcatacggtaccaaaaaatgggcaggaatacttttttcttttgttcaacaaaaatgactatttttgacaatatttgttattcttttcgacacactttccatttttcgtaattttttcaaaaattatccatattcagtcaattttcaggtttcgttatatttcacaattattaaaaacgattagttattttctaaaattaaagcaatgattaactaaacgcattaaattttttcaggcagactatgacaacatccaaggtatcaccaacatgaccatcaaaaattttgctcgtcttgatggagccaacgacatcttcaacatgatcgatgagcaaatttggccaaacgattccaattttggaacggtgaatatttcttggttttcagaatcaaaaaactgaatgattataattaattaacaaaaaatatattaatgtggcaaattttaacaaatccatgtagacacaacaggtcaaatctcaaaatggtaataaaaataaatcaatttaaagatatttggtatagggatggccgaaggtgctaccggtttttggagattaatccaatttttagtgatatcaaaaaatctaggaatttcgttagaggtgagcggatcagacccgtgaaaaagtcagcgttgcaaataagaaattcaatgaaattttatacaaaattttctcatagtaattctactgccttttttacatattttcattaaaaaataatgatcgaccaatcccgatttgtgaggaaaatttgtcgaatcgtaggaagagacggtagaaagaacggctaaaatttgcttttttaattccaaaaatttcatgctcgtccataaattctttatttttcttaaaatatggattgggtttaacaataaattagcatttttttttggagaaaatcggttaacaaattacaatcgaattttcaaaaaatattgacattcattctcagtcg

SEQ ID NO: 18011 - DNA, 2159 bp, Heterodera glycines
ataaatgtaggtaatacaaaaatagatttaaaaataattttggtaccccaaattttgactcctctcgaagaaagcgttttggcattcgtttctgcgcgaataaaccaaagcagctaaaaaatgaaaactttattaatttcttaagtgtgtgttgttgtacctcctcaacaatgcccttccagaacacttttttggtggtgagcaatggaatggtcccttaaccccgccattttttaaacaatttcatttttttcgattgacctccccggaggctatagcgcgtttgcatgccaaaaatggaaattgttcctgtgccggttctgtcagtgcgcaccgttccgcgactcaaaatctcacccacttgccgcaaataattcatttcatccgaattcacttctttgctttctgtttccccattaatatttccagtcaaaattttgccctcgctacccattgtagtgcaaaattgctgaaaagccaaaaatctatgtacgacgattgcaattttagaatgttttttaacaaaaaatttaaaatcaaaatacccaaaataccgcgtattttggctttgcgtttaaatcaaatgccgaaattcaaatttgataaagccgatcgcgatctgcaccaaattggggatttatggcacggttcgcgcgaacgaatattaactccaatttggcgccaaaaactaatgccgagaattcaaaattcaaagcctatggcataaaattggacttttaaagccaaagtattatcattttcacgacaattatcggccgccctattggggcacttggcggcgtcggagtgcccaaatcaccggccgtcgaccgtttggccgagaaaaggtggcccacaatttgtgaaatgtttctgcattttattttgacagactttgggaggagccggaagatgcggacgaattcaaatcggacgaagagattgaggtgccgaaatggacggatgggaggcgcgagaactaacattggccagctcgggcaccgatcgccgtctgcacatttgggacctgagcaaaattggcgacgaacagtcgccagaggacgcggaggacggaccaccgggtgagtggaggcaaaacggactaaaatggatccttttaaagaactgttgttcatccatggcgggcacacagccaaaatcagtgacttttcctggaaccccaacgagccgtggtctggaacaaatttcaatttttgtaattttttgtgtctttttcacagatttggcagatggcggacaacatttacaacgaggaggagttggacccggcgatggtggaaagtgttgcggccgcaagcggcgccggtccgatgggccaacaacattgaacacaccagaacatattcaaacaaattctgaagctaattgatgatgatggtctctgtttcctcaacaacactaaatatttattttctgtcatccatttttatgtttttgaataaagcgccgataataatgatattataaatgactggcaattatttaaaatttttttccaaaatgagggggtgaggttaaatgaggtacactagggttgcacccccgaccccgacatttttggccatttttcggggttaaccccgacccgaaccccgacttttctaaccccgacgttcgggggtgcaaccctaaggtacactattacccaaaagtgtgtattaggtaaggcctacaaaaatgttgctagccctgttaaagtgaccgagaaattgggtgccaaagaattacaacacttttttatcaacaatgagacaacattttaggccacttaaaacacgcgaaaaaagatcatggtcggcggaggcattctattacatcggcaatattggcaaactcaggctggtgaacatgctgatctaaaccgaaaatacgcagtttaattttaaaatggaaagaaatttttattttaaacgaaaactgcggatatacactttagtcaaggccccaaaaaatggcacaaatgatataccaatcgattcgtttcgacgagctatgcacgaaaaaaataggtatccagttgcgggaatgccaaaaaaacggtttttgaaccggtttaaaactcgaaaaattgagtgaaaaggagggctcctgaccctttaaaatggtcaaattcggacaaattttgtatcattcaaaag

SEQ ID NO: 18012 - DNA, 1018 bp, Heterodera glycines
  misc_feature (1013)..(1013): n is a, c, g, or t
tttggggtaattttttagaaaaacttggaatttatggggtcggggggcgctgataggcccggtatgggttcaaaagaaaaatacgacagttaactgatttggtagcaattttatgaggttttaaaaatgaggatttttcatgccaaatgaggatttttagggctgaaatgaggattttcaaaatttaaagatcgaaaattaattttttaaaaaattttcaaacagaaatttttcaagaaaaaaaatcttagaaaagtttttctgtgaaaattctataagaaaaaaattttttttttaaatttcaggcgattttttcataatttactaagaattttcaaaaaaaatcgctgaaaaattcttgaaaaatttgtttaaaattttttttttaaatttattcccggctgtgttatgtctcggctgtgtttcggcggctgtgttttgcctgtttcgtggtattgatgggttttcggcgctttttttatgtttaaccattatttaaaatgtgacccaaaaatgcacaaattagccatattaaaatctgcaaaaatgtaaggtatttgcaagcatagagcctctagtttagaaaacttatattgtataaaattttggggggttaacacaaaagataagaataatcagtttatggttgattagtatggtgggtaactttctttaaatgtatggaattctttagtttttttgtattattgcattattaagagtttatgattcctaatgataccaataaagttagagtttattcgagcatgaacaaagttattgtataaaaagcaggtattgtcagttgattggactcataaaagtcgattggactcataaagtgcattagagccccgatttccattgcatagtttgctcaaatacttttgtacctgactgtatgtaatttctacaaaatttttccaagaaaaaaataaaaaatttattggagttctgttcttagtacgtgttgtatatacataagtatactttttgtgcttgttttgacaaanatttt

SEQ ID NO: 18013 - DNA, 1133 bp, Heterodera glycines
  misc_feature (10)..(10): n is a, c, g, or t
tatcccctcnggggttaaaagaggcacaaagataaaagaataatgatggacagacgaatgatgagtgacaagtgtccgctgcccctcgggggttggggagaggcgattagcgattagtggtgtcccgtgccccccccccccccccctcattttctggcccaaatttaagcaacgacatttgaccctcgccggggggccaaaatgtgtaaagttagaggggggggggggaggttgcctgtgtttatgttgttttatgcttttggacggattaagaagcgggcaaaatcctcgtcttaaattccaaaagctttgagcagcggatatgcccgggccaaagtttaaaaacggagacaattcttatttaaattttgggaatttagttaataaaaattttacaaattaaaactcaaaaaataaagtaaaaaaagaatatttaaaattaacaaaatttttaattattaacccgaaaattttcttaaatttaattgcatcttatagataatccagcagtgtttttgcggataaagaaattttaaacatttttctttgattgttttgcggcataatggactgttataataattaattcgaaattaaaataggtatattaaataaaaaagcatcggtgattttttttaatatattttcccacctgggactggaaattttacgatgctcattacatctggcagcgacaggagcagcacggaattgcgctaaaacaaattcaaaaataattatttaaataaaaaggtgcttttaaaaatatttattttaattttaattaaccatttttgaaccaaaaaattaaaaaaaaagatcaaagattcttaaaataaaattcattaacaatcaatttcaacactaatttggatatgattctcaaattaaaggaaatttaaaatagaatttatttagaaaaaaaatgcttttcaaaaatgtttatttttatttaattttacttattttaaattaaacaatgaaaaacatatttaattatttaggcgaaaataaatgcattaacaatcaatttcaaactttaatttggatattattaaccaaatgaaagggatccaagtaaaggttaattaaagttaaatattttatttaataaataattaaaatattcttta

SEQ ID NO: 18014 - DNA, 2148 bp, Heterodera glycines
tcaaatagaataattaggctaatgatattaatttcctcaatttcatgattaaattaaaaaatatttggactcatgaaatgatcaagggttttaataaaaagcattcattgatcgctgggaaaagcatacatatagcacaggacgaggttcagcgccacgccgtcacaaagttcggcatagcgaagctgaagactcggcacaattggccattggcttgggtcgaggattggccacggatcagcagcagatgtgccacaaacacaatccctgcaaatgtgaattttaaaatgccaaatttattatttgtatagaaaagcgcccaatttttgaggcagtttttttttttgcaaaaaagcaataaaaaactctcaaaaataaccaattcttcgccatgttaaacattttaaatgaaataaaataaaataaaatgccaaattaattaatcgaatatttaaaaaatgaaaaaaaaacttacttaacccattcgcccaaggcacaactccaaaattgtccctcatccattcaattttgaaggcagaacaggcagaaagagattaattgcaattgattagttttaatgaatagtttattgagtttctgttaaaaaaataaaaaagattaaaaatttggttggaaaaacaatttatacaatttaaatataaaattgtcaaattaagaataaaattttaaaaatatgactattttttgttttaataataaacaatgagaaaaaataattgaattcaaacatttgtccagtaaaatattccaacaaaatttcggtcaggaatttaagtagttaattaaattaatgatggcaaccattggtaattaaacgatgcctaattaccggctaattagtgaatgttgctgttctatatatttttttttgaatgtgcatttgtgcattggaccgtcaacacatattcacacatattgttgtctgtttgtttgcacatccatcggcgggcgaggcgagaaatttggggctcaaatttggatgaaacattttcccgtccgcgcggctaatggatcaaagcggaaaagggacatggggggatgggacaagtcagtctcgtccgataaaaaagtatgggacaactcagtcccgtacaacaaaaagttactttttgctggattcgtaagtagagaaattgtaagtcgtggcacatacatgtaggagtttaatccatattaagtttgggattgcaaagcagtacccgcaaatcccgaaatttggagatttgtaagttggggacccggcattgagggatttgggacaaaacgacatttgtggatccgactctgacttttagcgactcgttccactttcaaaaattctattagaaagttttttaaaaaaatttaaagtatttcaggtcctgtgctattcttgtctgataaaaaagtccttggattaggcaacagcaaaatgtcttaaattttccataaaatgtcccgattttaaaaatagccaataacaagcgaaaaattttctaattaacgtcatcaaatttatatagttaatcattttaaaatatattcaatattaataattctgccaaattgagttgaaaaattcgtaacatttttgctattattataatataatccaaaatataaatcattttttaattgcattgaaaatattattttagatcctttcagactgtcattacagaaaatgaaagtattcttaatgatttctttatttgtgtttttgatcatcattttaattaatattaattatgttggatcagaaaagaaaaaaatggaacaaaaaacatttgacgaaatatttggagaaaaatgggaagaaaaaagaaacgaaggacagaaaaaaagagaaataattggaaaatttaataaaataaaagagaaaattaagcaaaaaggaagaaaatattcagcaaaagaacggagtaaaattgaaggaaaaatagcaaaaaaattgggcacaaatcgcaaaaatattcaaaaatggatcaaagaattaaaattaaataaattcaaatcaataaatgaccaacgaaaatttgaaattgttcaaaaattcattgaaatgtcaaatgaatacaaacaaaaaggaacatattcgaaaaaagaatagaacaaaaattatgccgaaattagtaagaaaattggagt

SEQ ID NO: 18015 - DNA, 2147 bp, Heterodera glycines
tttgccgcagccgttgccgctaccaccacgaccaccaccaccaccgaacggcatcatccaaaaagcatccgtaagcacaaaaagcaacgggtgcacaaacagaagggattttaccattcgtcgtgggccaaattttaaaaatattttaaacgtttcgaattcgtttagccatttatatcgggctttcgctccggtggaaacgacgtaaattaacgcatttatctccaactcgaacatcggctctatttcgccaacggttcaaaaaaattatttaatttatttacacagatttactccgttgaaatttgtggttacaattttttcaaaagaaaggtcatatggtttaagtttaagttcatctttgttattgtgaattttgttccatttgatcaaacttatgctaattgtcagttgattaggtgtgacattctcaaactttcattaaccaattcataatttaaactagagtgaagcgggaccgggaattttgagcaaaaccgggaccgggacttgccgggacctgagaagccgggaccgggacctcgatttttcttcgggaccgggaaccgggaccaaccgggaaattttaaaaattcaaaaaaattttaaaaattaaaaaaaaattaattttaatttatttcaattgaaaataatacaaaattaaatttttattttggttttttatttgataaaatccaaaagttaaagctaaattaaattaatgaaaattttcaaacaaattttcttcaatcatttcaaacaattaatcattttgggctaaatgactattagaaattcagatttgcttctcaatcacttttttcggcgcgcttccaaaagacttttggggaagaaggaggtccggcggtgccgataggcgccgccggggaaaattttgaaaatttgagtgtgattttttgaagaatatattaatattttttttaaattttttcctttaactccaattttcatctctttatttattttttttattgagttttacataacaagttttttgttgacaagcaaaaaaaaaaccgagactagtcccggtcccggtcaaaaccgggaccttggtactcaattgtactcagttgtccgctaccagatcccggtcccgtggcactctacttttatgtatgtattcaatttagctcatattctaatatagttttggaattaccatacccgggtccgtggtgcaccgataaacgccatcgaaaaagttttcaaaaaccgaatatgattttgcccatttttctagattgttatgaaaataatgtaaattctctccaagttttgagcttttgtactcatctaacgggtgcacatttctcgtaatttcacttcacttctccattcccaactgattttgctgacattttacgctatcctctgctgaaaaaatcgcgaaatatgcactaaaataagcaaataaaattttttattaacgcttttttggtaacaaaacaacgtaaaaagttaactaaaacacttaatttggattatatcttaattgtaaataaaattaaataatattttaaaaaattttttgaatacaaatttttaccaagaaaaaaaaaattttcgggaatcaatttttgaaaaatttttttcaattcataggggtgtaattttctaaaattttttcaggcgattattatgggtgtacaattttctatacgatcgaaaaactattaaacatgctaaaacataaaatatttttttaaatttatattttattaattaatcataaatcatcggatgatgccaccggaagtgataaattgcgcgaaaatatatttattgattatgtcgactgccaacactaattagatattgtatttccttttaatttgtttttgttaccctcagcaatcatagagaagtaaaaatttatttatttctttaatcaaataaacactacacacaatatgaatagggaacaaaataatacttttcaaacaaaaattgtaatcgcatttattaggcaatttgtgagcaaaaattttctaggaaataaatgtacaaagtttgtatagaaattttggcaattttaaatttacccagaaatttttgggattttttcataacacaaaaaatcaagggaaattgttctctttgaaaaaatccagtttttacgtgag

SEQ ID NO: 18016 - DNA, 1682 bp, Heterodera glycines
ttttgctgacatttagggctatcctctgctgaaaaaatcgcgaaataggcactaaaataagcaaataaaatgttttattaacgcttttttggtaacaaaacaacgtaaaaacttaactaaaacacttaatttggattatatcttaattgtaaataaaattaaataatattttaaaaaatttttcgaatacgtacaaatttttataccaaaaatttttaccaagaaaaaaaatattttcgggaatcaatttttgaaaaatttttttcaattcataggagtgtaattttctaaaattttttcaggtcgattcttatgggtgtacaattttctatacgatcgaaaaactattaaacatgctaaaacataaaatatttttttaatttatattttattaattaatcataaatcatcggatgatgccaccggaagtgataaattgcgcgaaaatatatttattgattatgtcgactgccaacactaattagatattgtatttccttttaatttgtttttgttaccctcagcaatcatagagaagtaaaaatttatttatttctttaatcaaataaacactacacacaatatgaatagggaacaaaataatacttttcaaacaaaaatatgtaatcgcatttattaggcaatttgtgagcaaaaattttctaggaaataaatgtacaaagtttgtatagaaaattttggcaattttaaatttacccagaaatttttgggattttttcatgacacaaaaaatcaagggaaattgttctcttggaaaaaatccaggttttacgtgagccccggtcccggtggatgaaatcccagcccgtcttttttggtcctggtaagtccgtcccgcttttcccaaaagtcctggccccaatattttttatgaatttgcctcctttttttgttagcatttttttttgttaccatttattttaaataattaaaatacattatgtttagatattaacattcagagagtaaaaaaatgcattttcaaattgtctcatttttggttttttgcattttccataattttccatcgttcgcgcggtattgtgggggaaaagcaatcagttcgtttaaaaagaagctgaagtatgaaccggatcaagaaggagcgccgcttgaagttaaaagggagagccgaaacagttttgtgggaggaaacggaaaagtgaaagcgaaaataaacaacaaaaaaaaagagaaataattaaaaataattaattactaattgcatgtccacaggtgtatattggctatgtgaagaaaagcccaacttacgaaggatgcgtagcgataaaaatattcaacccaaatttttacgctatttatgagaattcgaaagattttatgcaaaagattcaaagcattcttccgcctgacgagcgaaagcatttaatcacaatggttgacgcgtaagaaatttatttaaaacaattttaatattattatttaaaattatttttggatttttatattaaaaattcaatagcggaaaattaaagaaacagaataaaggattagtcataatggaattaggctcaaaaagccttgaaaaacggatatatgaacaaagaaacatttatggaaatgactcgaatttatttgatgatttgaagaaaattgttgagccaatttcggaactgcacaaaggcaatttttgttatttt

SEQ ID NO: 18017 - DNA, 1477 bp, Heterodera glycines
gcaatgctttatgcataatttctgtatctgctcatgctttatagcatatatacaattagcatcatcagcatataattttattttcactcctgatggcaaagcatcaggaagatcgttaatataaatcaaaaatagtaaagggcccaggacagagccctgggggacaccagagccaacttttttatttgaggataaagcatccccaattttaacacgaaaagtcctattactcaaaaagctttttatccacattaaaagtttgccccgtataccaattttttccaatttgtataaaagtaagttatggggcactgagtcaaaagctttctgaaaatcaatataaatacagtccgcattttttccattaataattgcatcataccaatcttccacaactgttattaattgacttgttgtagacctatttctaacaaaaccaaattggtattccgaaattttattgttttttaggagaaagttgtaaatattttggctaagaattctttccataaccctgcaaagtgagcaggttagagaaataggcctataattttcaggattaaatttgtccccttttttgaaaagaggaaaaacaattgattccttccagatatctggaagagaaccagagtctaatgaaatcctgaaaaggtcagtaataacagttgctaatgaaggatggcaatttttcaatgttttatagctaatattatccggagaagttccatttttattcggaagttttcttaaaagtttttgggtctcaatgatgttaaattctatatctgatataaagctttgattaacaaaagtgttgtccaagcttagaaagcctggatcaacttcagaattgttaaacgaatttacaaataaattggcaaataattcacatttttcttggtcattatgatagcatttgttttcagaaaccaaattcgatatttcaaagggattaacatcatatttttgtatatatttaaaaattgaattttttccctttgaaatagccttttgttcaagttgagaatgaaatttttttgtttgtatttttatgtgtaaactaatgctatcataaagtgccctttttgttgggtcgattttacacagcttatatagtttggccttttctttaatggatgccaataaatgcgttggatatttaggggctaactcttttttggtaagtctttttatcggaatacactcgtttaaggtttctagcagtgttttattaaaggcgttatatttttcatttacactgaaatgaccctgagataaggtgctaattctagatgaaataaccgtatttaaaagagacacattcgacggggtgaaccgtcgaatattaataaatttgggtttttgagtagtttttggaatagacatagtgaaaaattgcgccaaatgatctgatgaaaaaaccccgccttcaatattacaatgctttacaatttgatcatttgccgatagaactaaa

SEQ ID NO: 18018 - DNA, 1272 bp, Heterodera glycines
ggctttttctatcaaaaagggagatgaataaaatttttaacaatttttaattcctttttaaacaggccaaaaagtttaggcttaactctttttttcagaaaaccgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccacttcgtagaaaggcgttagcgttcgattgctctagtcaatttttcaaaa

SEQ ID NO: 18019 - DNA, 1988 bp, Heterodera glycines
caatatcaaaaaaaattttctcttaaaagagaaaagttcgcaaaaaatggtgaaaatatttattcaaaatgccaaaatgactacgaaaacccaaattttcatatttttgggggtgtaattttttaaaattttcaaaaggccgaacttagaggtgtattttttgctttttttgaatttttctgtgaaaatttgccaaggatggccgaaatatagactaaaaagtcaaaaatggcgaaatatggatttattcccgaaaacccccaaaatttggtttaatggactaaaaactttcaccaaatcaaaaaatttaacgcagaaatgctatttttgagcccctttcttcatagcatatgcgcagaaaaaatatgttagaccatataattagagttgcacggtactggtaccggtttttttacaattaccgattaccgtgctaatttacaaccctagttatgaatatatgtatttttttaaattaaaaaaacaaattatttgattgttaagttaaaataaatgtgcaaaaaatagtactctgctatttattttagtcaattgtgatttttcaatataaataaattttaaataataattacatgttttaaagttgtctctgattttgtctccccttctctatggaagtgccaaactaactctaattagggatggcaattaaattggaagttgattgattcattctttatttactaattattcccaaattcctccgtttctttccttggcaaatattattcttcgttaactccaatccaatctaatcactcttttgaataggccaatttctcttctctttcccattttcctctctttttctcccgccgaaaagaatgggccaattcgttttgtccatgggttttggagtttggcccaaacttttgtgataaattagtgagagtgctttcggatgagaagcggccatggggaaattgcctgaggcgccgcaatgggcggccaatgaattggcgggccaacgcgtcgcttggctcatccatccggcgccgtgtgttggttttggcccaccgggtcggccccggggatgggcgaagagaacgcaattggcggggaaggcaccgccgaactcaccagccgaactctccacgcaatacaccgccactttctgtttggtgaagtgaattattgcaccggcggacggcacaaaaaacacggagacaaaaaaaacggcggagtgccaataattccccgcggcattcctttgtccgctgcttttcgccgccgtcgttcttcggtcgcttcccccattttgccgtttcgttcgttccctctgcgcaatttctttctctccgcttcattttcgctgcaatgtcgcgcatttcgtcaatggcacgctttcgggtggcggctgcgctggaggaggaataccgcggcaatgagtcggcccagcagccgagcaccagcaattgggacgggcggcgtgaacgattgccgtcggtgtccaattttttggctgcacggcgaaggtcagtcaatctgcagagaaaagtgatcggagcgatgatcagaaattgattgatatggtttcgagaagcattggctaatcaatactaatgaatgaatgccttggatattaatgtaatttgcatgtataaaaagagagctttgattgatcattgaactttgatccattgcgctttgaaaatgaacaaaaaaatttccttttcatttggatgtaaaattttgggggaaaagaagcggaaagacgcaaaaagaggaaggagagagaaaggaagcgccttgtgaacggtggacggacggacaaattgaaattgatgaattgggcgcgggcggcacagcgccataaaaacataaaacaaaaatgggcgaaaattgggtcatccatcgcacaggtcgtccgtgcgtccgtccgacgacggatcgacggaggactgcgcgaggcgggatgaaatgaaattatgggcaataaataaaatgccaacacaccaacgacgaca

SEQ ID NO: 18020 - DNA, 1164 bp, Heterodera glycines
gagtcgacgccctaaaaaaatttcggcattccgtcccatccctacttcacatggctaagctctttttcatatcgtattcatttcccatttgcctttttgccctcttttggcacgttttgaatttttaaaatgccttccctcaaaatgcctcccccccccctctctacggcatttctttctccaatctctcccctcgcccctcaaggcgttcgatcaaaatcatcaccgccacccctcgcgcggttcggccatcgcctgctgccagcactcacactttgatgacagcatttgcggccgctttatgcgccgcaatcgctacctcgcgccccattccgccgaaacggcaaacggaacctttggtggcgcattgcacgcggacagaaacgggggcggcaaactgaacggactgagcggcgcactgagcgggtgggacatcagtgaggaaaactgctgggagcagttggaggccaactcggaactgtactcatcgctacagatggacatgccaataaaaggtgccaaaaatggacaaaagagcgaaaaatgccaaaaagacagagtggcctttttcactggttgtatctttcagtgctcaacggttcgccggggtatataaacattttggacggactgaacgcgtggcaattggtgtcggagttggcggatgcgaccggacaaccggcagccgcctccttcaaacagttcagcccggcaggggcagccattggcgtgccactgaacgatgccgaggcgcaagcgcttatggtatttatgggagagagataaatccgtaaaatcctaaatcattgctttccacccaaaaggtctccgatttgcctttggactttcggcggcactctttggcagttgctttggcacgtgcgcgaggtcaattcctttttttatgtgttgattttctatattttctacacatttatttttccgtttccttttcctgtatatttcttttccaaatttcaattcagaacaaaattggccattccaaacgccaaattcaaacaaattaaagcaaatcgtcggtacagtaccctcctctgtctttaccgtatcctgtccttatctgttctgtcctgtcattcttttttattttgcttttcgcaaagattagatatcttttgtttagccggagtttgtttgttttat

SEQ ID NO: 18021 - DNA, 2310 bp, Heterodera glycines
ttgttccgggatttttcttcgctctccattgggtttcccgatatgtgttgtggctacattgactgagcctccgaatctgttccgccttaattgtcgtttgaatccatgctctggatttgcctctttgccttcgaagccatactccctcatgacttctttgattgctagctctttgctcaatgcacttcctaaagcctttcggagggatgacgtgtcccaaaagtctggattttttgctttctcttccagaatttcacgcaggaaaggcttgtatagcttcttctcaagcattaaataaattggcggcccttcaatgtcttcttccgctgcttccaattctcttgccaggcgttccaattccatgcaaaaatgctttgtgtcttccaccgaaaagcatctcttgaggttcgacaactccgtgtgcaacctccttacatattcgcctttgtctccataggtgtcctttaacagcttcatggcaatttcgtaatttttctcttccaagcgtagacctccgatgagcaatgcggcctctcgctcaaccagcgatttcagcaaatttagcttctccgttttgcttcctggcttttggtccacagccactttaaatgcttcttcaaacatgggccattcccgtttgtctcccccaaacggcttaattcttagtgttggcaattggtacaatgcggcagtcatttcattgcctctcgcacggttattccctttgtctgcttctgcattcgacttcgacattgcttttgcatgttctctttgctccactcgcgcgtctctgtccgctttggagcgttgcagctttgctcctgcttccaccttcatctccaggtccttaagctctgttagctttgtgttggctgcttccatttttgtgttcagtttctccgttgtttgaaattgttcatacgctgtctgctcactttttctttcgtccttgtccattttttgtatgacgtcatgccatttgcttgcggttatccaaatttgctcgattttggcattcactgcctccacctctgactttattctctctgccgcgctttccaggagaattgcattttccaatgaggtcagagtttggtccggctcagcatacaattctgttgccgttttcgccttctcaagagcctttagctctattgcgatttttgtacgcaaaaatcccgacatttttgctcacttttgggttctgctacccgacttccgaacaaattgtgtggggttcggggtcacaaaatagcagtaagttggacaaacagtggacaaagtgagtttgacttcagacccaccaagagtcttacagtgtatgaagaaggacgctacgagttacgaaaaactcgtcgggtccgaccgtgtaagcgggaggcgccttgggtcacaaaaaaccctaggagcgacctgctcacaatggaggacgccttgggttacaaaaaacccgaggggtcggtcactggagaaaggaacacgcctcgggttacgaaaaacccgaggggccaactgagcaaggaaaaagacgcctcggattacaaaaaatccgaggggccaaaccctggggaaggcaagcgacacgaattacaaaaaattcgtgcggccgaactatgggaccggggaagcgcctcggattacaaaaaatccgtggggccaaaccctggggaaggcaagcgacacgaattacaaaaaattcgtgaggccgaactatgggaccagggaagcgcctcggattacaaaaaatccgtggggctgcgctaattggcaagggaagtgccacgaattacaaaaaattcgcgggactcagctctgggaccaaaggaagcgctacggattacagaaaatccgaagggcaaccttccgggttcaattcctaccgtcccctgtttttcccttttttgccctgcccaaatctcaaaatttcctcttccccccaatttactcactaatcccaaatgctcctgtgcgcaatgtctgttcggccgctttttgtccacgcacggtccgttgaagtgcccaggtcgccacttgacgcagatgggggaggggtctgcgccgatttgtccgtttttcgctgccgccaattgcccaaatttgccgcccaagaatttgcaccaaaatattccacaagtttatggctcaaacttgggtaattaaacccatacataagaaatgtgtgagaaatacaatggggggaaattgtgacaatggggaaaaaatgcgagggggaaatgcaaagggaaaaatggcacaattggggggggcacaaaagtggggtgagtcgcggggaggggggcacatcaccgg

SEQ ID NO: 18022 - DNA, 1497 bp, Heterodera glycines
gcgcggtaagccggaaaatgtatttgtccggaatctgaaaagatatttgtggcaactggcatagcgaaaatgccgacgggggggaatgtacggaaacataaaaacaatggcaaagccagagagagaaattttaaattcaaattcgaatttatttttaatttttcggtgccccccactcaccaaacagttcaaatcgcgctccaccagcggcagcacaaaagagagtgtggtggtgttttccggttttgagcaccaccgtcccctcgcgtcccattgctccgtgccggggcatcggaccaaaatcagaaaaacgtgggacggcggcggtgggtcggcgccgtccgcggcggtcgccgctgtgtccggagggtccgccagcccatcgttgtcgcggtcccacaccgggccggaccacatcagaagccgcttgtagtgctgcacatactgacggacgagcctggaaatcaacagcaatacttaagggtcgaagtgatcagcggaaagagtgaccgatcaaaaacagacaaaatgaaatgatcatttagcgatagataatcgatataaattgacgatcaaacatatatgatcaataaaattgatcactcggtgatcagaaaaagggatgatcggtcaagaatgatcattaaagtgatcatcagaataaattgatcattttataatcagacagaatagccaactaataatcggtgattatttgtgatcagcgagtgattgatcaccacaaattaaaaattataaaaacgtacgacaaaacttgttgccaaacacctaaatataacaaatgataaatgaaaagattcactttctcatttaccgttgtaaaatccaatgggcacttgaatttggccttggtgaatgtaccgggcatagtctgaacaaagtgccaattgctaatttaaacatcatcaaaacactgaccattgtccgaaaagagactgatccgcgcagttccgctcgcattatttgcggaagtgccaaagcgaacgcatttctcatggcttatagtcggagatgaactgaattgtgacggagagcttgtttaatggtcgaccattcttcgaaaataatattaatttggccattagataattgggcaaacggtggccaattgctataaaccaacgattgatcatttgttcctccagtttggtcagtcgtcctttccggttgatcatttatcccttcggtttgatcatctgtccaaaccaatttgtctccattttcatccttttgtctttgtttttccaagcttctttcctccatctgtttgaatggttgacaattgattagataaagcatcaattgtttgccatttgatttgtcgtcattttgtcccaattttgcttatttgtcgcttccgttgtcgcccctttttgtgccgttctttccattttcgtcgtttgttctgctggtggtattggcacttgctccttcctttgttgtttttctccttcacttttctcctcctcgccgtgt

SEQ ID NO: 18023 - DNA, 1213 bp, Heterodera glycines
agcaaagaattgagacggccgagagtgccattgtttgggagcaaaaaagaaagagagagtaaagagacatttggaaagcataaacacctgtaacgggcaattgcatcaaagctaaaaggggagaattgagaatagaaaaacccagcattatgagtggcacctgtgaaaagattgtacagctcgatgttctggaagggcttctccctgtgccgtttttttatggaggggccccaggcgccaaaaacggcacgcattgaactgacgcgattgtcatagcttaattggtcaattaaggatcaacaattgtgctagttagttggcaaatccgacccgtgctctcctttcattttgctggcgttcatcttctcggccgttttgaacagtttggtgcccactgccgagtcgatgaccaattcgccaatgcgtccactacgggcgtagctgaacgaaagtcggataaaaagcaacgatcatcttttgattgtgccatttcccactggtatcgccgtggcattgtttcgcgggtgtaaacgcggaaaatctgtccacccgaacattcgaaaggtgccaacactttgttgagcagtgtttcgtctgaaattcacaaatggaagtgccgaggatgacttttatgttctcactgttctcgcgcagttttatgtgcccgacgattcccgggaaaacttcgcgaatgccggggtccgccatatccacaaaacggtccaatgtcacggccatgtcatcacgcagcttttgcgccccgtggtcagacacaatgatcagattgatacagcccaaaaagcccttaaaaggaattggccaatcgaatgaatggcaaatccattggaaaagcaaaagactgacattgttgtccaattgttgcatcagataattgatcatcgcgtccacataaatcttaagggaaaaggacagaaatgaaacaaaagacccactaaagaccaatgccgaattgaccgcgtccgaatccggcccctcctgtcattaattttaattgcttttttgaattttttaaaatagcttttgcctggtgcatggccgagtccggctgctcaaaataaatggccaaaaacgcgggccgttcgttctcgtcgagacggagccatttgatcacctttggacaaaatggcaaaaaatgcttcagttggattaaaaagaggaagcgggacctggtcgactcgcttgagaagggaat

SEQ ID NO: 18024 - DNA, 2252 bp, Heterodera glycines
  misc_feature (2226)..(2226): n is a, c, g, or t
taatagtgtgaaaaatggtgtcgtttcttcgcttgccatttatgaagccgctgttgaaatctatcagccagggctcacctatcatcccatatgccctaagggcactgagtgcagagaattatcattattggttaaggaactaatcgataaccattgtgaaccacaatctcaagaaagagcaggtccttgaaccaccattcccaaagggaggtctttattgtcaccaaggttttacttgataagttttggttaactccgatatcctatgttacctctcaccagtccactggtcttggcaaagtgcgggaccagctttgcgccggatatgtaataaagaacacacaatctccagtatgagcaggttcttgaaaaagcacaaagcacatataaagcactggttacaaataaacaaagaaaacactatctccgataggagcaggttctttataaaactataaagcaaaaatacaataagcgttggttagtaatgtaataaagaacacacaatctccagtatgagcaggttctttaaaaagcacaagcacatataaagcatgggttaaaaataaacaaagaaaacactatctccggtaggagcaggttctttataagattataaagcaaaaatacaataagcgttggttagtaatgtaataaagaacacacaatctccagtatgagcaggttcttgaaaaagcacaaagcacatataaagcactggttacaaataaacaaagaaaacactatctccgataggagcaggttctttataaaactataaaacaaaaatacaataagcgttggttagtaatgtaataaagaacacacaacctccagtatgagcaggttctttaaaaatcaaaagcaaatataaagcgtttgttagtttaatgctgatagcatagctcggttatgagcaggttctttcagttgatcctacgttaactctcaccagtccactggtcttggcaaagtgcgggaccagcttcgcaccggatgttggccgttaacgataaggaattattgtaaacctttcggactacaatcgcccgataaaatgaagctctattacataggctgtatttacatgtatgacgtaacacgtaacaaaattagacgaatagaaaataaattccagtatttattggggctggaccaaaggaatatttagatgtaagctctacaaatttgaactttaataaacaaaaatgaaattaaagtctattcatatgaaattcatgtttttatgtaacatgtaaaaacgatagatggaatttgtgtttaatgtaacatgtatcatagacttgaaagaacaaaaaaggaaaaaatattatttggattttaatttacatgtgacagacatgtaacatgtaacaattgtaggattgaatgaacaaaaaatgaaagtttccagtatatttatagtggtggaccaaaggaagttatgtttacatgtaacatgtaacaaataattaattttgactttaatgaacaaaaatgaaattaaaatctattcatagagaatttctgttgacatgtaatatgtaacaaattagactgaatgaacaaaaaaggaaaaaatattatttggattttaatttacatgtgacatgtaacatgtaacaattgtaggattgaatgaacaaaaaatgaaagtttccagtatatttatagggaggaccaaaggaagttatatttacatgtaacatgtaacaaataattaattttgactttaatgaacaaaaatgaaattaaaatctattcatagggaatttctgttgacatctaatatgtaaacaaattagacttgaatgaacaaaggaaaaaatattatatggattataatttacatgtgacatgtaacatgtaacaattgtaggattgaatgaacaaaaaatgaaagtttccagtatatttatagtggtggacccaagggagttatgtttacatgtaacatgtaacaaataattaattttaactttaataaacaaaaatgaaaataaagtctattcatatgaaattcatgtttatatgtaacatgtaaaaacgatagaaggaatttgtgtttaatgtaacatgtatcatagacttgaaagaacaaaaaaggaaaaaatattatttggattttaatttacatgtgacagacatgtaacctgtaacaattgtaggattgaataaacaaaaaatgaaagtttccagtatatttatagaggtggacccaagganaagttatgtttacatgtaacatgtaa

SEQ ID NO: 18025 - DNA, 1703 bp, Heterodera glycines
  misc_feature (55)..(55): n is a, c, g, or t
ggaattccagaaaaatggctatctattttctgaaaattttatacagcacaatgcntctcaagcatgatagggagagcggtgcgcaatggatattatatgcaccagagaatttttggtttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatgtatctatttttctgaaaaattctatctttttctgaaaaattttataccgcacaaatgctctcaagcatgatagggagagcggtgcgcaatggatattatattgcccagagaatttttggcttctaagaggaattccagaaaaatggctatctatttttctgaaaaattttatacagcacaaatgctctcaagcatgatagggagagcggtgcgcaatggatattatattgcccagagaatttttggcttctaagaggaattccagaaaaatggctatctatttttctgaaaaattttatacttttctgaaaaattttataccgcacaaatgctctcaagcatgatagggagagcggtgcgcaatggatattatattgcccagagaatttttagtttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctttttctgaaaaattttataccgcacaaatgctctcaagcatgatagggagagcggtgcgcaatggatattatattgcccagagaatttttagcttctaagaggaattccagaaaaatggctatctatttttctgaaaaattttataccgcacaaatgctctcaagcatgatagggagagcggtgcgcaatggatattatattgcccagagaatttttggcttctgaggaattccagaaaaatggctatctatttttctgaaaattttataccgcacaaatgctctcaagcattatagggagagcggtgcgcaatatatattatatcccccagagaatttttcgtttgtataaggaattcctataaataatggatatatagttgtgaaggggacgggggctggggggaagggtggggagccccgcatgttgtggtacacgcatcgattatggaagccgcgcatgcactagcaacgaagtcctttgcgcgaagcgctcatgtaatgcatattcttttcatctctcacaagtaaactgtctacaccgtgcaatcactgtgcaaagcatacggtctacaccgagcaactactgtgcaaagcatactgtctacaccgagcaattactgcgcgacacgctagttatatactactaaagaaacaaggcaactcatttccaaaaacaaaatctccttacggggcgtcgggaggggttcgaaatttcgaccttggggacaactttttgaggcgcatctgggaaaactataggtttttcgctccgagggccaactgagcgccaacggcgctgaaacggctttttcaaaattttttttgaagttgctcggattcaaaatttttttaaaggcctaaatgaaaaatcggcctcg

SEQ ID NO: 18026 - DNA, 1457 bp, Heterodera glycines
  misc_feature (1390)..(1391): n is a, c, g, or t
cggtttttttttttaaatttttggctaggctaaaaatgtttgttttttaaattattttttattatgttttatctaggggttaagcaccgacccgacccgttaatgggattagggaatgtcgtctattgcattcctaatcggatgagagtgtcattaaatgaatttttctaaaacatttttttgtttagaaaaattactggtttttttctagacattttgtgaaatttactgtctctcttcgagggtcgaggcttaaccctagtttgaattatttttcaggcggttccccggccggcgagtgcattcgtcgcgcaccgcctgcacaaattgtgaatttcatggatgacccggacacatgcccgcatggctatttctgcgttggaatggtataaaaaaatagaaaatattattatttttttatagttaataaaataaaatattgtttaaacttatttttagaaaatatgaaaaaatatttttaaagggatttttgtttttgttgaaaatttaggtttttctaaacctatgcatggaattgtcttaaaaagtaaaaaaatctttgcctgctctaaaaaatcttaaaaattttaaaactttcacatatgaattaatttgggtggaaaatttcaaaaaaaaaattggatattcaaaaaaaaagattttcttagcacatgcatggattgttgaaaaaataaataaaataattttgtctgtcttgataaaaatcttacgcaatttaaaatattaaaaaatttaaaccttccaatgactcgaagtaatgtggaaaatttggaaaaatatgcaattttccaagcctgactcgccggtcggccactgttgtcccgcgctgtgcccactcggtactgaagtggaccactcttttgcatgtgtccccggcggcgctttgccaccggcttcaacaagcgccggaagtgatttgttgtcgccaatacaaccgacaaagtcatcttctagttcacctccatctcccatttttggtgagagttttgttaggacaaatggacatgaaaaaatggacaaatagacgacaaaattttgggggacggggggaattcggacaaattggcaatgaataaaagtttttataaaaatattttaaaaaatgccaggccgtgacccgcccggtgcgccgcaatcgtcgccgcccattcttccgccgtttgccaatttcaccagccgttttttggcacaatttttgcccaaaaaagtgtgcccatcagaaacccatttttgccatttcctctctggcgacacttttgctcaggtgagtcaaaatttttgataaaattatataatttttttttccttaggcagtctgctgtaagaggccgtgcaattcgatggcgcccgagtcgctgtatttgaacgnngaatgcgttgcacggggccagctgggctccgagtgcaaagctgagaccatgggggggggggggggg

SEQ ID NO: 18027 - DNA, 1150 bp, Heterodera glycines
tttttaatcattgttcaaaaaaatttgctgacgaattgtacactgacggattgtccattactgacggattgtccttcactgacggattgtccactaacggattgaccactgacggattgcccactgaaggattgtacggaccccgcccgtagccagggaggagggccgaattctcccatttctcaaccttataattgaattttaaaccctcaaaatggcataatttaatcatttttgggcaaatttttgatatccggcgctgaaattttaaaataatctggaaaagttttttttagtccaaatagcaaaaaaaaaaggtctttagtaacatgtaatataaatatttgggcattttttctcaaatatttatttaaatatttggggagtaaatctaaatcctcgccctacagatgaagctcgaaatttccaatcttttttcagtatcatgagcaatgtggtgcagcagaaggaatgaattgtgtgaagggtcattttttttttttttttggaattttcttttgcaaaaattacatattggaaaagaaattaattaattaatatccatggaacactaatggaattgatcaaaatgaattttatgttgaattattactaaaaatttaattttatttaattgttttatctttaaggccaatgccaatgcattgaaggcttttctcccgcatccgatgtgatcactcatccaaccaaaaatccaagccaacaatgtatcagagattgtgaaaaggtaagaatgattttctaaatttatttatttttaatgattatttattaattaactcgaattacatgaaattaacccaattttttaaaatgatatttataaatgtttgaatttatttatcaaaaaatcaaaatgattttagaatctagaaaaacctaaaaaagaaacctctttaaattttttgtatggaaataaacttgaaaaaatatggcaaaaaattaccacaatttttaagagttttataggtttttttatatttgaaaattctttgtatttttttgagaaaaaaaaaatttctgttttcattgaaaattcctaaaaaaaacttcattgtacgaacataaaaaatttctaaaggctcagcaaatataatattttttgttaaggccaccagcctaagtcggg

SEQ ID NO: 18028 - DNA, 1975 bp, Heterodera glycines
taattcccaaattcgtcattttttaatattttgtactaaaataaatgaaaatattcatgttgcacaacggactcgaaccaccaccctttgtccctttactatcttacaaaaaccactgagccacacatgcaaatcttttctggtacaggagctttatgaaaaatgtaataaaaataaataaaaatgcacgcaagaatctatttccataaaccaaaaataaggccatgatttggcggatagtcggacttttacgcctgaaaaaatctattgacttacaattttgtagctctggataaaaaatgagacaattttattgttttattgacaagtagtccaggcattttaagttttaacaactattaggtacctatttctcgattttttgcacctgaaaaatcctagacctggttatatgaatgcatgttttaaattttgatattatttgtaaattggagagattttgaattgaaatatttatacaatgtaaaatggttatatggaatggtccaattgtcgaggatgaacttgttgatcacaagaagacatttccctctcaacagcctttttcgacgcctcagcagaacggacagtttggagcatttcctcagaaagttcttcggtctaaaactcaaaattgttatttaataacggaaaagtaacaaaaaggaaaagaaaccgataaaatcatttgcatttttgccctgtcgcgcaacgacgttccatcggcaacgggtgcagtcaaatgcacttgctcctcctcagattcgggtctcggaatgtgttgaagaattcgagcagtccaacgaggcgatcgctcgaaattgtcagcacaagatcaggcagttcaccaacgagacggaacctaattatgagagaatgaaataaaacgcatagcacatagcatgtattagaaatgaaaaatttcgttgttttagagaaatagttcttttaaaaatttttcatataaaaatttcatagtgaaaaaattttctagcttttttaaagattttttgttgaaaaatttcaaaatatagtttcgagggggataaaacgacgtggggaaaacgatggggccaaatgatcacatcggaatttggacgtcgtcgatggtggctctgagcatgtcgatgcacatccccgtcggtttcaacaaatggtcatccgaccaacggttctcccgggctttcatgcaattgtcaaatgagtcgaaaagacaagtcggagattggagaggcaaagttggaaattgtcgtatgccttggccaccaatgaacgcaatctctgatcggttatctgcaaatattatcattttcttaaattgaatgatgccctaaacaattccctgacatgttcgtatgcttttgtggacggctcgtcctaagtgttcagtttcaattgaccaagttcggcgattaatgtcgtttttgttgggtcaaaggcaccgccggagcaaacgacaaaaatggcagggtcaattttgacctccaactccagcttcttgcgcacgtcaaccatgtgctgaagggctgtcgcagaacggcctaaaaagagcaataaaaaaaaattttttttaaaaataaattcaggttttcaactaactgtcatgaaaatggtcatttttatgcaaaactgctagcaaattaaccgttttttgcgataattttttaaataatactctcaattcaaaattttcccgtcctccggttcccaaaacagttggtgaagacggactgattttggcggtctgaacacgtcgattgttcaccgccggggaatggcacgtaaacaccacctaaaattacagaagcagtattgttttagtttaaaaaaatcaggagcatgtttaggaaaacacgttgttcaaagtcgccctctagcggatatgtttcaattttagtgacattctatttacaattaaaaaattcatcaaaatcgctactttaggaatttattcctggggtttgttagccataat

SEQ ID NO: 18029 - DNA, 1286 bp, Heterodera glycines
ccgattcgatgctgctcacactgacgccagtccagtgtcattgcgcaacaaatgagaggaagtgtcgggcaaatcactccgcggggtgctgatttgtttggaagcattttcaaatgcctaaaacagaaaaataaggaacaaataaacataaaggacatacttaagagttgggtaagctgttggaggaatgatttggtgatggtgatgtccaatgtatcggtggcctcaacgattatggccaagtggtctcagtgatggcggacccggtaccggtgaaagagtctgagaaaaaattgttatttgttttatttgttggtactcattaagtttgtatccgccttttgggtcaaatttttcagaagcgtagccagacagtcagacagtgcactatttccttctttatttttctcacctcttcccttttcccacacacaatgctgccagccagcacacggctgcttactgtctacccttccacccgccgcagccccacgttgacagacagtcagattgacagacagtcagacagtgcactatttccttcttttcttccgcttacaaagggaggtggccaagtgtccgtgggatctcggaatgagattttttgggtagatagagcacccctgggttcttaagaaaaatgctttcaatttctgccaaatggacccctgtgccgagataaaaaatgccaaagtttttaatgattaaataaaagaaataattatttacacccttccacagtggccggtggcgtagtgggttacgcctctgccgcaccttttttctgtcctaggttcaaatccccgttatgtaaatattttttcccatttatttttgcactttatgcaaattatttggccgaggaaaattgattcccgtccaataacattttcattcattttttcaaatgtacgttaaccccaaaaatattctttttctattttccaggtttttaaaattaatgtaaaaaataaatccatgacttataaggccaaaaatatatatgcagtggcgaacaccagtcatattatgaccaaacaactgatggttgaatgggtggacaaagttctttgtcctgctcttcgcccaaaccaaaaatcgcttttgatcgttgacagttggactgggtggaacaattttcatccaaaaaatggaattgaattggctgttaaacaaatcccaaagcatggaactggaatttgccaaacagttggatgtctatgtttttcggtatttaaagggtcaaagaagaatacaaaaaaatttagaatttggaaagaatttac

SEQ ID NO: 18030 - DNA, 1149 bp, Heterodera glycines
ctcacaaagttatggggagtgaaatggtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccatacgttcttgtagagctcgagctgctctttccaatggtcttatcccggtctcgatccgtgccgaactcacaaaagtatggagtgaaatgtgaaatattgttttcacacaaggcattttttctgaaaaccggattcaaaatctggggt

SEQ ID NO: 18031 - DNA, 1286 bp, Heterodera glycines
  misc_feature (18)..(18): n is a, c, g, or t
  misc_feature (44)..(44): n is a, c, g, or t
  misc_feature (118)..(118): n is a, c, g, or t
cgagctaatgcattgtcnccaaaaaacacaattcatagccaganaggtgcatgtgagatgtggaaacgaatccaccacaccatttgcctttcctaagaatcggaagagacacaattcncaatccaatcaactgcttttccctttatgtcaatcacccgaagtgatgtgacgagttgggcgaagatcggtatcaattcttttttcggccaacaattttgcaaagaatgcaaaagaaaccaacgaaatttgggcccctccgtccaacatagcctttgccgtcaaaccacaaaccgatacatttagggccattattctcccgatcgaaaccttattcaaatttttcgtcgtctcattttcggtcccatccttcccaaacaatttttccacctcagcaggactcatcgaaatgccaccaacaaaaagattttgactcggttgtggtggtctttcctgttgttcaacaataaaattttgtcgaacgaaatttgatgttgagctgttgttattctgagtgccttggtttcgttggggctccgaacattgcctggcaaaatgtccgaattttccgcaattataacaagttgggcggttttgttgctggtcattggcttgtggaaaattttcttggcgaaaatgctgctgcattggccgtgggctgtactgaggcacttgaaattggctgttgaaccttgagaaattgtttgacttttgcattgcgagcttcgatgccttttgagttgattcagctctcgccgctaatgcaacaaattcatcaaaaatcattgaaggacgacgggctaactcgagagttaatgctaactccgggttttggagagcccttatgaagtgccgaattgaataatcgtcgtaaagatgctcgagtaacccagggtaggcttttctgaccagcgaagaaatacggtccgccaaatcgtcgattctctcattatttcggcgatatgcaccagacatcagctcgtcaaatgccgacatttgcctagcatctgtctcctccagcagatttatcatcgctctctttacgctgtcataacggaatgggttatttgcaaccgcaacattgaacgcacgttccgcacgccccaaacattttgatcgaagtgcgcttaaacgcttcgcttcaggccattcttcggttgcgacatcaaaatgccggaaaaacgatcggacgccatctgccccgaagttcccttttagttcaggcagtgaatttaaggtcattgcgtatgaaaaattgtctaggcttttaattgcctgtgccaaaatca

SEQ ID NO: 18032 - DNA, 3350 bp, Heterodera glycines
  misc_feature (2317)..(2317): n is a, c, g, or t
cgggaaaaattttgtattttttaatgcgatttgttaacagaatttgtaaaaaaagaccaattgattaatttttgggtttttaggatgcttaaaatgaaagaaaaaaagttagaatattttttttaattaaaatttcaattaaaataatggtaaagaaaatatgaagaatattctatcccagtggggaattgaacccaagcgagaaataataaaatcagaaggtttagccacttgaccactgcatatgaacaaacgctttaaacgaaaataaataatttaattttttttttctcaaaaaatttctccttcttcaccaatttcctactcttttctcacccagacccccattcttaccagtgcaaatttttaccggcggtaccggtactagacaaaccggtaccgatactttgatttctgaaaaaccggtaccggtaccggtaccaaaaaaaccggtaattaccggtcggtaccggtaccggtaccgatactttgatttctgaaaaaaccggtaccggtaccaaaaaaaccggtaattaccggtcggtaccggtaccggtaccgagcaactctactatatatatatataccaaaattataatgatttaaaataaattaatttcaataaaaaaatatctaataaaaaaataatttattcaattttttcagcacataatgccgtcggcaaagaaggcaaattccatttgttcatccttttttcgctacggtagttcccaccatcatttttttaaataaaatcatattccgatcacttgattcatttgactgatcattatcgacaaataattaatctggactaattctttaaccgaagttttaatcatttctttttataaaaattgcttggacacataaaaatttgaaataaatattaaataaactaaataagaataacaataaaataaaattaataaatttctattaaaatactttttcaaccaatcaaaaaagggatcacattttgtccggactgctcccattgatcgcatggacacaagtgaccagccaactctatgatcaaagtgcatttttgcgtcaaccatcaaagctgtcatatttgtcaaagctgatctcaacgctcaacgaatttcgtgagcaaaaaacaattaattatttatatataattaatcactataattagtgggtcattaattaatattagccttcaaaatgtaatttacaattatttattttttaagaatttctctatgaaaaatccttgttgcaaggcattgaggatatatgaagaacaatttatggttttttgtgtgatgtgtccatatgtaaaatcagatgatgtaaatcaaaaaacgaattaaaacaccataaatatatatttatatatataaatacatttattatgtacaaaatttgttgtatttcataaaacagtatcagattttaatgaattaaatttttctttttctttttttaaattttaagactgcccagtcaatttctttcacatcaagcggatttgaacccagaacccatttttaatgcaccgctaaatgaaaaattcacaatagaagtcgatcctgctctatccaatctatatatagcttatatgcaatttcacggagcaggacaaaacgtcgtcggacgaatttttgggccataacttttttttctttctccaccaaattaaacattcatgctattattcgaaagcatttgaaaaacgctattaaactagtaaatttccaaaaaaaatgtattcatgcacaaagaaatcagggcaaaaaaagttcgaaatactgggttttcgagttccttctggccataacttgtttgaaacttaacgaaaatttttgcaattttacaaattaataataaaaaccacagagctatcgaacaacaccaacaattcttaatttgattgacagtgaacaaagttatggttcaaaaagtcttccgacgacgtttcggccggcgacgttttggggtgcaccggcaatttcatacatacatacagttgatatgttcccttgtaagcaccggaggtccggccgtcccgatatgatttacaaatcgctgaatattaattttttggctgttaaatttcaaaaaaaaattgcttagtttaaaaaggttgtgcaccgaaaaggaggctttttcgacacttttgaccttttgtatgagatttattgcacgaaagggagtgtggagttggaaaaaaagttcgaaaaactagggtgaaaagaacgtggtgatcaaatggaatttcccgggatataacctccaaaaggtacatttcgtcaaaatgtttttttataaaaaaaaaaaaaaaatcaaattnttaattttacaggcagataaagaaatttatgtagataattaactttttattaaaaataaatatttcaaatttttgccataattttattggactcaaacaaaaataattttcttaatacgaaattagaagttttataaacataaaataaaataaaattaaattgattaaactccttaaaattggttaatgtttatcgaaatgagttagcttcaaaatttcagcaagaaagcacccacactcacagaatacggtatattatgaatcgcaggactccacactcacttgaaattaaaaaatttctgtgaaatctgctatttttgattttttttttcagtattgtgaattaaggttctgttttctttgattgccattaatctacaaaaatgcaaataccgtaccatatgcctaatctttgtcatggcaaaactgtgattttttcaaaaactaatctttcaagctaaaataggtatttaatttggaaaaataaaaagcatttttttctttttttacattttatgttacatttttcaacttttttttttcttgttgcacgttttgccattagcgcgtttaaatcacttcagctatcccgaattacacaacagctgatcaccatagcaataacagaaatcaccagaaagatgccagcgcccaccgtaccaccaatgaaatgaccaatactatggtgtgcattcggttcattagcagtaatttgatgcattttgatggcacataaagcgatgccgccaacgcatgccaatgcaattattagccacaaaacaaagcaacactttgcgttacagcagcaacagtcgttgtcattgttggtactgctaccgccgatacagcaacagcaacaaaaatcgcaatcgccacaatcgtcacaatcgccacattccaagtcatcgccccgctttgtccttcggcctctgtttttggctgaacatttcttattggtgttgttgcttttgttggtaatgacatttttaatgtgtgcttaattattggacacatattttagcataaattatgg

SEQ ID NO: 18033 - DNA, 1844 bp, Heterodera glycines
aaaaaaaattcatttttttttaatggccacgcaaaggaggttaggccccgaaaaagaaagcatcaaattttcttttttttaattttcttacaattaggtgtcttagataatggaaaaaaatttttttttaagagtagcgatttttaatgcttttttctatgtaaaacattaaaaaaggttgttaagaattttctgttttacgtgtctttttcaaaaatttttttcttgaagttttcttattaagaaatttcttaggaattttttttaataaaaagtttctaggtttgaaaacatttcgggggggggggggtggcgacgcggagaggaaaggacctgctccgagaaatttagaaaaaataaataaattccctctaaaaataatcgcttaatttgcccagcattaattttgtgcagcttacttttttttaaaacgcctcaagttatcggccgctatcgcaatgatagcgatggccgccagacagccgccgaccacaatttccacatccaaagaagtggtttctttggttgtaggcgatggagttgttgctgtcgtcgttgttgttgttgattatgtgcagtcaacgtagacatttgctccaaatttgttgtaataccagcaaacagcgccgtccgtcattacacgcattgggggagcttcagcccccgagcattgcttcacccatcggcagaaaagcaaaaccactaaaaaaaattcaattttctcttaatggccacgcaaggaagttaggcacccgaaaagaatgcatcaaatttcatttttctaaatttcttacaattaggtttcttagatattggaaaaaatttttttttaagagtagcgatttttaatgctttttctatgtaaaacattaaaaaaggttgttaagaattttctgttttacgtgtctttttcaaaaaattttttcttgaagttttcttattaagaaatttcttaggaattttttttaataaaaagtttctaggtttgaaaacatttcgggggggggggggtggcgacgcggagaggaaaggacctgctccgagaaatttaaaaaaaaaaataattcccgctaaaaataatcgcttaatttgcccagcattaattttgtgcagcttacttttttttaaaacgcctcaagttatcggccgctatcgcaatgatagcgatggccgccagacagccgccgaccacaatttccacatccaaagaagtggtttctttggttgtaggcgatggagttgttgctgtcgtcgttgttgttgttgattatgtgcagtcaacgtagacatttgctccaaatttgttgtaatagcagcaaacagcaccgtccgtcattacacgcattgggggagcttcagcccccgagcattgcttcacccatcggcagaaaagcaaaaacactaaaaaaaattcaattttctcttaatggccacgcaaggaagttaggcacccgaaaagaatgcatcaaatttcatttttctaaatttcttacaattaggtttcttagatattggaaaaattttttttaagagtagcgatttttaatgctttttctatgtaaaacattaaaaaaggttgttaagaattttctgttttacgtgtctttttcaaaaaattttttcttgaagttttcttattaagaaatttcttaggaattttttttaataaaaagtttctaggtttgaaaacatttcggggggggggggggggtggcgacgcggagaggaaaggacctgctccgagaaatttaaaaaaaaaaataaattccccctaaaaataatcgcttaatttgcccagcattaattttgtgcagcttacttttttttaaaacccctcaagttat

SEQ ID NO: 18034 - DNA, 1036 bp, Heterodera glycines
caattttctagttaggcctcaaaaaatgactatctatttttcaactatttttatatgataaatctaaaatggaatatgccaaagaccatatatccacatgattggacttagctcgattttttcggctatgatgtctaaatttgactcttaattttctgttggcctcaaaaaatgactatctatttttcaactatttttatatgataaatctaaaatggaatatgccaaagaccatatatccacatgattggacttagctcgattttttcggctatgatgtctaaatttgactcttaattttctgttggcctcaaaaaatgactatctatttttcaactatttttaatacgacaaatcgaatatggaatatgccaaagcccaatatatccacatgattagacttagctcgattttttcggatacgatgtctaaatttgactctcaattttctgttggcctcaaaaaatgactatctatttttcaactatttttaatacgacaaatcgaatatggaatatgccaacgccccatatatccacatgattagacttagctcgattttttcggatacgatgtctaaatttgactctcaattttctgttagcctcaaaaaatgactatctatttttcaactattttaatatgataaatctaaaatggaatatgccaaagaccatatatccacatgattggacttagctcgattttttcggctatgatgtctaaatttctcttaattttctgttggcttcaaaaaatgactatctatttttcaactattttaatatgataaatctaaaatggaatatgccaaagaccatatattccacatgattggacttagctcgattttttcggctatgatgtcactacatagggtgcctactttaaatatcgattgattttctccgctgagcgcagagagtatgagcgggcgtgcccgtgcctattgggtggttgtgtctgcgtctctgacgtgtggtgcgcggggagggggtgggggggggtgtctggaaatgtgagttcgggatggtgg

SEQ ID NO: 18035 - DNA, 1236 bp, Heterodera glycines
  misc_feature (195)..(195): n is a, c, g, or t
ccccctttcttcgggggcctttctttccattgccgcgaccccctctcaccatagccgtggacccctctctccgtgggatcgggcccctcttttccgcggaccccctctctccgtcgccgcggaccacctctggccatcgcgcggaccccccccccccccctctcttccacggaccccgtctccatcagccccccncccccccgcctcttccccggtcgggtgcgcgagttttgctacgcatggcgggaggggggcgtggtgtcgggaaagtaatgctcaaaatggtgctagagactaaattcttagccgttcggcttagggggtgatgaattgactgcccacaaaatttggtgtcaatcggacaaggggtgcgtgagttttgctgcgcaagtctcgggggtgcgcgagggggcggggcgtcgggaaagtactgcttgaaatggtgctagagctgaaattctttcgtcgttcagcttagaggctgctggaaagatggcctgtgaaatttgaagtcaatcggacaagggttgcgggagttttgctgcgcaagtctcgggggtgcgcgagggggcggggcgtcgggaaagtactgcttgaaatggtgctagagatgaaattctttcgtcgttcagcttagagggtggtggaatgacggcccgtaaaatttgaagtcaatcggacaaggggtgcgtgagttttgctgcgcaagtctcgggggtgcgcgagggggcggggcgtcgggaaagtactgcttgaaatggtgctagagatgaaattctttcgtcgttcagcttagaggctgctggaaagatggcctgtgaaatttgaagtcaatcggacaaggggtgcgtgagttttgctgcgcaagtctcgggggtgcgcgagggggcggggcgtcgggaaagtactgcttgaaatggtgctagagatgaaattctttcgtcgttcagcttagaggctgctggattgacgacctgtgaaatttgaagtcaatcggacaaggggtgcgtgagttttgctgcgcaagtctcgggggtgcgcgagggggcggggcgtcgggaaagtactgcttgaaatggtgctagagatgaaattctttcgtcgttcagcttagaggctgctggattgacgacctgtgaaatttgaagtcaatcggacaaggggtgcgggagttttgctgcgcaagtctccaggggaggcgagggggcggggcgtcgggaaagtactgcttgaaat

SEQ ID NO: 18036 - DNA, 3735 bp, Heterodera glycines
  misc_feature (93)..(93): n is a, c, g, or t
  misc_feature (3542)..(3542): n is a, c, g, or t
gtacaaagtgtaaaaacgctgacacaatcagcagtctgtttttgactagaaaaggcttttattttttgttgggcgcggcgcgtaaattaattntaattacggaaatccgtaatccgtaattatggatggtctaaaaacgctgtaaatacgtaaatccgtaatttttttaaaatgaaaaaataccataattattatacaaagcgacggttttaaccatatgccttaaacttcctatgaataaaaatgcaataaaaaagaaaaagcattcttaagaattgactaattttttttaaatgcacacccaaaaagtggaaataatcataaataattaaatttaatattcttaatttttaaaattttttctaatatttcaaaaaagctcaaatatcttcttgcatttattttctccttttttatccataaatcctcgctctaatcatcgttaataaatttggctagggttggggtcgtccaaagtttcttcccaagtacagtttcactgctttttaagtacagagtaactgctcataaattaaattacgcacagaattgtgaaaaactgttaaatgtttattcagatgttaggtgtttctattgttcgtcagcatagatttttccaatattttttgtttccgctgatcattttctcattttgctgcatttgttgcggcgcgctttttaaaaaaaactttttaggaacggaggggggaggggcaggagaatctttggccaccatttcactctttccctacagtatcacataccgtcattctttataatagcatttcaagcgcatctttgtcaaaattcctgtaatggcatcactttttgctttttcgcttttccaaatgaataaaatatttttccaattcggaaaaaagaggggaatcactgctcactttccttttttcattctttcgttgattcattgactccacaaaaaattattgtaataataaaacgaagcgatcgaatggacaaaaattccaatggcaaatcaatgggacggcccaattcattcgattcatttcactttgacgggacaattattattcgccttaattattgtaataattcccatttttgacaatgctaaaattgggtgaacttttgtttcaattaaaatgcctttgtttcattcattctttttgattttgctctttttaaatttatttttccaatttattttcttaaaagcattgaaagtgccgcgtttcttagtaaaaaaaatattaaacgaaacgatgcaaaacgaagcgcagacaatcactgaaaaggtgggccaaacatggcgaaatggaaaaaacgggaaaatggggggggggggcggtaataacaatttaatgtaattatcattaattagtccaacaatgccaaagtgccgtttcagccgccgcccctcggcgcctccgccccttccctcggtggcagcgctttgtcctcccttttcgcctcccctctgatcactttggcccctccgatcacttcctccgcttcgtttctcctctttttgctgacgatcaccttccttctgctgatcagtgcttttggccttttgcttttcaaatggcacatgcgcaacggaaagagcgaaaacggagggagcaaagaaaaagcgtggaacggcagaacgccaatcatttcgcagcctttgcgagcggtgatttgaccgaccgcagaacaaatgatgggcaaaatgcaaactgtcggatttaaataattcatttttcctttttggtacttttcggttttgtgtacacatcccaaaatttaaaaaaaaaatgtacaaatgatgcacggagtttttgattggacaaaaggaataatttgccataaaatgacaaaaaaaccctcggttgacatatcataaacccgaaagtaccccctttttgtgtacaatttttttattttgttgcttatgattttgccatttttcacaacaaacaacattcaattggttggacttgccaaatttggggattattttaagggttaatgatcctaattagagcaatttttgtgtaaaaataatttttatttccttttctgtgtacggtataacaaagatagaaaattttgttcatacaattaaatttgacattttggcgaaatgttttaaaataattttacttcttcattttctatgaactcatagaaatttattttaaaattactcaactttaagcaattaattaatacctaattaatttttcagtaatcaatccgtccatttggcatacgtttctgcttccttcgtcttcccccggtgcttcttccgtccgtttttcttccattccgtttgttcttcctctgctgctgctgcttctgctactgcttgttgtccctccattcttcggcctttgccatggctttcgtcccccttttcccactctcttccgcttcttcttcctccaccgaattcactccgtctcccctcggctttttcctccttttttgcttcttccttttggcacttttcttcctcctcaaaaccatttgcttcttcgcccgccaacttcgccttttgcttggccctcttctgaacatttatgacctcacaaatccattggaaaagcgcaaatgaacaaaagaaacaaacggaagtgggaagagagagaaagaaacaaggttaattaagaagcgaaaaacaaaaccaaaaaataggttaattagtgaaaacgtagaaacaaaaagtggcattggtatgccaattttaccatttgaattgggcttgcctttaccggcctatgcttcttcccccgtccaaattatgcattttaattggccttaattcagttgcctttgatcgctttgctcattttttggcaatgacactccttaattagtttatggaggaatgccactttcgaacattggccaaaaagcgaaccatttaaaatgagaattaagcaaaagaaagattgcagagatgtgttttttgatggtttgtaatgcgtaaaaaatatgtaattaatttttcttttctgccattccatcgttttttttcattttgccttcaatatgccattctgtgaatttaaatgccattcttttgctgcccttctgtgatttctatgattacatttttctaactttgttcatttcgacacttaccaatgtcaaattcggcactagggctaatatttatagttttttttctgagctctccgtttgttaagctacttttcgagttattagtaactattttctagttttttattttgagtaccaattaacaaaaatgcaataaaacgaaaaatcacccctaagaatcgaccccaaaaatttatgaaaaataaacatgaaaaactctctctaaaattcatctctaataagatttttttgattttctaaattattgaataaatttagtcattttacaaccctaaatttgaggcttttaagtgcctattttggcggtttttagagctaaaacttggagctcttttattaacatccaaagggttaagtgtactctattagcctgcgatgccatccgtctcttttttaaattaaataatttgcagaaaacttcgttgtgncatatggaagcgccgatgcttcaaatcaacaacataaatccggcgttgaagcaattaaatatcatccaaaaacacaacattatgaaattaaggataaatttcgaaagaatacaagagcatacttatttttgaatgacattgtcgtaattaaagtaaatttattaatgaaaaataaaaaataataatattaatt

SEQ ID NO: 18037 - DNA, 3307 bp, Heterodera glycines
  misc_feature (84)..(84): n is a, c, g, or t
cttggaaatccggtttccaaaaaaattttgagcattggattccgattcgaaaatttttgaacctcgaatttctcaaaaagttgnggcttcggaattccgaatgtttgggttctcggaatgccattcctgataattccaattcaattttttcagccgtgaatttcttctgcaagattttcgcaaatgaagtgatccatcaaaaagtgcttgcgtcactgcgaccaaaggatgttggacgaatggaatcagtcagcgtctccttgaaaaatattttgctctccggatcagtggacaatgctttttggaaagtgcattatgaacgactttttggcaagggtatattttttttttgtttattgttgatttatgggtttttgaatgacaaaaaatactttttcgagggtttagtaggggtcaataaagaaatatttattggtttcgtttccattttagttcaagatgatcgacaaattccatatcgtgagcgttttggtgaaaaaatgagatggcaagcgaatgctgcacgtatgcttatggcgattcctcttcgagagcctaaaaccgttgatgttcctgacgagtaagtgaattgattgataatttagtaatttcatggacccgaaattcacaaatttttttgttttgtaggcctaagtcttcacctactgacccactttcaccatacgacccgtcccatccgcgtcctacacaaccggactatcccgacatgcgtgattatgatccgcgttcatttaaacctcctgagccggacgatgacccgcttcgactgcatccgatactgcccgctgcgccgtatgcaccaccggcacggcctcgaccttcacagcctaatgcgcccactcgaccgccacctacttaccccgacattggcagaccgtattttgatcctcttccgcaccagccgacgaacccgtacagcgactggccctatggacctgcagcaccgactggatccggcggatatatgggcggttatgatggtggagtgtatgaacctcgtcctgaccagcctgggaactcgaattatgacccatatggaagaggaggatcggacgacggcaaccacggacacgatggtccaggatcttctggtggcggtggcggcggattttttggtccttatctttaagaagttcggatggaagtctatttgcttgttgatatgcaattgtttccattgtataatatgtaatgtggttaacgggtattcattcatttaacacatacattggcatatgtcaaccatactatttgtttcaataaaatatatcgcaatattggatgacatcattttgtaaaaatgttaattttacatgctttactttgtttgccttaatatttacaaaaattgcggttttggcgggctaaaaattattcttttattttcaaaaatatcctaaaaataaatgagttttagaaattgcccgaatattttttttaattaaaaattttaaatactatttgtgttcgcttgtatgccaaattctgcttcaacaccgatggaagagtttgaggaaatggtcgctgttcttcagcttgatggcgtccttgactttgacgcggtgcgaagagcagtcagttctggtgcaatccgagtgcgcgaatgtgacgcggaaacgcccatggttcaggtgtctgaattttgactccttcgatagacattccgaaccgagttcgaacaaaataaaagttttctgatactgagttaatgaaattttgtttgaatttttgtctggagctcgcaatttgtcgagccgatgccagattcatgctcagaaattccgagaaatgtgttttcttaacttataaaattaaaaaaagtaaaaatgactatttattgaatatgaaaaaaaaatcgaaaaaccggaattgattattagtcttttatcttaagattggatctcatttgtattctggacaatggtcacaaacgttaggcactgatatgcttttatgtccttcttcaatgtcggattaccatcaccatgaaggtattaaatttcttttaaaccgaggtcgaattttttttcaatctcattgtcagctcccataaacagtattaaatattagagtgttggtttggtttttcatggttgtttaaccgaaacgaaatcgaaaaccaaggggtaggccaaaaatctaaggccgaggagtccaaagccaccctaactaaaagccggtagacccggttaataatcaaccgtgaataacccgtgttgatgtagcctatcttttttattacatattcatgaatttagttttgaaaaaacaaaatcatacgcactttcaaatacacattttgactacgtcgaaagataaacaaaaaaaaaaaattttccggaaaaaaattctgttcatgaacaacataaaaaatctgttcttcccattgggcattctgtgcgttttacgttttaatttcaggccatcagaggttggaattggtcgctgtgtcagacactcgtctctgtgcgcaaaaagttcttttagcaactgacgaaagtccgactaatggcaatggcactcggaatgaacaaagcacttcaaatagttcaaaggcataaagacaaagcatttgagcacttccagtttttttaaataaatattcacatatttggtaattcttccttcctcgtttttgagtcctgaaaatcagtgtttttgggagtcactaagctcaattatgccgttcattttggtcaatcccttagtgattggaacgaattcgaataaagtcaaaaactaaaacattcaaatttcaagagcgaatctacaaatgaaactaatatatatacatatatatatatatatatatataatgttgtaatttcgaggatcattattcataaatattcattatttttgggtgtcattaattgatgttttgttttgtacatttttaattgcttcagagtcccgaagtttaagaaaaacatgttttttgacacagtccttccacgtgcattaataaatgtcggcgcattcttttcttccattgcatacttttaaagtgattcatcattcattttgtgcttgacatgctgctttcagcaaacattttcggaatttttttttctcgatttggcaaacgaaatcatttattgttgcacagttgaccaaataaaaagcatttaatagcatttcaactcattttatcaaatggaattaatatttattggaattaaaatgattgaattataaatacattttctttaattaggtcgtcggcagaaattgatgggtctattggaaggagaaacgtccaacgggaaaggaggtgtagaatgat

SEQ ID NO: 18038 - DNA, 2843 bp, Heterodera glycines
  misc_feature (2744)..(2744): n is a, c, g, or t
  misc_feature (2791)..(2791): n is a, c, g, or t
ctccctctctttttttctctctatctctctttttccctctttctctccctccctctctctttctttgtctttctctccttctctttttctttcatcgctttttctctctcttcttcactctctctctctctattttctttctcttactctctctttctttctttctctctccctctatttttctttctatgtttcctcaccctctttttctttctttccctctcctcactttctctcattttctctctctctctctccctctctctctccctccctctatctttctttctctctcacttactcactttctctctccctctctctctccctccctctatctttctttctctctcacttactatctttctctctttcccatctctctctcttctctccctttttccttctctctctgtctttctctctcactcaccactctctctctttttctttctctcactctctctttctttctctctcactcttccctctctcacatcctttctccctttttcgtaatctcttatctctctcttttaacctcctcaatcactttctctttctctctctttgtctttcttctctctctctcacgctcaaatttctctgtctctctctttctctctctctctctctgttttacactctatttttttctctctctttcaatcccgctctctcatttcccttctctccctctccctctctttaactctatctctctctctttatttctcgctcaaatttctctgtctctctccctctatttttctttcactctcctttgctctctcaatctcttctctctttctctctttcagtctcgctctctcatttactttctctccctcttcttctcttaatctctctcttttcacactctctaactactttcactcctatccctctctttatctctctctctctatctctttctttttctctcaaattttctgtcttctctctctctatttttctttcactctcttgttctttctcatctcttctctctctcttttcctttctctctctctctctttcctccccttctttttatcacgctctctatcgttcattttccctcatcttttaatttctctctctctctctctccctctctcctttcttacttctctctcactgctttcttctttctcacttttttctctctctctcttgataattagagataatacggtaaacgtttttaattaatcgcgcaaattgtggttgggtgtcataaaattgattggagactaaaattgtagcagaactgcaaataaatcctaacaaatgaaaaaggttttttaaaatgggagtaaaaattttaaaaaaaattaaaactattaaaaaaatcattaaaattacttttataatattttcgatcaattggaaatcattacaataattgaaaaaacaaaccgataataaaaaaatcggcagcaaacccaacgaactaatcaataaatgaattacttcagagattttaacatttaagtctgattttttgttaaaatgatactaaatcgacaaaagcctttgattgatcgcgaaaattatgattggtcatgtaaaagttgattttttgttcaaggaacggaatgaaacgtttgatttgacttctttatttttaacattcggaatattggaataataattcaataataagaaaagagaaatcgaatttacgggtgttgatttcgtaaatgttattgacttttgttgttacaataataatcctcttttccctctttcattctctctttttttttgcaaatgctttcgcttcgaaaaataatccattcaaagtgtgacatacatagtcacacatcaaattagtatagttaattaattctgtgtgttgtctgtccttcccttttttttgtttgatttgcccaatgaaaaattcacaaaatcttatataataaagttgagtgtgtgtatgtatgtttgtatgtgtcattgtttgaatttgtgtggcgttttgtttgagttttgcgttaaaaatgaatttgaaaagagatgaaaagaaattgttttgaaaaagaagagaatataaagaaaagagacgaaaataaatagttaagatgaagaagaaggcaaaagaaatagcacagaaaaagaaggtaaaagatttctcctcctaggatgtagaggttagagggagggatggtgggaaatagtgcactgtatgactgtctgtctatgcgggcagcggcagatgggaggggcatacagtgaacagacgcgtgctgctgtgcagcagcagtctgttggacgcgtgcgtgtgtgtgggagaaggagggagtgggaaaaaaagagagtaaattgcaatggaaaagaaaagagagtaaaagaaaggaaagggagagataatgggaaatttctctcgcatcccttccttatttataacccattttttattgtataaaatatttaacaaaagaaagaggacaccccttagtttgttcactaagaaaatcctataatattaacattgtgttgtgttgtataaatgctttgaaaaatgaaatgtttttgttttacatttttttgttttgttattttgtgtaaaaaacagttttaaaatgtttctttttctttctttgttgtgtctgttataaattgatttggttttgatatgaaagatattgttttgcttatgtaaatggtaatgaaattttaaatgaatgaatgagaattttgtttgaaaaatttgtatagaagaaaaatgtgcgtaaganaaagtcaagaaacaaggaagaactgttatgccataaggaaatgccanaagaagaatgcgaggccgctaagcggtcgagccgctgtcggtttatcattca

SEQ ID NO: 18039 - DNA, 2379 bp, Heterodera glycines
  misc_feature (2354)..(2354): n is a, c, g, or t
  misc_feature (2367)..(2367): n is a, c, g, or t
attaatacacatttgattcagcgtacgatcgtggacattagaaactgaaacaaattataaactcgttagattctcaactcaaaacgcaccattagggtggatgattggtgtatcaaatgtaacagttggaccggcccgaggatatgaacgcggacagtcgagaaggacggaaaaaacaccatgtccactaaatatgtttttgaagaggaataaaatttgtccttactaaagcgaaccagccggaccaccgatcatgattttcaatttaaacatctggaaaaacaccaatagaaaaagaatggaggggggggggggggggaagaatgtgttcgatggtcggaattaattttttataatgaatgaaaatcttaaaaacaaccttttatatagaagttcacacacacctaacaaataaggtggaaaaaacctgacattacaattttaagtcaggaatattaccagacaggcagacagtgcactatttttgttggagagaaaagcggcaaaaacaaaacgccaatacattcaaaaacagtacagtctttttctttgaataattcttaatgaggtcaagtttctaaaagactaaattggttgtatactatcttaacaatattgttagcgtttgcaattttgttttttcatgcgctagagacgtgaaagtagtacgccaaaatgagaggaaaagaagtacaatttatttagttttatatcttttgattggagcgtgaaaacaaaattcgagcgtcaataacgttcggtttttttcattaccgttatgctaaatttggtgtggatttaacgtgtaggaaaaaagttaaacgttacgagtaaaagttgtttttttactttgttaaaaaatatagtacataaacttggaagaaataaagataaaaagtaaatgtgacactgcaaaggagaaaaaaataaattatttacgaaaattgcgaacttttgggacgtttaataaaaaaaaaataccttaaagaaatgtaagatgggtaaaaccccgaaataagtaaataaaagtcccaagttttgttcacaaccacaaaaagaatgtattcttcctactattcaaaacatgtatttacgtgaaattgacaatcctattgattatagacattttcttctgggtaatatttattcaatcatttcccttcactgtgtaaatttcaacaataagtctggatgatatcacttgctgtagaaaactctgtaatataaccttaaggtaaacgtaagttattattttatggacactcaaagggtaaaaagcattacgtttttgaccgccacagagaatacgaattgtcaaatttgagaaggtaaatgccctgtccgggataaacatgagatccggaaaacacctaaaaaacacatttgttcactttttgtcacttgaacgcacagaattacctcctcgtgacagtcccttcggaaggtctgaaaatgaaaatattaaaacaccaaaagcaatggcaatggggccggaccggaatgatttcgtctacgcgcggtttgttcgcgtctttctgtcgcttcgccgcgtccgcttccacatcgtcgcccgccgtctgtccgccggtgcgtccctcgccccccgccgcttcgtcgtcctccaattcgtcctcactctcttccacttgcactgtcacttggttcgtctccgcaattgtccattcgaaataaacgccaaaaccgaggtcatagtaatcggttgcaaaactgcaaagagaggactaatgaatgactcatatcaattggaaacgtactcccagactaaagaattgccctctgggtgcgtcgggacacgaacctaaaaataatgaaaaaatgcgaatttcaattagcatcttttgtttattttatacaatattcttcgtcccttttgaaaggccaaacagataaacaaacaaacaaataaattaccactagtaaaattgtttggctcataatggaaaggaccgtttcaagattcaaagttcactcactgtgacagtttcgccatgaccaattttcagaactccctcggtgccctcctttttgatgttgtctttaaattcctgcacattcttcgaggtccacatcgaagcgggcgccacttccggatttgctaaagacaaaaaataaatgttttaaaaatccattaacaaaaaagaaaaatgaccacaaaacacaaaaacaaaagaaaaatgaaaagaaagttactgtgacagaataagcccatttgagcatggacagaaggaactgaacagaaaggctgtccaaatcggacatcggatgcatcaaattcagcaagcacttacgaggcgcttctgcgtcctcctcgtcactcacatcggattcaccgngcacctcctcggncaattcatcgac

SEQ ID NO: 18040 - DNA, 1286 bp, Heterodera glycines
  misc_feature (1244)..(1244): n is a, c, g, or t
cattagggtggatgatgggagtattaaatgtaacagttgtaccgacttgaggatatgaaggcgggcagtcgagaagggcggaaaaagcttcgttttcactagatatgtttagaagaggaataaaatttgtccttaataaagcgaaccagccggaccagcgatcatgattttctatttaaacatctggaataacgccaatagaaaaagacagaaacagaaaaaaacgtacattattatccatttgttcaactaggtaaccatcacgttgtaattgtgcaatttcgcgtggaagcggatttcgcgaaatcgtccaagcaacaaagatacaaacacaactgaacgcaataaaaaaatggagtaacttaaattgcaaaactgttagataaccaagcaacgatggagcccactatccaaagcaccacacaaacaatttgaagaaatgagccaaaccacataatagagcaaggcgatctggtcaaaaattgatcttaatattaggcctaatacgtagacggccttagccagacaggaacctgcatcaacttgatcacccatttgttgccgatgcgcactagttgctttaccagcggtttcagaaaggcttcacggtcgatggcggagaaatgcgtgcggatgtccgtcgccagcttgtccgtgatctgttttatggcctgcttctcgtccggcactttggattcctccgcggccaaaatcgcgtaacggtgctgaattgtttggtattaatggcagaatagttttaaattgactggccaccttgaagtcggggtaccctttgcggcaaattcgaatgccttccaacacgtgctggtcgatcagcttttgcacgaaagtcatgtccgaagctaaaagagggggtggtgggaaaatccttctttccatgcatcaatgcgaccgaattttcccatttagaaaaccagaaaagatgaagatggatggatgaatcaagggattgtttagattaaaggatgagaagtgggcaaggggctaaagaaccagacaaaatttaatggtcacaaatcgattggccggcggaaggctttggaataacgacgacggctgacgcacctttttgagggggaggcacagacagaaggaaatgtgagagacatgcacactctatgaatccactcgacggcgcgctgtcagaaatgggattgtgcgagaaaagaaagaagctcaaaacgatcggcagatgtctttcatttatttgggcagtgattggngagaaaaacgatatcaacaaaagaaaagtcagggcttgggaa

SEQ ID NO: 18041 - DNA, 2652 bp, Heterodera glycines
tttttaaaattaaattaagtatcgcgaacaatgattgtaggaaataaggcgtgaatttgtgaaagggtcaaagcgattacgacgataatcataaaccagcgggtgaaaacgggctaaaaattcgttcacaagatgtggatgatgcgggaattgacaaaactccatagccaaagaagacaaaaagtgaagtttttttgaattttctgtgaacgtttggccatccaaaactcagtcacttttcggggaaattgaagagttaaatgcgctgacccacaaaatgtccaagccacgaaatgtccaagccacgaattgtccaagccacgaattgtccaagccacgaaatgtccaagccacgaaatgtccaagcctcgaaatgtccataagggtaaaaaacacgaaatgtccaaaacgcgaaatgtccaaaagagtaaaaaacacgaaatgtccaaaactcgaaaaagctcataaaaacccggaaggagtctaatttagggttttcagggtcgctgaatacgaacacgacctttatattgccccttgcctaaccctggacccaaatataaacataaaattgcaaaaaaaaattcaaagcacctaaaaagagtgctgatcaaaattcgaacaagttttagggtccctatgccatccgaattctctctatagacacaccctcagcttcacatattaaaaaaaataattttattaaacattcaataaaattctttacgacgtggacaattgaatcatcaaaattctcgaaatccttcaattttcctgcatatccctcaatttgtaaaccgagcgccgtcataagatcatggatgtcaccgttgttgttgtacgacgcgtccgccaaaattcgcataatgacagcatcctggaggatgtatcgtttgtgtcgcttgtgaatgaaatggcgagcagatcgggcagcgtccacctgtctgtcgatgctttcattaaccccacaaatgaagtccaagagggcggggtggtgacagaggcctttctaaatgtttcttttcaatttgcttttaaaaaattaaagaccataaaatgaagatgagttgcttccagtccgttgtttgtacgagcgagggcagacgtggcctgagagtgcatgttccaaaatgggattgggaagtggggcgcccgaaagatttcgtcctcccacgctggaactgaatttttttattaaattaaaacggatgaattgattaaagaatttgcctgaaggcgctatcgaagtcgatagcgggctcaacgaatattgaacaatctgctcccgtggacatcgacgtttcccaacaattttttcttctcacgccgcatcatttcagtcaacgcattgttggaactcatggcacaaatgcttcatccgttgctgatcgcctcacttttgacaaaattcgggtcggcttcagacatggctcggccaggacactttctttgattttctgtcgccttgattccgcctttaacacagcattaattatttggttttaaatttaaacaaacttgttgtttctgaggcgctgggaggtggttatgttctctttgacagacaatctcccccaaacttggtctttccgcgctcaaaggtcactgttgaaagttcagcctcgttcaaagtttgttgttcaacattgtcggaagttatcacggcatgcgattcgtcaacctccactccaaaattcacggcctcctcagttgtgtttgaaatgtctgacaaaaacgcttcttccgactttttttgtagactttcaagtttattacgaatcatttgttcgatcaatgaataacaaaatctgaagacaaaaaacagcagatattttaaccgaattttcagatttttcttattcggctgggtctaaggttaggcaaggggcaatataaaggtcgtgttcgtattcagcgaccccgaaaaccctaaattagactccttccgggtttttatgagcttttcgcgttttggacatttcgtgttttttacccttatggacatttcgaggcttggacatttcgtggcttggacatttcgaggcttggacatttcgtggcttggacatttcgaggcttggacatttcgaggcttggacactttgtaggggcgccccatatttctggtcaaattttaaaaagcgtatccagacagtcagacagcgcactatttccttcttttctttttctcaccccttgccttttcccacacatcgatgtttgcgtgcccattttgagtcactgatactaaatgtattggcttatattcacagcatgctcacccactcccttctcccaggggaattattttggatagggttctttacccccataaactttgcataccccatttttctcaccgttgatgttattaatattgaattctgaaccgatgtgaatatattagactacaaatgattgaatattttgaaagcatgtttcccactcccttctcccagggggattattttgtaaaggctttttttccccaacaaacttttcgaaccccatttttcgcaccctgaatgtaatttttattgaattctgaaccgttgtgagaagatgagactagaaaaaattgaaaattttgaaagcaatgcttcccactcgcttctcccaggggtattattttgaaaagctgtttattcaaaa

SEQ ID NO: 18042 - DNA, 4167 bp, Heterodera glycines
tttcatagagaattacatgaaaattctgacgaaaaagtaaagaatcatattctcgaactttaaggtattcatcaagaaaacttcaacaaaaaatatttttcaatgtttttcgttgaaaatcatgaaatttcttttaaaatttaaaattcctagttttttaatttgtttaattttttatttcttaaaatattcaataatcaatttttacgcaaaatctattcggtaaatcagttttttcgagaatttcttagataatttcaggtcattcggtgcacatagaagccaactagaaattttttgaaaattttcgcaaaatttttcatagaattttaaccaaataaattttaaggtcaatatgaataaatgcattatcgcccaccaccacctttttataggttgttcaagggattttggtcaaacttcatcaacccgagaccactccactagctccgatcaccaatgaagaagtggacaacaatcagcagacagacaatggcaaaaatgccgtagaaagcggtggcaatgcttcatcttcttcttcacctgcttcaacagtgccactgataattttggcactgattttggctgtgctggtgttggtcagcattttttggatattgatcaagcgggcaaaggctggccaagagaagcagaccgatcatgccaacggcaaaggtgggtcggggcaattagcacaactcgcgaggcaaactaattaattaattgatggggacgctaaaatggcataaatttgggtccgaatagcacgcattttttttttataaaggaaattcaaaaatccatggaaattttttttctgtttttttggcgtgagggagccttcgcaattttttttaaattttattaaatcttttaaaaacgatctgatagatttccatggatacaactggaaaattcaagaaacccaaagaaaaattaaaaatttttttatgttttttttgccatgaggaagccttcgcaaattttcaaaatttattaaatttttgaagatttcacaacataaaaggggtatttgtgaactgtcaaaggcgcgcaaacaggaaaaatttaatccatttatccgaatttttcccagaaatcaggtgaacaatttcctaattttgcgcgattcaaatattctatcattcaaaaggagaaaaattgtttaagatttgcgcctagaaaattgaaattttttaattttaaattttttagccgtccatttgccgtcgccggccggcgattcgaccactccaatgttggacatgcgtggaaatgccgagcggacaaccgccccggacactgtcggcatggcaccggaaaatggcaccgcgggaaggaactgattttcattcattggcattttgttcattctttggcatatgtccttctctccctgacaatatgctgaccatttttttttgtttaatacatacattttttgaggcttccttttttgtcatgccataattttttggcaattaaatttcaaatttttcttttggaaaaatcagattttttgatttttcatttggcttactgtctctcttttttcttttcattctcaatttgggttcttcttttgctatttaattttttaaatcaaatttcgggattttggtctcgactttttgttctaattttgcctgttttacaactgaaaccctccgacttttttagcattcattatcactattattacattaatttacactcctaaatatttaaaaattaatatttcaattattttgccacgcgccacccttacgttgtgaccagtcaaaattaattaattctgaaaattattttgatttattttaaatgattttttttatctatctttgtatcaatttatgggcagttgatatcactaatatttaggtgaaaatataatttttccagtcaaaatgccaaatttggcgcccaccaactgcccatccaactgaaactccattaatttgatttttattttattatttttaaataaatggctctccaatgatatgattaaaaagttttgataaagtgaacttacaaaaatacagaaatatttgataatttcctttatattaaaatcttttaataaatatttataaaattaatatttaataaaaaataattttttttttcaatttaataaagtaaaataaaaaattccaagaatatttttttctgttcaaaaactgtttgacaaagatccattagccgccttgaaggtggtatgccgtttagaaaattcctcttttggcactgatgccattagtgataacactttggcattccccgaaaggaatggaatttaaatgccaataaatacaacaaaaattcaaaatatttttatggtgctcattaaaaagggatttttgtctggaacattctcatttttttcaataaatattttaaatatataaaaaatcagaaatttttggctgtaaaataaatgatattatttatttatatatgcccttaaaaattctatgaaaattaaatgtgttttaattgtagatataaataatttcgaaatttatttggttctgagtcatctttggaaatctttttttttggataagatttgattcaaattataatttatagcataaaatttttaaaaattttcataaaaaattgaaaaaattatttgattttttagctaaaaattaattttaaactgaatcagcttacggttcgtcttaaaaccaaaggtcagttttgcaacagtagaaaaaataataaaaaaaaaacttaaaaaatccacatgtttgagagaaaaaaatgggattaaaccacctcgtgttgtgtctggaaaatggcgtaaatcaaagccctgaaaatggcacattttcaaagaattggcacagtgttgcaattcacagacgactcgcattaatggcacggcacattttaatctcccagttaatctccatcaacacaaatttcattatggaatggatgaaccaatttatttgcaacctaatatagtttggagtatcatgctggtagaacaaattttaaatttctcacatgaacatttggacaacatttttgccgggattcagtttggcggcatggcgccggccgccaatcggagaattttggcaccatcccagaaggcctgagagaaagttttttttttattttcccgtataaaataaaaatatttttaactttttttttaattaaattagtaatgagaattattttttaaaacaaatatttattattttgaggttaagaacccaattttttaaatagaaaatgtatttattcagaaaagagattcgcaactattttcttttcactaatttttgactattttgaccaggtgtcaaatgaatttttaggcaaaattgaaggaatattcattttttaattttaatattctatgaaaaaaaattgaacaatttttttgttgtcactaaattctgcgccctattgataacattaaaaatcttgaaattttttacaaaaaattattttgcaaaaaatgatgactcattaacagaaggctggcaaatttgttaaaatttacacgacaacaaaacaacataatgactaggagacttcaccaatgacatgttaggctcacttaatcctcatcagcagcgccctttggctccaatccctaatcctttttaagggaaattcattagctaattacaataatcctacaaaaattagaacctggtattttgtaaaagcccggatctagatttgaatttcccagatggacctggacaggatggcagactaaatgtccttttgtaacaggacattgacccatgttttttttaaaacacagaagccagatcaataccagagatgtggccgaaattttgacaaattaactgtaacttatcaaaatcccaaggaaaaaattctcaaattttatagatttttaacgcattttggttataccaattaaattaggattgaacatcggctggaaacagcatgcaaaattcacgattttttgcctgttatcccaatttgagtgccgtgtcggcaatcggaaatcggtattttatttttatctcagctcattatagtcatttttcccaatttttttttttacaaataatattcaaaaacaaaattttaagcatttttcatgtggattttcttagggatttgttgagttacagttaaattgtcgacttagtaccaaaa

SEQ ID NO: 18043 - DNA, 2999 bp, Heterodera glycines
  misc_feature (71)..(71): n is a, c, g, or t
  misc_feature (100)..(100): n is a, c, g, or t
aattagttaagattagtggtttttggtcatatagaattttctcattaataggaatagtgatttttgatcantatacacaccgagtccaaaaaacgagacnatgtgtcaataaagagagagtgcagagaaactttttgtctctaacttttctctccttttggcatactatctaatatttcattattaggaaaaacaacattccttctctccatataactttttttctaaccatacaatctgcaccaaattttgcatatcgatagagaaaaaaaatctgcatcgatttctatgtttactatcatcgcttaaatgttgttttaaaaagttataagataaaaaagttaaattattattctttttaaagatttaatggctaaaagaactttattacggaagcgacagaccaaaaatgcacgccatacgcatgagaacaagcgggaggagagacgaaccaaaatggcaaaggcgacaaaagcccgatagtccaagaaaagtgagttttttcactaattttaattcaagatcatttttttaaatttcagccgctccacagctgaatcccaatgccgaaatgccacctcaggacgaagcagggccgtcatcatctgctgcatcggccgaagaagcgatggagacaccaccaccaactccagcaccagtgccaacgccggagatggacgaggaaaaatttggaacagtatggtgctcttctctggccccaaattgaccaaatgaatgcattgatcaacagaccgattaagtggtaaaaagggtgaattttttttttaaattgtctgaaggtttatcggaggtgatgtgagctttgtgtgagcactgatcggtcattgcggatcagcagtgacttcgtttccatcgcctatctgcaattgtcatcttgatcagatgctcactgaaggatggcaatgtcaaacccggacaatcccgcagacaacgcaacagtcagaacaattcgcaaacgcagtggaaaacggagagaaagcaacagccgcagttcggtccagcacgatgggaattgtcaaggcaccgctcatgaagacaattgaatttgatcggattattccagcaccgtttcacgtgttgcaggggttgggaaacgcacttgttcgtgaacttgagcagcaaactgatgccacaattgccgttcaacaatttctgcgacagataggggctcggagggaacaatttcgtaaaaaggacatgacgggaaataccataagaaaagtcctcaaacgtgcatcggaaatggaacatctctttgaatcgacatggccaaagacaatttgccaagctcttatgcacttaggccaaatccaaaatttcacaaaagtacaaattttgagcaaataactcccaaatttataaatttaggctcaaccactttcgccaaatgacttggacgcatttgaacaccaaattgaggagttccgtggttttctggcccaagaacaacggatgcgcgacttcctatctcagaaaccgaaggcccacttatttctcaatcatttcgtcccatttgctcggcaacactcttttctcggcttgctggacgagcagggtgggcagcaaaaattaattgacgcaaattttcataaaaattaggggatgaggcgctgcattcggtttggcgaagactggagcaatggtggaaatgcatgccggacgcggaccaaattctacaacaattggagcaccattttgtcagcaattggctcctcgacaccggcagaattgctgagatgaagcaggcgagttttgagtggcgtgggaggggttaattttcccagaaatcatttgaattaaacattttagaggctggaagaccaaaaagaaaacgacaattttttggagcattcggatggtgaaaatgaagatgacgctgtcattgatgttattgggtgatcaaattttgttttgttttttaaatttacttaaaaaaatcttagaataatatgacttaattattttttctttattcgttgagaaaaacgtgaaatattgcttaattaaatatataactccggtgggattgaacctgggactccctttttggtggcaaactcacagaccagtaagacaaaaaatcaattagtttttgaactgggggctcaaaattgactcggtgtgtatagcatttggtcatgtaacatttttctcattaagattagtgattttttgtcatatagcatttttctcagtccaatttgaataaatttagtaacagcatttctctcacagcttattttaaatcttttaatacattttaattaattatatttttgggggtcctttgtccgtgggtcctctgtctttgtgggtcccttgttacgaaaatattgacaaaaatttctgaaaattggtttgaatttttgaaaaattcgcaacccataaaaatttttaggccgaaataagttaacaaaaaaatagggcttccatacaatctgggccataataatttttagaactctcaaattgagtgtaaaaatctttagaggtttttgagtcaatttaaaaaataaaatgaaagtgtggggattaaacgatggaaactaagacagactacgtgcttagcctctaggacatataaatggtttaaatcattttataaaatacaaaaattgccaaattactttcatgtattttagaattgaatattttgtttattttttcaatattttcgaccgtttttattgcattttgttagggaatttagacaaaagaaaacccaaaattttctcgaaaaactccaagaaataactttggtcatattcatataaaatagacataattacaatttaaataaaccaattttttgtactttttgaccaaggtgcgtcatggaaaaatataattaattctaaaactagagaccgcaagcattacatttgttataaatttataattttttaataaatgattttttatcttttcgtggtttactggaaaattcttatgcaaatcattgattttttgttggcatt

SEQ ID NO: 18044 - DNA, 1202 bp, Heterodera glycines
atgatgttacactattttaatcaaaagctgaattaattaattaatccttaattaccatcaaaatccgtcaattttattgaaacatctgtggaagaaaaaagactgagttttttaaataacagcaaatttaacggcttgaagtccaaatgcattgcaacttaaaaaacaaattaaaattatttcgataaaatcagtaaggaaaggatcgaacatgtattaaatttaaaataattaattattctgttcaagtaattacaatatttttttttgtctttgaacagtttttcatattattcacattaattaaataattttaatttagaatcgttaactctattattgacaattaattaataaactaattagttaataacctttgtgcaaaacatccaaagtgctcacgatatcttttaccattgtgatcagttgattctttgatttttttgttttaccacgttgcaattcttggtccaagctcatttcgcccagctccaaaatggtcaaaaaccccggcgaaaaaatttgatttggcataattaggccactaaaaattgcaaatttaattaggtattattttttaatgctaattaaattttgaattttactagtccatcatgttgacaatgtgctcattttttgaatcaaatggttttaattttctcaaaacatttgtgccattataaaaatgtcttttattattgccatacaattttatggcaacacatttctgtttcggcagattttgcccacgtttttttccggtgtaaccaatgaaaatctgaaaattatttgttcgttatattagagtagagcggtaattgtaaaaaaaaaaattggtacagggaatttttcgggttaaaaaccgtgactttttggctgggaaacaccgggactagtctcggtcccggtcaaatccggggctaggcattcatttgtaggtttttttcagtaccagtcccggtcccgctcagctataggatatattgattagagaccgtaaaatcgaaattttctaaaaatttttttgtcaatttccgatcattagaatcatatcctaatgattggtgttggttaaggtttagtgaattatattaaattatttttatcgtgcctaattagattcaaataattaaacaattttataatttattgattatgccatactaatttaattaattcttaatgttcttacttgtcctgat

SEQ ID NO: 18045 - DNA, 1865 bp, Heterodera glycines
  misc_feature (1180)..(1180): n is a, c, g, or t
tactgttgaatttcgacaaaattggtcagataaaattgttgaaatttgaaaataaaataaaaataataataacatttttcttggaatggcattcatttcaactggctaaaaacttgaaatttaaaagatttttaaaatggaagatgatttttaatatatttatattttttttataattaattatgaagagaattcaaaaattaattatgcacggtctcttaatttctaaagataacattttgcggacccacttataaaatggaaatattatgatctgccaggatttgtcctttgttactaaaaatgtttttttcaaattttatgttgattaaatttatattcatttaatttaataattaattaagataaaaagacaagggtaacattgaaaactcaaaatatctattttaatttgttaatttgtattatttgaataaaaatttttatgggatgaaaaatttgcattagaaaaaaatataaatttagtggaaaataagtgactgattggtcatgcataaaaatcaactcatttattaagggttgcaattttaatttttttccattttaaatatttttttttcgtatttataatttgtattttgtttttaataatgaaaacgaatgtggaataaatgctttacacaaatgatcattgtgataatcattaaaaattcagaaaatttgtgcccctcccccaaaatgcgataatcaaaattggtaatttctattgtaaaaaatgtattttaaaaaggcagaaaaaataaattagaaaaggcttagacaaattagcctttttaggttttatgttttccaatttgtaggttatatttttttattttctgaaattggtaatttttaaaacccaacttttaggaaggcctgagggatgtgcatatttgtcccattttcaatttaaaaaaaatattaaaattgattaatatttgatttaacttttttttgcactaattaattagaataatttttaaatcacaaataatttttcttccttcttaaatatttttgctttaaaaatattatgtttaatatcattaaaaatttagcaatcaattaacaactctctgtttaagcaaatcatatataaaattagcaatcaattgtcaaccccacagtttaatgatgtaatgccaattttgcccaatttggcaatgaaaagcccccnctcacccacagttaaaggatatcattaaaaatttagcaatcaattaacaactctctgtttaagcaaatcatatataaaattagcaatcaattgtcaaccccacagtttaatgatgtaatgccaattaaggatatcgtgccaaatttggcaatcaaaggccccctccccctactatttaaggatatcgtgccaaatttgacaatcaaaggccgccttcccctactatttaaggatatcatgccaaatttggcaatcaaaggccccctccccctactatttaaggatatcgtgccaaatttgacaatcaaaggccgccttcccctactatttaaggatatcatgccaaatttggcaatcaaaggcccccttcccctactatttaaggatatcgtgccaaatttgacaatcaaaggccgccttcccctactatttaaggatatcatgccaaatttggcaatcaaaggccccctccccctactatttaaggatatcgtgccaaatttgacaatcaaaggccccctccccctactatttaaggatatcatgccaaatttggcaatcaaaggccgccttcccctactatttaaggatatcgtgccaaatttggcaatcaaaggccccctccccctactatttaaggatatcgtgccaaatttggcaatcaaaggccccctccccctactat

SEQ ID NO: 18046 - DNA, 2271 bp, Heterodera glycines
  misc_feature (49)..(49): n is a, c, g, or t
ccccccccccccccccccccccccttccccgccgtcgtctcgactcatnaatagatattatttacatttgacagagagggaaagtttgtccctcaaatgccatcacatcactggttgtcatagatggacatcacaaaattttggcacaatatgccaaacacattttggcattgtgttgtaacttatcctggtgtgacttaagctccctacccgttcttggtacgatattgtttccctccccggtactgcttcgtcttcttcctcttcctctcacgtgcctatcttcctccccttggtaacagcatcgtctgtctgcttgcaggggccttatgctcgtctcgcggtttagtaaaccacggttaacgcattaaccacggtttcgttaaccgtggttaacgaccgaccttaaccggtatgctcgtctttaaccatggttaagtaaaccatggttaactcaaccgtggttaagagaatttatcttgaaattgaaaaataattaatattaaaaaaatataattaaattattataataattattttttgtttatattatcaatattagcatagattttattaaaaaaccccgaaaaactattaaatcaagaattggttttctaaaaatttttggccataacttttttaaacacagcaattttttttttaattttgcaaattaatagaggactcttggggctatagaatgataccaagaatgtttaatttggatgcttcaagaaaaagtttgctgcattaaaattgtcaaattatttttttatggccgtgtgaactgcaatggagccaacatttcttggtaatagtgcattacaaacaattacgttgttatgcaacatgctacaaacagcagcaattgagtcggggtcgttttggcgcccacgttttggcgccgacgttttggcgcccacgtgccagggtcaggtttttaaattttgtctatgtttgaataaatgaaaatatgtattcgtcagttttctgagtcgctaatcacgaatattgtattcatcttgacaattgcgaagcccggactcgatttaaatgaaatgcaatttttgaacatattagatcaggccttctatctgttttgttttatcaaatgttttaatatggtgggtccaaatctgagaaaatgatttaccagattcaaaaccgtagttgtacctgtttcaaaaaatggcctgtacctaaattttgtcaccttttttaaaaagctattttagcggtttgggcgtgtgcaaattttttgatgaaataacactaatccgtcaataatttatatcatagacaaaaataaaagtcagattctttttctacatgtaaaattaccctagaaaaaatttatttatttattttactatttaaattattaaataaatttacgttaaccacaactcgagttgtggttaagattccttaagaaagattaaaccacggttagatgagcataccggttggaaataaaccacggttaacttgcgttaaccgtggttaagaagggagtaaaccacggttaactcaaccgtggtttatccttaaccacgattaaaaagggaaggacgagcataccggttaaggatttttaaccacggttaacgccgttaaccgtggtttagctctaaaccgcgagacgagcataaggccccaggattatggcaaaactcgggattagccaaaaatttaaaggaaatatttaggtatttctgtttccctttaaggcggtcaaaagcagcgaattgccatcgctcgcgcattggtgagacaaccgaaagtccttttgctggacgaggcgacttccgcgttggatgcgcgcaacgaacagctgataagggagtcgttgtccgcttgtgcgaagggtcgcaccgttctgatgatcgctcatcgcctttccaccgtaagacgtgccgaccgtattttggtgatggaacatggccaaattgtgcaggtccgaaataggaaacggttgttgtgagaattagcgcacttccaaataggacggaaatcatgcggaactgatgaaactgaaggacggcctttattactcaatggtgcaaaaacaaatgggagaaatgttggagaaccaatgaattgcctctgccatttagctgatctcatttcctcttttgtaatctgtgataactcatgcttctgctgctcaggataaatgtgtttgtttttgtacatgttttgtcccggtttgtcacgccttttaaatgcaaatcatttcactggggcacgggggaatgggccagtgggggg

SEQ ID NO: 18047 - DNA, 990 bp, Heterodera glycines
  misc_feature (417)..(417): n is a, c, g, or t
tgcacggaactaactctgacatattacccacctatctttatcagtatacgttccgtcggttccatggaaatgcaaaaaatttccaaaatattctcggaagaaattcgataccaatatccactataattgtggctttacattgtgtatttcaattttaggctcgacagtttgaaaaataaaaattggactcaaacttttattaaaaaatcattgggactcataaaaaaatgattggactcataaatttttataggactcataaatatttgattgggactcataaaactcgatgggactcataaaagtcagattggactcataaaactcgattggactcataaagtgcactaaagccgaattccgttggttttcggggtcgctgatcactaaaaaatttataaaaaattgcataatggnaacttaatttttttttaagggaaattaatattggggtctttttttgtcgaaaaaagcatgtaaaacgttcaaattcccaaaaaaaaaaaaaaaaatttacggatgacacgccccaattcatcgatgaacagcaacagttgctggtacttgctgcccggcatgttctggtgcggcgcgctcacatggtattggggtaatgaagcggtgcccacggaaggggcgacgacagcggaagaagaaacttcaacgagaaacaaattatgagagcccagcaggtcgaagcaagcctaagccagtcctagcctaatgaatttttattattttcctaggggggagggggtagcaaaacggtggtacttgtgggttttgtgtcaacaaaaaaaaatttttttttttgttaaatttatttgaaatttataaaaagttgtttctataggttatcggtgccgtagaatccgaatctgatatccatttcgaaccccgaactcggattcgaacaaaaaaatcgaaaatccaaatttttaaaattttctcctaattatgattatcagcgcaagaaattatattgccgtt

SEQ ID NO: 18048 - DNA, 2297 bp, Heterodera glycines
  misc_feature (54)..(54): n is a, c, g, or t
  misc_feature (79)..(79): n is a, c, g, or t
  misc_feature (89)..(90): n is a, c, g, or t
  misc_feature (95)..(95): n is a, c, g, or t
  misc_feature (145)..(145): n is a, c, g, or t
ctgaagcgcgtgcgcatttgaaaaggtggcaaagcggcggttccatccggtcgnctgattgtgagcccacttggcacanatgccaaccnnggaangatggacctgtgcaaatggagttggagaatttccaaaaaaattcaacatnttcaaaattttcattttaaaagtgaaaatggacctgtgcaaatgagaatttccaaaaaaaaaaaatttcaacaaatttccaaaatttttcatttttatgtgaaaaaaggtgtgcaaaattttgaccaagggacctttcaataacgaggtgacgaaggacattaaatttttaaaatttgccacctttaatttttagcgtattagagatattaaattttctaaactttgttcccattttcttaatttttttcgggtatttcaatattgaggtgacgagggacaataaattttcaaaaaaattcctcattttcttaaatctttttttaggaaattccaataaacgaaggctgtgccaagagagagttaggctttcatgtcgttatttaatttttttttaaatttacacgagctggtatgccaagctcagtgcaccgctggaaattggacaactgtttctgaatgagttcggcctccaaaatttgcagttcaattttctgtttgttccaatcaaaatgtgccaagttttgctgctgctgcagctcttcatcattcaaaatgtcgtcctccaccgattgactacgctttaaaatggacaatttaaatattataaaatttaaaaattcatttaaattgcttttatgccagacagtgtatggcaaagatggcacggaatttcgaaatttttggtgtcggaatcggaaatactactgggcctcggaattccgacttccgaaaaatttttgggcctctgcctctgaatttcgatttcccaaagtattttgtggccttggaatatcatccctggtatttggctaggcgattcattcaaatttgtgagctactattatgatccaaggacgtcttttctaaatttgtttcaaatatcagaggggtaattaaacaaaagtttctcaatttttttttttggttttttcggacacatttttccaccctccccatgctggtttttttttcattttttccaattattatgccttcaaaatttcgataggaccattttctgttgtgctgatgttgatggcatcatttccgtggtcgtaacccggcgtcgaaatgggataacaattggcgtccgttcttccactaacgcagtgccaaccgcctccggcatcattccgtcaaaaatgccctcttgcgaatggtcaaaaatgcctgattcggcaaccaactggtgcaatttgctgtgctctttaaaaaattttccattattttttgtataaaaatgccatttcgaactaagttttccacaccatcctggcgggggatgtaaaaactccgtgtatccaaaaatcgtcacccggacgcttttttagactgtaaaatttgaaaaaaaaaaattcaataaggtacctcggcaacccccctccccccctaaataaagcccccttcctctgcccatcgctcgctcccgccccccattttttttttgaattaacaaaaagcgagtacattgaggcctttaattttttgcattaagatatcccgtttaaaaaaaaaaaaaaaaattaaaatcggcccaaattttttagagttggaaaaattgaggccctagtttttttttttgcattaaaatatcttatgcttgttcggcttttggtgctcaattctttggcacagatgaggcaccggactttggccaccaatgtgccatctctgacaatttgctcaaaacatttggcatatttgccgcccccgtgccatggaatcgcttcctttccctcctcttcctcctcatcattatcattatcaccatcattgttgttgatggtggtggtggaaatgaacaattcattgtcacttccatcctcaaaatcggaaaatttgccaccaccttccgccgctgaggttgccgattgctgcaatttctgattggtgtggtgcactgtaaaggggaggggggctcttatatggtttgtcccccaaaatttaaaaaacatatataatttttatagagtcggataaaacacttttccttaggttttcggggtcgccaatcacgaattcggcatctgttttgacccattcctagctccgaattcgaattgaatctctttgtgcaaaaaaaaaaaattgaatttagttgaaaattgagtttttgactttttgttcgaactcgggttcggagttcgaaa

SEQ ID NO: 18049 - DNA, 1675 bp, Heterodera glycines
ccgatcactttttggccatatcttctattgctgatcactttttggcccagcgactgatcaatcgctgactgtcattggccgatcactttgatttgattaaaaagaaccacaatattaatgacaacggagggagcagcaggttgtggcaaaatggttggggctgagcatgaaaattggcaccgccaattgaagatgaacagcacaaattggttgaggagaaggaggaagacaatgatgatgataaggatgacaataatccgcaaccaaatggtactgatcaggcgctgaatcggccatcgccgactgatcgccccaaaaagataatgcaaatgggggcggcggtggcacggcagatggtgccagcagaagctcatcaacttcggcagtcgttgagcggggttcgctttttggttggggacaccttccacccagagagaaattcgaaaataaattttaaaaatttcataggaaaatctttcttttttttcttattcgtcttagtttttccaaccgtgctatttttcagatgtaacaatgtaacacaggcttgaaaataatttgcttaaatggcaaatttatggattttgagggcaaaatttgaaaaaaatctatgaaatttaatgcttgttggggaaattgtttggaaatattagtgaaatttaaagaaaatgccttaaatttttagtttccttttcttttaaatttaagtctgagggctctttctattcccaaatatttggctcaaatttcatttctttagggcaaaaggaggccaaatttctcagctttttggagcagttcacactgagcacaatgtcccgcatttttggccgtttcgtcggcacttatcccatcgcatttctgatctcctcactgatctttgcctcgctgtcaggttgagcaaagttacaaaaaatggaggccgaaattcagaaaaatattgatcatggccctgtcttcacttgctgatcactttttggcccagcgactgatcaattgctgactgatcgctggccgatcactttgatttaatcaataaaaacaaccacaccattaatcacaacgatgggagcagcagcaggtggtgcaaaatggttgggcatgagaatgacaataatcagcaaccaaatggtagtgatcaggcgctgaatcggccatcgccggctgatcgccgccacccaaccgcccaatcgtcccaaaaagatggcgcaaatgggggcggcggaaggcaatcgcgcgcagttggcgctaaagcagatggtgccggcagcagttcatcaacatcgtcctcaacttcggcagtcgttgagcggggttcgctttttgccgaaatggccaatttgtggattttgagggcaaagattgaaaaaatgcctgtggaaattaatgcttacctgggaatttttggaaattttgagtgaatttttttttaatgctaaattttctaaaactgccctttccaatacaattctaaatgtttccaacattttttgttaataataaatcattaaagtccatttttcccgaaataattggctcaaatttcatttctttaggcccaaagacggccaaatttctcagcattttggagcagttcacactgtgcacaatgtcccgcatttttggccgttttgtcggcacttatcccatcgcatttctgatcttctcactgatc

SEQ ID NO: 18050 - DNA, 2272 bp, Heterodera glycines
tatattaatatttaagaataagcatttaatttcttccccctgatgaaagtatttcgttctaaataataaagcatttttaaattgttatatattttgtatcttcaatatgccttgctttaatttctgtatttaatttatttttcttttgaactgtaaatcataaataaagtacatttttttctaatgttaaatctccatcagtaaaatgttagattggacgaagcttattcctgtagtctcctgctgcttggtttgtgatttttcgaatttctattccgtccatttggtggaactaaaatttaaaatctgacttttcccttttcttatatttttgcaatttatattttgttagaatttaatttatacttttattttttatcattagtttaaagactattaattagttttattttaattttttgattagcacttacaatttagctgtatctgtttattctaattttttcgcatatcaaaaaattatttttttaaataaataaaacgttcctgatgcgctgtgggtgcggtaagaagtgcagggtgcccatgtgacgggtactattaagttcattttgttgattttagatttttattatttaattatgactaagtaaggttcgtttcaacgtatggagataatgaataacatatatattacatatttagcaataaataatcgtttctgataattaatatctaaattttatttaaatattctgtgtttttttatcataataatttattaattttattgattttgtatttagtatattctgtttatattattatttttccacgtaaaaacaaacgcctttttcaatttgcaattaagagattattataaatttattaaaaattttaataaacaggattttattatttagcggctaaaaaaaaaaggttaggttatttagcatatttttctcagtttataattgaatcagtttacgtgtgttattattctttgttgtttgaatttgcattaaaaacaacgacggatctcattttcattttaaaatgggggtataagtcatttgggagagcattacaaaggttttggcatttttattacagattttgatttatattatgaaaagattttacatattgagtgagaatataatatatttttattaaaatttcattttgtccaattataccatatttatattcttgagcattgtctgtgtaattgaattgcagtgcattgcttttcttattatagattaataggattattttcggagaaatatgcttggttataatttattgctaaactttttaatagctatttatttatttagtttaaaattttttaagaattaaatttatcatctgaaaattaattcatctgaataacctcaattttttttacagtagaaatttactaaactgtctttttatatgttttatcaaatataagcataaattgtagacatttatccaagtgaaataacgccggaatatactttattcaccacctcaaacttgggtaattaaacccgcacgaaaagggcggcacaacacaaatagtgacatcaaagaaatgaacaatgggcaaaaagaacagacatgatggacattacttttccattcggttaaatgttaatttacgttttattattaatgtgtttaagcgattttccattgaatcaatcacttttaattatttcttgcgcttaccatccctcgcctttttccttcaaaaaatattttattattcatttacgaattaaaattttgtgattcctttatctcaaatttttattaaacattttttgtgtttttattttatttttcccttttttatttttaaggtttttattatttttgcgtcgttgcgacaaatataattattatttaattgtgtcgtattgattttttatgacaaattgatttatatgataagattttatatattgaacaaataatatatttaattttattgtaagcacatcacttattttttattgatattatcatttattattactattttcttgatatcttaatttttataaaattgctaagcatgtatatctattttttctatagaactgataattttgtttgtttttctttgaaaatatgttttataaataaatcgcaggaaatcatttcgttttagtcgaatagaaaattttttggtttgctttatcaatttaaattgtcaaaagccaaaaaaaatgacctgaaaagtattggtaccggctttttaccattaccgataaccgcgcaaccccacggaaacaaaccgagaatttaggataaa

SEQ ID NO: 18051 - DNA, 1691 bp, Heterodera glycines
tgcagtgcaaacattcgtttctctctctgtcacttatacaatccatgattaggcatcagattgatatttatggaaaagtccggatttttacaaaaaactgagcgtgtaaacaaacctagtttagattagggtcggccgggtccgggtagcaaaaatcggatccgggtattgcgggtccagaaaaaccgggtccgagtccggtccaagtttttcaaccgggtccgggtatagggtcctaaaaaatacaaaatttcctttttttcatatttatttccatgaaaataaaagcttatacttaaaaatactgtatatgtatatgaaaaatattataatttaaaaatactcccgactatttgtcataatcttcaacaaactccatgtggttataacatatataactagcgggtgtgtgcatgcgagggtggcgcttgggaaagcgctgcgcgcttcttgagcttcgctacctaggcgcgttttagtctgttagggtctttgcgtcagccgacatgcacttggtttcctccaataattggagttgacacatcgcataatgcaatggaaaccggaagtgccctaacgttgcacatcatggccctcctccctcccttagtccaggcgttggcacgttattgggttgagcgctaaatggcaattcacctgtaggccctaaagagggctgaccggtccatgtcccggatccaagcttctcaccattttcgcacccaacatagtgcagatgggaatgggattggcatctctccaaaaaccatgtgcccaactgctctggactaagccatttattgtaacttgagcatattagtagctacaatattcagcactttggctcggccttgggcatcaatttcccggttgggagcatgaacacggacattgtttccgtctgttgcccgagagaaggccgtatacaattgaccgtgggaaaatacttccctttccagatcaatgccgacagtgcggattgtttggccctgacctttttgaatggtcatagcgaatgcaggctttattgggaactgcaaacgctcatattttatgccgccaggcgatttgtcttcatagacatttcgtgttctttcaagaaagaatctcacttggccgccaatagcattgctattgataacacgaccaatgaggcgatcatcgccaagttcttccagaactatgcgtgtgccattgatcagtccttccttatcacttttattgataagaaggacgacgacgcatccgactttaagccggagactgtgcgggggcatgcccgagtctgtgcgccggttcaacgcagccacttcggactcgatctcatcgatgtccagtgggcggtcgtcaaggggcttatccgtggacaagtattcccgcacttgacctggcacattcgccatcatgatctcgttgacttcatcacacgtgtcaatgtgcggagcgagaatcaaacgattgagcagctctttgtcattgccaaggagttgttggaagttaggatagacataatctatcagctcttccttgctcttaacgaggaacggcggaggaatccagaagtgctctccggtttctccgagcccgatttggcggcacatttgcaagtacgcttgctgaccttggcccagtctctggttgatggtcaatttcatcgtggtgaattgaccaaacaacggagacgtttgaaa

SEQ ID NO: 18052 - DNA, 2832 bp, Heterodera glycines
gtcagctgaggaacgtgccatgctcaccgagcaaaccgtcatcaaactcccggtaaaggacagcccaattgttttgattcaccagggagaagaagcggaaccggacgagttgtcacgttcgacctcaaaccgtgcgcaaacaccgcaatgttcgtcctttggcgattggcaagggcagtgccacaggaaaccatcattcgctgcatctgcctctacaccgcgcaaatgctggaagtggcacgcctcgtccgagaccagggactcagcaatgtgctcgtcaccactgcggacgccacccaggggcacgaatcagccttggcggtggtgattacgacagtgtcgcgaaacaccgtcgacacgaacaacgaccaacccttttgggccatgccgaacagaatcaatgtagcgctctcccgcgctggccacgggttagtggtaattggaaatctgttggttctttgcagaacacctgcctggcgccggttcatcgacgaggcagtgcgtgagacaactgtggtcggccctgactacgtccatgccattcgacaacccaactgccaacacgatgaccgcgggcgtcttgtgctcgaaggggacggaatggtgaggtcagaggagttttatgcccgatggagaggtaatgagggccgacgatcaggtaattcccgctcaggggaccgaagggagaataggtttaatccttattcagttcagggaaactcgcgcggcggtggtggcggcggcggcgatcggcggtcaaatcgacgatgaatgatggagaaaattcgctgaatggatgatccgcggcgctggcgtttttccttcctcccgtccctctccctcaattatgtacatttcattctcccatttcctaattgtctttcctctgttaatttctaaaattgttgcctctcaatttcttacttttgtactggaatttcggctgcctttttctctattttctctctcaatctgggcaccattcctatacagctctctcaaatcggcactttcttctttggcaccgattcatcgcactactctgggacggaatgagctctggttgatttcctccagcccctcaggccaagactgatcaaaatcttgatcggctggcgcgcaggtggttggattgggaaccgaagggcaaagacgttctcggactggcgcacattcatcaacattcatcgaggatcgcggacgatcctatggaaggggggagctgtaagggatttgcccacccccaaaaaacaattttcatttccctcatcagccggactttccatctttccatttatcgcttttcttatctccttcatcaccgccccttttccattcctttcacttttcctttccccagcgatcagttagtcgtcggagtcatcggatttacgatcgatcaactaattcacttttctcatatcgtccgtccatggaatacttcgatcacatattttatccggagaataaattactcttttaacatcgaggcaatttgggggatttaaccatcgatccctgggcccgggattcgtcctcccaaatcggcctccccatttattcgaaagcggtgagtcgtctgggggacccacgcgcctccctcactctatttattatatttatttgtgtggaataaatcactatttcttccttgactgttgaacggacacaacaggggggatttgagagcatgcgatgctgaaatggtgtcctttcattgaatgatgcatcgtgagggagggatggccactcggtggaattgtttggagttcgtaaatggagtgacctcaatgggggggggggttgagtgacctgatgagagggggattgatttctggtgagtacgagtgtggtctccccattttcatgattttcttttttgcattttacaaatattccgcttcccccattaaatttcttttattagaatgaaaaaatagacgaaataccaagtaatttacgtttaaaaacaaaaagggtcgtgtttcaactggcatgtcacagtatttatgcccaaaatgctgtaattttcttttctttaaatctttaattttttaaaatgattttttcccatttcagtcaccaaggcttcgtccagcagacagaccttcatccgtcgcccatccacacggcgccagcgcgtagtcacatccagttcaaaactggtacaattcccgcaatgtcacgtgtgggtggaggcactgttttttttgtagcaacaacagaacgatgaggaaacagacagtccaatggtgaaatgtttttaaattaaaaaatgatcaatgatcacattatgtgtaaattatttttataatgagtgatttccaaaaaatgaaataagtttttttggtgttttagcaacgccctcttccgccgcttttcaaaaaggctggcggcaagcgattggtgactgaagaagatgctgacattggagtgaactccgacgtcaaatttggagctggagaagccgatgagtaatcggatcaccccaaaaaggaggggtgtttaaagaccaatcatctcaaaggaggggggatacaaaaatattatgttataattttacatttttgcgacgacaacatcattttgtctgctctaatgctttttgctattgttgtccccaatgccattttctctctgatcgacgtaactcgttcaatggcttcgaaattgttgccattgacggaatgaatttgccataatacccaaccattcccaaaaaggatggcaactccttaaaattttgggggactggcattttctgaatggcttccaccttttccggcgacgtttgaatccgttctttgtcgatgatgtgccccaaataagcta

SEQ ID NO: 18053 - DNA, 1339 bp, Heterodera glycines
  misc_feature (11)..(12): n is a, c, g, or t
  misc_feature (40)..(40): n is a, c, g, or t
  misc_feature (62)..(62): n is a, c, g, or t
  misc_feature (68)..(69): n is a, c, g, or t
  misc_feature (80)..(80): n is a, c, g, or t
gagcatatgannttaaatgagtggaaattttttaaccaanttagcagaccccaacaccttancagcgnntgattctttcntgaacctcaaggggtggaattaactcgaatttaactcgagccccaccccccccccacccgcatcaagaacatgagtctgcttatgactgagctaatagcttcaattcctctgtccaagacagcatcaacaaaatttttatgctttttctttcttcttgtgtccttattgcttagcaattggtcaagttatggcggcgatcccaatttttgttgggtcagatgttccagcagctttcgcgaaagtttaatttctcaactcataaacaaaaatgtttgcgaacttttacggttaagctataaaaactgtgaatgtaaaccaatgtatttctgaatatttcgctttgaacttcctttcctcacagtttgtttgattacctttctgtccctttcattcctttgtgttccattcgtttaatatgaaattttctttcgtttattttaaaggaagttttcatcgattcctgcacacaacgccacgccatttttattatagcatccacatccatttcattgctctcactccatttgcccctcccattcattacatttgcgctacaatcgatatttcctccgcctcttcaattttgtttacccagttcgcgccagtcattttccagccaaattaaaaattcggcgctactttaaaagtggccgtttttggaaatttttttcaaaatttttaatgtcataaaaacagtttcctgggcttttcgatgtcgctgatcacgaatccggcatccatttcggccaattcgaaatcccggacccgaattcgaacaaaaagtcaaaaatccaaattcgaattttgcatatttcgtctaaaattggttgcattgtaattataattttaatgattgatcttgttaattttaataaaaaaatttaaaaaaatgtgtaaaaaaaaattttgaaaaaatttccaaaaacggccacttttaaagtagcgccaaaaaatctatatattgcgtatttcgacacattcatttttcatttacagcttaattttaatctcacatcccttcttttcccctttagacgcgtccctctcgcgttcacctccccatttccctctcttactttcaccctgccctttcctcgtccccactctccacccctcctacgccaccgcctcctactcattgcccctccccttccctccattttccactcacccctcttccccactgctcccaccctttgcccctccccctatttccactcacccctcttccccactgctcccaccctttggccctccc

SEQ ID NO: 18054 - DNA, 1692 bp, Heterodera glycines
  misc_feature (1049)..(1049): n is a, c, g, or t
  misc_feature (1065)..(1065): n is a, c, g, or t
  misc_feature (1098)..(1098): n is a, c, g, or t
  misc_feature (1105)..(1105): n is a, c, g, or t
  misc_feature (1114)..(1114): n is a, c, g, or t
  misc_feature (1170)..(1170): n is a, c, g, or t
  misc_feature (1172)..(1172): n is a, c, g, or t
  misc_feature (1193)..(1193): n is a, c, g, or t
  misc_feature (1238)..(1238): n is a, c, g, or t
  misc_feature (1243)..(1243): n is a, c, g, or t
  misc_feature (1261)..(1262): n is a, c, g, or t
  misc_feature (1280)..(1280): n is a, c, g, or t
  misc_feature (1286)..(1286): n is a, c, g, or t
  misc_feature (1296)..(1296): n is a, c, g, or t
  misc_feature (1326)..(1326): n is a, c, g, or t
  misc_feature (1350)..(1350): n is a, c, g, or t
  misc_feature (1356)..(1356): n is a, c, g, or t
  misc_feature (1383)..(1383): n is a, c, g, or t
  misc_feature (1405)..(1405): n is a, c, g, or t
  misc_feature (1415)..(1415): n is a, c, g, or t
  misc_feature (1426)..(1426): n is a, c, g, or t
  misc_feature (1430)..(1430): n is a, c, g, or t
  misc_feature (1441)..(1441): n is a, c, g, or t
  misc_feature (1449)..(1449): n is a, c, g, or t
  misc_feature (1452)..(1452): n is a, c, g, or t
  misc_feature (1454)..(1454): n is a, c, g, or t
  misc_feature (1465)..(1465): n is a, c, g, or t
  misc_feature (1476)..(1477): n is a, c, g, or t
  misc_feature (1480)..(1480): n is a, c, g, or t
  misc_feature (1486)..(1487): n is a, c, g, or t
  misc_feature (1489)..(1489): n is a, c, g, or t
  misc_feature (1542)..(1542): n is a, c, g, or t
  misc_feature (1550)..(1550): n is a, c, g, or t
  misc_feature (1555)..(1556): n is a, c, g, or t
  misc_feature (1562)..(1562): n is a, c, g, or t
  misc_feature (1565)..(1565): n is a, c, g, or t
  misc_feature (1576)..(1576): n is a, c, g, or t
  misc_feature (1581)..(1581): n is a, c, g, or t
  misc_feature (1585)..(1585): n is a, c, g, or t
  misc_feature (1590)..(1590): n is a, c, g, or t
  misc_feature (1602)..(1602): n is a, c, g, or t
  misc_feature (1617)..(1618): n is a, c, g, or t
  misc_feature (1622)..(1622): n is a, c, g, or t
  misc_feature (1625)..(1625): n is a, c, g, or t
  misc_feature (1632)..(1633): n is a, c, g, or t
  misc_feature (1635)..(1635): n is a, c, g, or t
  misc_feature (1638)..(1638): n is a, c, g, or t
ggagcagatgttggaggacgaggaaagagagaaggcggcggggggtgccgaaggtgaacagatcgccaaaggtgggcactatgatcactcagcagcaggcagaggtataattagtgttaatgcgcgattggaaaacgtcaaaagggtcgatcagagggggagtggggagggacggggattgccaaactgatcagcaaaattgcccaattacctaattacaaaatgcaacagatgctaactcaactgtctgtggcactgtgcattcgcaatttgttgaggcatttcaccagacaattgtcgccactgaaacaatgccaacggagctaatcgaagagaaaagtcagctgaagcgaaaggatgtgccaaatccggaagatctctcatatcaaatcgacgcacgcgacgaggaattgtcaaaaagtttgccggcggcacaaacggacggcactttgacgtccaccgaatgcgatgccaacacctccatcacaactccgtccatttcggccgacctttgggcggccgcgcaacaacttagcacctcactgcataataacaataaaacctctgccgtcgcatatggaaaaacgtcaaatttggaagtgaatttgccggcacttcctccgattgtttgtggacaatttgtcatcgcactgcttgaactacccgaacgggtgtttcccatttatgtcgacgaacattccgtgccttggcattggttgcacgccgccaaaaacgaaaagcaggcgaccgatggccatgagaagcgattgatcggcaacgaatcggaggaagttcgtttgtttggcaaaatatcccatgttttacctttgctttctgaagagactgttcttcgactgtgccattgataagctctgtcccttccgtgccgtttgggtgcgcgagcgttcggccgtttatcaaagccaaggccacgcccactccccgctgttatctccccagggattgaccgttcaaaacgctccgatcactcccgaccgcgctcatctccttctaccgatcagtgaaaacgctccgatcactcccgaccnctctcatcctcttctntctcctcaacgatcaatcaacgtctcttctcanatcactnatcaatcgntgtgtttctccaataatatcatttttactccaatctctccccatttccaattaaantnccattctcaacttcctatcantacattaatccataatccatccccaaataacatcaatatttcttncccantctcttccatctcttcanntattaacaaaaacctcanccaaanaacccctttnaattatttccccaattttaaaataatttanacacaatttcttttaccacttccnctattnaatatcactttttcccccatcttaatnaatccaattttcactccatttncttccaattntctatcaatcntcantcaattttcanaaccaacnacncncttccaattcnctatctttacnnttntattcnncnaaaacctccctttaatttctttctcattaacacaaatcaacaaatttaattanttctattnctttnntttcanttntctcttccctnccctnttcntcccntaccacaattcnattttcaaaggatcnncccncanccattcnntnccnttcaccactcaggaggacggactggctcagagaatacaatacacagcagaagaa

SEQ ID NO: 18055 - DNA, 1780 bp, Heterodera glycines
aaaaattttggcttgcggtcacataatgggaaagtacagttttttctcaccgtataggaatttttcccagtggtgaaatgtgtgcacacagcggaaatgtgcgggatgaatcgaatgcattcggcaaaagttttggaccaacgaccgcacgagtacatcttcgcttacgcgtctgtactgcaattgcatccgtttcaaatgggtcaattcgtcaaagatggctttctcgtgaatgtatcggcgggcgatcgaagaacgcggcgcgtgttgctcggtgggggagggctcggcttaacgggaagaagtgccaggtcggtttggactcgacttctccaagttccacccaccgaattcggccatccttccgatgggctgctgattatgcggcatcggtgggtacagtccctgctcgagaatgtgcagttcggtcactcccacttcttcttctcccctttcttccgctctttctgtccccctcggcgtcattcttctccgaattcgctttccttctgtgccgccctcctcaattttgtgctgcacttttttcacaagctctttttcactgtctgctcaatggaaaaagttgagtgattggacgggcactgacttttcttgccgttctctccgttcgtttgaccgtccgtttgtgccgttctttccctcgccgagtgtttggcacggaacttggctgtcacattgtgctgttttcgcataatgttctgctggtgttctctgtcctcttcctcagcttcttcgtcctctttctctctcgcactctctccattccctgcactttctgcgtgtccctgccctcctctccaagtttccccttgtctctctttcccaacttccctcactttccgcagttcttccttgacgatgcgttgtatcgtttgttctatctctgctcttccggctctgtcctgtgcctcttctcttttctgtccttcctccttctgctgattgaatgtctttgccattttctgagtgttcgttgttgccatttgtgccaaatctgtcgtgctcgttgctctcggcacttttttcttgaagtaaaacgaccccgaggcggaggaggagcgacgctgaacggttttgtgactgctgttgtttccttccagcgctcaccgacatcgtcgtgctcgcgtcgaccatttcccgaccggcggtgcccttctcccaaaacgaattgcccctccgcagcagtgacagcgcttcatcgcctgccatctcttcgtcttccgtcagttcaattcgcgttttgcgcactttggctgaatccgtctcagtgatttggtcggccaatctccgccccccccccacggcactcttttccatttgctgctcaatgattttccgctgaatgtttctgtcctccgacggaacatcgtcagcagataatgcaccgcaagttccgatcaaatattcaatgatcagtttgttcccgcgccgttttgcgacatccaacggagtaagcaattggccctgtgttccgatcacttcgagttggtttttgctcggccatccgccccttttctgatcagtcgcttagttttattttctctgaccttgttcatcatcaaagcattggttggtgcgccgtgaatgcacaacaaatccaccaattctttgctccccttggaagccgctaaatgcaacgaaattcgaccgcaaaaatttggtgccgaaacgaaattagggtcaatgtcgagaaaccactcgacaacttcttaattttttaatgggtttttttttacaattttcaatattatttgtactg

SEQ ID NO: 18056 - DNA, 2099 bp, Heterodera glycines
agtaatttttgaaaggatcgcaccccatcgaatatttccttatttttttttaataactgtccaaagggtgactgtgtcattggttctcctgtagtccttaaggtacttggactttccacagtaaaatgtggtacaaattttggaactgtcctccctcacggcgggacttaaaagcagggtaaagccaagttcaaaacttcagagatttatttgttctaaattttatagtttaatttcttagagtcaaaaaatttcggaaccaatttttaaaacgaaacagtgcacaaaaagagaggggggggggggtagaagacgagagtaattttttgaaaggatcgcaccccatcgaatatttccctatttctttttaataactgtccaaaggtgactgcgttcgttgacaagtaattgtccaattaaggtacttggactctccgcagtaaaatgtggtacaaattttggaactgtcccgcctcacggtgggacttaaaagcatggtgaagtgaaattacaaatcttcagagtattttgtttcgaatttttgcaattaatttcaaaatgccaaaaaattcggaaccaattttagaaacgaaacagtgcacaaaaagcgagggagggtagacgacgagagtaattttttgaaaggatcgcaccccatcgaatatttccttatttctttttaataactgtccaaaggtgactgcgtcattggctctcctgtagtccttaaggtacttggactttccacagtaaaatgtggtacaaattttggaactgtcccgcctcacggtgggacttaaaagcagggtaaagccaagttaaaaacttcagtggagaatttttagttttgaatttttacaatttaattacttaaagccaaaaaatttcggaaccaatttttaaaacgaaacagtgcacaaaaagaggggggggggtagaagacgtgagtaattttttgaaaggatcgcaccccatcgaatatttccttatttctttttaataactgtccaaaggtgactgcgtcattggctcttctgtagtccttaaggtacttggactttccacagtaaaatgtggtacaaattttggaactgtcccgcctcacggtgggacttaaaagcagggtaaagccaagttcaaaacttcagaggaaaatttttagttttgaatttttacaatttaattacttaaagccaaaagattcgaaacagaagcattatttaaatcaaaaataattattaaattttttacattttagtttcaaaaaaacaaacaaaaaatgttcccaattttgaaaatgaaatagagcacaaaaaggtgggatggttagacgaaaagagaaatttttaggaagggacgcaccccatctgatatccacccttttctgttccataagaggccaaaggcgactgtgttcgttgacaagtaattgtccaattaaggtacttggactttccacagtaaaatgtggtacaaattttggaactgtcccgcctcacggtgggacttaaaagcatggtgaagtgaaattacaaatcttcagagtattttgtttcgaatttttgcaattaatttcaaaatgccaaaaaattcggaaccaattttagaaacgaaacagtgcacaaaaagcgagggagggtagacgacgagagtaattttttgaaaggatcgcaccccatcgaatatttccttatttctttttaataactgtccaaaggtgactgcgtcattggctcttctgtagtccttaaggtacttggactttccacagtaaaatgtggtacaaattttggaactgtcccgcctcacggtgggacttaaaagcagggtaaagccaagttaaaaacttcagtggagaatttttagttttgaatttttacaatttaattacttaaagccaaaagattcgaaacagaagcattatttaaatcaaaaataattattaaattttttacattttagtttcaaaaaaacatacaaaaaaatgttcccaattttgaaaatgaaatagagcacaaaaaggtgggatggttagacgaaaagagaaatttttaggaagggacgcaccccatctgatatccacccttttctgttccata

SEQ ID NO: 18057 - DNA, 1325 bp, Heterodera glycines
  misc_feature (1215)..(1215): n is a, c, g, or t
  misc_feature (1246)..(1246): n is a, c, g, or t
tttgttcaagagcaaactgatcagagtctgtggccttctaaccgtgttattttgtcagcattttgttcctttccaccctccacttttacgccgggcaacagttttccgctctccatcaatgcgatgctatgcggcgcacccttttccaccagcgtcacgcggtcgttgcgcaacgcacgagcgtccacatagacaacggtggggtcggggctggccgcgccttgcatgcccacggccgggttcacgcgacagccaaacgaagtgctcaccgcccggggcgacagaccgagcggcgcgaacactttgatgaacgcgttgcacaactgcacgcggggacgctcctctgccacaacaacgcaattgcgcagactgtacgaggagaacagaacaataggcaatgaacaaaccgaacaaattgaaataaccccgcccctcgccctatttgatgttttatcatttttctgtctccccaccacaccttgacagattgacgcttttctccctcagctgtcccacttgggtcgccagctccttcaggcaaagttccaggacggaatacgtgcaaaaagtgtccctgcttcggtgctgactcagcgtctgcatccacaccagtgggttctgctccaactccagcggagggatcagaatgctctgatgaccggaatagacactgaacgaaggtacaattaaacggggaacgaaacgaacgcacattggaaaatgccaataaaaagcacctgcaaagacaccacaaagtgaagccgagtccggagtaagggtccaggcagacggtgacagtccgggaagggtatagttcgcaggccattttcagacttttgcactgtttcgcggcaccaacagcagtaacaacaatgcccgagagttgtccagtggtgctgacagcaaagtcctaaaaaaggggacgcattagtagcagttttacaaaggcaatttaaaattgaattgatgaaatgccaaccaaatagaaaatgtcgtcgggctgtcgtgcgatggacggctcaacagcagcggtagagctgcccgccttccgcactttgctgcgcgccacggacagcgacggggcgtcctcaatgtccaaaatggtgggccatgccttggcgttgacgcggtgagacagctctttgctgcgcagcagtttgatcagagtgccgttggagagcagtgcaacagccttgctcacatcgatgatcttanaatggaaagataatgcaacaatcgaatgaanaggggtattatcagtcatcatgcatgaaatatttttattttacatcatcctattttttatgaccattcgaacggtgagc

SEQ ID NO: 18058 - DNA, 2179 bp, Heterodera glycines
gcacggtaacgaagtatttcggcaaaattgacgcattcactggcggacgatggcaactctttgccttgggcgcccgcaatgcgcacgccttggacaatgttgccaacgaacatcgccgcagggcccacttccgctggtggttcacgaggtttgggcaggttcagcacgcaattctgcggacacatcagcagcgttgacgggtgtaaacatccgtccagaaaacgtctgcgcgtctccgtgacgtaaatgccgccgagagaagtcttaagaggaataattggttaattatttaaatgggcgagttgcttttgcctttggcaaatggttaggcggcacgagagcaagacaataaatgcccaattggtgaatggattcgcacgcctgcagcacgcgcaccatccaattgaacgcctcctcctcgctgatctccgcacgctgctcgcacacaatgcacacgcgttcgtcgcgcagaacgctgacgctgaacacggcgatgcggccccggtagacgaacttcatcggctcaacagccagcacggtggcaatcaactgaaaacattttcatggcataaaaaaaatcattcggtctttggctatcttaaaaaacgaaagaatcctaaatttaaaatagtataatgagtgttaatttattattacatcgtccgcactgtgcacacgtccggacacgtgcagaagcgactgtttgcagccgaccgtgaagatgagtccctcggggccgagaaagccggccaatccggaccgaacgtactccagcggaccaatgggtttgtcgtcggagccgagcggcagcacagcaaatgtgttttgggagagccctttgaggccgtggtagcaaacggcggcggacggtgcgtgcagacaaatctcgccgacttcgtccgctcggcacaaccgcggcgcaccgcacaatttgacgacaacggccattcctccgggaattacttggccagtgtcctgaagatgagagaacaaatgagataatggtagtgcatttattatgaatttgtgattccttccaagcaaatttatcccccacaagatttgttgatgaccccttcccattgctcacccttgaaaaaccagaaattccaaagaaaatgcgcaaaaaatccgttttttttaattcaacagacaccgacttggagtgtgagcgaagtcagtgagttctcctggtccacacggaccacgcaatggcttagggccaacattgagagcactccgcgaccgctggtggaacaatttgtcgttgttgtgccgccgccattgcgtgcaactgcgacctgttcgggatggctgggccgacgcatggccacaatgccagtctcggcagagccggcgcatggacaaagtgcaccgggccaaatgccgtgcgatttgaaggtgacgatgaactgatcgcacgaggacagagaccaagggttagcaccatccgccacctttgggaagggggttagaaaaaaaaagttgaacaaatccgatgggggggggggaaataattggaatcaaaaacaatgaaaaaagggtaataaagttttggtcctaacaaatatttaaccatgttcaattgcaagttttagtaattcatcataaattttttaaaaaatcgctaaaaatatattcaaaaatttttcttgaaattcgaaaaatttctaacttttgatttttgataataattttttaaattcttccggggaaaacagttcttaaaataaaatttaaaaagaattttgcaaaacttttagtgattctccattccctaccaaaaggcaacgaagtgattttagttgaatttgttgcgagtggtcgccgatcgccatcagcgaccagtgcaagtcacgggacttggcaacggaatgttgtgccgaatggcgggtgacttgggaaagccacgcggtcgggttgactttcatcagcgaatagggcacgaaatggacgcgcattccatggagaatggcaccaatcacagcgaaccaaaggcccacttcccttcggaagtcgaccacgcaaaccatcgtctcatctgagcggaaagagagataaaaagggaatgcatgggaaatcagtaaaatgacaaataactcatatatgagtcaaaatttcgagctgatacccttcagtttatgatgagagtagttttcatcgtatgtgaccttccttg

SEQ ID NO: 18059 - DNA, 3435 bp, Heterodera glycines
  misc_feature (3420)..(3420): n is a, c, g, or t
ttttgggctccagtacaattatgctggctttttcgttttagtggtctgtgagttagtcaccaaaaggggggtcccaggttcaagtcctccctatgttgtgtgttaatttcaatttcttcttttaaagaagaaggcagaattattttttcattaataaaagttttcgtggcaataaaaaatcatattcaaaaagcgttggttacgtccaacatcgacaattttatgaaatttttttagcttataacttggtgaatactagagcaaataaaaccattttatgctcattttgaagggaaaattctggagaatattgtaaattttatttggtttggccttaaattgtggacttggctaaaaaagaattaaaattattgaaaatttcacctagttgaaaaatttttccctatgttcaaattttcttcaaattttgcataggcccatagtttgaccccctttatcggatccctgtttattttatgaaagttatgtttttaactcgagatcagctcttccatttttacaagggaaaatccccggaaaattttaagttttgcaaagttttggcgttctgattactaaataaaaatccagcataattgtacttggagcccaaaattgggccgctgtgtttaaacaattaaattaattatataaatcaatgtcaatgaatttcataatacaaaaatatttaaatataaattaaaaataataatttccccgtttttgtataaggtatcatattttgtaagattcaatttaatccatgtaacatccgcttgttaagccttaagcaagccgtataaaaccatgatttattcaattctctaattttcctggttcaagaataacctcgaaaaaacaaagattttatttatttttttaaatttaagcaatattctaatttttaaaaatacttaatataattgaagagtgtaataataattatttgaatttataaatcgcataatttaatgtaattaggtattatattaatcattgagactattttcgggtcgcctacacttagtttttttttcggttcgacctagtatcattttttacaataactttttccccgtttttaagtcgtcattgaacaaatggataaaataaattggaaattacgagaaattgatcaacagaagagcaaggaaaagcaattgacagaatatttggaaagtggcgaatttaaatttgctttacaaatgagcgaaaaattcacaaaattattaccaatggtaaaacgatttaaggaaaaaacaatgaaagttgacgaatttatggaggaattggcaaatatccagcaaaatttagaagaagaattgcagagaaatgaacaaaatgaacatttgttcaatttaattacggtaattgcgcgaaattttggcggagttttcgttaaaattggcgatatacaccaaattgaaatttgttttgatggagcgcacaaaatgttgcaaaaactgtacgatttggccatagaacgattagtgaaggaaaaaaagggtgcaaatggcaatgacaaacaatttgaatgtcgtggcaatgacaggaacagttttaaagcggcaatcagagagctaacgggcggaaatacggcacagagtgccaaactattgcagtatatggacaaattcgtgccaaaaagggaagccccgtcgcatttgatcaattcattttttacgtttgcgacgcgacttgaagcatttttgtacgggaaaagcagcggcgatgccaatggagaaggagaagcggatcggcaagcagaggaggcaaaagcaacgaaaatggcacagccgaggcacagaattggcgcatttattgccgcgacgcaatgcctcggcatttcggcgacacaaatggaggagaggtaaagcaaaattggaagaaaaaactttattacacttggaaatcctgtaaagaaatgagcaagcttgaaaaaattagcctggataaagtagcaagcaaaggcttttgaaaaaggcttggacctgcataatttacctcattttcaccatttccacggaaattttgaaatcaatgctttaataaatttgttttagcatttttgactcaccaataaaagttgcaaaaatcaattcaatcgaggaaaagcgagcgccgctattcggaataataatagaaaagccgagagcagaaacggaaaagcaatggataaaagcggcgtgcaaaagtaaggcgacaagaaataaattttttttagtatttttacaaaaagatcaaattttatatttgctcgagaaaattttactaaaaataattttttcagaaaatttttcgatccttaggggtcaaaaagaccaatttaactgaaggagtgggggcccttctaatagaggctttttggaaaaatgccaaaaatggacaaatatagtaaatttggacatatcgcgaaataatatggaaaaatatagaaaaaatggatatagaaatccatccgaagcttcaaaccatgctaaaaatatgtttcaggcctcccatagaccaggaaaataaggatttccatataattgcaaccctaatgatcacgttaaaattaaaaaaaaacctgatgaatcaatgttcaaaaaaggttcaaaaatagacattaaaattttttatttaatttgaatttttaaaaataataattttagacaatttcaaaatgttgaagcaactggaagaacataaattttcgatttacgatgcaattaaattgatcagaaaaattgaccagcaaatcgaattccaccatataaagatagaaatcccagcagaagtcatcgcattggtagaacaattcggcagcgaacaaaaatatctgattggatggcacaattactctaaggatgtttacaaaaaaattcaaaaatgccaaaatgcgcggttgttgcaaaaaatcttggcacgatttattgaaaagttgcgcaaaattggcattgacccgaaagcgcagatggtctcgacggatttgagcatcggcgaaacgattcaacaaacaattaaattctattgcgaggcttagtaagaattcagacacattaataaagcatacaaataaaattcggttttttttcaaattcgataggcgaaaagattgaaattttcgagaaaaaataatttataattttgctacagagtaaccaaatttataatttttgatatcactcgagagctctaagtgttctcgattagcctgaaaaaatttttaaaaaaattcattaactttcaaaaaaaaattataagcagacaaaaaaccagggatttttaaaacattttttaaacttatatacagtgtttgtagagaattttgtgctctttctgtaagttatattcggtttccgcgtaaggtttttttcagccctctaggaatttttttcgaaaattttaaggattcaagccattttatggttttcaganttacccatgaaggac

SEQ ID NO: 18060 - DNA, 2585 bp, Heterodera glycines
aattattcaattattttatcaaaatcttttttttgttttttttcattaattccgaccccaaaaatgtcggaaaccggaagtctttccgtgccatacctggtgcctatcgacatctgcgagaaattttatgaaatttaatgcgatttgttaacagattttgtctaaaattgaccaaatgacgcagtttttgactcaatttctacaggattattaagtaaaagcctatccggcggtgccgataggcgccgccgggaaaatttcacaaattttgaatgaaatttgcgatgaaaaatgagttaactttaattaaatttattatttaatttatttaaaaatatttggcattctgtcttagaaaaatttaaaaaaaaaatcaataaaatcccgcataatcccgcacaaaaaatcaaatttgaggatcccgctgcgggattggaactcaaaattctttgcgggacgggatcccgcgagattaattttctgtttacccaccccttttttcatatgtgttcttgatttaaaaaaatatgtcttaattaatttcattaagagttctaagcttcgattctcgactcgctaatttctcgcgtttttcgcttctctcttttggtctcatggtatcccgggatttaatcaatccatgatacatattgggtcttaggtgacagggggcggatacacagtttagaaaatgagcaaaattggaactaataaatctcttccaatattttttgcatttttatcaacaacaattcaaattcactcatgcaaagtggtttttgttttagaaatacactccatgatggtaaatggataaaatgtttccggtacattttggctacggtaattcaaattatcgttctaggcagaagattcatcggtcttacaactggtgattgtgcctgcatttgagctaaaaatataatattaaataaaagcaggtgtaaattaactgttgaataattgttttttaccccattcattggcccttgcaaattctgtacgacaaattggacaagtgctatgccctgaaaacctggaagggatttcagcaaatatttttaaaaaatatgggaaattaccatgttttgaggcattcggcgtgataaaagtgcttaaacaaaagttttcaaaaagacatacagataaaaattttgaatttttatgtgcttttggattttattccaaatggctgggaaatagagaagggagaactgcacagattcgagaccagggctgcacgcaactggatttgcaattacgtaaatccgtaatccgtaattacggcgattttctcagttacggaaatccgtaatccgtaattacgggggtccaaaaaccccgtaatttcccgtaatccgcaatccgtaatccttaatttttaaaaatcaatttgtgtcagaattttagaaaaaatttttaaattgtgattaataaaaatcaaaaaactgatttttttgatggagtttcttcattttttatttcaattttacaaataatttataattttgtgtctgaaaaacccattctttttgaatttatgggttgatttttgaaaatttttgaaagtctgatcattataattggatttatgtatgtatcagggatgtgccgaatcggaatcgtaatcgtaatcggaatcgcaattaatcggattttgggccataatcggaatcggataatcgtaatcggattttgccttgaaatccgattattacacccctaagaattgaccttttgaaggaatttttttagtgagaataccaatgaattttgaaaaaaatgtttactgaaacgaatgttttaatcttattttaacataatgactgaaattaaatctttctcacaaagcagtgccggattaattctccccgatataatcaagttttttgttatttagcaaaaatgtcaaatatctgggaatattctccaccgctgtgttgattgtgaaagatctgagaaaacgtttattgcctgagaatgtggacaaacttttatttttgcatcacaatcttaaaatttatgattttgattatgaataaaatttttgggaaaaaattatttttaaaaaatcggaatcgtaatcggaatcgcaattaatcggattttgggccataatcgtaatcggcgatttaatcggaatcggattttgtctggctcggcacatccctggtatgtatataattatttcaacattttaatagtcagaaaaaaatttcggggggggggaatccgaagaatttttttggtcaaaatttgtttagattatttaaaaaaattcagcaccggagagcaaaaacaggaattgtaactatttttaaccaaaaaagactaatttttgccattttggagtcaacatttaaaaattatggtccggcggtgccgataggtgccgccgggcaaattttttttgaaaattttaatgattttattaataaaaatcgacaaaaaattttaaaaagtaagaaactttggtttttataaaaaaataatcttgcaggaaatagtctcgaaaaataatcccaaaaagccaattacggatcaaaattacggaaaaatcccaaaaatccgtaagccgtaatccg

SEQ ID NO: 18061 - DNA, 3230 bp, Heterodera glycines
  misc_feature (3175)..(3175): n is a, c, g, or t
  misc_feature (3224)..(3225): n is a, c, g, or t
taaaaatgtatacaaaaataataaaatttaatgtacacattttcgttttgttttttcattgctccctttggcatcatcagccgatcgatcaacagtcaattcgcaattttgctgtttttgttgtcactgatcagcggcagccagcagagtttaatgttgtcgtccttttttatttgctggttaaattggcgcttttggcattttatcgcagcggcgggaaaagtccaatgatggcagcctcagcttcatcagcggaagttgtacaatttggcacaaaatgttgttgaccattcattttggatggcatttgatttggtggatttaaatatggcaaaagtttcaaatttttgccatttttcacatttttccctcttttatagttaaattttgttgtcattttgtccaaaatttggcaaatgttctcactccttttactaattgcacgtgcgttcagcgatcagtcagcctttttcgcccattttcacggaaaaaacagatgaaaacattcgcgcacccaaatttactcaatttcatttattttattgcacatattttgagtaaatatgttcattaaataaagccaaaaaacattgcaattagtaattctttttccttttatttttttcggctttttgacatatgaaaaaattatgaataaaatacctaacaaataagcttctttggcggaaatttatgtaaaaatgacacgaaacaaaaaatattttcatcaaaatattattattattattataaaagctgattttttaatgaatttttgttaatgattattttaattgtttttattcatttaatttcatcatctgttcagttgaatctccaccgatgtcccgttattttgctttgataattattcctttcctatttgatataattttagttgttaaaagcgatattcaagtttgttataaaacaaataattaacaaaaatgattaattaaattattatttacttttaatggtaattaataaagaaatgcgatttaaaatttttttttgatttaggcaattgttaattaaattttctatttatgaatttatgttttatgcgtatatttttgtaagaatttattaaaatgtcagaaaatcaaatgaattaaagttaggagtttaagaccaaaaaaataaataatcatttggaattaggcgtaaaaacaataataattctattaaaaatgttaatcttgttatgagaacgttttatgaatttaatttctctcttataaaaaaatattatataagaaaatttaaaaattttaaggaggcgtcatttttgcatttaaaattgtgctcaaacattgacaattcgtttaattattcaaaatcaaaagattggcaaaaattggaggaatatgtgccgaatttattgccatatgataagcaaaaagaattttcggaatgggaaatgtgttatgaaagcatccaaaaattcattatttattgcaattttcttcaaagcagcaaaaattattattataaccgaggtaggaagaaagaattgtattttaaaaagaacaaataacaattaaattaaaaaaataaaataagattctgttaattaattacggccccgttttggctccgggaaatgcgtcagtgaaaattttactgtcacaaaaacaacttccttgagttttcaaggctattgatcatgaatccggtatccatttcggtcaattccgagccccggacctgaattcgaacaaaaaatcgaaagtccaaattttcgaatttagcatttttggttcaaaaaaggcataattgacctccttttgaagaattggtggctttcagtttgtttccgtgtattaaaacttattttgaaccaaacacactaatttcgaaaatttggactgtcgaccttttgttcgaattcgggtccggggttcgaacgatgttcttaaagaatttaattttagattacaatacttaatgctacaaaattttatttaaaatatttgtatcactgacgcattttccggtcatgccccgttttcccattagtcacggtcctaaccaattaaatgccaaatttttaattaaaaaatatttaaaatgtaaattttaagatttttatgaatatgaatttgaattcattgctctcaaaccggaatttgcatattcaaatggggacacaatgccaatggatgatgcgatgcgccaaattgttgaggcatataaacaattgtttgaaaggaaaaagaagaatttcaaattgaatccgttttcaaagaaagcccctcctcaagtcaattttgtcaacaaagaaaattgtgcaaatgtaaaattatttaaaatttattaaataaaaaataagtttaaattttaataaattataaattggaaaaataataatgttttaaaataatacagaaactgattcatacttgtatattaattttttcatagttctaattttaattttctgtataaaatactggaagatacagctatagaaataatatcgggtggcaagaatctgatccaggcttgtagctgttttgtttttgtttttttgaaaaatattaaaaaatgattaagcttgtgaaaccaagagagagatcctttagaaacagataaaaaataaaaataattatataatttaatattatttgaaacagatattttttcagtgaattatttataattatgtgtaggaaatatctgttttcgtttacctgtatgctgtagagaaaaaagacctgtacctgtctgtgcctgtacaatgtggatccagaaaaatccattctgggtcaagttacggtacagatcgagtttgaatttttattttaaatttaaaaaaagatatttcatttttattcaaacgtttaatcaattttcgttaatttattcaaggtgattgcctggtccgctattcatgtaaaagcagtcggaaagaatcatttggccaaagaaaacttgcaaaaagtaaaaaatcatttgattgaaaatacgccgttggcattggattttcctcctccaattgttcaaggtatcaacaagtggtgaactaaaccattctcaaatattgttataacaaataatactttatttgaattttgatatatttagaaatcaaaggggcaattagccagaaaaaatttcgggggcggagggaaatccgaagtccttttttggtctttagcccaaaaattgntttttcactgagtgtaattttttaaatttttggcttttcacaagaaaannatatt

SEQ ID NO: 18062 - DNA, 3035 bp, Heterodera glycines
tcaattagccaccgggcaagattgggatgggcctcacctttctgcaacaaataagccaatggcttatgatcagtgtgcaactctacattccccatgtaaatgaacggtctaaattgtcttagcgcaaaaattattgcgcctaactcgacctggactggtggccacttacgctctgcttcggacaaagtgcgactgcagtaggccacggcgtgaaatgcactgttgtcctgctctttctgcatcagagctccgccttgtccaactgttgaagcatctgtgaagatgtggaatggcttggaatagtccggaaatcggagaatcggatcttcagacaagagcttcttgatttggttgaacgcctcatgttgttcgacgtcccacgaaaatggcatgtctttcttggtcagctttgtgagtggcccagtaattgttgagaatcctggtatgtgtttcctgaaaaacgacgccattccaacaaatctgcggacttctttcaacgaagtcggcgctgtaatatctttgatgatctccacttttcccaagctgggcgtgtatccgtctttattgataataaagcccaaaaattccatttttgatgaagccattacacattttttgggacttacctttaaattgaattgccgtagccgagtgaaaactttccttagtgccaataaatgcaaatcgaaatcaggcgatttggagtaaatcaagaaatcgtcgacataggctataacagagtcttccagtcctgaaagaacatgagccatgactctggcgaaggcactggtggcgttgcgaagtccgaaaggcatgtgcgtcatttggtagacatcgtcttcagtaatgatgccgcattttctgctggctcgttcggtcagtcttatctgaaggtatccggaggacaagtctaaagaggtgtaccaatggcaattgccaattttctcgagaacgacttctagtctcggcagtggaaagtgatcaggcactgtaatttcattcagttttctgaaatctatgcatggccgcagccctccgtccttcttctgtaccaaaacaatgtttgaaatccacggagtgtcagaattgaccattactccagctttaatccatttctgcatatgatctctgacctcttctctgaaacgaaatggcgtcctgcgcggcttggcagttatcggatcctccgtggttgttatgatgtcatgttctcccacaaggcatgagcctaaatcgtattgggattttgagaagacatcagcaaactcaacgcagagttttttcagcttgttgaggttttcacccgttgcagaggatttggcgaagttgattttgaatgatgggtcatttgtagtaatttctggattgacattggcttcctttacttgcgattgttcctcaagccatggaccgtccacgctttgtttcaattcattggcaagtgctacgtgcattccggcacaaatgttgattggtgcatcagttgggttggtcaatatcatcttgatgcatccctccacgggctttgcgacagttgagatcatcccgacatgcattttggagagtcgtccatccagtgaatgtgttacaacttgatcaagttgaatttgtgagtcaagtttgccggtcagcatgctataggatcctggttgaatgtcaacatgatgacgtgccacaactttgacattggagtaaagcaagtcacctctttctcccatggttacagattttcctgaaatactgattagaccttgaacaaaatcaaaagtaatcggtggaagttttgccatcaagtcacatccaagaatgacttgataatcccttctgtcactcataacttcatcctgaatgagttttatttcgccaaaaattttctgacctgcaatttcgatatgtaccatggctgctgctgttatgttgatccaatgtccggaggctgatctaacggtgtgatttgtcggaaaaattttgcatttcaattcattggcaagactcatccgggcaagagaaacacttgctccggtatcagccagacagcttactggtctgttgttaatcagggaacggactgtcgctgttaagcgtggcgtcattgtatgattagcaacaatttcttccataatggaatgattagatgaggccgtagcccaaaaactcctgctctttgagagcacactcatatggaatgcaatgaatccagccattgcaccaagagagaccacgattccaagcagtgccaacaaatccgaaagtgtgagaaaaatacccgttccggctttcaagtcggattccgatgcttgttctgcgttcacaggtatggcgaccaacgcgatcatcagcaacaaaatcaaaatggttgtgctcgttccgatttgcaaaacagaagagggcctaagcctttttcgtggtgatttgtttacaacgttggttgtcgttgatgctgctgtggggtcagaagatgaaaatatggtctgaaaacttgacactgaaggtggccaattcattgggttccctggaatgctttgcaaagggatatcttcaacggttacgctggtatttggaaattcatcaattgtcacgtttcccgtgttgcgcgagcctcttgacttctttgcgccaaaaattattcggcccagccatccaggaccggtgtaagtttcaagaagtactggaagccaccttaagagaaaatcaatcaagagaactagacttacaaatgataggacgcatagccatgtcagtttgtagtctccgactacttttttctcgagttcgtctgttaattctcgccactggtcagaaactgtgactcttacttttttgtgctgttcattaattcgataagtgagttcacttgccttgaccataccgcttagaaaagcatgtgtttcaggtcagagacgttgaacaaagccatttggtgaaatgagtgcctttcaatttcgaatatccctgggagccgtggctcaatatcaaagtcttttactttgaggattttcgtttctcctgttacctgatctacctcccagaggctg

SEQ ID NO: 18063 - DNA, 2588 bp, Heterodera glycines
taatttcctaaggttctgatttatgaacggcagaaacaatttgtagagacttaaagtggaattggcacatatgaaagcgatcgaagcgcaacagaacgaatatttgataatgtgcaagaaaatttgaaaggattgtgcgaattgacacctttttattgtgcagagctaattaattcgctaatgtaaattgacacaaatgagcagaaaagaacaataaattttagagagatgaaaaatccaatgaaataagcgtgccccgtcggtggcggacaatttgttcatagtggacaatccgtcagtaaatttatttttgtgtcagattaatttgcgaaaatatttgttcaatttaaattccaaggaaatattttaattttaaaaaattgtagggattttttacaatatttgaacatttttattaataattttgaccgggaattcgctgcgccattagaaacaacgactccgccttatgtgccacccaatacaaatgttccgaagctttaattttaccataaattgtaaaaattcattatagatacataaagaaagtttcattaaattggtcaccgcatttccaagagttcggccttttattggttcattatttttattgcattttcggtaagaaattacaaaaaggccgaatatgtaattatcctgctcttttaccggcaggaaaaaaatcccgtgacttttatttggtgattttggcaccgtccgtaagacattaattcaaaatctatcattttatctcgtgcaatccgaaaatcgaacaaaacacacaatcataaatcgggaaaacgaacaaaaaagagattacttcgtcgaggacataaatcgcttctcgcggacgagataaaaataagatcggcgaattcggggaaggcaaatcaaaatacctgagagtgttgggggatttacaacgacagaaaaacgtacgcttctcggaggtgccgtcgttgggcattccaaagatggcaaaagcttacggtctttttttgggaattgaaatttaaaagcctgtacattataagcccaagcgacggatggtgggggattttttcagtgagagggagggtgaaaatccgacacaaaatttgatttaaaagtaataaaaaatattttgaattgaaacatgctgcagattcattctgtgtcgtattttcggttacacgtcaacttgtgcgctattattcgtactgtttttcggaaaaaatcgtcatatcattagtttaggtgtccctttctgtaaaatttaaaattttctcttttttgggttttttcataactttttctcttgtattatgaatatttttgccgaaaaacagtatactttggtgattctaccgtattcccttcggtgttttctgtgtctgacccgttcttccgtttctttctttctctctctcattggtgtgttttttctccattttcctgctcattgtcagtttctgcttctgctgatgacactttttagccgactttcggccattgaatgcgttcggtggtaagggcgaatggacccgtaaaaacggagaaggaaattgcgcgtttgtcgccgactgaaatggccacccgaatggcacgtggagcagagaaacagaggcgggaattggtatttgacgaattgagggtccttaagggggggggggggggggagaaataccatagaaaattggggaaaatggccaccggacgttttttggggcatgggaaacaaaaaaactattttttatggatatttttggtactgtccattagttgggctcgtcagtctctaactgtctgtcttgccattgccgtctctctcaaactttccccccacccacgccattatattgccgaggaatgggagaggtacgactctgtgactgcccccccccatcggatatgctcctgagattcggccaaaaaagcacctccgtgatgtcgccgtgcagccgcgcgttgacaatgttgtgagccctccacaggtacatgaccatgtcgtggagacggttcacctgtcatttgtcaaatgattgtcctttgattggcctaagtcagctcactcactctctgctcgttcatcggaaagagttcggtggtcattttcatgaagtgttttctgcagtgttcacatccgaagaaagtgctgacccatccctgaatggcacgcaacggaagcaaagggttgaaggaaagccgatctgaacagggcaacagccgattaatacaccaattagcaaaactaatgctttaaatggtatcaggtccccaaaatgaccctttactgcatccaaataagcgtgaacggtaatggtgtggaaaatggtccaaaggccgcaggtatagccacggaattcgggagaagagccggcacagtgctgccaggaggcattggaggggaagggactgccgaagacacgctgaaagaggtggggaagtggtaggaagaaactgcggagtggtcattggcatttccctttttggttggccattgatggcatttacctttggtgccaccgaaccagggggggagggtcggtcattttggcgctgccgaaatttcttcccttccccgcccccctctgttcctccttcccccc

SEQ ID NO: 18064 - DNA, 1117 bp, Heterodera glycines
acttcgtccattcgagtcacttcgtcaagcagtgccattctcacctgagaaagggtaaaaggggcgacagggcagaagaattaccgccttcagcagatcagtttccgacacaaaatacaattgcttacagctgaaagagaaattgtgaagggaaaggcgaaagaagtgatcagacaaaggaaaggacagaccgatcgggaaaacgttcgcagtcgatcacatcgacgtggggacgcaccgattgggtgctcttttgctgctcagtgtccaaagaaatgaaattcccttcaatgggaggggtcgagtccgttccttcttttcgtccttctctctctctctcttcccttttcttctattctctcgtccttctctctctctctcttcccttttcttctattctctcgtccttctctctctctctcttcccttttcttctattctctccgttctactcactctttccttccccactctttgtctgcccgatctcttacctggctgcactctctgcatcgcttcgtccagagtgacggctccctgaaatctgtccaaaaattgttccctttccgtttcattctcttactgctccatgaagatggactgttggtcgtccctcttgaacatggccacataagggaattttttgattcctaaatttaggagaaattaatcgttggagaatggggggaaaatggcagagggagagggggggggggggcactcgttgagaaagcaattccgacgcccaaaaaattgggaatcggaattccgagcccaaaagtgtcggaaaacggaaatccatcgtatcccttctctggtgcaaatgcttaatacgccctctccctcactcggccttttcctctgttttggtgctaatgagtccctgccgattaatcaattattacccaacattggcaccagcggtgaatttgacaacgtccgtctcactccgatttgtttccgattctgccaaaggtcgagaattgactaaaatgcgaatgagcaaaagccggtgcttttgtcctcacttggacaccaacagcgtcaaattgttcaaagattatgagtaaaaagttggggggcgggaaaatgccatgccaaaggtcctcaaaacgag

SEQ ID NO: 18065 - DNA, 875 bp, Heterodera glycines
  misc_feature (17)..(17): n is a, c, g, or t
tggacatgatcagtgcncagcgttgaagacgactcgccgcataaatcggtattcctttttggagccaaaaatcgccaacaatggcttgtggtccgtgagaagagtaaatttccgaccaaatagcattcggtagaatttttggaccgcaaaaacgagggccaatgcttccttttcaatttggctgtagtttttctgcgcgtcgttgagggtgcaggacgcgtgctcaatcaatcttttttgttttactattacaaaaatagtcgagactctcgacatgggatttttcattgcgtttttgcatccgtttttaattgatgttgctactcaattcatcactctattcatttcagcaaaacattcttccggaggacggtgatgaaaaatcagacctttcagtgccaatacggtgcgtttaattttccccaaaaatgcttctcctctaatcaataaatgtgtctctctttttttaagatggcaattgtccgttggacaaaacggtgcgttgcgcgtgccggcattgccgcttcaaaaagtgtttggctgttggcatgaacaaagacggtgagattattttgtcggcacattctttgatcattaggcagataaaaacttctggtgacaaaggtggtaataacagttgatgtgaaaggttcaacaaatcaccgattttataatggggagcattttgttctcccccccccccaattaaaagggtccacctcgtttcggctccgctcgtttcggcgccagcccagttttttgactataacttttctttttccaccaaatctaatattgttggtatccttctagagaaaaggtacacatgtggcctgggcttttgaatacttctagccatactttttttgagcatt

SEQ ID NO: 18066 - DNA, 754 bp, Heterodera glycines
ccccccccgaaatgaaaaaccaaaaaattactgtatcggatgtgtttactgtacccaaacggattgcttgaattattgacaatgaaaaaatgaacatttttctgcattaagttcctgataacggataaaatggtgattggaattggaattagacaaattttcgtctcaccatttgtcgagactctcgcgcattccttggccaatttgtggggaggacaccattttaacaaaacaaaaaaaaatggccgattgaactcgtttcgttaagttgctgatgatcgaatgggccaaaatgctgccggtctttcacactctgtccattgttgacaaagtgagcaacggattttgtttgtttggcattcatttattttttgctttttttggcatttcggaattactatcggaattcgctttgaggcttcttccgatcattaaattccgttttgttgtgatcaggctgatcactgatcattctttcttttgttatcaattgatcttgttcttattcaaatccctgactccaaattgacgacttgatcagtgatcagtccattttggccatttattttggtcaatcacttttttttaatcccggctccaatttgacggctttttaaaccctcatttttgtttgttttcagttagcactgctcagacactcggccattactttcccgtcgttgctccaatgcttttactctcccgacgttgggacggacacaattgtgttcccgagcggagcattctttgaccg

SEQ ID NO: 18067 - DNA, 2528 bp, Heterodera glycines
  misc_feature (20)..(20): n is a, c, g, or t
cccaagtttccaaaaaactnttttgagaagcgcaccacttcatttgtcatagttttgagataaaattttgaacctgggaattctatttccgatttctgaaaatttttttgggcctaggattccttgttataaaatgccaaattggacgcacttttactggcgccaatgaatgaatttgaatcagatgattaaagtgaaaaaaaggaagatttacgagcactaaaaagaaaaattgttttttttttgttaaataatttcgttgatcactcactacccgatcggggtccccgacccccgacaattgagatccacccgacccgacccccgacacgtcgccccccgaggtcccggcccccgactttttgccccccgagggctcggggctgaaccctagtccaaacccgccggtcccggtactttcaaaattccggtctctatataaaccatccctttttaaagggtgctatgtgattataaaaaagccacaaaaaagtgcgttatttcaactaaaaactaccctatctttgctcaaacctacagtcaggtgcaaaagtatatgaacaaaaaaaaatttttttaaacccggttttccacgagatgcgttattggatggaaatcttttctatgccaaaacaaacccccaatattactcgtaaaaatggcaaaagacattccgatgacgcaatccatcaaaaagttacgggtgcccaaccaaattgacccaatttttggcggtgcaaaagtatatgaagataacatttactcgatgaaaactcaattccaagtaggcagaaaattctgaaaaaattcctttataaaatgatcaattttctaccattttcccttgaaatacggtagaaatcagtcatttttgagatgtccaattttacatcctatgaaactctgcgagtattagtcgtagaccaaccattcaaaaggcgattcggtagagaattttgtcctctttctgataggcctactaaaaattttccagaaaaattttcctaacccccctaggaattttttctcgaaaatttccccgatttcaagccatttttgactttccaaatcaccatgaaggagtgatctgatcaagttggtgtaaagacttttttgatcagcactaaaagttagcttagcaggaattttttcagaattttctgcctacttggaattaagttttcattttcatcgagtaaatgttttgtcatatacttttgcacctaactaaaattaatttttaataccatttcgatacccctaacagttctttattatcctataaaatttcaaaaaattcgtcaagtttgaacaaagttattcccaaaagtacacaagtaaccaagtttcaaaaaaattttggccataacttttttgaaagcttgtgaatttttttgaaattttataggctaatagaaaattaattgttaaggctatcgaatgatattaacaattaaaattttcatttgatgtcttttttataacggctcagcaccttctagaatggctgtaaaaattgtttatttatttgattatcattgtacacttacgaactgttaatgtgcagcttggtaatatttgtggtgccgatcagcggaatgatttgaccggcgaacagttcccagcttcggtgttgatccgccatacttataatgtccaaagtgatgtcgcccatttcaaacagtggcttaaagcggcgtagaaatgagagcacagcgccgtcaatgaaactgaaagcagaatgtgatgatggcactcatgttgggtcggattccggatttttgaattttagcgaagaaaatctcgaaaataattcaatcttagagagcgaaaaaaagagttaccccaaaaagcattgaaatcatttgtttgcaaattatgctagtgaaatggataaaaaaaaggaatagattttcttgagaaatccacgtatttttgagcatttcaatttttaaaaaatgcaaaaatatgtgctaaaaattggaaaaaccaatggtatttttgcataaaaattccaaaaaactcattctttatcatttttgcccgcacaattgcaaataaaaaacatttggaggtgtttgggggtaaaattagtccttttttgataaattgtttttaaagataatttttccatcagttgagtaagtgccagcaagaaactacgatatccagtaacgaattaatgaagaattcgattttcggtacacgaaataaataaagaaaattttgaaagggcctataaaaatggcaagaaagttgatttttaggggtgcatttttgaattttttgtgtttttcttagatatttttttcaaaaatgccaaaatatgtgcaaaatatgtgccaaaccccgaaatatgtgcgatatgtttttatgtgcgaaaacgccaaaatatgtgtttttatgtttttataagtcgctctaaatcaaaaattgttcggagaaaatgctatttttgggcttctctcgccataactaagccgcaaaaaaaatatgttaaaacataaaaatcccagccctaataatga

SEQ ID NO: 18068 - DNA, 2493 bp, Heterodera glycines
attcagcgatgcctctttccctttgtctctcaaaaatgcccacttttctccttattcacgtgtttttgcatcgggtgctatttaatcacggcgccccctttcttctggctccttccttctttttttttctgcgtccacttttgttaatcgccaattttgccttctgttgacctatttacttttatcgtcgattttttccccctttggcaaataaatttggttgtttggtttgtagttccctttttgcctaagggacgagccactctctttggggaaatcgccaattttcgttgtttggggcattcctcgccccagggtcagcgtcgagagcagccaaattcgtacggggtcggatcaactcctctgatccgaagtccatcccctcccttcgcctccccattttggtgattggaatcgggacgatcccggagtacgatgaggttcacgcactcagagctcagaggatcatcggatgagatccgaagtgtactgatcaaaatgccaaatggccgaatttgggggcgcccagtgaacaaaatatgccccctcgaggagtcaccggagtcagaacgaaataggacagccgacatggacgagaatggcggcgccattgaggatcccgttcccccgggcacaactgcccattaaccgaggaaaaacccgccgaaatcgccaagcgaatcgaacaaagcatcgaagaggaggtgcccacacgggaaaccgatcccgggattcgacggtcgcagcgaacgcggaaaatccgggaaatcagagacccggatggtacatgccgaaaaaagcgcagaagcgcaaatttgcacaaccctgcgtcggattggcacttttggcagtgctaatgtggggagggaccgtggttagttgccagcccgccccacggaattcgagactgacggcactgttagactcgggcaatccaggaaaactgtgtgagatgagctgcgcagcacgtgggataacggtgcacagcgacaaatcggtggacaagctcgaaatctgctgcccggacggatgttggtcaacctcgcccaaaactctcgagaccaactacgaactaacggtcgagctactcattcatggctataattgtacgagcagttgttgggtggggaaaagttcccctaggagtgtcggccatcgttgtgcactaaagtcggaatgtgacttaatgcaatgcctctggtgctgggagcaactcgctaatccgaagtgcaacccgcgatggtcgtcgaccctatttggactcggaatggcggttgttttggtgatctgcgggtgtctgtggccgatgatcagccgatgtttgctcggagcgtctctgctgtggaaggtgatggcatgggcgactcggtagccaattcagggttttaatcgtttgactggcgggatgttcccgagccgacggctgatcaggtgaaaagccgagtgaaaaagggcgcgagaaatgccgggccgaaatcagggaggtccaagaacgactacagctggcgagacgggcacacgcagcagcccgggcctggagaaatcccgaacgaggacgggcacatatgcatgaggccgcaatggcattgcttccgctgctttgcttcatggcatttcgtcctcatccaggcccatctcggtgatgctgcgctcggaggactgcgcaagaacgccatcgggactcaaatgctcgggatccgcgggcacgatcctgactctgttgccatccgatccggttaactcatttctgatgaggtcagcccaggacgagctcctcagggcagttcggctacgtttgagctcaataacaatggtctgtgtgccaaaaacggagaattggctccgttcctatacggtttcaacagttgcggttaaaagatgcccagcggcgggctcctgtcatgacgatgagatatttctcaagccgaaaacgccaccagggcgttctttgcgtgttcaaaaaaggctttcggcatcatcaagccgttcgccttcacccgcactaacagttcggccacgaactaatgtgctggggccagcaacagcgttaacaaaacgttgccttatggtgcacaacggctggcactgcgctgctgctgcagcaaaacattttccggaatattctcattccggaaatcttggtgaccacaaatgcccccattgtggagctcttctcttcctacacgaagacagcagcctatgctgccaaaaaggaagggttgtgttgccaaaattgaacccacaccctcaagagcttatggagcttatcgttggtgaaaaccaaccaaaacagggtaaagagtttgtgcgacgcatgtcgcgttataataacttgctccaattttcaagtgtttccgctggaaacaagccgagccctgcttgtggtccgatggccgttatccttaaggcatacattgggtgtgcagctattttgctgccgtatggcaagacaaacgattccaccttcagactggtcagagatgtgtcactgga

SEQ ID NO: 18069 - DNA, 1605 bp, Heterodera glycines
agtgtccccccaaaaagtctctaattccggctggcgcgacccgtcgtcggtcgttcggtgttgaccccattttcggacgacggcggcggcggggtcggctggcagcagcagcacgacgacgacgtcggcagggcagcgcggctggcagcactggtggggcgggagcggcgacgacggcggcggcagcgacggggcgatttttattccctgccccgcaccagccgccccgggggctcttaatttttgcagtagcgctctctgctccgtagggctcctcatttttttgcgggtgcttcatgtgcacttcttcttgtctcttgagcaggcaggcagcaaatagagcacatattcgttacgcttgtttcgctcattaaaatttaaaaaacaaaaaataattatattttttaaaaattacagaaaagtgatcagtgggtttttttgactttggattaaaataaatgaattgaaaaaatgcttatcaccactttttataagcgtttttctgttcataaaatttttctcaaatttaaattttacaactttacaaatttacggatatttgaaaaaggcaaattttttaaattgatagacttaaaaaattttaatgcaaatttgtgatgtttaagaaacagccgagatttgtattccattattgcaatgaccgggatgggcttcttggaattaatcactcttttcttgctgatcccggatattgaaattgattttccaacctcattatcttttttcactttatccggatgtaatctcgagaaaagatcgcttttatgtaaaaaaaaacaaaaaacaataaacactttgttttacagaggaagaactgtgtaggaatgcattttctcttcatttttaaaattcattttaattaaatataatattttttaaatttttaatttattttttaagctgagacatcgaaaattgtccaatagttcacccacaaattcccccagcacatcgccaacttcgtccagtcttgtcaacacatcacaaaatgttaataataatttttaaaattaaatttacattttaatatattttttacaaatttttttgtgcatttttggcaacatttttctccaaaaaattgaaattattgcgtgcaaaaatgcagaaatatgatactataatattgtgcaatgtacaattctctgaatgccaaatgcattttaattttctttttactattcttttgcttctatttttttaaattttcattattgaacattcaatttttaggttttagaaaattacctaattattttaatttaaaacatattttgatttagtaaagctaatttgcatagtaaaaaagaaaattgttaattgtatattaaaaaaaaatttcgtttccttgagagacgacaaaagacactttttaataactcggtttaaagatttatttatttttaaaaaatcttaaaatatatttttttagcatatgaacacttcgccagcaacctttgacgacgacagatcgccaacaatcgccacaaaatcgcctcctccccccgccgactgttcaaattcgtccacttccatttcttcaacaaaatcatcgccaacacaacagcagacaaattcagcagc

SEQ ID NO: 18070 - DNA, 1096 bp, Heterodera glycines
  misc_feature (8)..(8): n is a, c, g, or t
  misc_feature (30)..(30): n is a, c, g, or t
  misc_feature (1064)..(1064): n is a, c, g, or t
aacagccnccatttgacgacaacggcacgnacagcagaagaacagccgcatcaccatcagcaacagcagccggtgcgcaagaatttgatagaggtaaaaaagcaaaaattaattaaattaaaagttgggaccggcgacatcaccggaatttacatacccgtttccccgcaccaggcggatccccgggatttaagagtttcccatacaggaagagatctctgggattttcgtccccgttttccccacagggcagggatcaccggtatttttgtttcccgtacagggatcaccggtatttccatcccgtttccccttaaataggtccctgtgatttaatcccaatttattttttattttttttaaacgtaattagcaaaagaaaaattaataaaaaaaagtaatttaaattattcattaaataaataagtgtttgttattcgttattattactaataaataagtaattttttttttgcgtcattaaggaattaataaaatttcaatttattgtattcattaataaattaataaaatttaaattttattttatttctttccagaaactgattgaaattgaccgtttacctgaactgataaatttgcgtggacttcgaattcataactcggagagttcggcctctgaacgcctttcccacgtacaaaaaaatgaataaaataaacctattttaataattttatttttggacagattggcgacgaaattgtggaacaattggtggaatggaccaaattgttgcctttttattcggaattacctgttgaagttcatacttatttgctcacacatcgatgggccgaattggtgggaaatatttttattatttatttattttatttttaattattttttaaattatattaaaatgtaaaacaaattaaatttttctttttatttaaaggttttgttgtcaacctgcttctttgcccattgttcagctaataatgccagccagaataaacgtatttatagtttttttttaaatttactcttcaaatctataatttatttaaattgtaaaaattgtttaaatatatattaccanaaaaatttttaaatttaatttatcctttttag

SEQ ID NO: 18071 - DNA, 1190 bp, Heterodera glycines
tttggatttgttcgaatgtcggaaattatgccgatgtccttatccgtagtgacattgtcacttgggcaattgaagtcgcttcggcttcggcgttaatcctttttgagttggagatccaatcccatgattcgtttaactgcaacactctccaattagtgacccaaattatgtccccaagtttcaatgcggtgtccgaagacctggccaacgtttcccaaatttcacttaataaatcattagccacaaagacgaatcccgctctttcgtcttgaccaaaagcaatcacaatgactccgtcctcccgaatttggcaaactaccattttcttaccaccaccgaaattttcctcttcatctgatgcgcgagaattttcctttgaaaattgctcattctcgcttttatccgctttctcattttcattctcggcttggtccacactcagaactgatgacccgagggccttttcatttccttccacttccatctctccggcattcgccttttcagaagaatctcgaggccctttctcgaccaattcatcatccttttgggaaatgaccccaattagcgcccccatggtttcaagcggactcacaattttggcaatttctacattcatttggtcattttcgcccgaatttgcttggaaaaattcgtcttcctcattcaaaactgtcgacccgagggccttttcattggactccgctgttattggcacagacttaaaaattatttttattattattttctggattttgtttcacctctccggcattttggtcttcaagaagacgatcaaccgagtcaggagatagtgccaacatcgcgccgttgttttcgggtgaaagtgccaaaagcgactccatctgctgatcaacaggatgagcagtagcagtgcctccagcggcttttgagtccaattcctcatcagaggtcaaatcctcgtactgaattgccgcggccggtggttcaacagacggtggaggaacaggaggaagagcaagaccaactttgtccttattcgcttttttgtactttttgggcatttcaactgattgcttaatttaacttttattactaatagatagagaaaaataattaaataatgatcagagatgccaaataaggccataaaaaatgaggaaaattgaattttatgattaaaaaaaaatgcttataataaaattaaa

SEQ ID NO: 18072 - DNA, 772 bp, Heterodera glycines
aaaatgccttattggccgaggacaaacaagccgaagcgagtgacaatcgtcttactcaccttaaatgtctccaaatagccgctggtgaatgtagtaggacattataacggcgtcgaaatttgaataaacaatttatggaaaatgtcaagagaaaagtggagcgaaaataatatgttcaaaaaataacaaatatgctgatttattaatacggtaaatattttaagtagtactgtagcacaaatcttttaatgcgatgcaatataaatttattaattagttctatgtatacagtcagtattttaacaatttcttactgtagcaagttcaaacgcgtactgtgcctgcgaacaagcatttttgggtaattaaattattacatattttcttttgttgactttcattgtgaaatggcgaatgaaggtaaagttaaaaaaaattgagaaagtataaattttacaagcaaatctttgagtacttttaaatttgcctgtggttttgagaaaaaaatgaagaattggcgatatgtttaattaaatgttttaaataaatattttaaatttatttcatgtgaataaattaattgaattttaaataaggataaaacaaaatatatttttttaaactcaattcttgttaatttgaaaaaatttttttaatagtaaaacggccgggtgtccaacccagagtttaagagagatgcccattaaggaccatggaggtagtgccagaggaatggaagagggaaagagaagcgggaattgatgggtgaaaa

SEQ ID NO: 18073 - DNA, 1527 bp, Heterodera glycines
attaaaagaataaataaataaagaacgtcaaaaaataccccccctaagaggaagtgtttcaccactgattttatgaaatcttttaggcaggcttataacttgtttactataaaagcaaataaaatcattttatgctcattttgaagaaaaattctaaagattattctaggtttcgtttctaaaaagaattgaaatttttttcgggaaaggggaggttggtcgggattcggacctgacaaaaaatgggaggggagttcaaagggaaaagtttatataagataagtcatgggggccggtcaaagggaccgccccagggaaagcataaatgtgaaaagacaggaggggccaaactaactacataaagaataacattggtcaggcccataatttgaacccttccatcggaatttctcttttttaaattcttttctaactcgggtggctcacgtatttttacaaggtaaaaccccagaattttttaaattgtaaggcaatttctacaaaaaagggtgggtgccctctcacttgcgccccacacttttggccttgctttatttactccaaatttttttgtctgatttaaccagagttaccattgaattataaccccctgaactagagcactccacctgaaataaagcccatttttatataaataaaaaagtcaatttgccatgtgggcttttttaatttaagatttaaataatttaaattggtatcattcaatggctctaaactttatgtattttcccgcaaaatttcaaaaaatctgaaaagtcgggggatccacaaagtgtggggtcaaaaatgaaagagcattttatcgaacaattgtgatcagtcaccgtgataatgataaggtataagagttgaattttgtttttccatgtcattttttcttgttctgttcgacttttcatttcggcctcccatacaaaagcattggcgtgaaaattgccggcaacgtgacattgaaagggccctgttcagtgaccatggccaaataggttaaaaaatcttgttccctttttgcgctgaagatcagcgcttcaatcagatggaccatttcggcaaaacgttgcgccgcccccatattgccgtggttaatgcgcaaatggcacattaacaggtcggcatagtgatcggaccaatgctgcaaggtgcgacgaccatcaccggacaggccggaaattgctggaaaatttattttctttcgcaaaaaaatattttatttaataattttgaattaattttgtaccaaagataggccccgcctcctttaacccccaaaaactgcataagcgagagagtgttttcgtaggttatattctcaaataagacactaattattataaaacagcaaattggcacccgtatttaatcacaactttaattagttataataaaatgaaactaattttattattctcttattttaattgtattcgttttttacctgaatgtgataatatcaatgcgcggtgcggataaaaattcctcatctgaaagtcgtaactgattaaatgg

SEQ ID NO: 18074 - DNA, 954 bp, Heterodera glycines
agagagtgagagagaagagagagagtcggagaaaaagcgagagagagagagagagacagagaagggagagagaatgcgagaaagagagagaaagcgagagagtcggagaaaaaagcgagagagagagaagagagagagggagagaaagcgagagagagagagaagagagagagggagagaaagcgagagagagagagaagagaaagcgagagagtcggagaaaaaatcgagagagagaaaagtgcgagtgagaaagcgggagagagagagagagagaaaaaagcgagagagagagaagcgagagagagagaagagagagagggagagaaagcgagagagagaagagaaagcgagagagtcggagaaaaaatcgagagagagaaaagtgcgagtgagaaagcgggagagagagagagagagaaaaaagcgagagagagagaagcgagagagagagaagagagagagggagagaaagcgagagagagaagagaaagcgagagagtcggagaaaaaatcgagagagagagaaaagtgcgagtgagaaagcgggagagagagagagagagagaaaaaagcgatagagagagttagttaccgtatatttgtttgggttcaatgcaatattctccgttcctttcaaaaaatcatttagtgttggaaattgctcaaaaatcccatcgtaaaattctctccgaatgctaatgaatgagcgaatgtgttgctcaactgaatgcattgaacggattgtttgacagagcgccacacttttgtcactcaaagttgaaggaatttctaccaattgtgcagcaaatggtcgatcaactttaaatatttaaatcaaattttaataattgtttctttttcggtaaaatttggaattattatgaatgttttttaactcaaattatttgcattattatcatttaagtagcgaattagtcattaaaataaatg

SEQ ID NO: 18075 - DNA, 673 bp, Heterodera glycines
agtttttgaaacgaaactccttgtcaatataacatatatagtaactaggtgcacagttggcaatggtgtgaacagttttgtttttggtgctgtgagaaagcgcttcgcgctcagggacgcggcttcgccgcgtcgctagaaagtgatgtaatttagcaattcatcgcagcctcaggacgggcttgcttctttcggctgaaagtgagacgaaattgctattttaggtcttctcaattgaacgagcattggcatggaataacagaagtggaaaaacgcttttcattgtccaatttccaaacatttccaatttaagagatgatgcttgctcctgaagaggataattagtctttgaatttgtcgggccgtgacaattcctttccgccgagcctttcctcactaaacgattcggaaagtctggcgagcgaagacagtggagccagagagtgttaatggataacggttgccttgtttttagttcctacttctttttttaggacgagaattttcgccgtctgtctggcgaagtctaaatgctgaagaccttagcttgtgcaaccgccaattgtgaatcggcgcgatattttttcgcttttttgcgaacatggaaatgtgattatgataaaaaatctttttattttagataatttttggaaaaaaaaatttagcctttgcc

SEQ ID NO: 18076 - DNA, 978 bp, Heterodera glycines
tttttaagcatttttgattcgtaaacaacagacctttttagatcgcttgtttttaaaaaattcatttattttaaaatttttgtttattcctaagtaagttctttaccatgctggaaaatctttgtatttgttaagacccaatagagcatgggaagagcttcccgttactattttttagaagataataaaagtgaaatgaattataacatctaccaatattttaatgcctttttgcgtgttttattttggatcgcgtaaggtcgccttgtccctgattacaccgtataattttattactagagaccgagatttccaaatctgccggatcggactgatattttcaaaagcgagctgattccggatccagtcttaaatttcagacaacgcagattttcaaattgccggatccggaaccggattggtaaacatttgtattttcatttatggggaacattcgaccgcttcgcggcatcaggacgggcgcttcgcgcccgtcttttaatttttttgggaattcggccgcttcgcggcctcaggaacatgccgccccacccctcagaatccccaatcacactgggattctgagctcttaaccatgtctaaagtaaaatatgattgcatattcgtgatcagcggcccaaatatcccctaaaatcatatttttagaagatttttggtgaaaaaaattttccactcaaaaatcatggtcacacccctgtggtcccaaattacaaaatgacttttatttctataacttttttcaaaaaagtgataaaaatgccaaataaaatttataaaatagagcaaaaaattgcggatttttgtagtattttatttataaaaaatactttttcagaagggagttaggaatttttttctgaaaaattgaatttttctagaaattctggaataacttttttattttggaagatagaagtaccaaataaatcccataaaattctcccaatttttctctat

SEQ ID NO: 18077 - DNA, 1548 bp, Heterodera glycines
  misc_feature (1416)..(1416): n is a, c, g, or t
  misc_feature (1472)..(1472): n is a, c, g, or t
aacgcacgaaaaacatggcttttcttttgttgttaagctacttttcgagttattagtgcctattttctaggcttttattcttagtgcctaaaaagcctaaaaattctgaaagaacctatttttgcctattttagcttttttccaaaatttgttaacaaaaatacaataaaaatacaaaaatgcacccttaagaatcgagcctaaaattttctgtttttttttactttttgaataaatttgtaattttacaccctaaaaaatgagatttttagtgcttattttccattttatcgcctattttgggctttttagggcctaaaaatatcatccctataacattactcagcatttgcatattaaacttccataaaattcttgtaaaaaattttcgcttctgtaaatcacatttatttttcatgtattcctagaatattttcttataatccctccaaaaaagatccaaaaataatttatttttagtttaaaaaagagaaattcaaaaatcagaatccgatgtctcatttctctgctctcttcgatttccctcttggattaaacgttttcattgctcatttatttcttctccaaattgttttttccattttgaaatgttcgttctatcaattttcatcatttttgcaatttccgtgtcactcattttcggattttcttttttaatttcgcaataaattttcattttttcttccttcgttattattttcttgcttatgccaaattgtttcttccatttcttaattactgaaatgctaactccaattttcttataaatttcggcataatttttctcccattcttttgttgaatattttcttttttgtttaaattcatttttcattacaatgaatttttgcacaatttcaaatttttcttcatcagtttttgatttgtagcttttctttatttgtttttgaagaccaaattctttaatccattcataaattttgtttcgatttgtcagcaattttttcgttattttattttcaattttattccattctttttttgagaattttcttcctttttgcttaattttttcttttattttataaaattttccaattatttctctttttttgagttcatttcgtttttcttcttctttttcttcccatttttctccaaatatttcatcaaatgttttttgttccaattttttatccactgacccaacataattaatattaattaggacgatcaaaaaaacacttaaagagaataataggcaaaatttcattttaaagatgagttatttcttaaataaaataaaatttaaaacattaaaaatgaatttattattttgatttgacagaatattattcatggcaaatacatatatatatatatatacacataataattatattcttagaataaataattttaagaagattgtanataaataaaaaataaagtaattccacgattaaataaacatttttatcctactgatncaaaaaaaattttattgctcatgaagtttttttaatgtcttaatttctttattttgatagcttttgacaagttcta

SEQ ID NO: 18078 - DNA, 1657 bp, Heterodera glycines
  misc_feature (1579)..(1580): n is a, c, g, or t
tttttcgcatcgcccaaactgagtttttttcgcatcgacctagcacccattttttgctccaaatgaaaaaaactttaattttttgttaaatctaataatttcattaatgaaaagcaattcttgaaaatcaatgccaggataaatacgaaattaaaattgcattttgtgaaaacaatgattttgttgctactaatgttgctgcatctgaatatttgaaaccgcattttgatcaccaattttcatgcgaaacaatcgcttgatgctttttcctaaataatcaacataaattaaaaaaaattaaataaatgaaaatcaaacagtcaactaattatcacataccgaaacattttatattcgaaacaaatttgatacggtaagcattgatggtgcaaaatgatacgattggatttaaagcggacggtaaaataattggaaaaggtgagagtttgttgtaatacagaagccaatcccatccttgtatatcaatattgaaaagcagaaacgcaagttgaaaatttaatgaaaaataaatgatgatgggcatagaagcctaaataataaatgtaaatttaataacaaaatattgaataatttatatttaaatagtacaaaaaagtgctcaattaacctaaaaaatgagatttcgagaaacttgtttattcacttcaatcatctttttggctatttcagaagaagatgaaacgcttcaaacacaaaaattaaaataaaaaataattttaaattaatttaccatttggttttcatgtccaagaattttttgatacaatatgctagtccaaatattatgatataagcaaaagtgcttataatgacaaggtaatataaacttaaagccaaatggatatcctaaattaaaaaaacgaatttttaaattttattgatttaccgttacattaattgcatatgcagccaaaataatttggtcgtcgagatttatgcccaaaatttccgcgacagatttgtcgtccaatattgcgtgatcagccggtggaaaaaagcaaatgaacatattaacgcaatatgcaaacgggaacaaaagtatcagaaaaagcagcaaaaaatatttaagggacgaaatttttttgccacttaattttgaaaaattatttttaagtttattatatatatattatatatatatatataaaaataattagggattttttttaggcacaaaaaatagcgaaataggcatcaaataggcaaaaaaaatttaggtataaaacacgtaaaaatttaaatatttcaattgtaaatgaaattattaaataatttaaagttttttctaaatacggacaaatttttaaaacaaaaatttttattgagaaaaaataaacaaattttggaattatttttttgaaaattatttcaattctttggaacgtattttctgaaatttttttgggtcatttcttaggggtgtgtttttcgtttttattgtatttttgttaaggattttcgagaatcctgcaaattggcacattaggcacaaaaaccccgaaataggcaaaaataggcattataaaagtcatcgtagacaccccaaaccaagcggaannacgcgtttttcgtgcttatctttgctttacaatgcgcaaattttaggcatttgtctaaaaaaagaaatcctaataat

SEQ ID NO: 18079 - DNA, 999 bp, Heterodera glycines
cttcataataattttcaagcagtctccatgttgtttattaacgtgtcgatgatcgagaaactttttttaattatctatactattatattaaaattgctaaaaaaattttaacttaaatatttgacttatctttttaataagaaaaattgttcattttttttacattaaattgtatttcatagtttatgttttaattattccaaaaactcttgccgagaaacccaatgtcctcttctttattacttacgcaaaatattttagcttcatatgccttgcccaatgaatattatattttatgcttttcaaaagtgatcacattatttttattttcaatgaaattatatatttatctttatttattatatgatttcactggattactttataacaaaataatttacaatgtaaataatacattaaagaaatatgaaatattaaataaaaaatgattttttatattttcactcatcgaatttcttcttgtaactttttatttattattttaaatgtttttcattatttaattaaaaatgttttttcatatttattaaattatttttaatcagtccacgtgtgtcgagaaaagtaataatagtcattcgaaggtcaatagtttctttttctcgttgagcatcgagtcttcgcggtatatcatgaatgttcgtgcttcagttatctgtttcatttaatgtatcaaaaactaataaattttataaaaaattgaaaaaatatatatacatactatttataaatttttcattcaattttttgcaataaaataacatgattttttaaattattttcaccgagtaaggttttaagattaatattttaagtgcataataagtaaacttcaaatcatattcaattttaacaattatctatttgctcttaaaagcttttttgagtgattgaattttttatcattattcattacaatataattttgaattaatttttaattataaacatttataaaaaaataaacaagtatttttt

SEQ ID NO: 18080 - DNA, 1620 bp, Heterodera glycines
  misc_feature (1594)..(1594): n is a, c, g, or t
gaataactttattacttgcttatattatattaaattaaaatttaaatcaaccctgaagcttttacaaacaattacaatcacactgaataaagtttctttgctgattaatcaaacattgatgatatttgttgattttatatttttttttgtatatttctttattaaagttccataatgttaacttttcaattttttaagatatcattttaatttatactgttaaaaacaataattttttaaaaatatttaaaagtatatttaaaaatatattttaaagtattaatattattctcgtgtccaataaaacgaacggtcatgaatcatcgaaatgtactcttatttaatatataaatcttttgttgtttaattttatatgtgtatagagcccagcaacaatgataatttttcgtcccatttgtcaattttttaaaaatattagatccattttgttcattatttatatctttcacaatttcattttttatacgcatttttaatttgagtttttcatttttaattagaataataaacgttcccattttgcaattattttcaaatatctaatgtaaatataaaatttaaatttttttaccttatgattaaatcatctttctttaaaagttttttttttcttttttttaattcattagtttaaatatttaaagttcatttaattttttaatgattttttcaaatttcataaacatttttacataaggaataaaaagttttttgttctcattagtttaaatattaagaaatttactaattaatatacaaatactgttacaatttcataaaatgatatacaaaattatgtttagcaatcaatccttttctagggattttgccttcaaataaacatttaattatattagtttatgttttccatataatttatttaattttaattttagatgctatttgtttttattaattttttaattaagatattttttcaaagatagaaatttaaaattatttttttctgattcttgaatttatatactttcttcaaaaatattatggcatttttgcttaaatagtttttttatcttgtcgggtgcaccacctgttctctttgccatctgtttttttaaaattattaggtggcatattcttgtgttcttaaaacccacgttgtgtgggttcttttgtcaatattttgtagagataaagcaacattcataataatattattcttatattcattaaattctgtatatttaattttcgtttattttaataaatttgaaaatataaaataacaaattagacgaaataaaaaaattgtattttcctttatttctttgtttcattaccatattatttaatttatcttaacaaaatattaataaataaattgacaattctcgacagtaatgcagtagccctgaacgcgcttgattcactcataaatagcattgcattttttgtatttcagtaaaatttaattattattattatttgatccaaatatgcaaagttcagtgttgttcgtctcgatttagttttttaacgttattttattatttttatggtttaaaagacgaagaaatcttggagagtttaatctaaagttgatttttccttnatgtattaagcttagcttcactttca

SEQ ID NO: 18081 - DNA, 910 bp, Heterodera glycines
aaaaattctgtatgtttaaatttattataaacttgtgtctatctgtgatgtcattatttaattggtattttctgaaaaatacccgtgaaataaaaattatttgcctatttaaagccattttattccaaaaaattctgtatgtttaaatttattacaaacttgtgtctttctgtgatgtcattatttaattggtattttctgaaaaatacccgtgaaataaaaattatttgcctatttaaagccattttattccaaaaaattctgtatgtttaaatttattacaaacttgtgtctttctgtgatgtcattatttaattggtattttctgaaaaatacccgtgaaataaaaattatttgcctatttaaagccattttattccaaaaaattctgtatgtttaaatttattacaaacttgtgtctttctgtgatgtcattatttaattggtattttctgaaaaatacccgtgaaataaaaattatttgcctatttaaagccattttattccaaaaaattctgtatgtttaaatttattacaaacttgtgtctttctgtgatgtcattatttaattggtattttctgaaaaatacccgtgaaataaaaattatttgcctatttaaagccattttattccaaaaaattctgtatgtttaaatttattacaaacttgtgtctttctgtgatgtcattatttaattggtattttctgaaaaatacccgtgaaataaaaattatttgcctatttaaagccattttattccaaaaaattctgtatgtttaaatttattacaaacttgtgtctttctgtgatgtcattatttaattggtattttctgaaaaaataccgtgaaaaaaaattatttgcctatttaagccattttattccaaaaaatctgtatgtttaaattta

SEQ ID NO: 18082 - DNA, 840 bp, Heterodera glycines
ctccctccttgctcaacacgcatattttgttattgttcaagcccaacaaacttatgttaatggtgtcattatttacgctttcataaataacctattttttgtttttgcacatccactttaccccccccccccctaaattcctttcgtatccccttttctccattttcttcatcataatcatcattttctctctctctctttctctcgacttcacgcgctctcagctctcaatctctctttctctctctctcccctacactctctcctccttcctcactcttttctctctctctctctcttcctctcttcgtgctgacccctctcattctcttatctatgctgctgccatctgcaaacgcggacggaccctcaccccttccgcgccgagcggcgcggcacaaaacttttaccgcccctcctttcgtaaaatttttcaccaaccctcaccaccgacactttaaaaaaaaaatgcggtaaaaaaagttttatcccccccccctctcaaaaaaatgcggtaaaaaattttgtgaaatgatgcggtaaaagaaccccctcccctcactctcgcgcacccccaacccgtgccacaggcacggggtcgcgcgataaaaaattacatcaaaggcgccgaaagcaatcaatcattttcacaccccgctactacacttgcaagctatatacaaatgggcaaattgttgagccgcgagggtcgcgcgagttcggatgggacccatgcttccaagtgaatgaatgcttatccaaatttattttatatccattcattctttagcccgatggatttcaaaaaacatttgcagaaatgatcaaggatgaaaagaa

SEQ ID NO: 18083 - DNA, 1602 bp, Heterodera glycines
  misc_feature (1462)..(1462): n is a, c, g, or t
  misc_feature (1532)..(1532): n is a, c, g, or t
tattagaacattttaggcaacagctgaccagcgaaaatcaaatggaaagcgaagaggctggtgaaattgtggccggaccaggtaattaggatagcgtatctcaccaattacattaaccagcgatcaacatgatgatgatcgcactgccaagtctgaaccggaaaatgtgccgctacgaaaggcaccggcgcgcgttggaggaagcgggtgggacaaatgggggaaataggggaaaatgggggacaaatagagagaaaaaaatggatacaaatgggaaattaaaggaaaaagtgcattttcagcactcgcagaggacgacggaatgtcttcgagcgaatcgctgtcggaagacattcgaattttgaccaacgactttttctccgaagcgcccacttccaactcaaagtgcttaccccttcttccgttttctcattttccttataattcccccattttccctcttagagggtccgcttctttgggtccctccggcggttgtcccagtgccacactgttcaacggttttcgtgcctcattttcgggcgtaattgacatgcgcaaaaagtcaatggcggatgaaattgtgccctcaatttttgtgccgcgcaaacggtcggcctgcgactttggcacgttcagcgcattacgagaaatgtcgcgccaaaacaccgctccaattaaaatacgcgtgaccaccgtccgtggtactgtactttacagtcattttggaatacttttgtggagattttttttgtttcgggcatttgattgtaaaacaagtcattttgatgttttaattccgacagatgacagcagtaaacggccagagactgaaattgtccatcgttcgcagcttttggcgcccgaaagtgtcgcgtgggcggtgccgacgacgcgccaaaattcagcggaagtgccaaaagagaaaagcaatgcgcaaccgctaaaacatcaacgtaattgccaacggcacgcgccggcaagccgaggcaccctttcgtttccgctggtcaaacgaattgcccttggcagggaaattcgcggtaatttgggagaataggcaaatgaaacgaaatgccaaatttagtgaatcattatttgctgaatgacggggaggacttgaccgatttaattgtgccggacaacgaagacggacaaaaggggacgaaggagcggcaaaatgagcaacaacaaaggccgaggaacggcacagaagtgccaaaaacggttgacatttcggaataggaaattaaatactaatgcagaaagtgccacagcccaacggcacccttttcggctccgcgtcctttcgcggtccgtcgcttaacattccttcggtgcctccttttcggcgcggcctttcctccattgaattggcacgcgcgacagcagacgacgaagcgtataatgacgaagaagcatccgaaacgacgtcaacgaggggtgggggatgaaatgccanagttggcgcaaaaaaaacaatttaagcggccgatgaaaatggggtaaaagaaagagaaatatccaatggngatgccatgaaacaccgcagtctcaacaagtaccgtaacaaagtcagcagaacaagggccgacgcaacgt

SEQ ID NO: 18084 - DNA, 1157 bp, Heterodera glycines
ccccccccaaatccgttgattcaccatttcttttgccattgctttccgtttctccgtttaaggcacttttctgtgctgttgggtgccattcttctcgctgaacattgccaatgctttgtgcattgaaatgggtgccgattggtgccaaattggcttcggcccctttttctactccacttggctcggctacatgaattccttcatgaacccactaatttacacaatgtcagtccccgaatattctttaattgattaattagtgcttcttttcagttttaatgccgaatttcgtcgcgcatttaaaagtttgctgttgggtcggcgcggaaatgtttttgccagacgaatttaaaagtgatgcgggggaaaatagaaagaatcaaacgcattgaatgccttttgtcgtctaaaatctccgaaaaatatttataaaattgaaatttatcaacagcaaaaaaaaaaaattcaaataaattattaaaaagtatttttctcttttggtcacttcgtcctgtcaaaatgattctttttttaacgaaaagcagaaaatacttcaaaaatcattctctggtgaaaatacaaaacatttggagaattcggtacttcgattttgtgcacaccctaaaatttataaaaatgtgaacaaagggcagacaattcgaaaatcggttctcttttgaacttgtcgagagtccattcctaccttaattaaataaaagagttatcaagcattaatatttcattatatgtaattaaattttgtgaaggccaaatgaaaaaaaaaataatattttgaataaaaatttattaagaatgcataaaatggaataaatataataattagaacaattaattaaatgtttgtttctttgcactttctctgtttttccctcgtccttcactttttctttccaagacctccaaaaaggctgctgagtcctccgagtcccccacctttccgttgaaaattcattaatcatttaaaatgtgccattttattcaacgtaccgctgccgaaaccgccgccgccgccgccgcacgagggacaacacgaatagcaaggaggaggaggagggggaggaggagaactgaggaaaaatggaagattagaggaggagggagagaactgaggaaaagggtggggggggggaaagtcg

SEQ ID NO: 18085 - DNA, 535 bp, Heterodera glycines
attacggaaaaaacccaatccattgcaaattcaatgtggtacattttttgtgccattaatcaaagctgcgtttcacttctgctgtttttgactttgtacaatttgttgtccactgatggctgagtttctgctaaaaatagcatcaaatattttaagttggggatgaatttttaaattttgcattgtcagaatcgcaacaaatgataatgcacaaaatgccaattgaggaaagtccagcacccgtgccgagtctgtccgatcccaccctttttaaccccccccccccccctctcccccaccattttccacaatgacatccacagtaaccgtcagaatgtccttctcctcgtcgtgccacccattctcggaactcatcaaatcctaaattaatttttcttatttaaatttacaatttatgtttaccctgaatgggattttgcataaaagtgtactttcgttgacaatcgatggatttttttggaacaaaatggcgttgggtctgaaatgtgtgccgctttatcttgcttttgtgaaa

SEQ ID NO: 18086 - DNA, 1983 bp, Heterodera glycines
  misc_feature (1913)..(1913): n is a, c, g, or t
  misc_feature (1923)..(1923): n is a, c, g, or t
  misc_feature (1925)..(1925): n is a, c, g, or t
atgggacagtaaaacggggaacatttcttcgacagtcaacactttggacggaactgtcaaaattataggcaaaaatcaataaacgaatagtcttactgtacccaaaaacagtagtcaaaacaagaaaatactgtgtcttgtgaatttaataaattcaattcgcgctatggagaagcatcaatcaagtcgtggtactactcacaaagcagtgtaaataattattatggataaattgactacagtaacaagagtaggatcggattccgttagtcggagcgtttttgggcaaaatttcattaattttttgagtctccggaaccacccttacacacactcaccaatgattttcagaaattcatcctgtgccattagtgggaatcgaatagccatcaaaattgggccaagcatttgccgacgattttcccccgaacattcgatgccattttgacggcaccgttcgtcagcccaacgcagtgcctacaatttaaatttctcaaattagcaaaaacattgaattcctatatttgttacgatatacaacaaaattcttaattatgtcaaaataaaattacgaaattaaaaagtgcccgaaactttttcgtaattgtcagactttaatgagatttgaaaattaattaatttaataaaattccaaaatcaaatttaagtgagttaattccattatattgttttaacattatcaatttcttacggcttgccaaatgaaactttcttctccaactttgagctgatcacggctcagaatctcacagaaatattgttgataaattggtaaaaaatcatccgatctgatcagtatttgtgctttttggtcaatgtaagccaagcatcgatcagcaaattcccaaaataaaagtgaaattattatttaataaatcgaaaattaatttttgtacattttcttgcaggagacgagcttgggcaaaggcaaggaaaacatttggcaattttgcaatgggaaagtcagcgaatccttcgatcagaccgatgatggcatattttttggctaaataataaataaataataattaatccatcaatgaaatcaatttaatttttgacccgcataaaacacagccattgcattttgtccgtccaaaacactcaatttgttggtgtaaataaagcgtaacatcgccttaaatggcacggcacaaaccttaaggactacagaagagccaatgacagcagtcacctttggacagttatgaaaaagaaataaggaaatattcaatggggtgcgatcctttcaaaaaattactctcgtcttctaccctccctctctttttgtgcactgtttcgttttaaaaattggttccgaaattttttgactctaagaaattaaattgtaaaaattcaaaacttaaaattctcctctgaagttttgaacttggattaaccatgtttttaagtcccaccgtgaggcgggacagttccaaaatttgtaccacatttcactgtggaaagtccaagtaccttaattggacaattacttgtcgacgaacacagtcgcctctggcctcttatggaacagaaaagggtgaatatcagatggggtgcgtcccttcctaaaaatttctcttttcgtctaaccatccctccctttttgtgcactatttcattttcaaaattgggaacattcagaataataaaacgcattttctgaaagatggggtaaattaagttaattttaattcatttatgatttgcaaaatcaaattctgtgcaacttatttcccaaaaacacgaatatcagaaggcataattatgtagaaaacaaccagtaaaataaattcttataaggttaagtcgtttcgtccccaaattaaattcttttttaaaattagtgcttattttggcattttttagagcctaaaaatccgatccctagntaatgaattnantaaaatacttttataaattgagcaaataacataacataattgaaaaaacataaatcaa

SEQ ID NO: 18087 - DNA, 2368 bp, Heterodera glycines
  misc_feature (29)..(29): n is a, c, g, or t
  misc_feature (71)..(71): n is a, c, g, or t
gagcatttgtcggggtttaatccggaatnccaaaatttccgattcgtttgaaaacttcattcaaatgtttncgatgctcctcatgtgaacgactgaccacgatcatgtcgtcaaggtaagcaaaagcgaactgacaatcggccaaaatcgaatccatgatcgattggaaaatccctggcgctgatttcaccccaaatggtaagcgcaaatattggaaatttcctttgtgcgtggcgattgtgcacagttctttcgatttctcatccaattcaacctggagatacgcatccttaaggtcgatctgagaaaaaattcgtcctccattcaatttggagaaaatgtcttcgggcaacggcaatggatgctgattcaaaagcaactcgttgtttaagcccgttgaaaaatctgcacaaacgcgtgctgctccgttggccttcttaacaaccacaataggtgcggcccaacgggtgtgatcgatcggtctgatcactttctgcgccaacaatcggtccaattcggcctcaacaatcaaacgtgtgttgaatggcactggacgtggcctgcagtacacgggaacagcatccgctttcaattcgagatgggctttggctttggtgcagtggcccaggccttctgcaaaaacatgcggaaaatttgactgaaggtcgagcaaagtcgtgtccttcttcgtcaggatttgactcttcattcggtccttcccttccgcttgaacgacattcactttcattgccattttaactttggctctgaatgtgtccaataagccaaaagcgtccaaaatgtcgattcccaataaatttagtgaaccctttttggtcacataaaattgtcctttgtgtgtgtgtcctccgaacgtaaaagtcgcaaaacccttccccagcagggtgcattcagttccatcgtggtacttggcactttcgctgcattgaattagtcggggacgtccaatttgaagatgtgcttcttcgtcgatcacggttatctcagctcccggatcgaacacaaaatcaatgggtttgccattcacatcaactggtgcctccacaagacggctcggttggttcagtgcgttcactgaaatacctcccagttgtaaagcattcatctgctttccttgcgtcggctttctcgaatgcttcgaaagccattctcgatgacgcgcacacatattttgcaaatgtccaacttttgaacattttcggcatgttgctttcgcatgaggacaacatcttggttcatgtccaccgccacaacgccaacaagtaggctgagttgggcttttgtttggttccctcttctgaaatggtctccgattgatcgccaaaacattcgaatgggatgggcgctcaatggccttagcttcagcaattgttgacaggaacatctgcaagtcactgacgacattgtcgtactttgctttgtcgccgtctgctgtcagctttcccaaaattcgcttcctcagttcggcgtctttcggcgatttcagagcgatcagaagcatgaggcaattgaactgctcttcgttcagcttcttaaaatcaaaatcgcgaagcagccgcttgtggcggttgacgaaagcacggaagtcttcgtcgtcctgcttcactgcccgcaaacattcgtatcggtcaatccaaaccgattggggcttggcaaacaaacttttcagttgtgccgatgtctccgaaaagtcgaactcggtcggcttcttcggcagacaaaatttgctgtattcgttgtatgctccctcgctcaatttcgtcagcaccagcttcactttcagttggtcctggatgtttgatgaagagcagtcgagggccaacacaaaacggtcgatccagctttcgatgttcttcccagattgatcatcaagatcaaaacattcgacgtttgaaagagctgggagttgagttgattgagctggcgcggcattcgtctgttgagcaatcagcaattgttccactagtttctgctgcttggccagcaatttcgtcaattcatcaattgttggatttgctgccatttttgtcgttcaccactcttatgtttgcagcgcctagatacaaactgagtgggtgcgcgtggatgagctaataaatgtcgcctagacaaattatcagcagcgctaacttctactgattgctaaaagctaatcagtaaggatgacgaacaatttggaaaattcaaatgccgactggctgaagttcgctccgatgaaatttggaagaaatttgttggtgctaaaagcaaatccaacaaatccaaaacagacgaaatttctttgaagaaattaaatgtcgaaatatctgtcacgggcgtcgccaatttgttgtgccttttcacttga

SEQ ID NO: 18088 - DNA, 2962 bp, Heterodera glycines
tttttcttgcgaatcaggcaaaaatggactcttgtgtttctaaagtttggaagtgttttgaaaaaatttcacaatctatgaatgtacaatgcaatttatgccaaaaggttttgaatcgaggagatgcatcgaccaaaggaatgtggagccatttgaagtcgattcatttagaggaatacaatgaattgcaattgcaggagccggaaaagccaaaaaataaggttattatttaaggctgtttagtttatttcacaaattaagacaattgattcctttttgcttaaaaaacatgacgagcaaaaggaagttgaggaaatgttgactaattttatggtccagcaaaactgcgccttttcagtttttgaaaattcaattcttctaaaattaacgcaacgtgcataccctaattttgaggtttgacagtcagccactatttagaatgagatattattcagactcgcagtgaatggcattttcgaaaaattgtgattccaagaatggctgaaaatcttcaacaaaaaatcaaagacaagattgggactggttattacagcatcacaagcgatggttggcaacaacctacaaaatcaccctcattgcagaggttattactaattaaaaactataaaaacctaatcaatgtgatattatcattttttagtgtgacaattcattcagtcgatgaaaattttgtgcgaagcgattttgttctcaatgttgcgccaatatatgatgctcacaccggcgaaaatctcgcagaacacatcgaaaagtgtttgattaataatgggttttcaatggaaaaattggttatgatggtcagagatgacgcaaaaaacatgatcaaaacatgccgaatattagaaattgaaaggtaaaatataattggtaaaatatttaaaaatattgtttagctttcaatgtgttaaccattttttgcatcttacaatatgtgatgttttgaaagaaccgaaattatctgatctgatcgaaaaagtgagagaatgggtgaaagagtgccgtactacaaaaggagctgcattatttcggaaaaagcaaaatgaacagggtcaaaaaacaacaaaactgatcatggtaaaaacagtaaaatgaacatggcgtgattttttaaattttagtcagttcccaccaggtggaattctacctatgcaatgctttctcaatttcgccagcaaaaaaaagcaatccttgcgcttgagtttgatagaatgcattcagaaattcgaacggttaagcgggcaaaagtcgaaaaaatttctaatgatttaccgagaattgatgcagtcgattttgatttattgcgtcatgtctgttcgattttggacatttttgatgcggagactcgaaaagttagaagattttcatctcaaacttagttacaatgttttatcaattttagttttctactgaaacatccatcgcttcatctgttatcccaactctaaaaaaaatccgtgactttctcgcttttactccattccacccatctgttcaatttcttgccacttcattggcaaatgcaatcgatcgccgtgtttctaatctggcacataatacagcgctccaaattgcaactattcttgacccacgatttgcgtatgatgaaaacatttggcgtaaaagcttatgggcagatattgaggaagaattgaaaaattttgccaaatcaagtccatgaatatttatttttaattttcaattttttgaattcagttgagggccaaaaaaatgtgtcggtcgatgatgagcatttggatgatcaaaatgccgccttttctggcttagttcaccatgataacgtcgatttgagtgctttggacgaaggtggaagcagcgatgagagtgttcgatgttcgaaatattagcaattttttttattttattgcatttaagatgacatttgggttactcctaaatcgccaggtgccgggtcaattccatcaacactttcgggagaaattaatgctgatctcaattccaaaattgaatcacaattggctcattacaaggccattgttcgtcctgcaattgactctgatgttttttgttggtggcgcgaaaacgctccaaaatttccagaattggcaaggctggcacggattttcctaacagcaccggctacttctgtttgtagtgaacgtgtcttctcgaaagctgggctcctttacgcaaattcgcttagaaatcggttcaaacattttgtcttaataaaaaattttcagtttaaggctttctggtgaaatggctcaaaacttgttgatcattaaagcaaacatgaacaaattgtttttgggaccatctaatgatatcgatgacgaggaaaaggatgatgaaaataatgatactgaggccaaataataatgagaaacgcatcattcataaaaattaatttacaaggccattgttcgtcctgcaattgactctgatgttttttgttggtggcgcgaaaacgctccaaaatttccagaattggcaaggctggcacggattttcctaacagcaccggctacttctgtttgtagtgaacgtgtcttctcgaaagctgggctcctttacgcaaattcgcttagaaatcggttcaaacattttgtcttaataaaaaattttcagtttaaggctttctggtgaaatggctcaaaacttgttgatcattaaagcaaacatgaacaaattgtttttgggaccatctaatgatatcgatgacgaggaaaaggatgatgaaaataatgatactgaggccaaataataatgagaaacgcatcattcataaaaattaattttttgtgaaattatttggaattaattcaaatcaaacccccgcccccgcccccgcgggggcggaattttcgtgcccccgtccccgcccccgcgactctgacccccgccatcccccgcccccgcggaaagccacccccgcccacggggctcgaaccctacattt

SEQ ID NO: 18089 - DNA, 3085 bp, Heterodera glycines
cctttgattgtagtttatttataccttttttcgctttaccaattgcaacaccttctcttgcatcatttctctttgtgtatcgtttaaagtcgaacccttgacctttttgggcatttatgttgttggctgctttctctagcaaatttttgagccccgtttttccctcactaacaagtgactctttgaggtccctaccctctaatacattggatagaactcgatttccagattcaagtccttggcgcccgatggctgtcccgatttctttcccaattggtattaggtaacgcaatagactcctaaaaacagacccgataccactaccgcgctggtatggaacccctctgaacacattataaccaccgtattggacgactacttctggagaaatttgggttaatgctgaccattcaactttaaaaggatcaaaatcaacgtgcatttttctttcttttttttgttgcgctttttaaattgagttttctagttatttatatttgtttaaacacatttttttgcataaatttgttcacaaaaaaatctggtgatatttttgcgcgttttagcagttgcaaaattgcttcaaagtgcatccccatacaccgtccaaatataaagaaaatcacatgctttccgcatgagtgtgagtatggtgcttggagcgaaagttgatgaaactgaatttgagcaaaactctttaaaaatttttggatgaaagggcttagcggtggccaaattcctgtcgaatcgtagtattccacccgattttgctgctcgcaatacacggcaacccaatgtgaaccaggcgaaccgctcggatcaacgttaatcaccattgagtaaggaactggtgttgttgctcctgctggaatttgatctgatggaaaacaccctaaaaaggtcgaacgcgtgactgggtttcgagcaagaattttatttatttgaacactgttcatttttaaaagtaggaactctttctaaagtgtagcgttaatgtacatgtaccgtattgaaatggcattaagttaccaccggatgttctgatttcgatgaaaatttcacttatttctttgactagtacgcgatggtattggacggagagaaactgctcctctataatttcgtcaggttttccccgaatcgtaacgatacgcaaaactggggcaatcacgtcaccaatcatcattggttcaattagatcaggtgcataaacatgaaaagaagcaactcctccactcatgtctggcataaattttgcaatcgtttctttttcagtgaattcggttgagttaaaacccaaaatgtaggccaattggtctgaaatttttattttttgcacataacgatcgtccagtttcaacgaaaatctgttcgttgcactgtcaaaatgtaggaaacatgcagagtatgctgattggaaaacttttatccatgctgtcatgcctaattctttggtttgatcgagaattgtcctttcttcgtcatccatcagtgcaatttccgcattcaacttttctgttatcagtccctctaagtgttctaaattacggccacgtagacgcaaaaaatatttatcaagctttttctggtattcctcttcagtgtcatcccaattccgcagggggaccttgcttgttgctgcacgtttttctctctcaagtagaccaccactggttgccccgtaaaggtcaagcaacgtgtcaacccccgctaaaagggcgtttaataattcttcttcgtttttatcatcatcatcatcatcatcattaacatttcttttgtctctttgttgttgttgttgtttattgatgtactcggctctgcccaattgacgtgctgtattggccgcttcagtgaattttttctgtacgccttccactttaactgcgaacggtttgttgccttcttcaagcagtttgtaaagacttttccaaagctcaacggggtttgtcacgttagaggatggaattggtatttgaacattctctccaattttccattcaatttgaacaaattggtcctctgatgtgccgagtgagggccacgaatgggggtatatgatcacacctaagcccacatcccattccgaattaaattgaagttttcttggtagtcgaactcgaaaagagtttgtgcgatttccttcaacatttgtgttggaaggaacgatcacatagaatgagttggatgaaggcattctcatttgaaatttaaaaaaaaagagccccctttatatatttttccatgtcatggagcttgcaggaatccagctgttgtgccgttgactgtagcctttccatttcaccaaaacgtattcaacaccttgctttttcctctttcggacgaccttttcaatgtcatatagggtatcatcatcatcatcatcatcatttttgcgcactagcacacgacagagatcgttggcatagaaacggcccttgatcagggaaccgtcgtcatcacgtattcggtacgtgacgggaaagcggtcagtgtgcacttcggcaacagtgaacacttcgttggtgaagcgtccggtgtagcccttttggaacacgtgtttgtacttctcaatgcgcacacggtcacccaccttaaaacgtggttgtggttgtttccgttttgctgctgctgcttccgctgtcccaccaatagcgttctgcttgagttttttcctgagcttttcggcattctcaaaattcacatcaactgggcgcatttttatgcttgagttgtacgagtggtttattccatgcacaatttgctgtatcacatcaagccatttttgggttccccgttccgtgaaatagcgataaaggcgttctgtgatggttcggttggatcgctctgccatccctgcgtgaatttgagacgaggtgtacatagaagaaagtttttcacgttggttattttatgaaatattccagaacctattttgcattaaattcgagcccttggtcggtcaacaatgtccatggtatgtatttggagcgtattaaggcaagtcgttcaaagagcaagcaatccatgtcggagctatttttgcattttcatcgaaatggacaaagagctgtctgctcagtgt

SEQ ID NO: 18090 - DNA, 3282 bp, Heterodera glycines
gactctagtcaaaaatacaaaaaatttcttagataagattctcgaatcgtatgggaaaatctgctaactagttccgtgtttgagttccaattttctttatcagaattcgaaaatcgcaaactcctctaatgtataagaaaaagcctgcgcttatcattttaattttcaaaattaacaagacttataccatatagaaacagttttttttaaaaaaactttactgtagaaatcaatcactgtcgaaaccaacactgtcgaaaactaacagcaccaggaaattaagcgtctttcgactaattagaaaataattttgtcttttgacttccatcagtagggatgggatttttatgtttttacatattttttctgcggcttagttatggcgagagaagcccaaaaatagcattttctccgaacattttcgatttagagcgacttataaaaacataaaaacacatattttggcattttggcacataaaaacatatggcacatatttcggggttttggcacatattttggcatttttgagaaaaatttgcaataaaaatacaagaaaattgaaaaatacacccctaaaaatcaacttttttcacaattcttatagaattttcaaatttttaaaattttttttcgaatgtagaaagtaacaaaatcgaattcattaattcgtcattggatttcaaagttctctgctggaactttcaatttataaaaatgattaatcaaaaaaaagatcaatttaccccaaacactttgaaatgtatttgatttgcgttgtatgggcgaaaaatgataaagaatgagatttttgggaatttttatgcaaaaacacacttgatttttccaatttttaacacatattttagcacatattttgggatttttggggtttttagcacatatttcagcattttttagcacatattttattacatatttcaggatttttagcacataaaaatcccatccctattcatggattataataatataaggagaaacagagattatttaaaagatttaaattgaaaaaaaactaattctttaaaaataaaataaatatacaatatttttactttcgctaatctggcgcatttccttaatgtgtcatttttatataatttaaataattatttatttgaacttatcgattgaattttcaatttattttaataaatgataaaaattattatatttttgccttaatattgcgcaaactgtttattatattaatttaaaataacatttttagtaaataatgacaacaatatttttggacaacccactacataaactgaacaacattggaatgacaagataaatttaaatgataataagtatataaaattttattaaattatattaaaaaattcaaaaccttttatgaaattttaagtcaattaaatttgaattaagaaataattaagaaatttaaaattagcgaaataaaacaataaaaagaaggtcgtaaatatgtaaaacgattcaagtaaaattgtccctttttgttaaattattacagattgttaataaataataaaatataattaatatcaaaaaaaataaataaaatttctattttagataaaaataaacgaatgttatttaaatctatgcttttttattatagataaataatttctttttaatgtatttgtattttcagttctttttctcaactggaatttaatatcatttatacaaaaaaaaaatcttgagcaaaaaactgcatggactaattgaggacggataactgggcgccgcgccgactgagcgctgttcatttcttacagaaattttttaaaaattttccatttgagataaataacatgcatttattaaaatagttaaatagatagaaaaaataaataatttatttatgttttacatttttttaaatatcataatcaatgtgatgctttctttttttatttataaatataaaattttcagcttgagatcaattgttttttcctttatttaacaatatattttaattaattttactttttatcttttttcaatacttcatattttaatctcatgatgtgtcaggacgtatttcagatgccttcggactctttgcttattaaatattatttattatgtttattaaaaaatttatctatttgctattttattcagtgtatcgaaactttatccattttagtgcttttcctatttatttatcatttctgattattttattatgatttttggattaaattttattttaatttcttattaacataagttccaattaattagaaaatgttaaaagaatattttgaaatttatttaagtatttaattttctcctttattcatattatcatattgtaaacaatttttatttgataatatgtcaatttcatattttataattaaagcaatttttttacattattatcagatggattaattgttttgaaatttttctgattgttctctaattttatgaaaatagcctccctggcaaaggtgttgttgctcacagtttttttgatggaaatagctaattaggttatcccatatttggatttttatataaaattctttttattttattttttggtgtttatcattttttgattttcttttgaatcatctattaattcatttcatgtatttaattttgcaatctttggcaaagatagattaatttatttgtattcatttacttttctaattatagattttaagtttatttctcatctgtgtaacgtaaatacaataaagaataattaaataatatttttaagataaatgttgaagaaaagattaaaactgtaacttttggatttaacacttcaatcttttaagtaactttacgaaaatattggtgaattagaaatgtgatgatatatctgtttttgtttattggttttttattatttgtaatcattaatctaaattataatactatttgaataatatgcttgaatataaaaatttattgtcacagcttgtttaattaaataaataaattatatctaatgtaatttgaaattaattaaaaaattaattattatttcagcacatattattttttcattttattgtgtatttatcgttgtcttttttgctgataaattaaaatttttacttatttattttaaataaatctctttaataataatttacatgttaaacaatttttattattttttctcatattttcgaattaactatttataattgtgaattatttcaatttatacagtcacgtaatatttgactgaaaattatattacaaagatgtgctatgaagcattgcttc

SEQ ID NO: 18091 - DNA, 2531 bp, Heterodera glycines
ataagtcatccgcctcttcttcgtaatgccacgctccataaaatctgtccacagtataaccacattccaatgcctttgccttaaaaacgaaatttattttaattttatatataatttgttaccaattcaaggctggtgtaagtcgccacgtatctccgctgtgccccatcatgagggcacttgtagttacatcttgttgtctccttcttaaattttgacgcacatctccaacataacggaaacaataatctctcatcacacttcaactgcaaaaccggaacccgtaacccccgcggcgggttgaccctcactttatacaatcccttatacttcaaatcctctggtctcgtccaattaacattaatctcatcgctcttaggtataataatctctggcaatccaatcgggtaagctgtaccgtaattcacagacggatacagactcacaatatcgtaaacgctaatttttttcttctcgtccgattttgcaaacaatttcatcggtcccgtcctccctcctgcataagccatccgcggatcaatcggccccttctcattccctctgtcgtcgaagaagtcccgcatctcctcatcctttttcagttccttttcaatttggcacccctaaaaactcacaataaaaatgtaaatgtcagataaacttacccaaacttcttcgacgtccaaagtcttacgcagctccatcaatctctcctgcgtctcatcgttcaattcctgagccgtccttcctccaatcagttccgccgccgggtcataacaattcaaacatccgtgtatgtaacatcccatcacctcaatgcatttgtccctacctccgttattcccaataaatccgtccaatttgtaatttccaactttgacctctcgtccattccccgcgtgccttatctcaatcccatcccgcttgctccgccactccaaatactttattgccatcacacttgcccgatcacaccgctcatatcccttctccggcacaatcgataactgctccgtcaataaaaacattgccttaaaaatattcatcgcgacccccgcattcgtacaactcctcggcaacgggtcaaaccccttcgtaatgtcgttgatcaaaattctcctaaactcaataattgacagcaataaaatctccgtgtcgtttcggcaataattcttcaattcttcatccaaataaaagggtgtctccttgttttcgttatacctaaaaaataagattttattgtttttttttaaattattttcctaccatttttcgaattttataaatttctctttattcatagaccctggtgaataatcttccattgttggcagatgttgtaatcgaactccataattttctttcttgttgtagtaataggggaaaaagggcttgtcctcacagtccaaattaaatgtcgccttcagcgactcaagcttcaccggcatcaataaacatgagtctctccaaatcagccttgaatgtttcttcgagttttgcactttaaattcataaattttcaatccattgatgagcggtagcgggttcttcccggtacggcagaggtaattaaaaacaaaatgacctaaaatttaggatttaaaaatttagattaattgttttcattaccgtcaaaacgtccggcgttatgtgcaaatatgtacgtatcgtaattcgtaaaagcagttaaaatccactccacaaaatccttggtcggctcatgtccctccgcctcgctccaatccttgatcctctcctccccacaaattttgcaattcgtcctgtttttgtcatcacagcattccgtacacgtaactctcaccgaaatataattaataacatgctccttctggtcccccttgtaaatagaatcctgcgatgtctccgaatcctgaagttaaaattatttattttcatttagtttactataaaacttacccaaacgacaattcggtaaacatccttttcctctttctcctcgatcggcataatataacacccccgcttggggtcgtggctcacactacaaagctggcaataagtctctccgcattcatgatccttcttcggattaattcgataagttttttcacaaatcacacaacgtttccataaattgcaagtctgatgtccctgatgatagctgtagcatccccaattgtaaaagtaacgtcgacacttcgggcattcaatcttcactccactctccttttcacacggcattcctccaactctattgcagtaataacatctcgcccggcaatccatcgtatgataaacatcctgatcgtaaaaacattcacattcaacgcagaacttccttccacggttgaaaaagcagacataattcttcagaccatcccaatggccattctccaaaaatatcggcactacattttcacgtcccatagggcccttccacaaaacacggattgatttccgtggatcagctgacttttcaaatgcaacaacccggtatttaccggggtaaatctcatcctgaaaaactcattatttgagaatcttttttt

SEQ ID NO: 18092 - DNA, 1624 bp, Heterodera glycines
cggaaccattttggaatcaaaatttaaaaaaaggcggtaataaaaataattgcgttaagcatgtcagcacggaggtgaacgaagtggcgacacgacgagcaaatcggcaacagcagcgaattctttttcaggtaaaaacaaaattgaacggcacttttaattatttattttttgacacgtaatttgttttgaaaaaatcttttttcaaatttttcacctttttaattactcaaaacagcgaaagtttgccatttttgaacaaattttcacatccaaaattttatttttacctcaaaatctttgacttttcctatgaatattttgaaaattatcaaaaggaatttctgggtcatttggatgctttaaattttaatgttttaaaatgtgtttaagttttgaaacgaaaacttatttagaaacgatactgtattttaaaaaaagatacaatcgattttaaattctgccaatttttaatttttttcattttttcgaaataaatttatttgtttagatttctgttgtggccatcatcttctacctgtacatgtctggtaaaatattaaaaaaacatttttttttctaatttttaaatttttccctcacccattttatttagcctattatttgctttaccatgtgttcaatgtgtccaataaatggctggtgttgttcaactcgttcttttattccaccacacacatgatcaatcccgtaaaatggagaatagtttcacatttaaatgaaaaaaacgatttatttttggcatttttatgccaattttaaacaaattttggcacatatttttttgattttcttactaaatttctgggtgatttgagaaaatttgttaacattttcatcaaatcaaaaaaaaaatatgagaattttttaaatcaaaattttcaaaatttaatttcttttttcaaatttttaatatttttgttcgtctttttttgatttttctcaaatttcaaatgcttaaatttaaattttgagtaaaatttccaatcgtatcaaattgatcaccctccgttctacaggtgatctacttttcgttgaacaaggacatgcgagcgcagctgatccgtgccattgccgactgtttgaattgggcttgttgtgtcggtgacgcggccggcctcagtcggttcggcggcattcactcgtccatctacggccgggccagccggcggacacagcccggcgctgagtcgtcctccggcggcagtgtgctgctgcacaagtcctcgtacggcgccggttgcatgacagaggcgaacaggtgaagaatgaatgcatggcaggcacggcatggcatacaaaattggtgcaggatggcttagtgccagccgggcggttctggcactttttgtgattaaactaggcgttttttgatcacttatctgatgcgagatccaggtcacggtcggcacgggtacggctatttgagaatctcgggttcattttctcgaatcgaatttttgaaatgggtgccaattaattggtaattcaaccatttgttttctttcagttccgtgcaaaccgaaaatgccaaaccaggatggacgcttaggtgagagatggtgaaataatatataatgtcatggtccctagaatttaaatt

SEQ ID NO: 18093 - DNA, 1100 bp, Heterodera glycines
attcatttttggattatttcatttttctgttttttcattttcttgcctttttgtccccagcagatcatcatcgtctcgtccgatgtccatttcatcaccatcatcatctcctgatggtgattattatcatgtgattagtggtgtgatcagattgtgtttttttgataaggtgaaaagccaccaaaatgccaaaaaccgccgctgcgacacggcgtccaacaacaacggcacccacacagtggtgcctgttcaggtgttgtatctgctattactgctgatcaaaccgttttttttttgatcgaatgatatcattttcctaagtgtttctcaatagccttcaaaatttcagaatttttttttttgatttaaaaaaaattatggctagaagaactcaaaaaacagtgtttccgacgagaataagacttattttctaagctaatagaaaacatttattgctatcgaatgatatcaaaaactaaaaaattgattgtttttaagcaaacttataagcataatttgtttattttgatggattttatccatttttttttacaaaattatgacaacatttgagctaaatgaagccaaaatttactttattgcgttgattaagcttgggcctttgatcagatagataaaattaaaattagtgatgccaatttgatcaaacagcatgaggcaataaaacttttttactgattattagtgatcagatcgaatggacaaaaattgatcatgttttgccaagcgaaaatgatcactcggaaaaacactgatcatcaccagcttatgtacaggcttctggtgaagctgcaaaaaaggtgatgccaaaatcatcggcgccggacggcacgacgacgacgacggcacaaggccaacaaacattgcgacgaatgccaaaacaatactcgagcatgaaggcgatcagagtccgatttgtgcaatgattcgtgccattttttaattatttttataaaattatatttttaaatcagttttttttctccttcattttttcttattattttgttttttattgtggcacttttctgtgtttgattgatttgatttgtattattattatttattttttaatatat

SEQ ID NO: 18094 - DNA, 1261 bp, Heterodera glycines
taatcagcggacgggcgcatcgcttgcgaatttttgggggcgacggaaggtaaaggagaagttgaagaacgatggacaacagctgaacggggcggagggaggcgagcagttcaacggaatgccaagggtttgcttttacctggttgccaatcagcaaattcgaatccaacacctcgggcaatccgtacaaaaaagcgttgcaaacggcggcacgtcgaagtcgcgcgggagggattgtgaagcacttgtcggagttgctgtagccaagaagagtgttgaaatggcggagtagtacctgagcaaaaagaagaagtacaaaatcggaattcaactatgcgagcaaattgcgtacactttgctttttggcattttctgccgggccgcagcgtttgctggccaaaaaatagacgaacagagagacgacaaggaaaacggtgtgtctgtgggggcggggggggaatatttcataataaaaaaagcattcttgttgatgcacctctccgaattttgcatgtccacgacgcggttcaacaacaggcacaggttggactcctcgtcagtgaactcgcgcattcggccgtaccgaccatctgaagcaaattcaaataaatctcgatttatctcttgaaaatataaccattggttgatgaatgaatggaactggcggcgggagagagaatggcatggaaagggtgctgatgagtgatgtcggtcactgaagcgaatggacggactttagagagatggcatggcatttgaagaaaagtaaagcaaaaaaggaaaagcgaaggaaaatgcaattagaaaagaaatgccaaagtgccgatgaggaaaaaggaaaagaaagtgccaaaacaaacacagcaaaagcaaagccaaaagtggggacaacgacagacacacagtggcgggtcgaagacgtacaagaaagcgagaagacagacggggagcagttcatcgcggtcaactgcggcagagggtatattcagtaacgcgagacatgcatttggattcgaatcgaaaacgttaaaaatataaaaaactgacatatacaaaataaaaaattaacaaaaaatattcttacataaaataaagtaaatccccaaatattttatgaagaccaaatgtatctattttatgttaatgaaacttttattcctaaagaaacagtcacaatgagttcaatgtggagcgtattccgcatgaaatagaaaagaatttaaaagaaatgcctgtattaacccaaaatattaatcctttt

SEQ ID NO: 18095 - DNA, 1458 bp, Heterodera glycines
  misc_feature (1425)..(1425): n is a, c, g, or t
aaagtggcagttacgcaggccatgccaagcggactttgttcagcaattgtcatcgcgccctgcgctcgcgcactctccacctctccgcggggtagtgcactggcgagttgttccgcgggagtgctcgcctgtccaattagacaactattaggataattagtggtgcaaaggtctagcaaatcactcaatgatagatttgcgccattgttcaatctaaaaacgcacttcttgcattgcctttccaactgattgtaactgctgttgctggcgtcgttgtatgctgggcgatgcgaaaaatttggtgcccgcggggctcgaggaggacagcgcccgaggggacggcgaccgacgcgaagaagcggatgcgacattttggtggacggagctgctggtttcgctgagccaatccgcaaattcacgcgccgcttcgtccgccaatgggaaaaagccggcacggacatcctccttggggcagaactgctccaacatttggtgaatcacctgcggacatttggaaaatgtacctctgatgatcaatacggcttttcaactcacttgatagaggaaaagcgcctgctgacagcggatacaatcaacgaattggtcactgtccgccttttggcagttgtgggcccagccctgctcttccaacaccgtctcggaatggtaccgaaacagccgagcaatgacggagaacagccgttcagtgttttgctcattcagtgccgaagggccaccggccaaagtgatctataaaatgggacaaagtgagacgaatgaacgtacggcacggcatcctcaaactgtaaacactaacacatgcgaatgattcagcatggcgtctaaagcagatcggaactgctaattgtaagagcgaaaactcactaccaagtcagtgttgactttttccacctttatccattcaaagatctaatcatttacagtatccgtcacagtactgcctgtacctgttgtgccaaaatgtcggtcatgatcagttgcactgccaatggtccggtgggcggagggggcgttcctttctcgtcgtctgcctctcgttttgtctcgttttcctctctttctccgtccgtcttctcctcctttgtgctattgttgtcaatccctctgcctccctctcccatcggttgcgatggttccgtcgcgctttggtcaaattgaacggacgcgggcaaaggggcgggcaatcgctggagagacgaagaaaacacttccaggagcaagtccagcgaaattcgaatgtcaatccgagtcagcaactgcaaaaaacggatgccattttgggattgtccgattttggcattttttaaaattaattaatttaaatgctcacatggagccaatcaatcgccttcagcacttcgtcgtacacgtcgtttaatcgcaccgcaataaactcgaagaggncgtgcgcctcaaacggaagcgggcacaggtcgg

SEQ ID NO: 18096 - DNA, 1259 bp, Heterodera glycines
catttttggaaattttttgaatttaattgaaattttttcgaattttccaaaatcccgcaatcccgcacgggatcccgcaaattttaaatgcgggatttgcgggattaatcccgcgggatcctgtcccgcaaaaaattttgagttccagtcccgcagcgggatccgcaaatttgaaatttccggtctctacttttcaaattgttgttctaaaatttacttcctttttttattgcgaagacagaagacgaactgatgttgctgggagaggaagacgacaccattgaacctgagagaatggatgccgaaacggaagaagaactgctcgggagagcttctgttgttggcatttgctcgcaaaaggcaaaattttggtttttttccagggaaaattcaattcataaggcatcattttgagaaccctttttaagacgatttctgttgccaattcgaacaacggaaaaaattccaaaaatgagcgaacgaaagcgaattcaatgttcgggaccaaatacgacgagaatttgaagcgattccaattcaagtgagggaatgggaaaaacttcgtaaccattttcaaacacagggatttgtcagagttttggttacatcaaatgcaaaatctccgttcgaaactaattgcaaaagaatacggattttccaccctctctcttttttgtccatttgttttattgccattttgacagcttgtgcggtgctccatctgttggccctattcaattcggtggtgggatggacctttcgctgatatcaaataaatcatcggacgcgagcacaaacaatgggacgacgacggggggcagccgaagcgaagggaaggcaaaaagtgcgaaggatcactgacacttgaatttatcctcaatttaaatgtttttcattttttagacaaaaaggcagagacagcggcgacaacaaaaaggacagtcgtcgccaaacgcattttgaaacggaaagtgccaaatccatcggcaagaaaactgacggcggatgcgagccgacatttgggaggacaaagcgccaccgcaattcgagtgaagaaacgccggtcgaggagtttggacaccatgttgaggtgcaaatggtgagttacgttaatcgaactgaccgaccaatggcatttgctgctattttaattatttgaaatccaaaaattacattccattagggacacttcttcgtcttttctggacctcacttcttccaccgatttttcctctttttttgatgagccgaaaaagcct

SEQ ID NO: 18097 - DNA, 1809 bp, Heterodera glycines
  misc_feature (23)..(23): n is a, c, g, or t
ctgctgaaccaccgggaaacgcncaaagcgaagcgccattcggacaaacatcggacggagtcggagccatcgccaaaagtgaacaatcaatcggacaaatgccaatcaaatgggaaacgcttcctttttcagtcttacgaagccgcttctgcttacataacagaattttcgtcaaagagtgcgtccaattcaaatcccgttcatttgcttctctttgccttttagccactctttttgtgtgccccgtgccgcccactttggatgagaatgggctcaagggatacttcctcacttttggagatgttcggtccgttgtcgtgccacacaaccctttcacgggtgaacatcgcgggttcggtttcgtcgactttgccaacgaaacttcggccaaagcggcgtatgccaagaggggactgatttgggtgcgttttcaattttgagtaaaaatcgccatttcaaattaatggcaaacttagcctcgcggcggattgaaacccttcaatttgaattggtaccgtcccaaacgaccgttttctccgccttcgtcaaactcggaactttacgtcttcggactcagtcaaaaatgtaccgaattcgcaattttctcctattttggtcgctacggttccattgaacgcgcacaaatcggacgcacgacggacggcggtcgcgcagcgctccttcgcttcaccgattggcacagtgctttgcgcgcaatcgaagaaaacccaaaacaatgcgaatgggcaaagacagtggcagaagcacaggaacaggtggcagcagatgaggcatttacatgattaatcgaattaattaattaaggacggaacaccgccaatgaaaaaatgggtcaatgttttcgatttgccaaaaaggtaagaatttttgcaaatggaaatgaactacaaaacaccaaattgtttgttcagcaccaatgaaaattcgccgtcttttcgtccctcccgtcgatcggagaactcatcgccgaccattcacaagcagttcttcccggacctggttcagcagaaggcaagtgaatttgggtgtgtacgagtttggactgatcagttgtcaggatcaatcaccaaactttggaatgccaaaattggcggttttagagaaaggggcgttcgcagtccatgtgccgttttttggcgaaggaggaggacgacgcttacaatggcacgtcggacagagaccaatttgaggagggcaaaagggacaatgagtggcagcagaaggggcatcattcgcaatcagaagcactaaaccgagcaaaagtcaggtacagcgaagcaaaccttattgtaaacttaattgactacgactaacttaattaattgcccttaattccttttagtattggtgcaaaacgccctctgacgggtgcttcgtcttcgtcggaggacgactctgaggtgctcgtcacacgagagcatgtgccgcgtaagggccgtacgcttttccgtgccgtcgatgctatgcgttgcgacagtgttggttcggcagtctcggcacaacagcaccggagtcgttcgcacaagccaaaacccgggtggaacagtgtcagcggcgaagggagcggtgagcaattgcgatggaaatgggctaattggaaccaatttggcttaatgggtgttctcgttgtttcaggtgccaccgattctcgccactccctcgccctcttttccctcctcttcctcctcctctttggctttggagtcgtcgctcgtttcggctgaggaattccgtcgaaccaccaccggattcgtcttcgtccgtttcggcattgcgtgaaaaatacgg

SEQ ID NO: 18098 - DNA, 1925 bp, Heterodera glycines
atttcagagttcccaagtgtccttttttctaagatttcttctttatttggcacgacctccttattttgtgcttattcttggatttgaaaataaaattacaaaaacgaataactgttttgaattatatatgtatcatttttatggaagcaaatatttgaattaattcgattttgaaaaaaattgcgtttttatttcgttttcttgaatgtaaaatgctctaaatttcagtgaaaattttgttaaaaatggtcaacatttctatttttcctccggcggcgtctatcggcaccgccgggccttccaaaacttattttttcataaaaaattggccaaaaattgtcatattttgaataaaatttttcaaaatgctgattttttgtcagccaaatgctgattttgaaaattttcagttggcagccctggtttttccgctaataaaatattgttttaagtcgatttttcatatttttattgcgtttccttcacgctactattagttttagaaaaatcttatttttggggtccgaattttagtttttgagccattttgtcttattttgaaaaaaaaacatggaaactctgttttatttacctgctgaattttccctctaaccctccccctgcggtctaaattttttttgttgtgtatcgattatttttacatgctttcggatgtgaactgtctgacttctcgctgtctccactcctacacaaacacaaaaacaaaacgaaacaaatattcataaaacaaatattgctgataatttcgcaacttttaaaaaaaatcattgttttgtttttcatttttttgaccggcaccaccggggaaataactcataaaaatagagggaaaaattggcatagatccataaatttggcaaatacctttttaaacaatatggaagtttcagcaaatttttggccaacgatttttcaaatttgaaaaggctcaaaaaatatcaaaaattatggtaaaactaaaattcgttttttttaaattttttttatcccttttataaatgcgcctcatttcagagctaattaccgaagacaaaaattttgatcaaatttccgagtgcaattttttttatataaaatgccatcgtcggtggaactgatgagacatttgttgagcacgggtgagcattcggatgtgcactttttggtgggggacggagacgcaaaagaggcgagtttaattaaaaataaaaattttattttatttttcaattgcaatttcattaattatccacgttttttaaaggttttgccagcacatcagcttattttgaagagcgcttccgatgtttttgaggcaatgttccgttttgacgccaaaaaagaaagaccggaaaatggtaaaaaaataataattttaagggaaaataccaattatgctatttgttcttcattttgtctctgctaatttccctaattaatttaacaattagtttctggtaattgtcctgatgttgtggagatacctgacattgaagcagaagcgttcaaaataatgttgagcttcatctatacggacgatttaagtgatttgaatggagacaatgcaatggcagtgctttacgccggtggatttaatttttaatttaatttattaattgttgaattccctaattagccaaaaagtacaatatccctgatttggtcgaccggtctttgcaaattcccatctccgaattgcgcaatgttttctttgcgtatgcccaagctctccttttcgacttggaggtgagaaaaacaaatttatttttaataattagggttgtaaattatatggactaaaaaacgcgaaatatggacattaatatggactaaaaaagcccgaaatatggactaaaaggccaaaaatggacaaaatatggataaaaatggcaaaatatatgttgtaaaccccaaaaatcccaaaa

SEQ ID NO: 18099 - DNA, 1223 bp, Heterodera glycines
  misc_feature (50)..(50): n is a, c, g, or t
ggactaaaaaagcccgaaatatggactaaaaaggccaaaaatggaccaanatatggataaaaaatgccaaaatatatgttgtaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaacccttattaataatgcttttgttcgaattcgggtttgttgagctcgaaacttgtcgaaattgtgtgagattcatgatccaagtgtaagcaatttttaaggatttttccatcaaatgtttgcgttacatttgtcaaaatgcggctgacttgttcggatcagatgaatttttgcaaattgatcagaaaatgttatgcaatcttctcgagagtgatcgtttgttactcaacgatgaatttgaaatttggaaaattgtaatttcaatttaattttttattttcattttttaatttcgatatttttttctatttaggcactccgttgggccgatgaaaaatgtcgtcagaatggcattgaatgctcctcgggaaattgtcgttccgtacttggtcctgcactgttcaaaattcgttttcctaatatccatgagaaggattttgcaaaatgcgtcggtaaaaattttgaaatcggaaattaaatagaaattgttttggtcgatatgaaattttacctttaatgcttgaatttcatacatggataaggagggtcagcaaggggaataaaatttatgggaaaactgacaaagagaactgat

SEQ ID NO: 18100 - DNA, 1197 bp, Heterodera glycines
  misc_feature (81)..(81): n is a, c, g, or t
  misc_feature (109)..(109): n is a, c, g, or t
  misc_feature (1096)..(1097): n is a, c, g, or t
  misc_feature (1148)..(1148): n is a, c, g, or t
atttgaatggcagtcgatattacactgacacccgtgaagcggtgatgcaagccatagcaaactgtattttaaattctggcngcaattctaccaaaaacgtgttagaccngcagtactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcggggcgttgacaactgagatggaaccaaagttccataatatctttccatanngctggaaaggcagaattgaatggccagtcgatatttacactgatcacccgntgaagcgggtgatgcgaagccatagcaaactgtatttttaaattctggc

SEQ ID NO: 18101 - DNA, 927 bp, Heterodera glycines
tagcgagggggaaaaaagggaaatgcctgaaaaatttggctatttttaacaaaaatcgttaaaaattctgaaaatttttcctcggcggcgcctatcggcacccccccccccgccaaaaaactccaaattcttcttaaatattagctcaaaattgaagtgcttctaaaagggtttttattattgaaattaatgaaaaattttgaaaattttcgaccacaggtctaaatttgccatttttccccaatttttgctgtttttctcccgattttggcccatatttagagatttttcgcctcagaaaatgcaaagcgtttattctgatcctaatttacttttaaatagtttttagattgagttttttatttattttgaaaatttaaaaaaaaatgaaattacggattacgtattacggcaaattacggccttttttgacctccgtgatgacggattacgggtacccgtatttgaaaaaatcgccgtaattacgggttacggacttccgtaattgaaaatcagttacgtccagccctggtatggagaagggatggaatttttagacttacacattttttgattagtgcaaagttcggtttcgtccttgaatggcaagggcgtcctggaaattggtccgtttcacatgtaaatttgaaaatatccttgaattcaagattcacacaaaattccaattttttccctggcggcgcctatcggctgatcggcaccgccggaacatatctttctatttgcttttaaaatttggttacacagccaaaaagcgttaaaaattgatcaattttggcaaaatacgttaacatattttctatttttttccccggcggcgcctatcggcaccgccggatcccctcccctatttgagattttttgcaaaaagcgcgccgcaaaaaaagttgcgtggaaagtaaaaaa

SEQ ID NO: 18102 - DNA, 1303 bp, Heterodera glycines
tttttcttttgacgttctgtatttaatttattttttatttatttgctttaaatgaattgaaatttacacataacataaggaggacttgaacctgggaccccctttttggtgactaactcacagaccactgagacgaaaaatcaaacatatttacactggaagcccaaaattgccatgtttttaagtgcattttaggccttccattgttcaggaaaattgattgttttttgagtaatgcctttttaatgggttttgagtagagatcggaccggtcggttttttttcggtatttttcgattttcgatttcggtttttgaccgaaaaaaccgaccgagaaatttttgagtttttcggttttttcggtttttaaccgaaaccgttcgaccgaaataatcaaaaaattaaaattttcccccggcggcacctatcgacaccgccggccccccaaaaatttatcttttcttaaaaattagcccaaaatctcaaaacttggtaaaattacaaaaaaaaatttcccggcggcgcttatcggcaccgcctgccccaaagttatgactagagttcgcaaaaaaaggcatcaaaaagcgcgaaaaaggcactaaaataggcaccaaaaaattgaacaaaaggcatgaaaaggcacaaaaatcccgaaaaaggcatgaaaaaaggcatttaaaaaattttattaaggatttttagggagcaaaacacgtaaaacttaaccaaaattacttaattttgctgatttaatgataattcaatattttataatgtttaccaataaggaaatttttaaacctaaaattttttatcaagaaaaaaatgaaattttggcgaacaatttttgagaaaattttcaattcttaaaggtatattttctgaaatttttttagatcatttcttagtggtgtcttttctgaaatttacttagacatttcttaggggtgtattttcccgattttattgcatttttaatggaatttttcggaaaaaacgtcaaaaaggcaccaaatcgctaaaactaatctttgggattttttagaatcaaggagcaaacacacgtttttttggctccctttttcaatcattttcccaacctataatacaccattcaatagaggtttcaatagctctacaattttactcagaggagatttttcgctttttcaataaatagaaacagtttattgcttttttggaaaaaaaataaagaaattcaaaaaaaccgaaaaatcgaaataaaccgaaaattttcttcggattgtcgatttcggtttttttcagtttttagccgaaaccg

SEQ ID NO: 18103 - DNA, 997 bp, Heterodera glycines
agaaaatggaaaaaagttatttgattaatttaaaattacatttaaatgtagttaaactgttactcatgcgcatttaaaactcatataaaaacataacttttcatatcatgtgaataacagaaaatttcatgcaaaaaattatgagttatgaatgagtaataaaatttcaagaaaatttgttcaagtttaaataaatgaaaatacattattacattaaaataaggacactttttcagaaggatactaactttttgggttgaagaaaaattaccataaagaaatattaatatttatttttacttgattaatttagggtattcattaaaccaagtaatattatattcaattatttaaatgaatgtaaattttttaactgtacctaaaaataatatttttaaattttttaatcagcaacaataaatatgattaaatataaaaaaataatgtagttatattaaaatagaaaattttaatatagatatgacttcacgttcgtaagttttgttagactactgagcaagttaattaaaaaataaatatactatgaatcaagttggcaaatattatctaactatataaaacaatctaacaagtgattgtgccatcattcattctacaaaaatatttaaataaactcaaaaaatttcactacaaaattgtacaataaaaataacatagtgataaaaaataaaatgtgcaacataacttttataaaacaaaaagtaccaaattttcaaatttagggtgatatgttgatttgttggaagaaaagctcaaaatggctatttttaggcaatcggtccaccggcccctaaaattcgccctgaaattttcaaaatttgactaataaattcacaattttcagtgaaaatctgttaaaaaatggtcaacatttccaccaatttttcccccgggtggtgcctatcggcaccgctggaaccacgccccctgtttcaaaaagatttttttggataaagcgctctgcaaaaaacttttt

SEQ ID NO: 18104 - DNA, 1802 bp, Heterodera glycines
  misc_feature (36)..(36): n is a, c, g, or t
  misc_feature (40)..(40): n is a, c, g, or t
  misc_feature (65)..(65): n is a, c, g, or t
  misc_feature (68)..(68): n is a, c, g, or t
  misc_feature (103)..(103): n is a, c, g, or t
  misc_feature (125)..(125): n is a, c, g, or t
  misc_feature (1754)..(1754): n is a, c, g, or t
gaattaaagaatcgcgtaaaacacattttcataatnaaanaatgtttggagcgttcaacaaaatnttnttctgaatgagtacgcttcaaataatgattaaatntaataatatgtaataacccatntaaaaattcaaaatatgcatatatcaaagttctttgtaaattttatgtattatgtgaagcaaataattaaaaatcttaagctaggaaaaagtaagtaactcgtacaaattttccggtaatgaaattacaatttgagacaaagcataatttttaaatgaattttcctaatgcaatacaataattaaaaacatattttccatgaagtccacgattttatacggtactcctggtccgtccaaaaattcgaattataattatttggaaatttaaaaacatatattttgagaaaataaagaacattttatataatcattattcttaaacaattaaatttccaccttgaaaataaatatttattcaattattaatccaaagtgacatttaatgtgataatgactaataaatatccaaatttattcttatttattcatttttaatgacaaaaaattaaatgtcttaagttgactactctcagaagataaaacaaaatttggctgccatgattcaattttcttaaagatgggcgttttgtgtaatatgtgctgagattaaaagttttaattaaataagaaaaactaataaattcaaagaaatgttacaaatttattttttttattggctattacgtataagagaatctcaatataaaacaaaaaaatatatatatggtcacaacgaaggactttttttacaactgcacaatccaagaaaaaatgttaatctactttacaaactaagcctaattctcataaaatataaaagacaaaattatttgtatatctatagtgggcgaaaatgattcgaaactcaaatttaagatataatttaaaataacaaataatttacaaaagaaaaaaataataataataatgcacaacaaaattaatgagtattattttatttatatattttatagtttaaaacagaaaatctgaataataataaaaatttcaacgataagttgtcctttcctaattgttaacagttttagccctttgaacaataaaataaaactataaatgggtatttaaaatcaaaataattcctactttcaaaaatcataaatatgttttcatgactaggtaatatttttgcccattttcttacaaaaaattcgtttaattttggttataggcagggctacaaattaacattttcaaagtcagcattttactaacaaaaaaacagcatttgaaatcaaaaatcaacattttgaaaaaattattcaaaatacaaagaaaaagttaattgttagaaattaacaattttaaaattctgaatataaaaaatcaaagctgaaaatttaaattaaattaattaagaaatcaaaaaacaattgaaaaatgtcataaatttaatataaaccacaaaaaaataataaattcttcttcctcttcgttcatttttgcctgcggaattaaattttttaatgcaaggattgtacataaaaagagagaaacgaaattcatttagcgttctgttcaccaaaagtattaacaatcggtgattttgaaaaaaatacaattaaaaaaataatacaaaaaagataaaagaaaaaattctttttagaaaaaatttaattattcgaaattcgaagattattaaatatattattgcatattaacccangaatataatacgaatgtttattttatggtgttcaataaattataataa

SEQ ID NO: 18105 - DNA, 3435 bp, Heterodera glycines
aaatgccttttttaatttctcacccgatgcaattctttgcaataaaaagataaaagaacacatagtgacaattattgtcccaattttcatattcttttgctgttgaaccgccgcggtctccccaataattgtgcatcgtttcattatccatcggttgtcccattcattttcatttgatttggccaatgtcagcttttcctttgtccattcgttcaccaattcaaatggcaccatttgcattggcggcacatgaacagaaaaacgaatttggtaattgacggaagaaatggcattggcacgaagaaaatgctaaacaatttggaaaacaaaaataaaggcaataaaaatcaatgatttgtcgaaaatgtggggccacacctccttgaaactgttgacccaatcgaagttcgcttgctcgttaaaagaatcgcaacgcaatcgcttgggttggccatcttttctcgaaatgtgtaaccatttggacagaatttggccagcagaaattgttgcatttggtccatcaaaatcatcaccaaacgcagcgggcaaccgtccaaatgatttgattgaattcaattggttgagatcagtgaaaattgtcggcgaagtgcgacgaagcaaattgtccaaatgatcatgacgggaaaagtccaaatggtgaatgtttgtcgaaaaaatgggccaatttcacgaacaaaaatgtcccaaattggctgcacatccgtgttgtgtgatgaatgaatccacaaatataaattgatgcctcttttgtcaaaaatttgctgattggaacgaagaaaagcgatgacggagtgatcgatgtacctaaaaatgaaataaatacttttattgtcatagctctctgatttttaattactcaatccgaaggtgcttaaaacggattttgctgcgcaacagacggtcgtcgggcaatggaaattccacaaatccgttatcgatccgtacataaagtttcgtttctggtcctttgtccttgtgaattgaggttcgattccaaattgtcaattcgcttttgccattgaaatgtttgtccactagcgcattgaaacgtggcgaaagcaatgccaatttgaggccgagttgggcatggtcaaaacagggcaaaatgtccatccaaacgtcattacaaatccaacggaaatgcgaaaacagtttagataaataaatgacgaatttgtgtgacttttaaaatccttttaccgtcggttcatttatgtggcaattagcacaatttgtcgagttacgaatgatggcgtcgtcaaaaagcgaaggaagaattgctgaattattcgttagaaatttttattatttttcaaatgcgaggcaaagcgaaaaaacaaacatttttatagtcatgaaaagggattaatgaatgttttggtacttttccattatgcggccaaaccccaaaattttaaaaaaagaaggggtgctttaaaggacgatgacgatacattcgatgacattttagctaaaattgcggcttttatgcctcctaaataatttttttgcacaaaactggcgctttccccctctttttttaaaattttggggtgtggccgcataatggaaaagtaccgaaaaaagttttagtggaaaaacatgctggggccgaactgacggattcggcggaatttttcacaaatatcatttatgtcatttgtttctggcgtttttactatacttgagccctcgaaattggttgaactccacagttttacaaaatttgttcaaagatttccatttttatccaatgttttagtaagtatttttgcattttacaatttttttcgtaaatattttggcgtttttcgtaaatatttatttaaaatgttcggaatttttcacaaatataaatccgtgccttaataaagtcttttttatgcacagtgaacagtttaccctccttaatttatcattcgccatgcgttgttgtcacttttaaaaggacgacgttcagccaactcatttttactcgttttaatgtttaatgttccaaattggggtcaaatcgataaataaaatttaaagttttttgttcgaaaaatcagaaattttttttgtttcttaaattattcaaaaatcattaaattgacaaacaaaaagaattcttatgttgaaaagttcgaattttctttgaaattgcatcgatttgtccctgattttgtgtttctttctatttaaaaaaatgagtcgatacaaaagatacaaacacctgaattttcagcaattttttttttttacattacttccaggtaaaagttcaagaaaattttactgcgtacaaattttcaaatgtactcatgtttttttccaaaactttgaacaaagaaaatcaaattttcattgatccgtgattttaagtgcttaaatcgccgcatcccttatggaaaaatgaaatgtccccctgtttaaactagggttcggaccccgcccccgtcacccccgcccccgccaggggcgggacaggttttttggcctcacccccgtccccgcccccgtgactctgacccccgccatcccccgcccccgcgaccttcacccccgcgggggcgcgggggtgaaaatacacccctaagaatggcatattcatggataaaaggcaaaaaatttatacaattttgatttttttaaccattttgataaattttttatgaattaaagttaattttattattggtcattgatgtgtagtgtggtgtagtgcttagtgaatcaaccttgacattactttctgtcgtgagttcgattcaggttgacggtttcttttttaatttatttttttaattttaaaattcgcctggcgctgcctatcggcatcgcagggcccaaaaattcgtaaatcttattaaaaaaattctctaaaaattgcaaaaacctatcattttttggacaaaatctattaacagatccatcagttttcaaaaaattttcccggcggcgcctatctgcaccgccggacctctacgctcgcacattcaccaagttttttttttggaaaaatgtgccacaagaaaatatgttacaaatctgagttccaattttgcttgagtaaatcatgataatttaatatattaaaaaacaaaaatttatctaaaaattttattttttttttgtaaacatctgttagaaatcgagcttaaatttcaaaatctgccaggcggcctatcggcaccgtgggcccccccaaaacctattttttcttaaaaaattagccaaaaatctctaaaatttggtaattctttagacaaaatctaggtaatttatgccaaagggaattgaattgaggcgatacattgactaaaggaatgtggagccatcacatcattcataaaaaattaattttttgtaaaatttttggagtaattcaaatcaaacccccgcccccgcccccgcgggggcgaaatttcgtgc

SEQ ID NO: 18106 - DNA, 3386 bp, Heterodera glycines
ccattgggcttttctcaacaaacaatttttctgttgttcttatcttgccaattctgatttctctccaaattgtcaattcgcttttgccgtcgaaatgtttgttgaccaacgcattaaaacgtggcgaaagaagtgccattttgaggccgagttgaggacggtcaaaattgggcaaaatatccatccaaacatccgtacaaatccaactgaaaatgagaaaaaatatgttgaaacggtcttaaaaatgaaatttcgtaattttttaacccaataaattctcacattttcctcaaaattcgcttattcattttcatgccacgcggagactttgtcgttttccaaatgtcacaaatgaatccaacagtttctgttgatttgtatcagttgcagaattgaggcgatggttggcggaggaaagtttttccttttgtttgacgggtgccatttagaaaaataatttgtaatttagtagcctaaaataatgaaattttgaaaaaattaaaacaaaaattgggcgtaaagaataaatgaatcgcaaaattccattttttctgtcaattatgtattatgatgatttagaattttcggatggaaaggaagtgctctctgttttcatttatttatccaattagaacccccgggggttctattgttcaaccttattttttcacaaacgcaaaaaaatggcgatttttttaaacttttcgtcaaaaaattgtaaattcatctgtcttttagtcattactccttatttttaatcttttacgaatgacggacgagcggaacttattagcatcgttaaagtttaaagaaagtaggaaacaattcaaattttactcaaaatcatttaaaattttaggatggaaattttctgtttttgcatactgaaggccattggtcgattttaatacatttataaagagagagaaagagtaaagatttaagcatttgcttctacgttttcattttcgtttttcgtgactataaaaatgtttgttttttcgattggtttctcattgtgtaaaaatatttctaacataattattattgtgccccctttgtgacgtccttcgtaattgtgctaatttccaacaaaatgaaccgccggtaaaataatatttagacaaagttttccattgccctgatttgattttccacaatttcagttggatttgcaccgacgtgtggatggacatgttcccattttttgaccgtcttcaactcggactcaaattggcacttctttcgccacgtttcgaatttttggtcgacaaacatttcgatggcacaagcgaattgccaattttgaaaaatatcgtattgcgcaagaacaaagtgacagcggtgccagaattgcgtgtgtttattgacaatgccaattatgtgccctttccggtgcccgaccattcgctgcccaagaaaattcgttttaagcatcttcggatttggtaattcaaattccgacatggattaacggatacatgttcctattttcagctacatcgaccattctgtcatcgcatttatccgtgccaatcagcaaatgttcgacaaaggaacaaacttggagttcttctatgtgtcttggaacgaaaccttttttgtccagccaatttggaatgctttgatccgccatattttgccaatttttgtgccaaatattcgccaattgaaatttccatgtgctgatcaactgtactgtttgcttcgtttcacttctccaaaagtgctctccgatctcaacattcattcaatcgatgctggtcgtctgttcccaaatgccattgattctggtgaccaattgctcgatgagatttgtggtgattctgatcagccacttgcatattctgctggccaaattttgtctgaatggcttcacatcccggcaaaagatggccaaccgaagaaattgatttgctggagtgattcgtcagaaatcgctgatttagtcaacaatttcaagaaggtgtgtggccacagtttcgttggattaattgccatttgattttcatttcccattgtttagaaatttcgccgtgccaccacttcttccgccagctatcaaattcaatttactgttcatgtgccaacggaaattgtgccatttcaattggtgaacgaacggatcaacgaaatgctgacattggagaaagcagaaaacaatgatgaaagtatggatgaagaagatgatgatgaatgggatgagcgatggataatgaagcgatgtcaaattggggagactacggccgcgttaaaccaaaattcgggcaatttgaacaatgtcagctttacgttctatggaaattgcattgggtgagttgcaacagcttttgctttaataatcaaattaaaaactgcgctaaatttaggccattgtcgacaccgacagaagacgaagaagcgggacaaagcgccggaaaagagtcgacgtattgtgacatgaatggattaatttggaaatgatcgatcattatgtattatgtgatgaaatgaattttatgaaggaaattcgcaaatatctacattcatatatatgtgtacatgtaaataaatcggatgtataaaaaatgacaaaaataaatgcgaaatcaaaagttttttagaatttgtgtaaaaaaataatcataaattggtatttttgcacaaaattattcggtatgcagacaattatattcattgatgaaacaaattgagaggagcaattatcagctatcaatttacgggattcccgacaaattgaaaaaggaggtaaaaatttcatgagcttaaaatctattaaaaacagacactttggtggagacaatggcctaaattaagggcaatttgaaattagtaataatattgtaaaaactgatgccactcacccaatgtcaaactctccataaaggcgaatatccacattgttcaaattttccaaattttcgtcctcccattgaactgtcttcccaatttgccatcgcttcaacaaaaaaccgatatatttaccatcatcatcatcatcatcgtgttcttcatccatattttcatcttcgtcttcttctttctccaatgttagcatttcgttggttcgttcgtttatcaattcaaatggttccattggcgttgattcataaacatcaagacgaatgatgtagttggtcgaagaagtgttggcacggagaaatgcctataaaatggaaacgaaaagcaaatgccaattaatccaaatcatttatgaatatgtggccacacctctttgaaactgttgacccatcctttggtttctgaggtatgcgcataatcacggcaactcaattgctttggcttcccgtcttttgtcggagtgttcaaccatttggacagcgcttggccagcagttgcatttggcccatcatcagcaattgaat

SEQ ID NO: 18107 - DNA, 1065 bp, Heterodera glycines
aatgaattaattaccagtcgatatttgtaattgctaagcaaacgaaaagatttaattaggggacaaggaaaagagaaggaaaacggaggagacggaggagagaaaagggaataaaacaaagtacagagaaaaaaaggggggggggaaagtccaacaaatgacagctgccaaagagacaattcaattcagaaagagcgaatggcaaatgaaagtggcaaatgggcattttctattggccgggaatggactttgcccctaccattttatgcttacatttcgctttggacattgccattcgcatggatcattcggtcaatgccaatggcatcgccaacactcagcacagtgagttcgggcggagaagtgttgctgggacgacgacggatgataatctttgggtgccggggaaatcggcaggcaaatagccatttgaatattaacaaattctaacattagggcatggaagggccaaaaaagcactcactcttccgctaatcagcacgtaaatccgtccccggatttgcgtctgttcgactttcgtccgaaactgccaaaattcctctctcacttgggctgccaacgcgtgaatttggtcctccccaagaaggtcactcagctgacgacagctgaacgtgttgcggctgtacagctccaacgtctccccccccccccaacttttttaaacggctgaagttctgttcctgctgtgactttgcattaagcaccataaccatgtgaaattccgtccggtgaaggacccacagacggcaatggctaagcgcttcaaagtttgaccgatcgcttttgactggtcaaccgtaccccttcccgactgaccaattactgtggcagtcctctcacaatggtacagtatggccaattcgccaaatacgcaagggccttccataatgcgaatgaaacggcgatctttggtcacttgcactcttcccgctgtaaatggaagataaagtgccattcgattatgatgagcactttcgggagaggttattcaccctcgaggacgaacagttcgctgctgagttcccttgccgtacgatttgagtg

SEQ ID NO: 18108 - DNA, 1396 bp, Heterodera glycines
  misc_feature (88)..(88): n is a, c, g, or t
  misc_feature (137)..(137): n is a, c, g, or t
gagagctaaaattaagaaaaaaagttgctaaaaggtaaagggcaaaaatgaggtggaaaatggtggaaaagaaagaatgaatttatgngcaaaaatggtcggggcaattttgtgataatttggcaattaaataaacntcggaattccctccggcaaccgaatggccgactattcccttttcaagtgccatttgtaatggacaaagcacagaaccaacgaacggtgggaatgaacggacgacgcaaaaaaaggaattccgtccgtccgccttggcattgtgttcattttattcttcttctgtcctttgttttcgtttttaagtgaacggaataatttagcggaaatttaatatgacttactcattcattcgttccgttcattgcattttccattttgaaattcattcttttggaaagccaagaaaagaacgaaatgaatggaggggcgggggaagggacgaaggaatatttttgggtggggtaaagcaaagaaaagtgagcagcgatggcacggcacaggcggaattaagccgggcgtcggcatttttgatggtatgccattgaccggagcccatcactcactcatttctcacccattctgcggctcattggcagttcaccgcccccgccatgggttgccctttcgttgccaaatttattggtttactcgccgtcggagatggttggccttcccccggcggacggttggccacgtcaatttccctcaggcatttgggggagagagtgaaagggacgaatgctttaatttaatgctttatgttttagccaaggaagagaaattataatctgattattttattatcatttaatagttaaatagggcaaaactcaaaatatgaaaaatgaattggttaacagtgaataacaaaagcttttaaacaaattaaatctcattttatttttattagtttctaatgatgctcaaatacaattgttaattagtatttaattaatgagttaacagaagagttcaccaagtcagaagaacagaagaagaagaagaagaagcagagcaacagcaagcagaaggttttgactgaacgcaattggccattttccatgtcaattttagagaagaattgcgtttttgaagacatttttcaatgtgagtgtttaatttgtccgtttgcattgactaatttaaattaatgaaaaaactgacagattaccgtacaaatattacagtagctgacaaaataaattaatacgctgaatgcatatcatttcaatatattcgttttgccagattttagcccatcaaaaacagtaactgtttactttctgtatacaatacattttcccttttctcctccctttccattcattcgcccattggtccgcccattcgccgtccgccgatttgaaagggtttaccc

SEQ ID NO: 18109 - DNA, 2357 bp, Heterodera glycines
  misc_feature (54)..(54): n is a, c, g, or t
agtccaaaatgcggatttctctttcgattatgtatccgcgacgtttgtgagtgnatgatgaagccgacgcatcaatcttgtcattgtcctctccgattgatttggctgttggcaaattgttcgaatgcgtcgtcgtcttggtcattgtttgtcgcttcatttataccggcgaagttcgcgtttttgtccatcacaacatcatcgtcatcatcgttgagccaacagttgcagcaggtgacttttgcgctgaatcccttgttgtcctcggccgcaaaaagagcacggagcaattgcatggcacggctttgagcatttgcggcactggtgcgctccagaacagatgttattgcagtaacagcacacctaaattgaaattaattgtataatgaacaagttatgaacaggtaggtacctaaaacctataattttgaactaccttttttaacagatgcagaagggtttctctcgtccgtcattcgtaaaagatgaaaaatatggagaatgaactaaaacaaatgaaattacaaaaaaaatcaattttttggcgaaatgtttacaaaataagtagccattttttggtgggtttttgaaaaatgagcgttgaaaaaacccccctctgaattagaacctccctctgtaatataacccccctttcgaggggggttgaaaaatagaacccccgggggtactaattcaataggtacggtattcataattgttttttcctattgctaggtctcggaattaagaatcattcaaaaaactacgaaaaaattgcattttgggaagctgataaaaatcataaaaattataaaacaaaataaaaaccagaaataaagctgactttttaaagagccaaaagtttctctttcgaatgatatattctaataaacaatgatttatttgagcgattttataaaaaatccttaaacaatgctatgacaggacttatttcccaccctaataaaaataaaataatgaaaaatgcaatgatatacataaaacataatccaacacaataaagattatgaaaaattttgtgataatgtatctgtaaaaataatagactacctcattttatcataaagcaccacctatattggagaataatgatcaaaaattaacaaaatgatgaaaaagataatcaaaaaaaatctagaggattatgtggtatcattctccgaaaaacggagtgagaggaacttgaaaaaaaaaacacaaagaccgtgaaaatgtgatacaatgaaatgacggagataaaacatcgaaagaaaaaaacgcataataaaaattaaaggcaaaaaatcgaacaaggcgaattctaataaatatcaacaagttttactccatttacatgaataaatggaaaagttaaaggttgtagaacataaaaagaaacgaaattgagagattataaaaatgcattagtttaagtaatatattaacaaaagacttgtaaataataaaaaggacaaaaaagcaaaatgctaaaatttaaaaaacaatcgttcaaaattaaaaaaatgtattcaaataaagaagaaaattaaaaaggcataaactatttattgttcataaagatatgacaatgcgaaaactctattaaaattacccttaaaaaaactaggcgtctgagggcatggtgccgaatttagtcagctgggcctagcagttcagggggaaccgttaagcagtcaggtgtagaccgtcgcgaaaacagtgtgttaaatctacattttttcgttgtgagagtatttttttgaaacaaatgttttttggcttcgttttttggggtggcgtccccaagcgaagcaattccattgattttcggtgtttcctcctgcggagtttggcagagaatgggctgcaattgcgcaccagcgctgggacgcgaccgcgattgcgatgcgtgatccgcgattcgcgacatttttttcctcgatcagcgattcgcgaccgctgcaatttgaatccgcaatgcgcgatccacgaccgcgggattttaaatcggcgatccgcggaatttgcgactccgcggcaattttgggtaaaaatttttaaaggaaaattatttattgaagcgattgttttatatattaaattatttaaaagtaagtttttgtttataaaaaatagagtgccacgggaccgggaatttttgccaaaaccgggaccgggacttgccgggacctgagaagccgggaccgggacctcgattttttcgggacctggaccgggaccgcaagaaaaaccgggaaccgggaccaaccgggaaattttaaaaattcaaaaaatttaaaaatttaaaaaaaaattcaaattttaatttatatcaagtgaaaataatacaaaattat

SEQ ID NO: 18110 - DNA, 4047 bp, Heterodera glycines
atccaacgcagaattaaagtacagactataggatctttttattcccgaaggagttcggtctccccataaatctgggcgcatcggttcagggggactgccccgaaaacccaaaaaaaaattttttggagaaaaattatttaaatgaactgactatataatatttaaaataggttatttctcttcctttcagtatccctgcaaagtttggtgcgcttctgatcaagattctgaaaaaaaagttaagcctaaactttttggtctgtttaaaaaggaattaaaaatttttaaaaattttattcatctccctttttgatagaaaaagcatcagagtgcctaaactaacatgaaaataaaatttggagcgattcagaaccctttctgaaaaaatatttaagaattaattttgcaaaaaataaataaaaacgaaagactcacattttcgaaaatttttttgagccagctagctcggcgctcatttcagtgtaagttagacctttaccggggagtatccctgcaaagtttgttacgcttctgctcaattagcaaaaaatatgagtgatcgaattatcactaagaaagttaagcctacattttttggcatatttaaaaagcaattaaaaaatttttataatttaataattttcctgcaccgaaggtactcactcggcctcttcgcggtcatcgtggtgtgtacatcgattacttcgtcattacaattttagtcctaatcagggctggagcgcgcacagaaaaaaaccgcggccgcgcatcgcgcatcgcgcattcaaattgccgcggccgcgaccgcgcatcgcgcaaaaaaaaaaaccgcggccgcgcaccgcgcatcgcgcattcaaattgccgcggccgcggaccacgcatttaaaaacaaaattttcaatttaatcaataaaattttcccaagtgaaagtttttttgaaaaaaaatttgaaaatttgactgcactttgttacgaaaattgcctatattaaaatatgtactcattgggggaggcattcgaagaatttttccattatatagaaatttttttttaaattttcatgcgggggggggggggggaatcttggattttctgagtcccaaaattctggattttttttgaataaattaacaatctattaattttttaaatcgcgtttttgtgggcggttccaaaaaactttttgggaacattgtgggggggggggcggcggtgccgataggcgccgccggaatattttgatattttcagcgagattagttaacataatttgtcaaaaaatgaccaaggttaatttgtgattttaggctgtttaaaaattaaagaaaaataaaagttggaatatcttctttattaattaaatttcaattgaaataatgtaaagaaaatatgaaaaaactttctgttccgttgaggaattgaacccaagagacaaacactgaaggtcagaaggtttagccactacaacacataagattatggaggaatactttaaatgaaataaaaaaaatatttttttttctaaaaaatttctcattcctctccaattcccttctcttttctcaccagacccccattcttacctgtgcttaaaaatgcgcggcgcaccgcgcaaaaaaaaaaaccgcggccgcgcaccgcgcatcgcgcattcaaattgccgcgaccgcggatcgcgcaaaaaaaaacgccgcgaatcgcggatcgcggccgcgctccagccctggtacagaattttgtacaattattaattggaaaagaaacgagagcagcggggaaattatgggtaatcatgcgcccttttgccacccatccatcgccccatttacaccccacacaaaatcatataaatagaaaagtgcgtgccattgacccccatgcgattgctcgcctgcgccgtttcgcgcttcaagctgtggtcgccgcggttgaccaatggtccaccgaccggcttacgctgaaaagcgtacaggcttggcaatggcctcgcccgcatgcgcagtcgccatttttacttttaattcctaatatgggataaacagaagaggctaaaaagccagggatagccattgttttgatggtcttaaagccaattctggatttttacacaattttggcatttttttagggttcagagccattttttggcagtttttaaagaatatttaggacatatttgagggatttttgagtgcatatttggcatttttagagaatataactcccatcctatgcgctggaagggctcaaattttgacctttgcgcacaacttttgatgcgcatttgagaaaaaataagggtttttagctccggtggccaattgagcgccagctgcgataagtttgtctcattttcagttcagttttacgaattttttttgaactttttaatcaaaaaattgccccattttaatcagcaagcattaggaattttccgaattttcacttttgtccattccttaatttttcattattttttaaaaattttaaaacaattaaatttaattttttattttgaataaagagcaaaaatgttctcttgcactggaaaaaatttgtttgtttttcgaaagataaaaattttctttactttttgttacaaaatcttgaaattttttattacttagtggattttttgaattcaaactaccgtacctaaatacagtccccccaccctaaattagcgccccgcttttgaggggggttggaaatggagcccccgggggctctattttaggaagtacggtatgcaacaaaatgaatgaaaacataattgaattgatatttcaggcagttatattgcgttaaatccggtgggagggaggcatttttaacaaaggcagacaaaaaaaaaggagaaatagtacacaaactattgcattattaggtagttgaaaaagaaacgagcgtaactgttgaaatagtgcatggactgagcgcccctctgccacccattcctcgccccttttacatcccacagtaaaaaacaaacaattgattacccatcatatataataaacgcgttcgctctgtcgccgtgcgattgcctgccggcgccgtttcgcgccgccccgccatctgtcgtcaacgggcttcccaccgtctgttcaggaccgtaggccgcgcgtcggacagtgggcagatattgtgtcctcatgtggtgggcccgccacggacacgcgctttgtgagacgcaacggtccataaaggctttaagcctggtgatggcttcgcccgcatgcgcaatcgtctaggcgacgatgccatgtggcgctgtggcgcttgcattcggttggagtcggcttgagcgaaatcgccaactttttttttcaatcccaattcaagtaaactagaaaagtaccccctcttttttgaattagaaccaggggcatggggaacaacaattaactaacaaatgccaaactaaatcgtgtgaatttaaaatgactcagaaattttctatcaaaattctggaatctgaaaacttctccaacaagattttccaaggacatccttggcattcaaggacagcattttctctttgcaataaacaaagcgccagcagggatgccaataggcgcagcagcggagcctaaattgtgggttggtctccgtccccgagctgtttgggcctgctgcttcccacgcgaactgtcctccccgacgctccccgcgaatttcttccccgagagaggtcggggactaaccctaacctaaacaaataattgagaaaatagtaaaaatgggtatacattttaaaatattatatttttttttctatgaatataaattgaaattggtgcaaaacgaaataatttttgattttttgtcacaaattcttggaatgtccacgctttttgtgtattttttaatcttttgtctttgttgtcccaatcaatttttaaaaattttctacaacaaaaacgaaaatatttttcccgatttttgagagttttgaaatttaaaaattttaataaattactaattttcctaaaaatgaaatcaaggaaatcaaacaaaatctgctgtacataaattaacca

SEQ ID NO: 18111 - DNA, 3039 bp, Heterodera glycines
  misc_feature (531)..(531): n is a, c, g, or t
accatttaggataggctaatttagccttgaaatatcccctccccgcatttatgtaacaatattatgtagtttttattccactactttcggtctgcaaatgtcgcactaattgtagaagttaattaattgagaccgattatttttaatttttcactgcgatatcatcttagtccataccattaactatgccttgaatatcttaaattatgctttcgattttgactaatttttgcttaaaaatacactattctgttttgatcaaaccaaatacatgcattaaaatgtggataataggggtgctagatcgtttcataaaatccgccaaccattcgatagccaagctttttctctattagcctaaattggtcaacattagaaaaagttatatgaaaataagtactatttctgccagaacttatgttaaatttgataattttatttgaaatttttcaaaatttccaattttttcccccgcgccgcgcccccaaaactcctaaaaaatgatttttgctttatgattttaactattanaaaagttgtagaaaaaatttcgctttcgcatttcgcattttcgcatattttatcttttcgcatttcgctttttattttttaatttggcccatccctgctattcatacattcaattcagttttctttttcaaaagtttctgttagaaaattttttcggaggagcgggggggcgggtaaagtgcttttaattatgtgattataatgttttttttaattataaatacatagctaaatttacaatgcggtgaaaatgcactggttaaatatgtgggaaaaatgtgtaaggacagcgcatagtccaatcaatcaatggcaagcagtacggcataatgggtgccaaagaaaaaaacttaaattaaatattaatataataaaaacaaaatttagtttaggtttgaggttgtccgagaaaatgaggctggagagatgaaaaaattgcaacaaaaaaaaataaataaataaaaatacaatacctaaacactaatattaaatcattttcataattcaaattttgttaataaattggattttatttaaaagttttccaataaaataataaaaaggcttggatctgcttacatttatttcttcataattaattactttatttgactcaaaaacaatttatttcaaaataaatgattcgaaaaatgattctctatttgccattcctattcggtattattttcttctatttggaaattttgaagcctaattaatacaaaagtacacattaatattgtatattttaaaatgaattttttgataaaattttatacaatgaaatttctaataatttaatttattttcagcttttaagtcttttgtcttattagtgtgacttttattagttaaatattattattagtattattgtataaaattataaaagaacaaaaggttgaacgttattcgaaccaatgtgcgtttccgaaaaagcaaggaccatttggataggctaatttagccttgaaatatttaattcaatcatttatgtaacaatattatgtagtttttattccacaactttcggtctgcaaatgtcgcactaattgtagaagttaattaattgagaccgattatttttaatttttcactgcgatatcatcttagtccataccattaactatgccttgaatatcttaaattatgctttcgattttgactaatttttgcttaaaaatacattctattctgttttgatcaaaccaaatacatgcattaaaatgtggataataggggtgctagatcgtttcataaaatccgccaaataaataaataaaaatacaatacctaaacactaatattaaatcattttcataattcaaattttttaataaaatcaattttattttaaagttttcaaataaaacataaaaaaactcggatctgtttatatttattttcttcatgatcagttgactcattcaaaataaatgattcgaaaaataattcatacaaacaatttttggatttttctttgggtttttaaacctatgttttattggtccataataattattcttaaaattttaatttaaaaatttttttctaaaggcggttataaacataaaaaaattgaattttcttatttctttttaaatatagaaaacctattaaaaagtataaattctgtatatttttctcttttatagcttttcgcattataattgatccacaatgaagtaagttatgaattttaagaattttaaaccgaatacgattttgaagctatgagcattttgggaacaacatgtctccaaatttgccaaaaatttcaaaaaaaaaatatcgataaagccaaataacgaaaacacgcaaatttttgtgtttttttggggagtgtattttttaaaaatttccagaccgatccttaggggtgttttttcgcttcttttttttcatttttttcaatatatggaccaaaaatcttaaccaaaccaaatttttttttttagtctaagtagcatatgcgcaaaaaaccaaccctagcaatgagtaaaaaaagagtttaatgagtaaagagagatttttacttttaaataaaataaaatccaatttcagtgtttttgttctccgggattcaagactcgaaaatttttttttgccacttattcattcatttattcattcaattcaattatacttgtattaaaaataaatatatataatatatatatttttttttgcctttttatttcacccattggaaaaatcagatgaatttatgttaattgatgaacacacaaagtgaacaaacagtcaccattgatcattttatgtccagaaaaatatttcactgatgttgactagcattcattagtaatctcatttggtcgcttttatgaattagaactaaaataacaaagaaaataataatttttatcaaatttttggttctaatcacaccacaccaatccaaattttagtaaagggtgattaatgagaatttaaaaatgaatcgtccattaaatcccttttaatgaaaaaaacttttcaattttctgg

SEQ ID NO: 18112 - DNA, 1650 bp, Heterodera glycines
  misc_feature (317)..(317): n is a, c, g, or t
aatagcatttccccatgagattgagaaaaagcaattcccctaaagaagcattaacggatcatttgaggaaacaaatgatccatttggtcgataattggggttgtagaaggcagaatcggtagttcagctggtagaacactcttccggaaggccaacagaaacggcggttcaaattcccccccccccgacagtttttccctcaaaggcttttctcagctcattactttattcacgaaaaataaaaacaaccatttaaaaccttttggtgaaaataataaatgtatattgacttcatttattagcattaataatcattntttataatcatttcccccccccctccctattaatttctcaattacagtttcattttttttcgtttgaattcattctccccccccccccttccttcgtctcccatttcatttgttcgaccttttctcctcccctcccattggctctctttcgtcccaccaaaaagggaccgccccttctccataacgtcggcgatgcaatgagaaggggcggggggagcgaaggtgaaaaaaagcgggagaaggaggagagaatggtagtcaaaggaaaagccaatggaaaagccaaaggaaaagcaaagccaaaggaatgggcggaggagggccaatgaaaggcgagacgaatcgcacggcacaaacagtgcacgcgcaacaaacaaaacgcgcaaatggccccattttaaaccaaataaattccaattttccctaatttttgatgtatttaaaataacgaaatccaacaacaattaagcaattagtactccaattaatgctaaatcccgcaaaattgcaacaactttggacgaccgttttcaccccgcagaacagcaacggaagtgaaacattactgacaaacaattcatttgctcaaaagaagcaaatgtttccctccaccccgggggaaggtgaattttgagaaatacaaaaataaataatattaattaattattaaaatttaaaataacagcagcaggcagccatcatcattatcgtcatagccatcatcaacagaacagctcattaacgacgacgcccaaacaacggcacaaaaggggggaggggagaaaagaagacgaagaaaaaagagacaacaaaaggcataataatgaggaggaaaatgagcaggatgatgagccaaatgaggaggaggatgaggaagagcagagggaagggacacgcaattgtcgcggcgatggcgacgaagcggcgggggactgcgaacgccggcggagaacgcccgacgcgtcgccgacgacgccattctccgaaaagcaacaacaaaatgttgcttcatcaaccgttttggaaattaaagaggagaagcaaaaggacgaaggaattgaggagaagcaaaacggaggcgaaagggaaggtaccaatggacgaaagaacggggcgaaaaacaaagggaacaatggcaatttgacgcgggtgcaatcgccgacaacgaaggacactgacggaggcgagcggaggatgaagcgagcggcgagaaatgtcgccggattggagcaaacggggggagcggcaacggacaaatcgcaatcggcgcagccgaaaagcgaacagcggtcagtgggcggggagggataaatggaactgatgagagagagag

SEQ ID NO: 18113 - DNA, 1139 bp, Heterodera glycines
cgccaacggtcttttccccggcggaattccttttccggtgttcggcataaacatcgaccaggtcaaaaagcaccttaggcgcatattcattccgttttttggcattttgctttgttcacaattaccatttaaattagccttttccacttaattcgacacttcattttcagattctcaaaacctgcaaacagcttgaagattcgaaaaattatgaccaattggcccactttctcaacaaaatgccgttggcagtgcaaatgaatgtcgcgatgcatgagactgtcctcagggcacgcgctctgataagctttcatacggtaaggacaaggccatttttgtttgccttgggcacactttggccaatttccggcgataatttgcatatattttcgccctcatttgccttaaggggaatttcaaagagatgtacgccattttggaaagccacaaattctcacaagacagccattcgatgctgcagaaaatatggtgggacgcacattatcaggaagcagagcgaatgcgggggaggtgaaaaagggagagaaaattggagaaaagtggaaatttggggaagagaaattggaaaaagaaattggaatcaaaaatgaaaataatgaaagaattttaaggacacttggcccagtggacaagtacagagtgcgcaagaagtacccgtgtccagcgacaatttgggacggggaacagaaaacgcactgttttaaggaaaaaacggttgggcatagggcacaccaaataatgggaaagtaatgaaacatgccatctttgcagaggacaatgctccgagaacattatctgaacgacccctacccgaacccggcaaagaaaaaacagctggcggaagaggcaaacctcacaccgatgcagggtaattaatggaataattaattaattgattaggttccggaattgcgattcacgaaaaacgaagttttgaatttaaatgacgaattaaatttaaaaaacaaacaattatttcatttaagttggcaattggttcaaaaaccgacgacaggttggtgacaaataaattaaaaatttaattaattaattaattcaaattatttacagagagaccgagatgccacccaaaagcacaagtaaattcctttcggatt

SEQ ID NO: 18114 - DNA, 1250 bp, Heterodera glycines
tcgtatgtcgctataagaaaatttccactgccgaatcaatttaattggattatttatttgtccaaagatctgattttattttcattttttttacttttacggaattaagaaacgcttggcgaagaaatgagtcaaaatgctttttatttgcattgtgatagcgaaatgaataaagaaagaaactttttaagtaattaacgtattttacgagcagtttttttagttctgacaattttggcgttttttgaacacatttttgaggcttttggcatacagtatttcctcgattataagccccggggcttctattgttaaatccccctccaaagtgggcttatatttaaggggggggggggggtactaatcgaggaaatacggtatattatgtgcatatttgcggtttttagaacataaaaatcccagccggctcttcctaaatgatattttagattaccctatcaacagatggttggacaatatctctttccgtttcacaattctctgaatagatgtcactttcggctcaatttgaagaattgctgatcaacagttggataatcatacaattcttttcagtgtttggattgtgtgttcagttcatttatcgttttttgttgttgaacaggtaaaaacgcttaactcttgcttttgacacacgggagtcattcaccattagagcccggcctggacctggatccaggcctggatttttcctggatccaggtctaggccatttttcggcaacatggatttttcctggacctggatttttgttcaggaaacccaggtcaaatgagcaaaaaaatctaggccaaggcaaaagcctggatttcctggacataattttcgaatttattatttcaagtggccgatttttttcaagtttcaattcaaaaaatgtttaaatagatttaaaaacagattattattgtaaattatattttttagatgttcccgccgaagaaatttttcaaattgagcaacttttgcgtggaaatctcagcgactttgtgttatattgtgaacgaaaagtatgatgtgccgaatcatttttaaagattatttaattttagttaggattatcttcccgggcaaattttaatgggagcttctattgtcgaaaatatcatttgttacacggtaattgtcatttgcgggtacaaaatgtccatatttgttcataaaaactaggacaacagttcaaaacagaatacaccaaatcagccgacaaatcatcattaatctgatca

SEQ ID NO: 18115 - DNA, 1204 bp, Heterodera glycines
gtccgcaattgtcttacgcaattgtcgtccgcaattgtcgtccgcaattgtcgtccgcaattgtcgtccgcaattgtcgtccgcaattgtacggtccgcaattgtcgtccgcaattgtcttacgcaattgtcgtccgcaattgtcgtccgcaattgtcgtccgcaattgtcgtccgcaattgtcgtccgcaattgtcttacgcaattgtcgtccgcaattgtcgtccgcaattgtcgtccgcaattgtcgtccgcaattgtcttacgcaattgtcgtccgcaattgtcgtccgcaattgtcttacgcaattgtcgtccgcaattgtcgtccgcaattgtcttacgcaattgtcgtccgcaattgtcgtccgcaattgtacggtccgcaattgtcgtccgcaattgtcgtccgcaattgtacggtccgcaattgtacggtccgcaattgtcgtccgcaattgtcgtccgcaattgtcttacgcaattgtacggtccgcaattgtcgtccgcaattgtcgtccgcaattgtacggtccgcaattgtccggtccgcaattgtcgtaacaccccattaagagcctttttattcacatgaataaactacaactctaatgatttcggaaaaaatctaaatattaaggaaaaattaataaataagatgattttcttccctattgatcactagggattgttttttatgtaaatacatattttttccttgattctccatagcctaattagtaggaaaaacactttcttttttgtgtttgcgaacaaaagttaggacttttatttatatatttttatacatattttggactttttcgtacatatttcgcaatttttcgtacatatttttttgtgcatattttgaggatttttgagaatttatagaaatttttttgtgaaaaattaaaaaatttttttgaaaatgtatccctaaaaaatctatttttttcaaaaaatgagatatcaaaaataatttttaaaataataaaagtgatttaggtaatttttaaggcattttgtgcctgtttcaccctttactaggaattttttccaaaaaaataaccattaaaaaaattttatttacatatttggtacatattttgggttttttgtacatatttctacatatttagcacttttatacatattttatttgcatatttcgcgatttttattacataaaaaacaatcccta

SEQ ID NO: 18116 - DNA, 1527 bp, Heterodera glycines
  misc_feature (1416)..(1417): n is a, c, g, or t
  misc_feature (1430)..(1431): n is a, c, g, or t
  misc_feature (1465)..(1465): n is a, c, g, or t
acatttacttttgcttctgcgcccattgctgtcaaattgtccattggttttggctcgtgttgctgttgttgtacagcttcaatatgttgttgctctcgttgttgctgtccctcttcgtcctgcgcttttccttcgtttggtcccacgcaaattttcgtgttaaaatcgggtgcaacagcgaccaaaatgaagcaaatgataaacagctcaatgacaccaaatgtaatggtgaacgacctttttaaaacaattcacagattgcggccgtaaacaaattttgcgatggttaaaattcacttggaatgacaacaacaggtacggtaacgccggtggttgggctcaaacgggtcggcacactgtagcggcaccggttgcttttggctttgggctgtcgtgccgttgttcggcttcgtcgcgttgtgcgcttgagccgatcttctgtcataataacaactcttccaactactttaaaggaattaaattttaatgattttaattaaacaaaacctgccacaggcgcatggcaattttttggaaaaccatcgaatataattttccattttctttttcgcccttagtaaaaatggcatattttttcaatcgtttctacatatatatcaaatgattaatcacgataaaattaaaaatttttttgcttcgtgcaatagcaaatatccaatgattatttatcctaaattccttcttaaaaaatattttattataaaaatatcaaatttaagtttccttaaatattcttagcatttaatttgtcttaagtctgaaatattatttatagaacactaaatgaacagaatggccaatcattttatcattcgctccttggcaacgatttgttggcatttgcacattttcctcctttaatttgggaccatggtaactatgagaaccctctcaaaagtttgtgtagttttggaagcctgacgaggcgagaacaaaagggggcgatggggtggagaaagggcgtgtgccataaagaaacgcccgaagttggtgggaaattcaattatttatcaaaacgaaatgccatttggaatcacaagccaacggaaaggggggagggaactctttttggtgcatttaacaccgaaaatggataagggaccgaaaaagaacaacgttcaaattggatgaagtttattctgataatggtgtcatgacaattcgtacaaaaggcaactcgtacaattgcttaagttaagcctaggctttaaccttaggcttaggcctaagctttaggctaagcctaggctttgggtctaggcataggcttaagcttaggcttttttttttgtaaatgagttgaattttgtacgagtttcctttgtacaacagtgtacgagttgccttttgtagagttgccattcattaacccgggagccgatcaggaatggcacnngtcgtttccgaannaattaaagtgttgtcaaagcaaatagcccctttnccaaaaacatattaaaaacaattgggtaaattgatatgtaaaaaatctgataaaaatcactg

SEQ ID NO: 18117 - DNA, 1694 bp, Heterodera glycines
tagcaggaattatttcagatttttaagatccttttgaaatagttttttaagtttgttcagacttttttccgccattattttgaccatctctcacttcgttgaccctatcaccttcattctatttttgattcgggattatttggtgctgataagaagccgatatattggactaataaatacataaataattgcccataattagggcatccaaaaatatggatataaaatcacgaaatatggccataaaatatggaccaaaaatcgcaaaatatggatttcaaaattccttcaaattcgctaaattaaagtaaaactttcaaaaatggctaaatatgatattaaaaatcattttagaagaaaaaaatatgataaatctaaaatttactcatttttagcaaaaaatcaactagaaagcgaaactttacttttttaaacttatttttgacctaaatttaaatttttaaggaaattaaaatttattcatattttcgagaaaattttattaaaaaatgattttttcggaaattttccgggttttcggggtcaaaaagccaatttagctgttgggggccgttctaatagaggttttttggaaaaatgccaaaatatggaaatattgatataaatcgcgaaatatggaaaaatatggaaaatatggatatagaaatccgtcctagaagcttcaaaccaagctaaaaacatgtttttcgtacgtttcaggcccccacagtccagaaaaaaaatatggatttccataaaattggacgccctacccataatatttcatttaatttcgatatataaaattgcatgtttgttcaaagacttttttccaccgttgtataagttagagaatttttaaagaaatttacattaaaatatagtagttaatttctttcctaataaatttgtgcgttttttcttttccttaaaaatagtttacacaagtaagatgtcctcattttattttagtaattcgagttcaatctgagaatgagcagcgaaatcaagagaaaaacgtacctaattgataatcattaataaatgcatgttccaaaacattcattcacttaaggcgttatttgccggccgaagtttggcatgccattttgggttttatgtgccgttccgatttgtcggtgaatgtcgctttgacttgcgctcgtttctctgtcttttcgggtgtcttttgtttggtttcctcataaagctcccattcattcttaccaatcagatgaatggttggccaaacgttgtggtcgtgttttgcccccggttgagtttcatcgcttccgtttgctgaagcgtggccacgaccgctccgtcgcttaccgcgcatcgctccaaacccgcgaaggctccaaagacatgccaattgcggaagtgccgtcgcccgcacatttcaaccttttcagctccgttaatattcggtttgaattttgcgttcttattttattactcttccaaattttagatcatttttttacaattttaatcaataacaatttgagtttttcacctgattgtgagaaaatgtgaaaattgagaatcttatttgtttttggattagtaatttaggatttattaattttttttgctggaaaaagcgaacaaaggtcaaactaaaaaattttggccgatgttaaaaaatggtggggagggcggaaaagtgaatccatcctaaaaagcattgt

SEQ ID NO: 18118 - DNA, 1796 bp, Heterodera glycines
tctctctctctttctctccctctcttcaaaggcctttcagagtaacaaaaagtgaaagattgtccctttgggaaagaaagcaaagtgaaggaaagaaacaaatggagatgggcatttatggccaaatataattatttttttagttccatgtgattttctggacaagtggtgtttgatcaatacacaataatcaatgatcaaacattaaaccaaaatcttaggtggtttttctaaaatgttggttaaagtacgaacatgcgactttttgaaaagtgtcatgtgatttctgctaaaagatcgatctgtgtgatttttgatcactgagtttgatcaattgctgctgatcagtgtcagtacggttcagtccccttgtcccacccttttcgtcgtcccttccctttccatggcccttcgatggtgcgcattccttcggctcagttaattaattgctttcgcctccgtttaagtgaggactttcccccgacatttcaatgttttccttctcaacaccattttgggctgtcacactttttaaaagacaatctttccattttccgtccgccatttataaattagcgcagaatttgcaataattgcgcgtttatttgattttgtgttgattagcgctccgattgcgccgccgttgtctcttaattggcccatttgcaactgttccttccctttgcctccctcccaaatgcgtcaacgcggccgtccccgtcgctcgtcgatgccggccgttgcgcaccacaaggtgcaaaatttgtgggaaaaatgatcgaaggcaattccagctccaagacactccgtacgggcagcagcagcagcaaagtccgtcccagcagtactacagcggagaggcggacacggagagcggggaggaggaggagtcgcggcaactctcggaccgctactcgcgcatccaactggcggaccacgcgtggcccttggccggtgccgagcttagtgccaccagcaatcggcactttccgctttcgaacacaaaaaacggtaaaaatgaggacgaagcggtgccgaccaactcggaatctctaagagtcgcccatgccttttgttgaaaacgcctacagtaaccccaactggccaatgcttacagattccttcgacgacgacccttcccttccaacgacggattttgattatttgtacggccatgctcagcagcagcagcagttcagcaccaacgacgagttggagcccgatgactccgctgcggcccaattcggttgtgggggaacgaagcggaagagggcattctccttctccagtgcgccttccgcttccgccaccaacacaatgacgaccagcacaacgacgattatggggctggtgaacgggggaggcggcgcggggccgtcgtcggcgatggtcggcggcggtggcccaacagcggcggttgtggagaagagaccggccaccaaaatttgccgagtttgtggcgacaaagcgtacaggtggacaatgccacaaatactgctccaaaccgccttttgttcagctacaacttcaacgtgatcacttgcgaatcgtgcaaagcattcttccggcgaaatgccaacaaagagaaggttttggcgcccaatcgaccgaatttgaatttcgtcccaaaggaaattcggtgtccattcaacgaacagtgcgacattaacattctgtcgagacgcttttgccaacggtgccgactgcagaagtgcttcaatgttggcatgaaaaaggagtggataatgagcgaagaggcgcggctggagaagaagcagcgcattcaggagaacagg

SEQ ID NO: 18119 - DNA, 1782 bp, Heterodera glycines
tacgtttggtactgaattggcactataagatttgaatcggttcaaaaatcggtctatacataattgtcggtttttatatggcgcggttcaacttcatataattgtttttcgacttagctcgtcaagagctttcgaatttccaccaaaagccaacattcttcccccccccatctttaaattgcccattggtcatctgctgacccgtgcccttcccttgaaaatggcgtcgttttgtgtgccctttgatcactggtcactaatgagccttaattgtgtcatttactcctcaccaattatacgctcatcacactaatagcccaaccacattaattaaaataaactgatgactcaatctctctctgcccctttaatgcctcatttttcgtccgtttcttaatttattctttataattttaaggtttttcctcgatcatttcgttttacgtaattttaaccacaaaatacatatgtctgctgatgataattttgttgtgcatgaatctttcaacgacacaagtaaactgaataaaaacattgcctaattaattaattaattaattgccgaattaattaagtttggcccgccagcattgggggcaccgattttgtagacatcccgtggtggaagagaatggcattctggcgcaacattttgctcaatgccagatttaatattttgtttaaaaatgaaactttgttatttttaagggacttttcactgtacgtacaccgacaaatgacgcacattcaaatgcaactacggtaataaaatgccaaaaagcaattttaaagttaaaaaaaaaaaatttttagtcaattatcaacgcggtgactgaacttacgaaaaatgtggcccaattggagcaacaacaggtgaaaaatgtttgacaaaattctaaaaattttatttaaattccaatttttccgcagggaatggacaaattggcgaatgtcaaagaaattcaggtcctaattacgtaattaaatcacaatttttaggggtcatggtaaaaataaaatttccttttttcaaaaatattccaaaaatgaaaatttcgaatttgaatttgttttaatttttaaattctttaatgccattttgcctatctctttcgaacccctaaaaataaattttgcacattttcagtcgcttctcagcgcagcgattgacgaaaaattgtcctattttttgttgatggcattttttctgatcatcgtcgttggccttctgcagctgatgatcaaaggaattgccgataaaattttgatgcgattttggcggaacaatggaaaagggaaggaggaggagaaggaagaattggtggaagaaaaaggaagaggagagaaaggaggacgacatgaggaggagccaattttagaggagaatgattgggatgaggaggaggaagaagaaaaagaggaggaggaggctgaaggagaggaatttgttggggaagaggatgaggaagaagaattggtggaagaaaatggaagaggagaggacgaagcaagacgacaggaagaggcacttttggaggaattggaaggggaaagggatgaagaggaggaagaaggagaggggaatgaacgagaggaatttgttggggaagagaatgaggaagaagaagaaaaggaggatggaatggaggcatttttggaggaattggaagggacgacagatgaagaggaggaagaagaggaggaatttgacaatgacgaggaggagaagcggaagacgaagaaccaattgtgaggaaagaagggcacaattttggtgagcaa

SEQ ID NO: 18120 - DNA, 578 bp, Heterodera glycines
gttgaaaattgagttttgggaataaaaattaatttctttatatttttaattaaagtgcgaattttgtgggctgagatttgcgcagaaaggaaatctgaacagccacatccgcactcacaccggtgaaaaaccgtttgaggtgagttacggatttggattttttgactttattatttcttttgcaaaaaatagtgcaatttttatggcatggcatttctcaaaggagtcagcttgacctctcatcgcgtattcatactttacacttttttttcaaacacagtgcgacttttgtggacagcgatttgttctcaactcacatctgaaggaccatcggcgcactcacacggtgagaaaccgtttgaggtgagttacggatttgcggttttaaaaacaaaatgcactattttgatttatttattttttaattccattacctatttggtttttattataaaattaaataaataaatttcaaattcagtgcaccgaatgtggccgacgatttgctcagataagcaatttgcgtgtgcatttgaacagaaaaaaaaagtgcggaaagaaatgatcaaatgggattt

SEQ ID NO: 18121 - DNA, 2471 bp, Heterodera glycines
  misc_feature (39)..(39): n is a, c, g, or t
caaaaaaatttttaaactttttcgtcagatttcaaaaanttcatccatttactaagggagtaggtagcaatttgtgctttccatgtaaatcctatcttccaggtaccactagatttctgaccgttgaatttatgagcgatttttgggacttaaattcttaaaatgtaatacgattttttaaaaatttagttggcaatgccattttctttgtgtgtgacaatgttgctcatctgttccaatctggctttgcaaaaagtaaataaaatacaatgatttaagttaatttagtgattttttttcaagttgggaacgcttttatttttgtgagagataactttacaaatttgttttggaaaacggttgagaaaagtgagtgtttgtttttcaaaaaaacaattaaataaaacattaattatttttttctaattcaagtttggaatgcaactcttttcgtgcggaacggtgttgttgttgtcgtctggggtaccatcgaaaaaagtttgtactttttttcattatgccctcttaaagaaaaaaattattaaaaattggaaaatttttgacccttctaaatgaaaatcatcactaactactcatactagtatttaatttttctacttttcagttttcactgttttcaacgttctaattcgttcaattgcgcatttcttcacatcggcttacaatgcgtttgccggatttgtgttgggcgtttggcattctgtgcgcttttctcccccagcgacaaaagtggaggaattgttgaacaaggcgcaagaaataaaagttcgttagttttctgagtcaaaataaaaatcgctaaaaagtaaaatgagcagattttcaagacttgttaatttttgacataaaaaattattgtttttcaaaaattgtgttatttttttggtgaaaaacatatcttagaaaaaaattccagacctttttcttttttgctaaattgaacagacattaggtatatgaaaatgtattttctttttaggaccaagacctgccttctgatgatcacccgctgattcagcattttcatcgcattttgactgccacattggctgaggagcggacggtcctggagcaacggcttcgtgaattggcccagcaaaaacaacagcagagctcaccatcagcaatattggtattgaaaagaaaaggaaaaacgagactttctcttttatttaaaatcggggaaccaaagagttggaaaatgcaaaaaaaaaaaagagccatttttaagtagttaaaaatgttacctttttttggtgaataaatctcaaatttagtttagaaaaaatcttcatttgcgttatttaatagtccacatttatcttccacaaattgacattaaaaggtttggttagcttttaaaacttgcgagaaatttttcttacaaattttctaatttttttttgtgtgcactcaaatcttctgttacggttttttagcccactccaacaattgacggaaacgcactgaaggacaacttgcgaaaagagcttgacttgaaattgcgcgttgaaaaggaggaaatcaacaaaacggtcaaccattttgaggagcaaataatgacggttagttttttttggtacttgttcagtttacctgacagatttcacatacattttcagatgcctataaatgggttttagaaactaatgaaaatagttttatggggtttttgatgtctctgatcatgaaacaggaagaataaaattcgaaatttgtatggatgatatcctcatgggcatcttgtcaatgagggtattattggtacatgaaacctatcaattctttgtccctgtacagctcatgtagtgaacggtagcgctgatctgagcccggattcgtgatcagcgaccctaaaaaccccttaaaacttattttcattaagtacctttttttccaataattccatataaattgtatccaaaagaaaagcggtccacgaatgattatttatttttttagcacaattgaataatttaaattcagtcagtcgatgcgcctttcaagcgttgtctgagaataaatgaaaattattttattcaaattttttagggccaaactttagcagattcattctttgtcagaattccctattctttactatattttaccaattatgttttcaaaagatttttctagtaaatttagttttttgacaacttattgttgcttaaaaattcctttcgaaacggtggtgtaataatacccttattcttaaacatttttcttttttttgcagaaacttcgcacgctcattgaacaaatgcattcccaaaaagacgtgttggagcatgagattgatgaagtgcgcaagacgcaattggagttgaaaaaagacgtggaagacacagggaaaccgttgttgaagaaggagaaaatcacacaacagttgaaggaggacggacgaacggaaacgatcaaagtgagaaattattgggattaggagcagg

SEQ ID NO: 18122 - DNA, 2856 bp, Heterodera glycines
  misc_feature (1286)..(1286): n is a, c, g, or t
tgcttgggaagcacttgatggaaaaaaccagggttgcgaccccgacgtcggggtaggaaaagtcggggttcggagttgtcggggttggaagcgtcggggttcggggttgggatgaccaaatcgttcggggtaggggttcggggttttttttttaccttatgccatatagtcaaaatttttttattattttttctgaaaaaatatttattaatttccatataaataattttatttgtttattttttatatttttttatcatgaagatttttgtataaaattatatttttcttgaaattttaaaattttttttttcggcgacgtttgtctttttggcggcgactttttgctgcatcgaatttctgcataatagatgaaattattataaaatgttatgatgacaaaaaaggcaatttcgagaaattatatttaaaaaaatgaatttatttaaaaaatgagcaaaaatttctgattacttttttgtttttcaaaacatgtttttttcgcggcgcgctttttctaaagaattttagggaaacgccgccggtattctaacatttttcaatttaaataaattttgtttttcttcgatattttgtcaaaatattattaaattttcatgatttgagttatgtaaaattgaatttttaatttcaactaaggatttagaaaattaagggttaatttgttaacaaattaagccaagaatggtcgatttttatgaatatttttgtttaaaaatcatattagtgaataaaaaaataaattaaaaaataccaaccggtatcgaactcatgacagaaagtaatgtcagtgtgaagaactaaccattacaccacattccgaataaacaaacaaacaaacaaacaagtaaaatagcaaatttacttgattaataaaaatttcgcaaaatggtttaaagaaattcaaaagcgtcggggtcggggttaaccccgaaaaatggccaaaattgtcggggttggaggtcggggcggggtaggggtcgcaactctaaaaaatatgggcgggccggctttgaaccggcgtctctggctttccggaccagtgttctaccagctgaactaccgatcctgccctctccagctgcccactttgatcgatcgcataggatcaattgttgcctcaactggtccattaatcttcctcttcgggaagcttcttcttcttctctatctcagaagagagaccagagcgggagggaatggaactgcccagaaaatggtcaaatgctttggtgagacaagaaacaatgatcaatgctattgcncattcttgcctaaagtgcttgctcaaaaaggacgagtccaaaagccattttcagacacacagaaattgataatccgactgtaatggctaatcaaaaaatggctgtgggagcccaaaatggtgtggtagcataagcaacaggtgccaaaatgaaggaaagatggcccaattttttcctaaataataaggggcaatggtaaacgttatcctggctatgtctttcttgggtcgcgcacttcacaaatagtgggcaacaacacacattttgctgccacatcagcacagcagcaaatttttcgttcattttactaagcgtttgggtctggaaaaaattattaatataaattatatctgtaaaaatttactgaaatttttctgctataaatggaagcgccttttttaatttttctcagtaaattaattttgcatgttatttttgaaaataaatctttcctcatttttggaaaaaacggtaattctttaagcttcttttaattttgaactaaaaaatattagcaattaaaaaaaaatctgactgtttttagagccttttagcctaaaaagcaaatcccttgcaataaaattgttcaaaaataaaattgttcaaagaagaaaatatgtatggttgcctgaattggtgctgttcacttgccaagcaattctcttttattgcaacagattctacttcatttttacaagcaaattttatctgataatgatgacgtaatgccaatgccattctcattttttacttcatgttgagagagagagggagagagagagagagagagagtagaattattttacatattgcgaagatagcgagaatgcgaaggagtgattgagagtcagagaatttagtaaaagaaaaagaaggagagagaagagagagactagagactgactctaaaatatttaattaaaaacaaaaaacgaacattagagttaaaaattgatttttaaaaaacatcatcaacagtaaaatattgtttttttaaatatttcataagcagtaaaacattgatttaaaaaaatcaaaatcatgcgcagtaaaatattaattttttaatggagattagggttattcaatgattataattagggagtgtaattatatggatataaaatcgcgaaatatggacataaaatggcaaaaatcgcgaaatatggacataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacatccgaaattggtctcgaattttttcggcaattacgtgcaatcattttaaaagaaaaaaaacataaaagataaaatttattaatttttttagcgtaaaatcaacaacaaaagcgaaattttcgcttttttgcttatttttgacataatttattaatttttaaagaaaatttaaattttatccaatattctccaagaattttcgggcgaaaaaaggattttttggaaaaatttt

SEQ ID NO: 18123 - DNA, 1148 bp, Heterodera glycines
gggctctaatgcactttatgagtccaatcgaactttatgagtccaatcaattgacaattccgggtttttatacaataactttgttcatgttcgaacaaacctatttttttggtatcattcgaatgcacaaagtctgcataatgtaataatacgagaaaacaagagaattctaacatttcaagaaagttacaaacgaaaataatcagcaattactcaattaatcaaatcttttttggtaattgcctgaacactgcggttttatatattttagcttagttagactttgtgctttcgaatgataccaaaaagatagggtttgttcgaacatgaacaaagttattgtataaaaacccgggattgtcaattgattggactcataaaggtcgattggactcataaaggtcgattggactcataaaagtcgattggactcataaagtgcattagaaccgatttttttctatggctctcaatttccggaggaccaaacgaagccgaagtgtggcgccgaaaagtggtgaaaaggaggagcccagcgggtggccaagtcgaaatttctacgtcgtggagatcagtgagtttgcctaatttttccagcatttttaagccttttaccgatttgtatctcttaaaagtgccgcaaatactgacactcagaaaaattagacaatttggtaccctgtgtgaggtccctgaattatttatcaaaaattctcgaaagctgattcatgtattaaaaataatttaattttggtcattttaatgattattaaatattaaatattttataattttttcgaatagggaaaattggtaaatctaaaatttttataaaaaaaaaaaatgaaattttgacaatcattttttgagaaaaattttcaattcttagggggtgtatttctgacattttttcaggtatttcttagggggtgtattttcccgattttatcgcatttttactggaattttttcggaaaaacgccaaaaaaggcacgataaaatgccataaaaggcatctaacgcacgacatccccgaaatgggcaaaaaaaagacataataaaaactcaacctaaaagcttcaaacaaagggaaaagtgtgttttttatgcttaatatattgaaattattgcgcaaaaaaaggcttatg

SEQ ID NO: 18124 - DNA, 954 bp, Heterodera glycines
atcttttggcacataaaaataaagttacatattttggtttaataatctgtaagaaaattgaaaaatacacccccaaaaatcaactttgttctcatttctacaaattatttatttatttccaatttctactcaaattgatcgggtcacctttcacatttttttttgaaagaaattcgtacaaaaaatttttttttataaattttcaaaaaaacaagtttaagacaaacattttattcattagaaaagacatatgaaattttgtaaattttacctataaaaattaaatgattttttgtggtgcttcataactttattcacattcaaaaaatttacaatacaaataaaaatggagaagagagaatttcgaacaaacaaattgaggctgagttagaatcaatgcaataaaaaaaataaaatattaatcaatatgaatataaaaataatagttgagtatatgtgttttcatatgccatttcaaatttatccatgttaaaccaggctaaagcagcatcgacctgaagtgtggaggagagctatatgtttaaaatgaaaatcactttttgaattaaattataataattggtgaccagaaatttttattttccgcttaatttccaatattttaaccgttgtgattggtctgtgcttttttctgcaatcattttggaacatttcaaaaaaaattttaaaccatagtaattgattatttatttgtcgtatttagcgcctataaaaaattgggggatgggggggttaaattattttaataatattctcatggggtcaaagctttgtttttttaccgactgtacaatttaaccctaccatttgcttcaaattccattcggacaaggtgtcaatcgacttgactttctaatgaaattataaacacttaattaggtggctaaacaataattaaagtggtgttctattgtctcgactcacttttgcaca

SEQ ID NO: 18125 - DNA, 2021 bp, Heterodera glycines
ttgtttagaaaattaattgagtcaatttagcgcctcccggcccctaccggtttattaaatcataatttatttcctagtttctaaaaaattttggatctatatgaacttctaataccggaaattcttgaaaaaaatgaaaattaacagcttattcattaactataattggtggactaaaatattaaaacataatgacaaaatagaattttggcatttgtaaaattaaatttacttaaataaattaaacaatgcaaaaatgtgtatttaaacaaatgaaactcacattcttttttgtatttttgtttttttttaataagctgtagccaaatttaaattattttaaaataatttatattactgttacatcggaagttcttcaattggtggcaatggttcggcctttacattgaaaattgtttaatttgaataaataataaataaatatatacatacatacagtcgcacattgtattttgttgagtgattgcatgcacaacaattcacggtcgcctgacataataattaacaataatttgtattatttaattgggggttaccaaagatttgtgaggtccgatgaagcattccaaaagtttttaagctaaattatttaataatattattttctactcgggctatcaataaaatgcatacgcatccgagaatgatgtcttcaaatttaatagtgaaaagtcaatcatcatccattgaccccccccccccccccggggaatttttcgcgttttaggccaaggaaaagcattcattcaagccatttatgccgcaaaaaagaaaattacttaacccaataaaaagatcatttgtaaaaactcccatttcaaatgggattttcacaagcagttatttgggcgcctagactgtaaccgaattaaaaaattatttttaaaatatgaatatttaaaatttatttaaaataaataaattaccgttttggataggcgtcggaagctcaattggtggcaatggttcggcctttatatagaaaattggttaatttgaataaatgataaaaaagtaaaataagcatacacattgtgttttgttgatagaagcatcgtcgttctgcatgaaaaaattcatggatgcctaaaataattaaactgtaatttgtattatttaattgggtaccaaagatttgtaaggacccgtgaagcattccaatcctaaaataattaaacaataatttgtattatttaattgggttaccaaaaattgtgaggtccgatgaagcattccaaaaatttttacgctaaattattttaataatattattttctatcgaattattaacaaaatagcatacgcatccaagaatgatgggttgttaaaacatctaatcgctaagcaattttcatttattttgggagcatctgttattaattttgtcttattttgctaccatgccaatatttgtttaaagcccgatttgatatgggtctactgcaaaagcccaagtaatatttaatgttttactttgtctgttgggtgtaattgcatcgcgcgcaattccaaaattgggccttaaaataaatattatatcccatttaagttcaaaaaataattaattttaattattttgattaaatcactaacgttttttctatcaatttgtttgaagccatcagtgcttggcgcggagctcagaccacaacgatctcatcagtgatgccaaattgcactcattattaagcctctggtctttttcaaatataaaacttaaaaatcaataaacaaaaaaattactgattttctcagtgataaaaaaacaaattttttttgactgttactccagtaaaattattttgcatttatttttttatttagcctaccaaaaaacaaaatcttttgtttattgtcatcctgataatactatgaaaagaattcaattcctaacaaaaaaaaagactacaaaatccaattgaatgaaatttgttgaagccatcccttcgcaacccaaaaactgattttttatggcctaatccgtctatttatgcacataa

SEQ ID NO: 18126 - DNA, 1270 bp, Heterodera glycines
  misc_feature (5)..(6): n is a, c, g, or t
  misc_feature (1256)..(1256): n is a, c, g, or t
tctanngagtcttgaaaaaattgggaaaacttcactttaatttaatattcttattttttcgaaaaaataaataaaataaatatttgcttttttaaaagagttttacagaaaactttccagcgatgagttttttcacgcaaatttttccaaaatggaaaactgcgatttatgcttcacaactagaaaataagtatttctcatcaaaatatacgtgaaaataaaatttatttttatttttaattataattagcgtgttgcctgtgtatggtctaaaaaatgacaaaatgcacataaaacatgcactacaaatactcaaataggacctaaaacccgaaaaatgcccaaatattcaataaaaacaccaaaatggatttgagctatataaaatgtaaaagttttgtaaaagaaaaaaaatcgagaaaaataaaattaaaaaatggctaatatgtatttttcaaaaacataaaaaattttttgattcaggtgtatttacgagttttttaactttaattatctgataatttattgaaagtttttaaaatttctttccaaagccaaaatttttaaatttttggtatattttaaaatttccaaaaagtccttcttaggggggtctattttcggttttattgcgtgcaaaaaatatcaaaaatatgtttaaatctaaaatggcttaatatgcatttattcttgaataaccagaaataagtatttattataggcgctaatttttctccgtccatctttcaaattagagtgagttattaataaataactaaaaatcctactttgacggttgggcacctaaaaacttttaaataacaatagttaaaattagggtcgcagcatagggtttatcgggcatttagtaaatttgaactttttaagtacttttttgtgatttaaatacaccaaaatcaaaccagtaatggtaattaattaattatgttggcaactaaaacctttttggccgtttctttcacatttcttcccgctttgtttgcaattgacttttgcaattcccattgctgcttcagttcatgcagtgccactgttctgtagtttctgaacagtgcgtgaaaagattgcagtgccgtggcatcatttgatggcaaattgggagcaattttctgccattttactaaaattataagtgtttgtttaatcgtttcgtccgggtttcgtttttctttcctttttggtgcgtttgacttctctttgagcgtaacacctccattttgccccttttttggaanatgctccgattttt

SEQ ID NO: 18127 - DNA, 1046 bp, Heterodera glycines
gggggggggggggggaggggtctcccaccgaaaatttgcggcaaaggggtctcaacaaaaccgagttgccgaccttttttttttgcttttccaatttttacaaaaaaacttttggggaacatgggggcggcgatgccgttaggtgccgccagaaaaattttgaaaatttgctgccatttgctaacagattttgtctagaaaatgaccaattttggcgatttggggaccttttttaagaaaattggtacaatggtggaaaaaagtcttgactcaagatgataaaatttgcagaattttaaatttcgcctggaattttagctgattattttttgtttatgtatatttatttaccccaaaatatgggccttttatacaccacaaaataatttcaatccgctttatcattctcgtgaataagtcttctgatcagaccttgctcaaaaaaggggcggaaaaaagtcaacttgaaaaactatttaatagtttacccaaaaagctgaaaaaaatcttatttatataacttttgatactgttaaaaaagtctcttataccaacttggtcagatcactcctttatggtgaccgagacaccaaaaaatacattgaaaatctggaaattttcgaaaaaaattcctagggggttaggaaaatttccctggaagttttgaataggctcattggaaagaacacaaaattctctaccgaattgccttttgaatggtagggctacggtttgtatataaaaagttattcttgggttgaaaattggacaactcaaaaatgataaatttttgatcattttcccttgaatacgatagaaaatagtgattttttatcgtcatcaaatccaacccaagtataactttctatctacaagtcgtatcccaccattcaaaaggcaattcggtagagaattttgtgctctttctggcagcccaatcaaaaaactccagaaaaattttcccagcccctaggatttgatcagtatctaatgttaagcaagcatgaattatttcaggtttttaaatgaactttaaggtgcttttt

SEQ ID NO: 18128 - DNA, 2627 bp, Heterodera glycines
ataattcaatgtttccatcgtagtgtgcgtcttttcattgtcgagttccagacacgttttatgttccggtgtgattgaaatttgggttgtttgatcgtaaatacattcaatctttccgttttgatcaattgcgcagtcgtttgttcctgctaccatgttagtgacttcatcacatgaaaaaatagtcggcgaattgagtaaaagcctaatcatgattaaataaataaattgtttccgtttaattatttttattttctgtaattttctttttctaccgcaattgtagactgatagaaaaataaatatggtgaagcggtatagtatttttataattttaagactaagggtgataacgtaaagggtgagcattatcatgatcagaattagtgcccaatgcatttgacctatgcattgtgggtttcgaatgtattccatacagaagcgacagataattaattcacagattggtgatggaggacatgttaagtttttgtactcagatacgcttgtgcctttcataaatttaatgactggtttatattcgttcatagtaatttttgtaggtagagaaataaattcttcgctctgtggacttcgctttaggataaagtatttatcaaccaaaatttctaattccgtggtagtatgagttgggtttatttttattccaccttttgtacattcagcggatatttgttcgttttcgaacggatcgaattctctttttttacgtttgagttcatccatcaatgtgtcattagccaaataaaaaattctttcgatgcttccccatgcttttattgggataatttctcggtctgatttcacaagataagttttttcgtgtggctcgtaaaagcaaaattttgttccatgtgtgtcagtgcattcgtgttcttgacagaatttttgtgtaccaatcgtcagattgccctccccaaggcaacgataatcaattcgagaattggcttgtgtatgaagtaaattaagacttttgactgaatgaatgctattatcataaagcattattgaactaaatatatttttatccattagggagcatttttccgttttattgaatgaacaaacgtttggtttaaagaatgaaataatattttgaatattctcctgatcagttatttctctttttattcggtgatatgaggcaaaactacaaaaaattgtccaatcaggacatttgcattgtggtccacaatagggtgggtgattttttatgacgtgttgtttgtgacaaaatattttacgataacaaaattccattgttaatttattttgtctgatagtaaatccattttcaacacaaaatgttgtatacttcgttctccatttttcattggtttttggacattcatataaatgggataagcatggtaagagttgcataaataatagaagaaacgtgagtgtgtttaaaaatactttgcttaattttggggatgataggacactttgttttctctttcgatttgtaccaatttgtttgtgttcagtggtttttattaagtttgtgatagtctcattctcttcacagtcatttttgttaatctctaacggatatagtaattttaatggacggttaatgacatgtttgcttggtagttcaatattagcacctcttatgataccgtcttttccttttatgacatttttaataattcctgttttccacattgctcttggtgtctcatcgtgaattatgacaacttcatttggttctggaaaagattttacacaattctttgggtttttattttctgttttgtatctttctctcagactcggcaaatattcttctgtccaaattttccaatagtcatccaaaatttttgttgtctttttccataactctattgtttggtcataataagttggttttggtaaatatgttgggtcattagtttcattttcttccaaaattgggggaatgcatagatttttgtgcgggagtataaaatcgattggtctaagaatttggtacgaattaatttcgtcataaatgaatgtaattggtcgtgagtttactaatgcttcgatttcacaaataagtgtttgaaatgaatcaaattctatcaatttccttccgattgcttttttcattgctgattttacattttgatttaaccgttcgattgctccgttttgccaaggggctaattcaattgaaaaaatccattttatgttttccttttcgaaatagtttttaattgagtcgtctttaagtatgtcctttaattttaggacttcaggtaatacttttgatgcaagttttaattgtgatgcattgtcactccaaatattcttcggtgtcccttttcttgaaataaatctgcgaaatgcattgagaaagtgttgaactgataatgatgtcactaattcgaggtgtatcccacgtgtggagaaacatgtgaaaagtattatccaacatttttcagtgaaacttttaatttgaagtggacccatgtaatcaaggccaacgttttgaaaaggctcagttatttgaactcttgattttggcattgcggcatttttggttgctgatatggttttgcgttatatcttttgcattagaaacatttgtttctgatttggtcaacaattcttcttcc

SEQ ID NO: 18129 - DNA, 1052 bp, Heterodera glycines
cagctaacacagaacctgggagaacgaatttattatttcattaaaaatgaaaattaaatttaaaaacaccaaccaacatagaattcggggatgtcaattaccatacgtctttcaaacatgtctgcttggacgagttgttcaaacaacgggtctctacgatcaaaaacttcggagcgaagaaaatcaggataagcaattctaaattactaaagaataaagcgttttaatttcttccccacgggaaatcatccagagaaattgcatttatccgctcagtcgacggctgcttcacattttttgccctaacattagcaagcgtagtggccaagcgtgtagaaggaagcctttttagcaataatgaacaaactgacaaatgcattaaaattttttattgaatcttaatttgatttatttcaatgataagagataaattaagcagttgtttttcaaagtcagtaattaaaaaaatatgaattaaaaatttagtaatttctgtaactgcaaacattggaagggcggatatataagtagatttatttgggaataaaatgaaatgcagagaaattttgaataaataattaattgtatggccttatgttttgaaatttaaaaaggctgattcgccgatttacctttccctttttctcttatctgcatttttcaatttttcaatttctcatttctttccttttcttttttgtctcaaaactaatctaaggttaagaaaccaactattgcgatggatgctaatgaaaatatgcaaacagaagacaataaaaaaggaaaagtgaccaatgatgagcgtaacttggtcgtctcatttattcagtttttgcgtcacaaagtctcatcgaaccaatgcactgatgaacagattgaaggccttgaaggttttctttttgactaattgttggtggtatataaaaaacgctgcttgaattttttaatcatttcatggctttttattattgtctataatttaatgcatagaattaatcagccagaattctaaacaaatctcaaatttatttcatccagtggtgaaagcatga

SEQ ID NO: 18130 - DNA, 2624 bp, Heterodera glycines
  misc_feature (2583)..(2583): n is a, c, g, or t
ggccaagctgggaacccttctgcaaatgctttctctgagatgcttcgtgttggagaggctgtgagttattaccatggatttttttaaagtccgattttaactcggcaagcacaaatcttttgttgaatcgctttttccgttttcagcttgctagatcgatgcaagagagtaacccggatttggttgagcagctccgtcgtcagttcggtggagaggacggaaacgatggtggcgccggagctggaggcaatcagaacaacaacaaccagcagcctccgcccggcagtgtttgagaagtaaaaatatcagtgaaaaggagggaacggacagaaatttatgtgatggtccgattaattgtccttctccttgtgctattccttttgatttcatcagaaaaactattatattattatgtgttctctccagcaggaaccgttatttgttaatgtcacataacgcttataaatctattcttggaaaacatcttatgaaccaaataaatcaccaatttgcatttgtatttaagcaagtgtaacagggcagtgggtaattggggggacacgcgctgcacgggtcgaagggcgcgagttgggttttgcttgcatcgaaaaatggcactgctgcaagtgaaaaaacggagaaaggcggcggttggtttgaagagggacagggcaacaaattgtagcagttctgctcctctcgggaattcctttccggcaaacactgaattttttggaaagggtaaggaaaaattggcatttcagtgcaactttttggcagggacagttgcggatccgccgccggattccgctaccgcaagtcgttgagcagggactgaaacgggtgcattgacttatatttccgcggaattccccaacggttgctttggccaacctccacgccgaccactcattccattggcaagggtcgctgtgttttttgaatgggcccggctccgtacaatgcctttgttccaccggtgttccgtggcacggaatgcacttagtcggaccgtttgtcagactttggtctgcattttcattgggcccactttcaactcatcactgacagcctctgccatttcacattttctccggtcacaaattctccatcttgtcctaaatggtcgtgaagagcccatcggaagactttggcattccgtccattcactccaaaaagtccattcggcgttggcttcggcaatggaaagggaaggatttgtccaagcttgggatggctcgtcccgctttgtgttcggctctgtcgagagacatgcccttgcccttaattaacagttgcgtcgcttccctttggaatttgctctcccactgcgtgtcactgccttggcatttgttggcatttactcccaaacatgccctggtccgagtttgcgcaaaaactgacattgggcaaaagttaagttgacaaaaaaaatgggacggactccccgcggagtgctcaaagcacagcgaccaatggttccaaggtgaccattccgcgttgagtggcacaaattggagaaagaccaggaagagggtgattattaagcagtggaacatttgcccaaagcatggcaaaacaattaaagtgattagcggcggaggaagaagcttccttcctccccggcggcaacggaacacaaacaatcggaagacccttccgtccctcactcactcacttcccccgtccttccaatccctttgccctctcatcttctcgacctaattatacgagcaaaaaaacagtaatttgtttgttttacactcaccaattttctaaaataagaaatgaacacacaacaacaaacttaagcagacaaattattgtttattcacttattaatttgttttgtctgctattttccacaattcccttgacaaatggccgaattgccgtcgctcgataccaaatttatgtggcagcacacgtggccaagtgcggatgtcctctgttcgtttcgtacaatctcatctttgggaatgtgatttttcaattgtattttcggtgaatttattgcgagcaattcggagctttggcgcggtgctttcattttggaactcggtgccggaatcgcggcacttccgtcaatgacggcacttcgatacgacgcagcaaaagtggtgataactgagcaaaaccaagaggtccgaattttccatttgttgtccgaaatggccccaaatttaatatttattcaagttgcaggttgttggcctctctccgtgctttttggcgcgcctttttggcttcgtcttttctcgcggggtcgtgcggttggtggttgtccggggggtgctcggtccgttcggtgctcttttcttcctgcgtgttccgtggctttcgtcctccgagtttgggttggcttcggcccggcgcttccctggctcgggttgttgccgttgtgccgtccgtcgccttcgtcttcgcttccggcgtgttcttcggcccgtgcgtgttcggctctcttttttggctgctgcgctggctcttcgcccgtttccctctgctcgtcgcgttcgttgcttctcgcctccgcgagtgtgtgctcttgccctctcaaggttccttcccttttcctttttntttcctttccccctcatgggatggtcggttgaggaactttt

SEQ ID NO: 18131 - DNA, 3223 bp, Heterodera glycines
atattttgaatctattataatgttttgatcatttttgtttgctcttaccatgctttatcatttttgaaccctttttttggcgggggatggcctcccccgactgtccctcgttttttcttttttccacatttattcattgtccttcttcgatcaactttgagtttcaattgcggagagtgaaaatattatctattatttattttttcaaaatgaggctttttgaacttaaattaggcaattaaaaattttcacttaacatccatgatttgagcattaaaacaaatatttttttttctaatgagcaaattaatttttgctttttttatattattttgcctaatttttgaataggttccgaaaacctggcattcactcctttttggtggttttgccaattttactgtttttcatttaaatgtcttattattggccctttacaatgggcacttttacaaatttatcccaatgtttcttcgtcgtttcgatgttttataattttgcattttttgccaaagaaaaattcttaatgaatttttccactattttctttttcttttttctgctaaacttcaattcggttcaaccatgtggttggctgaaaaatgggccccccacggtgattcaaaggccaatttggacagactcggcaagttacaatggcctggtcagtaaatgaataattttgaattttatttaatctaaattatggtgacatgacaattcgtaccaaagcgtacttgcgccaatggtcttttattaattttttaaatttttatgcattattttgtatgagttgatgctgaccccatcttcgtggcatggcgcatgtgaaattgttatttggggacctctatatttagtaattcattttaactcaaattgacaaagtttttaattaacttaattaatctcaatcattgaaaagcaagaaaatgcttcagtggtccttgagaagaactttacaactctgtcttagattaagatttgcttggttttccttttgtacgggttgttaggaggttgctctgccaatggtcccatttcataccattagaacgcaacgatgaccgagcagcactttggcattaattgcgttgacctcgaattgccgatggacatttcacaattcaccgttaacgtctcagcaacactttttgatctatcgtgtgcaatgtttcttaaagaacgggaccttgacgaactgcccgacaattatcttcaagtctcaaagcgtggcaacttgaagcctgtgaaatgatgcctacagtaatgagatgcaaaaagtagagtgattctcttgttagccgacatttttgaccgaattttgcggatgattagtgaacaaaaaaatgatgaattaataaataatttataattgagatacaatttttaaaaattgtcatgaaaaaataaaacgtagcagcagggcactactgtattgctctgtgatggctggcagatttgctcgttcttataagatttttccaaaattaaaatcagctttttaatttagcaaaattataaatgaaaaaaattaaaaaaaattaaaaaatacttttaacctaaaaaatatattaaataaattaaaaaattaattcttttttaagttgttttagaataattcgtaatttttttaaatttttttaactgcctcttgattttttaaggcatttataaaaaataaatcctttttaaaataaattgtctagaagtgtacatttgtttatattaggtttttaattttataaatcatatttttgtttatttatattatattttaccaattgtttattaaattcatcattttctaatcatccgtaaattcatttgcatatgtcggtcctaaaatgctgcactacgattatgtaaaatctcttctcaaatgacaagtttagatcctctgaacttgttgggtgttttgttggcaacaaattgcccataactcatggtcaaatattcgcgttgtgtcgtcgacatcttgggaaatctcgttttgccgcgggttttcgaattcggcactgttccagacgcagtccagaacaaaacaaaattataatcgaatcgactttggatttttcttttaccaaaaaaaagtgatttaaaaatttttttaataattattatttccttaattaaggttttccataactcgaagtttcccaatcaacattcacgcggttgaaacagcaaaaaaacgaattcctattttcttaattgattttggaaacaaccccgatcaaagtgcactccgagaaaaaagtgatggcattgagatgctaacggatatggacaaaaaggtgaatcaattttaaataaatttaagtatttattttattaatctagaactttttggggaaaattagggtttttaattatggctcgtgtagtgacctacaaaaaatgcaggtctggtctggtatatgtatatgcaatttggaaaaagcaaaaattcaattttttgaaatgttatactaattgtttataacttaagcaaaaaataaaatgctggcgccctttttgtaattttccaaaaaatgttctaggaattgaggttttgggcgttatcaacggaattcacgaatattgatgaaccgaaattaaatggctgtttttgtttaaaattttgggtacttttccattatgcggccgcagctcaaatttttataaaaaagggagaaagcgtcagttttgtgcacaaacaaaaaattatttaagagcataaaagccgcaatttgaactaaaatgccattgaatggatcgtcgtcatcctttaaacgaccgcaaaaaaaattttactcgccaaaactggcgcttttccttcatttaaaaaaaatttgaagtgcgaccgcataatggaaaagggtgcttgcgcgttttataaaaaccgccacctagtcgcgttttataaatccgccagtcgcgttttataaatccgccagtcgcgttttataaatccgccacctaacaattcgcgttttataaaaccgccagtcgcgttttataaatccgccaaaatggaaaggcgcgttttataagtccgtccagtcgcgttttataaatccgccaaaatgggtttgggcgtgttatgaatgggtcaataggcgaatagtcaacgacaattctagatgtattttttttgatgctaaatagatcgataaattttacgtggcaacatgtgccagtcagcctgcaataatctttggcgcatactacagcggaataa

SEQ ID NO: 18132 - DNA, 2731 bp, Heterodera glycines
tttttgaaccttaacgaaattttccgaaattttgcaggtcccacaagcatgtgaaggactttcgaatgatacccaacaatcttttggatttggttgacaaagaaaaaagttacaaccacaaactctggctaaacgtgggcaaacgaatcattaaaaaaaacaaaaaaatatttttgctttttttttgtattgccccattttgtgaattttttttattgcgccataagtccgtcaaaggtttaaaactaaaacaatacaaaatattgttttttaagtttaaattttcaccatcaatttttgaagcggcggtgcacacaagataaatgtcaaaccattcatcaaagcctccccacggtttgctaatttgtgccattattttccatggcaatccatcgatgtacactttgtcgctgtaccgactgcacccggccttctcacgtacaaattccgatgttttttcaatttccagaaaaatttccattttcgattcagcaaatgtgcgtcgtccgtgcctcggaaattgcagtgggtacagtaagccaccagtagaattcctacggtattgttgttgaaggttgaccacttcttctgctgttaaaatgccggatgtaactgtaaattaatatggaaaatacagtagcgaacaattgaaaaaaaattaaaaaaaattaattataataattttataaaataaaaaaagttcaaaaaagaggtggaccaaaaaaaaacaaattaatttttttaccaatttttcccgaaaaatcctcttttgagaaaagtggaaagcgaattttgaacaatgccgggccaagcatttgacggcgattctctgctgaacattcaatgccattttcacggcacttttggtcggtccaacggagtgccgaaaaaaataatttaaattaatggacatattttccaattaaattaatttatttttaaagtaaaatttactgcattccaaattgaaatttcttcacggattttcaattcgtcacgttccaaaatttcgcacaacattttttggtcaatttgcaaaaaagcatcagatttgattaaaatgtccgcgttattgtcaatgtaagccaagcaattgttgacataattctaaaataaacaataaattggatgtttttctttaaaaaataaatttaatcgatgagattattccatataataatttaaaaatattatttcacctccaagtcgaaaagacgggcctgggctaaagcgaagaaaacattgcgcaatttggagaaggggatttgcaaagaccggtcaatcaaatcaggaatattgtattttttggctaattaaaaagattcaatattaataaattaaattctaaaaattaatccaccggcgtaaagcactgccattgcattgtctccgttcaattcacttaaatctgccgtgtaaatgaagctcaacatcactttgaacgctgctgcttcaacgtcgggcacttccacaacagggcaattagcagagactaattgagaaataattaagacaattagcagatgctaattaaatttaaattagagcatcaaccgaaaccaattgaaaattagggatacaatttctagtgattttttttttttgctcaattgatttgaagaaagcagctcaaaaaacgcatttctgcgttaaaattttttcatttggacgtattttttggtcattagaaatcacaattttggcaacttcgtcacttaaaatagtgaaaattcactattttagcgttttatcattatttttacactttttcaacattttttggaaaattcctttttttcactattttggcactttttcgtcactattttagttaactaattcgagactttcgtcactaaaagtcgcatccctatttattaggttaattagcagagactaattgaatcaattaacaaaaataattaatccattttttaccgtcttcgctttgttctttgttggcgtcaaaacggaacattgcctcaaatacgtcggaagcaaacttcaaaattagtttatgtgctggtacaagcttaaaaaagattttatttttaaaaatcgaattttattatttttattttcaaaatttgcctcttttgcgtctccgtcccccgccaaaaagtgcacatccgcgtactctcccgtgctcagcatcaactttagcccagcaatcgccgctttggacatgataaattggaatattttctgaaaacataaaatgtgtagtgcataacgaagacaaaaagtgattttccaaaatatccgaccaaaagaaagagacgcacttaaaaatcgatgttttaccggtgatacggagggagagagattaaaactgaggagaaataaagacaatcacaatgggggcggagccgttatttaaaaaacatcataaagtgcgttatttaaaaaaccatcattatggaaatttttgtcgaaaaattatttataattttgctccaaagcaaccaaatttttagttcttgatgtcattcgatagccctaaatgttctctatcagtctgcaaaatttcaaaaaatttcgttaagtttcaaaaaagttatagctcgaggaactcaaaaaaccttgattttcgaacatttttgaccataacttatttgaaacttaacgattgcagactgatagagaacacttagggctatcgaatgatagcaaggattaaaaattggtctttttagagcaaagttataagcaaacatttttattttgatgg

SEQ ID NO: 18133 - DNA, 895 bp, Heterodera glycines
  misc_feature (17)..(17): n is a, c, g, or t
  misc_feature (35)..(35): n is a, c, g, or t
tcggtcatttatggctnttgtgcctattcaccctntaagaagaatttttttccaaaaaattaaccattttaaaaattttattacatatttggtacatatttttggtttttttttgtacaacatctttttgacagccctaattataatttttagtccgcaggataagttatttttttaataaatttttactttcttccaatccaaataattctaagatcacatccctatttcttacaagcgcataaaaattaaattgaaaattaaactcgcctcttttccgtctccgtcgcccaccaaaaatttcacatccggatgctcaccagtgctcaacaaatgcttcataatttgtatcaattaattgtcctgcttctccaagagttaatttattatatataaaaaagtcgaaattaatgcgaggcgaaaatgagaagttattctatatcatttacaaaaatttgtggtcaatctctcaaagaaatgacttcttctgcagggacggcattccgaagcctcaaaaattttggaaattagaatgaagtgccatccctagcgagcactgttcaaatatgataaatgatcgctggaaaacaaactgagtttctacgaacactcaaaaacaatttatatttttgggctccataaaaaatttggaaaaatatgaaattttctaataattagaacacttaaaagtgatcgaattcaaaaaatcaacataaagccaatttttctgcacattgaatcatttatgtattgtatttttagtagagtcccacgggacgcggtaccggaccgagcattcgcggtcccggttcccggtcccgggttttgaaaagctcaggtcccggtcccggtaggacaaccgggaaaaacaagcactggtaagaatgatacatat

SEQ ID NO: 18134 - DNA, 2337 bp, Heterodera glycines
aaaaatttaattgattgctaatcactcaaaaattgttctattatgcattgttcttttttttcttcataggggcaatgaggtcggttgcgcgacaattggcccacacgcattcttcacagagctcaaagctcaccgcaaaacggccatcttccaagcgcgcgactttctgttgattatgaaacagtcggtcccagtcgtctaaataaattttattaagtttatttatttaaatttaatatttcaatttaacctgcacataagtacgtcgcgagcatgaatttcccttttgccaatttccacagttcccggtcctccaccttgcgcttctttgtagtgtccgactttggtggctccacttccgcgtttggttgattgatttctttttgttcgggaacagcgaaggtaacagatttcttcattttggcaaaaatgaattgggattcgggatggtaatttaaatttgctttgaaaaatggtggagtcaaatttgaatttggatgggagtggccaagatttagagtataaaatgagtttccagtttgcaaatttatgtaatccatctgaaatggttcttgtcactgtattttgctctaaactgctgaactgtcagcccaagtcgctgcgcgatcggttaaatcatcccgaggatcggagtcttgttctgaagcatcttattggtcgtaaagtgcgcacgacctacaacgacaggaacggaatgaccaaaacatttttcgtcggcggcatttcgactaaaggggcggcatttcttccagcatatgggcagctgcgcagtccatttaacatcaatgtggcagcgcatttctatgcgcgacaccgcataaggcttcactttccctatttaccgtgcattggtgagcaatttggaggaggaggtgagaatcgctactacccaatggagcttcttgacctgattgatgacaacaacaacaacaataatgaacaatggttggaccgccttttcaccgaaattgggtcaccatcatcatcaaattcatcatcaactcagacaccgtgcctatccattgatgaagagatgacttgccgcattcacgcagatgaagcagctgctttctgaacaaaccctggccctggaagagcgggtccgaaaatggagaaagagaaagtcgagctgcaaacggatatgctgcgcaaggaaatggagaagcactttcggcgtcaaatgttggagatggaagaaagattggatcaaaaatggacttcgctggtggataaagagcgacaaagggcgcagcgaatcgcaactcaaagttctgcggttattggtcagctaatgatgacaaagggggatgaagagaaagaaaatgaaaaagaggggagaaaaaaataattatcagcaatcgctgtcaatggtgtttgggggagggcccagtttcgttcgggagtaggaaatgtggtcatgttttttgttgtccccaatgctctgtcccgataattgccagtgatgaacccaattgtctgatttgtttcgagaaagtcacccaattggaatatttaggatcttaaaatcgatgaaaaataccgaaaataattaaattgatgtaacatgatcctaaatattagtgctgctcgagagtatcagtcttgagtctaggctcaaaaaattgtcggtactaaaaatttttttaaacgcttttaagaaaataagaatgtctctttttttcagcactactaaacatgtcatctccctttcattcaatgattttattttaaaaatgtattgagaattacagaaattttggcttttagcacaacactctaattaaaatttccgtaattgaaaaccctattatgatcattgtccctcaccccccttaaattatgggttgagcggtaccggtgctggtactgtaaaattgtgtacctagtaccggttttgaccggtacctgtactaatactgattttcccaatcaaaaaataccgctttttcaatccaaaaattatcggtaccgattaccgttcaactcttcctttaatacataaatgtttttcatgcaattgaatttaatcattttaatccatttttattttgaacaaatttattgaattaaaaaataaaacaaagttatcgtttaaagaaaaaatttccgttgtaaatctcttcttttcgaaagcgagcaattgttttctgtctgtttgtccgtgttcgcttctaaaatgaaaaaaattattattagatatttattttgatatatttttaattttaaaattttttatttaattttaggagtgcctaagcactcattttttaattttttttttaaatttaggagtggcctgagcactcaacttttttt

SEQ ID NO: 18135 - DNA, 1151 bp, Heterodera glycines
  misc_feature (1046)..(1046): n is a, c, g, or t
cgttaacaaattgcattaaaaaatgcaaaaatttcccggcggcgcctatcggcaccgccggcccccgtattccccaaaaaattgttggaaaaactgccgcaaaaaaagtggtgtgaaaagcaaaaaaaaaaggtcgtcgcccggggcggaggccccccccccaagccagccaaaatcctgggaccgtccctggggggtggcaaaacccggaagtaccttaatttaaataaaaattcaaaattgtttaataaaatattaagaagtgaaattaccaaagatatttggtaaaacattaaattaattgctgaagatagaaaggaatttaattttggttaaagtctttttaaattgtttgactttgacagttaagaaaaaacaataaatagttgagagaaattgttattaatgtttcataaaaattcaataatttcgctaagacaaaccgtttaaaccaattaaaaatttaataaaaatgcctgaggctgaccattaagagccactttttaattagagaaaaatataataattcctttatattttcatttaaaaatttcaaaggccttttattcattttttaatataaaatctcaaaggattttaattcttcattttaataattaatttttcatatgcattttctttaccaaaattattaagaaatatatttttaaaattttttgcaaatatttttttacatatatcaaaaaaaaatttaaatttatttcacagcttcatcttgtccatgtcaaagatgggctctcattgcaagaagctgttgatgcatcggacgggcttgcggtcattggcattttttatcacatcggcgatgatggcacatcaatggccaatttggaaagtggactgaaaagagtggcagaaaaaggcatttttttttaaaatgaaaatataaaaattattttaaatgaaaatttctcactaaaattattgctttctactaaattgaaaaaaaaaacaaaattttccaataaatttttgttgacaaataaaggaaataaaaaaaaatttgggggaagaatttttgtganaattttccaattcttaggggtgtaattttgaaaatttttagttcgattcttaggggtgtatttttcgtttttacaaagctccaaaatagtgattcctagtgatga

SEQ ID NO: 18136 - DNA, 2202 bp, Heterodera glycines
cccccctttttggaaaaaaaatttcaaaaattttttctcaataaaaacaagttttctaagggtttttgagatcgttgatcatgaatacgacttccatttcggccaatttcgaatcccggacccgaattcgaacaaaaagtcaaaatttacaggtatttgaagttttggcgaataattttttaaacagcagaccttttttttggcaaattatgagtttttagttcgcatcactgtgaattgttttaagttcgttcgcccacattgacatttttaggcaattagcaacatctaatgatttatgcctctaaatttaattgacttcccatttccttggaaattcgttttatccgtgcttgggaattaaagaaaaaataaaaaattaattagtagtaattattgaaattttattactatagtatttggctaaaataattgcccattgggcaattttttgaaaataaaaaaaaaattcaaaattgaaataatttcaatttttgtaaacagttggaactgttccgcgctgtgcaagggcccacgtttggccagcgtctcactgataatgtgcgtccggtgcaaccgctgaacggtcgtcgcgtgcagttccgctcgtccgcgctgaaccgtcaccgtatttgcaaccttagcagcgcggctgattatgtaacgacacgcagtcgcgcgacgcgcacgtgcacagcattgcacgagagcctgctgcaccatgcactaattgcagttgcctctgcggtgattatgacgatgaaacagcagggaataatgtgaacaatcaaaagcggatttatcaacaaatttgtgtgcataatttgatcagtaattgtattaatataattttttggcacataattaaatgtaattagtgatggtattgattgtagtaattgatagctcagattttgtttagatcaatattacataattgtgtttttaattgctttgttaattgccattaattaaaacaagggtttaacaccgcacaaccaaatggaatgaaaatatgtaactataaaaattaatcttttttttatttagttaactctattttttatttgtcattttcaatattttgggaaatttcaagctcatgagattgtgctttcaatcgtccaataatctagcccaaacttttgctaaattttgcataaaattctttccatttctttggtgaatgcttttcatttggcataaatttcttttttgttttaaaatattttaaaataaatttctcttttttaaatttattagcaattttcacaaaataaatgggaaattttatatttaaaatgcaataattaattggttttactttgtgtttgccacgaatattcatcaaatttcattagaaagagtttaggcacaaaatgcattcatattaaatttgagaagaatgctcatttaaaaagcaattaaataaatggttttttaataatttacattttattaaaaatgattgatgaaatatttggtcaatgatgggatgaaaaaggaggaaaattaaatgttgtttgtcagataaataatcgtctggttaaaaattttattgcaattaaaattttgtactgaaattagaatgatcaaaagtgtgacctttttttttgttttcctacccttggcggatttaaaaaatcttggcggatttaggaaacatcccagcaccattcaaagtcacccaatctgctgaattgtaaaaaatatttctacaattttttttggctttcactctaaaatattcacatttttagatagggaatttaaaaaataatcaatgtaagcaatttttatgtaaaatttgtaaaaataaatactacaaacatcattaataaatttgagtaaattttttatttaaaattggtttttatatgaaacgagaaaaaaacatactgcaaaatacattaatcattattaaatttatgtagataaattaattaaatgaatgaaaatatgtaaaagcaaaatattaaaaggaattttaatcattttcattttataaaatatggaaataaaaatattattattcctaataaccctaaacaatttacataaaatttatgctggtggaattaatgaagaaaaaaactttgacgaaatatttggccaaggatgggacgaaaaagcggatgaaagtggagagaatgaaacggatcaaaatggaataattggacaaacgaaggccaaaagagacaa

SEQ ID NO: 18137 - DNA, 3318 bp, Heterodera glycines
ataactttcatcttttcaattcattcatcaccttacacgcacaaatgagctgttttttgatgaaaaaaagtgttcatttggaaatggaggggagtaacttaactgatcggacacaaatgttttttaacacatcaaatgagcgttaaacggttccacaatgatatgattaatgtccaaaatatgctttttaatttcaaatgaacgagtaataaacccgaaacaaaaatcattacggcaacaattagcaagttttttgccattttgggttcatataaaagcgaataagcagttaccattaacagcagaagaacatccatttgctcagcaatttgaaactccctataatttttaaaatttatataaaataaatttaataattttgaaatgactctttatttccaattctttcatttctgattaaaatgcaaaaaaaaaaaaaaaaaaaatttccacagagaaaaactaatcccaaataagtcaatatttaagaaatcccaagattttaactagtaatatgtaattgaaaaatcacaaaattttaccgtaaaatatgcaagaaactcacattgtcctcggcattgcctcgctgtgctctctgctggcaattatcgccaccgtagtcactttgccatcgctgtactcggagatgagccaactgaacaacaaagtgcgcgacggcgttcaagtaaaaaacaattttaaagaataccgtaatttattaccgtattcccaaggccttccgtgtcaacaccgactcggcctggactgacctgatggatgtgcaagtcgtcgtggcaccgccgtcaaaggcccgtgacaaccccttcagctccatcttccgtgccaagcgtcaattgcctggccactgcaattgcggtcccccacaacggccaaactgccctcctggcccacctggtccggccggaccgcctggccaacccggacagccgggaggcgcaggactgcaaggacagccgggagcacctggccaacctggtaagcatcgctacacataattgccataactcgtctcacatagctcctccgtgcccgccccagaacatcccttgtccacgctgcccggctggcccacccggcagccccggagggcagggaccgcccggacagcaaggagcccccggccagcctggtgcgcccgctccgggcggaggacagggaccgcctggcccatccggaccccaaggacagcctggacagcccggacgcagcggaacacccggccaacccggacagcctggaaataatgctgttattttgtaagcattttgatgggctaacttagtttaaatatcattttcaatgtttagcaacaccattcctggcccgagaggagctcccggagcgcctggccaacccggaagccccggcagccaaggccaacctggccagtccggaggccaaggaccgcctgggccccctggtgcgcctgggctgcccggcctgtctggcaacagcggtcagcctggacagcccggggcacccggccaacccggcaaggacagcggctactgcccgtgcccgccccgctcttccgcgatggcactcaaaaagaaaatggcggcggtcaaaaaagcataagcgaaaagtgcaggggaaaagcgaagaaacgagaagaagacataaagcgattctgttgaataaatttatagtaaattgctgtctttcatttctctttgttgttaaacaaatttcttaattgaataaaaagggtatattttctttattagttttattttaagaaagagaaatttaattttctaattgaaacatagtttttaataaataaaattaatttttatttttaaaattgcttattttcatgcgtttggtgcttattttctaataatttttgtttcaaaatttttaataaatgaaaaatttaattttttaattattctttttgtaaagagcttattgcttcattgcttcgttaacaatccacttttactgcgtttgaatagatttaaacatgaataaagaatatgtatatatttcgtacattcgttaaccaatttaagaaaattttaatttattacaaaaattataatttcgttgcctcgttagctcagttggtagagcgtgagacttctatctcaaggccaggggatcgagacccctacggggcttactttttgatatttttttcgaatttttttattaaaagtagaagccggcaaatttgaaaagttataaaattatatcaatgaatgatcttccaatttttcaaaacataatcctctaatcatggaacctttttttcaaaaaataacaccaaaaataaataaagaatttaaccaaaattggaaacagtttagggtggttttaatatgacgtaattaacatgtcaatacaaaagaggaaatggcatagaaaacaaattaaaattcctcatttgcttccattgtaatgtgctgcatgccgtctaaaaaggattgtgccgatacatttaaattgcgaatttttccattatttcaaacattgtcacagtgttcttaatggtaatagccgagacattttctttactataaagcacattttcgagttccttttgaatttggtttactgtttggtactcgtgcagtccgtttgggccaatttcgaacaatttttgctcagaactcaatttaatcttcaaaaagtcagcttctgaaaccattcgctttaactgttcctcgccagaagccaaaatgtgatcagtgaattgctttaaaagaagttttgcttggtttattttaaattggcaatcgtccgacgtttggccatttgctaattgaaataaatgggccaatgggtccatgtaaaaaaatggtggtgaaatttcattggacacaccaaacgacactttaacttgagcattctaaaaaggatgaaaggtaacaaattgatattaaatttttatttgcatttttgtaaaaaaaaaaaattcgctttaattacgcgactaattaaatttttccatattttattgtacctttatgaattttgcttctctgttacaaagagggcatcgaattagttgttgttgtttaaccctaaaattcatatgcatttgtttttaaacaactttaattatgtatgtattaccatttgatgatacaatcattgtgaaaaatatgctaaaaggttcattaacaattaattaattagacaattattaattggtaattaaacttgataatcgtcatgtaatttcattgtttctttttcactattgaatgtctcaagggcaattgaacattcattagcctgaatagcatttttcatgtcaagcgtttcatcataattgttgttctaaat

SEQ ID NO: 18138 - DNA, 3235 bp, Heterodera glycines
ccgtgcaccgtttagcattgtatgatatcctcactattttcaatatttttacttgtttttattgtttatttctttgaaatttctattaatattttacttttgtagtgtttaatgcaatcaaagaacattttaacttgaaatttttaacaaaatgaacttaataaaatattagtagttaattattgtaaaatataatttattaataaataagtttaattcatttattaaaatctaaaaataatgataagaatatatgtatacttcatattatatatcattttattaattaattttcaatataaaatttctttcttccatcattaaaatgtttttgcttagcaataagtaaaaaattccatatatgcacgctacccctctccgcctcccatctgatatgaaattcttaacgcttttttcttaattattattatttttttcatttatttccttatttttagctatcatcaccattattattattttactaaatttattttaatatttattttttctacaactcttcatctcttcattaggcttgggttatgacacaagtaccatttgtcacccctccagtcgccacatgtcaccacacctctcaaataagttttgggttatacgaccaccatttggcaggttgccaactaaattgttcatgctatgccacactacactaaaatgagtcgccgtatgaccaacattttatgccatccacggtcagtcattagcgcttaaatgaccaccagcgggcgctcagatagcccatgcgggcgcttaggtgacacgtgcgagcgctcaggtggcctggcatcccttccctccccaaaggccacgacagctgatgtccgtccctccaatacgatttgactttaataattatttaattaattaattttatattttttcatttatttttaaatttttatctattattttaattttattttaatttatttaatttacctaattttaatttattttattttatttttaatttaatttgaatttatttaatttaattttttaattaatttattattattattatttatatttttgtgtggtattagagagagcaagagaaaagagagagagtgagagagaagagagaatgagagagagagagagaaagaaaaaagagagagagagagagataagagagagaaagaaaaaagagagagagtgagagagagataagagagagtgagagagagagaaaagaaagaaagagagagagtgagagagagaaagaaaagagagagagagaaagagagagagataagagagagtgagagagagaaagaaaagagagagagagaaagagagagagataagagagagtgagagagagaaagaaaagaaagaaagagagtgagagagagaaaaaaaagagagagagagagagaaaagagagatataagagagagaaagaaaaaagagagagagtgagagagagagataagagagagagtgagagagagaaagaaaagagagagagagagaaaagagagatataagagagagagagaaagaaaaaagaaagagagtgagagagagagataagagagagagtgagagagagaaagaaaagaaagatagtgagagagacagaagagatatagagagaatgaatgttagcttttttattcaattattttttaaattataaaaaaattttttttaaatttatttattttaatttaataatttattttaatttaatttaatttattttttaatctttttatttatttttttatttcaattaatttgaactttaacttttatttaattttaatcctattttaatctaatttcatttattaatttaatataattttagttttatcaactttaattctaattcatttaactcgaattttatttttagcgctcaaatttaacaagcgggctcacaaaaggcccctgcgtgcgctcagatggcacgcacgagcgctcaaatggtccctacgtgcgctcaaatggcatacgcgagcgcttaaatggcacacacgcgagcgctcaggtggcatgcgtcccttcccttccccataaggcatgacagctgacgcccatcctctgcctccctttcccttctctaataggatttggccttgggttttatccttcagatgttttttcaattatttacctcttctgggattggatatatttattataggtgttttttaaaggtttaaatttggtactgaaatgtccctttccactgggactgaaatggcggggctgaaaattaagggccaaaatctgcatgggtaactacttatcagttaataaggaattttcaactcttcaaatttgcacgccgccgcataatttaattagcacctcacacacgaaaattttcaaaattacacaaaatataatgccaaaatattaaaaaaaaaaattggcgactcgcaggcgtaaattcgaaattttctttttttaatttctaatttttctttcttttttgtatttttattttacttccatcttttttatagcaattattaaagctgctaaaatgtcaactatagatgttgaagagactatcaagagaattcaatcgcaaaaaggtgtcaccggagtgattataatggacaatataggtaagaactcaaaaaaacaaacgagggtctcacaaaatatgtttctgaaaaaaccatttttcctcgtgtttaggccgtgccattcgttccacgtttgatgatgacaccaccgcgcaccatgccgcacttcttcaacagctctgcgaacggtccaaaaatgttgtgcgcgaaatggacacgagcaacgacctgagcttcatgcggttgcgcaccaaaaagaatgagatcatgatcgcaccagacaaaggcatgcgctcgtctttcccgctttttggggcctttaaatttgcaaattttaaatttgggtgtgtgaaaaagaagtcaccgacaaatttgtaggttcaagtctgtttcttttaatggcgttttgctctcggttttattttttcgattccattttcggaaaatagcgagacatgcctctttttcacgagattactgacaataaatacattgcaaattcccttttcagattatttgattgcagtgatttataagaagagccgctgaaagacagacaaaaaaaaattattccccttatttctatatatcttcacccctttttccatgtatttgataaatgagatactctgactgtttcggtattgcttcactacatttat

SEQ ID NO: 18139 - DNA, 1065 bp, Heterodera glycines
  misc_feature (60)..(60): n is a, c, g, or t
  misc_feature (151)..(151): n is a, c, g, or t
agtcatatcattaacggatcatttcattattacatattaaatataaatttaaaattttanattcaaataaataatagaaaaactttggctatcttttcacatcaagtgctgtatctatacaatttttatgaccataaaaatataaaccatntaagatttctctattattctattcaattaaaacaatttttaatgagttttaatcttgtttaattaaaaattattaattactataaaggattaaaaaaatatttggtaaaagtcaaatcactgaaaaatttaaaaaaatattaataaaaagataaattcatttgaaatagatcaagaaaaaatataaaatactttaataattaataatctaagaacatttcacttaaaattatttgtaaaaaatataatttaattttgctcataagtaattgaaataactcttaaaatgaattaaggaaatattattaatgatttatagttaaatttaaacttggaaataattttataattcataaagtaaattaaaaggatttaaaaagaaaaaaagctggccctctcgtcggcaacaaaattgccgacaatttggtttaaatattaatcctattttaaaatttaaaaatgaaaaaaattatttcattaaaaattaaatttattttttgcattaaacccaactgctaacaaaacaagagtttatatttaaatttgataaaatataattttatttgaatttgggaaaaaatttaaaaaaaacatttaatagacattatttaataaatttaattctcccaaatgaaattttcccagatggagatatttattaaatgagaaaatttaaaattcacaaacatgaccaaaaggaatatttaaaaataaaattcaaaaatttgaaatgataaccgttaactatttgttcacgccaaacgagtgaaaataaattaagaaagcgaattatgttataattaatattaaacacttaattagaaaatttttaatgtttaaagcaaataaactacttataattgggacattagctgttaataaatcgataaaaatgcaaatacaaacacaattttt

SEQ ID NO: 18140 - DNA, 1055 bp, Heterodera glycines
agagaatggctgttctcggaacagcggaggaagaggcgacgaagttaatgccacacaaacccgaaaccggtagtaattaatgactgacaaatgaacgccctccccaaaaatgaaaaaagacggaacgagtcatttttgggtgcaattcattcccctcacccggattttttaaaaattataggggtaacgaacggtctgcgctccggtcatttttcactctcggattattcaaaatttgaatttcgaaagaaaacggttacgagtttgtagcaaatagggtgccagagagttagctgcttttccaaaatcattggcattggcactcgaataaaagtacaaagtttcattggtttccaattaaaaattcccgccccttttgttacgttttattgcgtttgggtccctctgctgctgctgttgtcctccttttccgtgccattgtcgtgtctccaaatgagccaatttggcctcgtaaatgcgtcgattgcccgcattcattggccccgcaatgcaattgcggcggcgcaaccgctcgcgcagttcgtccagccgaagcatggcgaattgatgccgaagtgcgtccaacacggcctcgtcagagtggcgttgtacagcttcaccgtcatcaccatcgcttggctcaccatcactctataaactcaaaaaattgttaaattcttggagccgcgtttccgtaagttgttttgtgttttgcattcgaaattgtcgatggacacgagctgcgcaatcggttgttattattgttgtggttgtgttgctgatttttctgctgtttttggcccttcgccggcgtcgcggccaaaagtgactcatcacccactcactgaccgtcggctccgtagtgtatcagcaactgacacattgccaaattcccctgaaaatgccgacaacaaaaatcattctggaatgtaagttcaaaatatttttgaaggtactaattcagtttgggtcctatattttggtcaaattttaaaaaagcgtaaccagacagtcagacagtgcactatttccttatgaatttttctcactgcttc

SEQ ID NO: 18141 - DNA, 1167 bp, Heterodera glycines
gcctgcaggtcggggagggggacgggaaaggcactcccccgccgagacacccctctcccgctattgcgcggacagtgccattcccccaagcaattcaagtcgagaatcaaaaaaaaccgaaagccacgagcgatcactcccccccccctccgatcgaattatcgccttggacattcattttctgttttttgcctcagaaaacacttcgcttcccatttgtacggttggcattgaagaagactcaatttggaaacgataaaacaatgtatccgggcaaacggcgccaacgcaacttcaaacggtgagtgatggcaaaagggcgaaagaaaggggacggaatgggacgaggaacaactccacgtcggcgggggagaaggatggcgggggacaatgttttgtgtggaagtcacggaaaatgccgtgccgtgctcggcccagacgattgcgctcccttctccagggattgtgggccaattgggtggaaacggaagacaggccaaaaattggccaacattcacagtcatttggccaaaggaatgtcattaaagcagcaattggaaaagcgaaatgccaagccaaaataaaaaaaacatgcctagggaaaagcctaatcaacagaagaaggtcagtgccaattcatcacaaactgactttgaactgttcgttattccccccccccccttctcaattgcattgcttttgcgccttttcctcccccggatgatcccttctcatttccctcaccttcacatccttccgttgaacaattatgagatgaaatggcgcaattaatttctgtaccatggagcagataaatgaaaaagaggggggggggagagggggagacgagcaaatggaaacattaaaaatatagcgaaactgattttcctcaaatcactcaaatattggctctcccccccctccttcctctcctcaattctctgcttaaattcccctcccctctttttcccccccccccccactttccccattctctcactattttatttccctcctccgctttgtctcttccctttccttctcccggtgcgcttcatcatattttgcttcatcttcattttcttttccctataaagaaccgggcgaatgaataaaattacttattccttattaatcacaaattgggcaataaaatcgggcgactgg

SEQ ID NO: 18142 - DNA, 1192 bp, Heterodera glycines
ggggggggggggggggttggggccaagtgcattaattattgctgaaaggtgaaaaggcgagttgagaagagaaatcgcggatgagtgacgagcgaagtgccgatggttctgcttaattatgagaggagcttgtcatcaccgatttcattctcattttcgttttaatttcctttaatttccatatttgggcatgtcatttgtgccattgactaaatatgccattctttggccaaaagcccttttttaattgttttttaaagttttaaatttagtattcggacatttcacaacagcgaattctccacaaaatgccctcgggacattggaccatttggcgaccttctccatgcgcatacgaatcaacagcagtcttctgtcaatgttttgccgtcgaacccttcgaaacggcacagggaaaggctaaacggagaattggagacggtgagttacggtattcccattcgatgggaacaaaaaacagtgaaattaatatgggccattcataattgaggataattccagcgattgttttgctctcttttcaggtggcctctctgttgccctacgaggagtcggttcttcaaaggttggacaaattgtcagtgctccgtctggcagtcgcatttttgcagatcaaagcacatttccaaggtgaataaaagtgattagtacgtgctatttgatgttgggtaattatcggtgatattctgctaatgaagggtggacggggaggggggcaccgacttgaaaatcatatccatccgtcatgctaaaaggggttcatttcagtgtcgagtggggtgaagaacagctgaagagaaactgagaagttggcacttgacaaatgaggggagagggaaaggcattgccaatgggcatttaccaagatattagtaccattctcaattaatgaacaaacaaatgacataacgaaatgtccatccgagtacgaagggggcgagaaagacaaacaaacggcgaaaatggcacaaatggcggaaaggggagggggagggggagggggggggagtgattatgagaaagcgcgagggaatggccaaagcggcacggaacagtcaatgggaggggtcccttttttgggcttctcggcgggaaatttcggcaaatctgaggacaaaaaggagacaaataaatagtgccaaatgagaacaaaagggaaaaaggtaaggca

SEQ ID NO: 18143 - DNA, 3505 bp, Heterodera glycines
  misc_feature (134)..(134): n is a, c, g, or t
aaaataattccaccatttttgtaattcatctttattcaaatgatagtggcatacaaaaaatgacagccttaaatagtaatgtctgtgctaattgatcgatttttgtctaacatcacaagagagtcgcattcgcncatcaccaccagcattatccccccggtgggtactgcctggttgaatttgatgctcaccgctgttgtcccgttctttatcaggtcaaacagcgcagcttgatcatctccactgctggtcaaattgaacacataaatgcagtgggtttttccgaactgttcatagctaatgccattgctttccaatgagttggcgaatcccactgcttcgttcatgtcattgaaagggcgaacatatttccaatttgggtagtccaagtcgtatggcgcttggggaaaggagcggccattagcaataattgagatttcgcgcacattaaacggttaaaagttaaacggactgcgcgaaattgttccaatatagtcagaattagccactaaccccattgtgatacgacggggaatttgatccatgaacaaattggctgtaaactcgaaacgtccatgactaatgaacattgatttcatcagcgttttcctcacagcatatcgtgccggtttcacttcaagttttcgcgcaatgtccaacgccagtccatccatcaatgagacttttttcacatacattttcaaactgacaacctcgaagcggtaacgaggagcagctgcagcaccctgggcaacagcgggcgtagtgattaggacaaactcgttgtcgttgggtaaaatttcaatgtccagctcacagaagttgatcaagtagagaggttggttgaacaaatcggcgtcaattttggcaatgaattgcgctgttctgcttcctgcaaacaggttgcgtcgcgcaatgcatccatccccggtctcaagcgagccgccgatgtcacggtaatagcccgccgcattcaaatgcgagtcctttgccgtattggaataggacagctcatgtgagaagtatgttttgtaggccatcagggaattggagttgaaaacttcacgtccatttatgctcattttgatgtttcggatgaaagtctgaccgatcatctggatcggagcaacttcatctgctgtgaggtcaaccagctgaccatgctcattttctttgcgaattcggaattcactttgtaagtagcatttggacaaatcaataaagttttgactggaatgaagcttgaagtggtagggagtgtccgtcagtgggttactgggaagcagctcaaacacttttgatgaagagacgctcacattggtgggtggaatacgaaaaaagtctaaggcattggtgattgagtttgcactgtcattatcaattttatggaaagccatttatttagtaaagtccaaatgcgtctgaacgaatacgtttgtttcctggtttgctgattgtccgtccaattatggtctgatggcttggtgcatgagatttttttctttttatactcttcattcgaccaccgccaaactgttttggcaggccgcccttctcaagcaccgtatcaattcctttctttccctcgctgacaaatgcctccttaaatggcactccttcgtttcccactctctccagcactcgctgccccgtgctcagtgcctccgatcctactgtagtgccaacacgacgaagaataggaaggaaaaagcgccaaagtccgcgaaacacatcccccacccctgcgcctcgttgtccataccctcgttggaaggggctggaccctcggaagtaatcctcgctttctatgccacttccgtattgcatgtactcatcatatccgataatgtttgggtcgaacacaatatgaaccattttatttgcgtaaaatgagtgaatgaatacaaaaatgagtgggttttaaaaatttatcactttcttaaatattaataccaccatggtcgtgccataggcgaatggcaccagtcgtcccttgtccatcgtgcgcagctcaatttcaatttcgctgatctcccgtggccgcactcgagcgtatattggcgaatcataaatcttctcattgtagtcaccgggtgtggcaccgctcaccgacaccacgcgaagcagcgaactcagcgaattaccaacaatcatgttctcggtcagtccttttgagtagactgcgaaacttgagaatccaccccgtaagtcacagccgtattttgagatttcttgaggcccaacgtgttgggggttttcaaatccaagcacatagcctagctgaggtgagaatgacaagtggctgatcactggatttttgaacaccaccttgaatcgctcaaagtcatcaagatattgtatttctacatcatcgacaatgtttttgaaaggatcatatggccattcggactcattgtcatcgtcgtcgggaaactcgtctccggcagctaaaccgccaaaaacctatcatccacatccaatgtctttgattcctttttgctttcgtttagggcttccactgatcgtttagcgtcctttgctatactctgtggtggtggtggtggtggtggtggtggtgatggtgccggaattgaagtcagaataggcttaataggaggcggcggtggtttcggtgttgttggtgtaggcccaatctgagaagttaaactagaaatagatgttgtagatacggtagttggtacagtggacttctttgcgacatttggctcctttggtttagctgccagaggtggtggtattttagggatattctgcgccttggtcgatgaagcaggagtcggaatagttgatttagatgctggagtgggtgttggagttggcttcggcacagccgctgttttgaacggagaaggcttcggggtcgatggggcttgcttaatgggtggaatgggagcgggagccggggaagttttggttatagcaggtgtcacacttggcttttggggaggtactgtagcagattttggagctgcctgttttggtgcctttggcgcttcagttggaggatgagaaggatgagcaagcgttggagcaggtggtatcggttgcttagcgacaggaggaggtgttgcttctttgactttttcagcctctttccctgtctcatcgagtctggggggaaactgaggctgttgctgctcatctgtctcatcatacctcgggggcgagggcagtgaagagagatcatcaattgttgatctcttgaggcgcttggcgtgtggaggcgagccgatcactaccggtttatcgaagtaaccttcttcatgcgcaagcggcttaagtctgactttttcttgactcttcaatgttgcttgtaaaaaacccctgagttgctcaacttttttgtgcgacgcctgtgggacaggtactctgatgacacgctgtcggtcctcatcaacggaatggagattggtgaaatgaatgtcaatccattggtcatccaaggtaccaattgtggaatgccatgagtagggatagctaatgc

SEQ ID NO: 18144 - DNA, 987 bp, Heterodera glycines
ttaacaacggaaatgggcacaatgacaaggaaaaaaataataaaattgaaaaaaggatgccttgcccttagcaggtcaattttgcctgaaaattcgaattttatttgttatttcataatttttaaagcccacctccgctcaacgcattgtttatttctttgccccacgcgtcccatgtctactgattgatgagcatttaaatacaattcaaacaattagcacttccaccgcccctccccccaggggctacgggcgcatttaatttgaaaaattcggattaaatccggcacaaacagaaaaattgggaaaataccccggacatttaaaaacaaatttaatttcccaaattcaccttctcatcggcacgcttcacacagttaccgtacgccattttcttgaaagagtaccgtatgttaattaccgtatcccgtcgtattattgttttaccatgaactcgccaaggaaaggaagacaaccttttgggggaaaatggtgttacaaaaagccgtagccgtccttgtctcaaaaacaaaccgtcgccctggcgaataccgaaattcctttccgcacccgggaatagttggcgaagtgttgtcggcatcatcccggccgacgagcgttgctgcccgccgccgcttctggccgaccgaccgtccgaggcggcggcgtcgaaactaccgcttagcattcgcattgcctagcaaatggggatgtgccaacgtaagcatgtggagccaaaaagcattgtttataaatatccccccccccacaaaaaacgatttcaaattttccataaatttccttccgtcatatttcgacgcccaaaattcggagccaaatttttttccaagtgaatcgaattccataaattttattactctccaaagcagggctggccgtgatcacggatctcggatcacgggtcacggattttttcaaattttccgtgattttgatccgtgattggcattttatatagggaatttt

SEQ ID NO: 18145 - DNA, 1192 bp, Heterodera glycines
gtgatctcgcctcacggattttcgcgattgtagactcagtcacggccagtcgtgctccagagtcaagagtatttagaagctattaatatgcactcagcgattatcattgcttataattttatccaacgctttgtacaaaaaatgatccgcccccggcatttccattgtccctgatatcagttcgactgacttggccaatcatgttgtttgcagcgccccctccaccgttgagtccgtttgggatgccttggtcgtcgtcgctggcggcggcaaatcgctcgacgactgctggcgatcgctcccgccaccagccgccgccaagaaaagtttgtgccaagtcgaacagtgcccggttcggattcgttgcgtccgctggtgatgccaaggccgggggtgccacggcgagtgggtgccgtcggtatggcgcaattttgttgctgtcactgccctcttccaatgctgtctttgaaaatgctagagccaatcccacacaccgatatgaagagattccgtaggttcaggatttgttccaactccgaattttttggacgaaattccaatgaaagctgtggcattttatttgaccaattgaaagaaaggcgcaatttttaattgcaatgccatagctttcgcaaaattccgaagctcaagggaaacaaaacaagaaagaccccgataaattctgtgagtagataatcgagactctcgcacgccttttacataagtgccgtgcccggtcactgcaacgaaagtcgccagaaagtttagggggcgggctaccacgtcataggttaatcagggtcagttagtcccgagttaattactcgttgggctcaccaacaccaccaccacttttccattagcaccttttcgtcgggtggcgccgcgccgagcgtaagcgatgctaattgacgggtgggctgaagcatgttggtcagtccttgtccaagcatctgcaaaaacgggcacaatttggagggggaggaagcaacaaaaaataaaagaaaagaaaaagtgggacctcggaaggacgcgcatttgttgggattggctttacctcgggcccggaatttgcactttaaaaacaaacctaattaaaatgagttttgagcatattttaaaatagttcttttgattgtaaaaaataattgagtaaattaaattattaaaaagaaaattaattaattaatta

SEQ ID NO: 18146 - DNA, 2985 bp, Heterodera glycines
  misc_feature (1190)..(1190): n is a, c, g, or t
aaaaattaagaatacaattaagcaaattctcttcatacacgattcattctctttcatcccatccttttttcacttcacggacaaaatcgacaaaatctccgaatcgcgttttcggtcgtaaataatatcgttttaaaaagtcgtgagtcgtttttcgctctcgaagaggtcaattcggaaggcacccaaaacgatctctcgtgccgccccccccgtcgcattccttcgccacaaaaaatcgccctcacacaaacacaacatatgatcgaagatgggaaaagcactactaaatgttcggcgttcaactcgataattgaatgaaagtagtgataagcgatgggcggagaatggcacggggacgaagaaaagtcaaacagaagggagggagagaagaaaagggagggagagggaggaagagggagggagagaaggaagaagagggagggagagagaggaagagggagggagagagaggaagagggagggagagagagaaggaggggatgagaggggatgagaggggagggcacaacattaggaagaagcgaaggaaggccaatcggtgtgagcggaagcagcaaaacactggcagatgatggacgaactgtctgctgatgttggacagacatcagttgccgtgacatcattcatttggctaccaaattgcgccgaaatggtataaattcgacaaatcttcgaagacccgcaaagcggggcgaatttgttgaagttttggggattggcacgcgtttcattattttttttatgccaatcttttgattttttgccaacttgcaccggcatttcccatccctttttcgatgggcttttccccacctgctgttaaaagcaatgatcgacagcgtgcctttgccctgcattttcccctcaccccacaaaataatttggtgataattgacaaaatgcaggcgaacaaacaaacgaaaaactggtgacataaagaagatgaattaatgaatggacgagccaattaattagtgggcataattaatacctaattaactaatgaatgaatgaatgacttccgtctccgattaaaccatttgaaaattggttgaagagcgatcagttggtatgacgtgttataattgcattaataaagcatttacgcgaagactgcccccgtccatcaccgttttatggcccgtgtatcccgccccccccaaatntccccccccccaaaaaaaaagaaattccgctcattcattttggttggccatcgattaaaataataaataaataaaaaatattttcaaaaaagtcggctgattttctgtacaaaactgtactgctccctttgatcggataataataaagccattgtttttatccttcgcttggggcggcagagaatcgcattaaatttgcattttccaccggtgattaaaaatgagagcgatttgatcccttttcggagtttccatttttgacagccaaattattattacatattttgaaaaaatatttccctcatcattttgctacaattttcggtctttggtccgtccctgtcgaccaaatgtcgcccggtcgaccatttgtcgcactttcgcagtttgtccaaaatgtccgcttggccttggccatgctgaggccggcgaagcgccttttgacctgcattttggtgccccttttgctcagcccattgccgctgtttttcagaacgaaggcaaatttgaataaaattgtgaaaaatgaaataaaaataataataaattaacaaaaaagaaaaaacccacaaatgggttaaggaggcttcctgcgcttatgtggtgatgataatggggtcggttttgggctctgtttttcaatatataaaaatgttaatttattattaataaccctaaattttctttttcatataattttaattatattattatttttttgttttttcaataatttaaaattttctttttcttttttataaccctttttaattccaaatcttaaaacatttatttatttatttatcctttttttgttatttcccccatttagcctgtttttggctcaccgaagcattgccattggccgtcaccgctttggtgcccgttttcgccttccctttgttgtccattgacacggccagcagagtgtcctccgtttacctatcggtgcattttttaacaaaaaaatcactgaattttcaatgataattttgtttttatttttttgttaaggatagcaatttcgtttttttcggctcaatgataatggcaggtgaataactctaattggggatggcttttccatttttaatttgttcgactttaattgcccgaagaatttaatttaattgccctcatttgtcagttgcggttgagtcctcgcgacttcacgaacgaattgcgctgaatgttttgctgctgaccgggccaaacccgcgctggtatgcccataatttgcccaattaaaaattgttttaaactctttaattgttaattaggctaatgctcggcttccaattggccaccgcttttctctccatgtggatttcgaacacagcgacgacaatgtaaaaatagtcaatattaaatatttgaaattgaatggatgcaattttaggatgatggtcagttttgtggtgacaaaagggggaaggaacatttgaaacaatcaaaacgatggcattttgttgaaacaataattttaaatgcaggtgccaattgttgtggcggtgatcaaagagttggacttgtgccatcggagagagtaaaatttttggaattttatttatgttaaatatgagacaaattgtaagagggattttaaattttaaattatttaaaatataaattaattgccaggagcgacccgctggcggagcctttgccggacgaaggcggaaaaattgtcgatttggacacagtgtccaccagacaattgaacatttacaaggcgcgagaatggcttaaaacataagccaaacaatgttaaaatttagggccttctgttgagcat

SEQ ID NO: 18147 - DNA, 3421 bp, Heterodera glycines
aagtctcggtctcgagtctagactcgagaaaagtctagggtttttgggtctctgtctcgataccgagtctcggagtcaagtctcggaatcggtctcgagtctcgggaaatttttggtctcgaacagcactaataattaaagtcagaaaatatctgtttttcgatttttatcctgtcttactatttcaacaggacgaaggcatccacaataaaagtgagcacaatttactttaataacaatttttttgaaaagcttttgtatgttaatgtttgctttttcattatattgtaaaaaaaaagacatggataatacttataatccatgttaagtgaaatttaatgataaatcgaaaatgttgtaaaattcattatttaatacaattaaaaaacattaaactgaaaaacatattttttaatttaataaatacaattaagctctattaaattatttttcatttttatatatgaaaatatttaatggttccattaagcatattgggaaaaatatgattattactaaaatatagttaaacttcaaattgtttatccttataatagaattttcaattaataagtgaaatattaaaaattattctataagcgtaatctggagtttttaaaaatgaaaaaacctcgaagcacaataaataaaaagaaaaaagatatattcaacggtttttgaagtgttgcaaatgcaaaaaatgcaaaaaaaattagaacaattaaatttttaataatcattaaagttatggcttaatgaaaatattgaaaatgtataatcgatttaatctaggaagataaattaatttaaaattttatatttatttaaacgaaaattatattttaaaacctgtttaaatataattcatttacgaataagacaaaaagaaaatatacaataaaagaaataataaatatacttttttcattaaacataaattttttaatcaataatatgcaaataataaacctattaagttttaaaatttggaatgtaaacttatcgtaagcaaaaaaaaacgcgacaagagatgaattaaaaataaagcaaagttatatagaaattacaatggttgtactaaaaatgaaaaaaggcattaatcaagaaaatagctaattcatttttataattatttaactgtaaaaatttatgaatatttgaaagaattttaaaagtaatttattttctaataacaaaataattcataggtaaaaaatttttctgtcaggccttctaatgtttttagaatgtacaccaataaaattgcaatcaattttttttttgatttgaaactacgcgatttaggttgacaatacattctaattttacagcaatttacttcgtacctttgccctttaaatcgttcaatgaattctttattttttaaaataaaaaatgcacattttatgattaaagtataatttttggaattctcttaaaacattttattttaaatttaattataagtttcgggcggtgcctatcggcaccggtcatcattaaatattataatatcgtttactaaaaatttttaataaatataatgaaaatttctggtatttgatggtactcataaatatatttaaattattataaaccgtagctgccactgaatatttgccgccatcgaacaccagcttgcccctcatgacaaaacttcttcagagtcttctttattctaccgtttacctaaaataaagttaggatttaacagatttatgtaaggcttgatataaaattttcagtaagtttatttttaatttaatttaattaatttctataaaacaactatagttttgtaaagttgttgaatgtgtatccaattaatcattttcgtttaaatcaattttcacctttttgctaattcgctttttatcatttttttgttaaccaaatttttttttaattttttataaattaaagattttttatttttctcataaataatttttaattgttaaaaattacatagcctaaaatttttagccaaaccggaccggacttttaaggttgaaaaaccggggaaaaccgggaaaaaaccggaaatttcccggtcccggtcaaaactggtcaaaaccaggacttcggtactaagttgtccgtgttttggtcctggtcccgaccaacactacctgaaactgatgctcccccttagagatatgtagaacaatattttttcgttgatttttatttatgattgtatttatatcttattttattttttgccatgaatcattattgttaatccctttaataaattctccgctccttattatttccatatcctcttcttttacttctccattatccaattagtttgatcgatttatttacttaaaattggaaaatggttgcgaattaaatgtgaaaaatggaattgaaattaaatgtgaaaagaaggaattgaaattgaatgtgaaattgatgaaaattaaaatgatctgaattccaaaagtatttgagtgaaaaatggccaaaagagggatttctgatgagggacggtccgggatgggagtgggatgaaaaaaccaaaggagagttttgtccgggaaccgaggaaagggacttgggatctcgatgaaagggacggagaagaatttcttctccggagttttgctcgtaattgaccgggggagctaactgatattccgtttccctacggggaaaaggatcagcgaaatgctgatccttaatccccgccttcttttgttactgtgtgtaagggggggaaaggggtactgtacgttacactattttaaattaaactaatgagtagtgtagaacacaaaaagtaaattactcatattatggtcaccgatttgtatgttaaaaagaagaggatcaaataagattgataagaatttggaaagaaagtcagaacccaatacaacatcaaagttattttccgagacccatgagtcttcttctgtgatgagtaattttaaggagtgagtttgagacgctatttcaatgttagttgaaatttgccgatagtttgcaatggaaggaacgacacaccaacacataggggtttggggaaggagtaaaatttggacttttgataacatgccattcggacatgagtaaatgagatgtcagattttaagtcaattttgcagttaattaaaacagagttgactttaagttggatgactgggaaaggagggctttggttacttgctttttgaagctacgaaatggtgttccaggaggaaaaaatatttgtaatggatagatgaacagaatagttataattgaaatgaccatgagagtgaatataaatgtaatgctaatgaaagatatgggagaatactgttcaaaattgttaacattttcgttggataatgaagcatgtacagaggggaatagcgatataaaaagaagaacggtaggcataatggactttttataagaatttctg

SEQ ID NO: 18148 - DNA, 1582 bp, Heterodera glycines
tagcacttttctctctctccgggcctcaaacggttttcggtaattatcgcaaataattaatttaaaacctattaaattattattttttaaataattttaaaaataatttcgaaattcttagcccaactcactttttcaccgatcgtcagtgaagttgcgctcgaaaattgttgaagaatgtttgtatgaatacagaaaaatggtcgaagatcggccatacatcaaaattatttcgggccttgaaacggtatgccaaaaaatctctttttaaaataattttggttgcattaggaagcccatccggcatttaaaaattacctgggcgagttcaaatatttgtgggtcgatttccacgccgttctgaacaaagtgttgcgcataaatacgtcaaaaaattaccagcaaattgagaacagttgccaaatgtcggaggaatcgcccgtggtacggcaaaatggcacaattcagctaatgttacggcccgaagtacagtaaaacacacggacgattttgatcatgatcatggaaagggttaagccaaaagcggggtctgttgtcccttccggttcctatttgttgatcaacaaaagtgatcgatcagtgccttcacatgagtgatcaaaaggcatttgccgcgtctgatcgggccgggaactgcgcttcactttcttacatatttatgcattccaaaaacggcagtgaaatcaaactgatcaaagaatggacaagttttatcctaaaataagaaactgatcagagaatggaacagattttattccaaataaacatggtgggggttctccattttatgagtccattaattcacagacatttattttcatcctcaatttttgttgggtcattgcttttttatggcacatattcattcaaaagttctaaaatagtagaaacagaaacaaaacaaattctcacaaaatggaaatgaaaagacaacccaaaaaattgtgattctgattaaaaatagaaaattgcaaaagtaactgaaggagattaattaattaattaattaactggacttggctgtattaaaataagttgattttgccaatttacaaactaagtaggtttcttaaattttgaatgatcaaagactgaccaatcagtttcatcacttccaattggtcaattccgttcatatgatcagtttcatcacttccaattggtcaattccgttcatatgtttggggtggctgggcccaatttctttcaaaagcttattatttattcaattaatttcctaaatttccgccctattctaaaattttcgctttttcagtcccttttttgcgattttggcaaaaaatttgcatttgtgaagcattattttgttgaactgaagagacaggtcaacatggaataccaattcattactgaggcgagtgaaatgctgaaaaagatggaagaggcctatgaaaattggatggggatttgcgggacgaaatgccgaattggaaatccaaaagtggcggacgacgtccaaatggtactgggcccaatcaaatgccaaaaaattaaaaattttaaaaaaatagacggggcaaacaaaagagaaggaagggtt

SEQ ID NO: 18149 - DNA, 1098 bp, Heterodera glycines
aagagcaccttccaattggcactgaacgcactgaacaaagtgccattggaagcgaacgaatcgcaaagcaatcagacgcaaattgacgggacatgcgccgcgctttacaaggaggtgagtgaggtaagggaaacaacagcaaatcagagacaaaccgcaagagatggggccggcacggggttggacctgctggccgaaaccgaaactctaacaaattctacaaaaatttagaaaaataataattgacattggcatttactcttttttttaatagaatatgctgaagaacatgtgcgtgttcgccaagaagttggcctatttgtccaaattccgccaaatttatggctttgccccgccggcgccgacttcgtttggcttgaattggctgctgaaacgaaaacgaaacaaatcggctgccgcgaaaaacattcagaaagttgacgaatgcctggacagaatgcgggacgtgtacaaggcggaagtgaccaatatgggcaaacatttttgggggacgatgaagcaacaatttatggccaaattggcatttgagagaaatgccaaaggggtggcggaagagattgaagcgatgacgcgggcggaagaagagaggcggcggaggacaacgggaggcggacggaacagcacaagcagcaggagaagaagccggggatggccgtgggaaggggaggcgaggagataaagccggtcagacgcgagacaaagggaggaaaagcatgtgatgagaccaacagaggagagggagggattgttgataaatggggttggccaatatcatcaaattttaatttggcattagcatttgtaaatggatttaatggatgttattaataaagtttagcaaccaaaaatacttttgtttattcgtattcgctttttttagccgttatcagctttatcagaaacaacctgttgtatttctcggtggtgcggaagtgtaaaagatcaacccacggtgggactcgaacccacgacacctcccataacgcgggatgctctaaccactgagctacgcaggtctcatttcctccacactcatctcatccctctaagatgcactcttctcggcccgagatagag

SEQ ID NO: 18150 - DNA, 2765 bp, Heterodera glycines
  misc_feature (2740)..(2740): n is a, c, g, or t
cggaaactaatttgtttctcttcatcctttcgaggcccgaagcacaatacacgcggcaacaaataagggaatcgtgggctgctaacttggtaaagtcacagaacaaattgccattattttgcactgcttttccagaacgaacacaatgccaccgtccgtttcgtcgtcggttggccgttgcgttacgactttgaccgattgttggaggaatttttgactttttctgacttaattctctacgacatcgaagacacttatgccaacttatatgtgaaggtttacgtgtctcttcagtggcaacggcacttttgtgacaacgcaaaattcgttctgaaaacggatgacgactccgttgtggacgtgggccgactccgctggtgggtggaccacgaattcgcccgaagagtcgcaacgcacccggccagcgtttttggcgggatgtggaaaggagtgaaagtgaaccgggagaagacccaccgatggcacgtcctccttcacatttcactcttcgaccgtcaaatactcattcatttaggtacgtcccgcgaactctgtacgctgcgaagagatacccgccgtatatgaatgggtaggcataggcacaccttcagaatttagtcaggggagagaatagccccctgctgaacttgttgtttataaatacaggcccacttatcttttgtccaacgaagcggtcaaaaagattttgaacgtaactgccaaagtgaaagctgttccgattgaggacattctgttcacgggaattctggccagcaaaatgcaagtgcataagttcagcgcttggaagcacttccgatatggaaaatccgtgagtttcgcaaatttctatcagaaaattctgacggaaaacgatatgaagaacccaaattagagtttaagtcagaaaggcatctcggatatttgttcagttgtacgcctacgaaaagtgccgaaacgactcaaccgatggtcgtcctgtgccttatgtaattgccatcttcggattgtccaaccccgaaaaaattcgtcaagcttttgatgaacttcattccgtaaattgctcctcttcatggttgtccattcgaaggcttctttggcaaaaagcattgaattggtggaaggaattggatgacatgaaaagggtgacaataaaatggcaaaaacaccaatggaatgattacgaacttaaatctaattaaaaaatttaaatgttacaattttattaaacggttaaaatgaaaaattgttttttcattagaaaattttaaaattaataggaaatgaattgaatttagcgaattagatcatgtgcagtgggcattaagtgagtatcgaatttcgtcgggcgcggcgccaacggtcactgactgggcaaaagtttgaaggcatcgaaccatccaccgaatatgatgttgaaatcggattggtatttttgtatcgtcacgagcaaagtcgtctgaaaagtgaaaaggacattcggaagagcaaagcaaatggataattaattaattaattagtgcctggtcatcgtccaccattttctcgtccaacatctctaagaaggacttgtggaaaaatatgtgaaagcgtttgattgtctcggaagaacccgctaagaagcctaaaattggaaaggcgaaaatcgcattgggacgcttgtttacctccactgaccaccgatttttgtttccgatacaccttaaagggaaggaagggacatttgagggattgccaatgccgtttgtttcgcttttgctctgcttgccttgtccaaagtgtatcgttcgacccggtcaattttcggtgtcagctgaaccaaagtgattttatctgattttagcaccggcgaccacactccgtagggtatttctgaggcagatccatggcctgttaattaagcacttcgtacagaattgaattcactgatcctttttgtaagatcgaatgccgaagcttaccatatccggcgtccaaccaaacaaaaaactgctgcccgttcaacggtttgggaaagcgtgagattaaagtggcattgagcaggaagtacggcttcgagttgaccagaatatcgtaatcagggtaaatcgtctcgggatgggttcgcatttgctcatcccagtcgccgtgccaatggttctgttcccagcgcataatctcttcaatctgtggggccacaattgtttggcatttggagggagagtaaacacctcatttcggaatttgtaataaggcaattcctgcaaagacagctccacaacctaaaaaagaatattgtataataataaaaactccaaaaagactgaaatcgactgacttgaatccgctcccaattgatgcgctttcccaaggactgaagataggaagtgaccaatgaatcacagtaaatgattatgcggttttggagtcgtagcacaatgttggccaagtatcccaagtactggtcgaagtgacgagtgaatctgaagaaaatgccggaggttgaaactgaatgctgcgcccatgactattccaaatgaccgtggccattcccctcgtcaatgtccagcagtgctgtgactatcactggcgcctcgcgtcgtttcctctccaatttggctttggcatgcgctgtttttcgtcgaaagtgtgtgaatgatatcgacaataatatttaatcactaccgttttgttttgtgtgtatcagaaacgacgacttcggctactgaagacggctttttcggcggaaggagcgtcggcgcanagccttcccgtccgggggaggacga

SEQ ID NO: 18151 - DNA, 937 bp, Heterodera glycines
tagagaaagaatttaatgcaattcatttattacgacctactaaatccaggtccaggaaaaatccaggctcctcgagacctggacctggatttttttaaactcattttaaaaatcaaaaaaatgtttgaaaaattcaattaattgcttgggaacatctaaaaatatctaatttacaataataatttgtttttaaatatatttaatcattttttgaaaacttgaaaaaatatcggtcacttgaaataataaattctaaaattttgtccaggaaaatccaggttttttcctgttttgcctggacctggattttttttcacatttgacctggacctggatttcctggacaaaaatccaggaaaatccatgtccaggaaaaatccaggttgtcaaaacctggacctggatccaggaaaaatccaggcctggatccaggtccaggtcgaactctactcataacctacctaattgtctggatgagaaaaaacgtacctaattagagaaagaatttaatgcaattcatttattacgacctactacatatggacgacacccaactcgtactaggccaactcgtactgccccaactcgtactgtttttcgacaaaaaaatcgtcataactttttttaaagtcgaccaaattaaacattcttggtatcattcgatagctcttaacgttctctatctatctgcaaaatgtaagaaaattttattgcttttcaaaaaagttatgaccaacaatcgtaaaaaattttgtttttgtccataacttttttcaaacttgatcaaatttttggaaacatggtggatagatagagaattttaagggctattgaatgataccaagaatgtttaatttggccgactttaacaaaagttatgacgatttttgtgtcgaaaaacagtacgagttggggcagtacgagttgggtttttacc

SEQ ID NO: 18152 - DNA, 1091 bp, Heterodera glycines
attgatttttgccgttgttccatttgccctcttccaacccgtgaaaggggaggagacccattcaccttctctggtatagccccattttcccaaacccataataaaagtattctaattttccataattgttactcggaagctatggactgtcccaaaaaagttaaaattccccctgaacttattttggagttggccaatttccttcattacaattttcgctggttcggcatccgaatttctttgttctttgaccattttctcgccaaaaatcaaaggaaaattcgtcgcaataaaattaaggtataatgatttttcctctgcattaaataattggaaatgagaacaagggaaggtccattacagaactcattagacatttggtacctagtttttaatttgagctttttctcttgggtcctttttcaaatccgtttattttttctaatccctttattaattgtgtataattatactcccaatgctgttttcagcaactctttgaagaaatccgtgctcaagagaaagctgtggccgatgcgaaaaagttgttggaagatgcagctgttcgtttcggagaagcaactgctcgtctcaaagatttgaagcagcgctacaaaaagcttgtctcatttttatatttcgatttttattatagtgactaatttattgcaaacacagttggagtccgaaagaccggttttgacgccgcagatggttcccagcagcgaaactccaagtcctgaacccgtctcatcggtactgtaacttcaaaatttctttgctttttgtattttatggcaaggtgttccgtttaagtatctgagtagtgtcaacaggcgccgccatggattttatatatgaaaataacaattttctaatatttttcttgaaaaacttattaatttccaaaaataaattggccgacgaactaagccggggggggggaactagctgctcccgattttatattggaacttggtcatttccgggtaatactctagtttgtccactccatttttgaaaaaatctattttttaaatcaagagggcgcggtttccacgggtttttggggtcactgatcatgaatccgg

SEQ ID NO: 18153 - DNA, 1280 bp, Heterodera glycines
  misc_feature (1206)..(1206): n is a, c, g, or t
acggacatttagcgacttggaaaattggaccagaacagaaaaccaaggccagaattgagtgtttgtgcaaataataaataataatgccatttgctgtttttaagaaatttaaaaatgccaaaattcgtgttttaatgcaccaaacactcaaagaacgaccccggaggacgggggaagaagagcaggacaaaggtttagccaaacaaaaactcggaaattagaaaaaatttgggttaattctaaacaaaaacaagtttggctacgcctttggcctgtccgattaaagaagacacgcacacagaccaatttcgggaataatcaacatttttatagttttatatgggcaataacacattttgttgttggcgttataggctgtgctctgttaacggatacaactgtgcaagttgaggcgcgaacgtacggttttcagatttgatgacttagaaaagacgtgccaaaatcggagtgtctcatcaccggccccagtgacaatggactcgccgtccggggacatcgccttgggagggattattaagtgaattactagtaaacaatgaaatcggtcagtttcattcgaccaaacataccaagtaaagtacgcgtgactggtgcccggacagctttgtgatgggctgcatgctcgggtatttccacagaatcacttggttgtacgagtagccgtgggtggacaccaactcggagctgtgctttgaccatgcgacgttacaaacctaacaatttggaacagcatgttaagggacggaggacctcgcccttttcttccccacctggctgcccgtctccacacattgcattgcctgtccggtcattgtgttccaaaaacgcaacgatcggtcggcggtgcctccaccgctgaccaaaatgctcggatggtggggcgacctacaaaatatgaggacagtatttcggagtacaaatttccactgattttgtaggtgttcccccatcgcccgtgttgggacgtccccaactgaccatgccaatgctttgacggccgcgttgtgctctgtgtacgtctgaatgggctccgaccgtcgcaggctccacaccaacaattggttgtcattcccaccggatgccaaatactctttgttcggagaccatttcaatccgcacacctaataacataagaaaggaatttaaattttgaggtaaaaggcattggccaagcgttttttctcnaattcaaacagagcatctctgtttatatgcaaatttacaataaaataaaatatatgtcattcgtacataaaaaa

SEQ ID NO: 18154 - DNA, 1177 bp, Heterodera glycines
cccccccccccaaaaattatgatgtcgttgcttcgaattcattgtcagaatatatgtgtgttctcgaaagcccacctcctgccgatgggcactcatccgtttctccgaccgttgaatgtcgcgcaagtcgcggtgaagaatgaagcgatcacgcgagcccgagcaaatgacgttttcgttccatgccaagcaaccgatgcgcatgtcatggattttcaagttgtgcagcattttctgcgcatgtgtgtcccaaatctgagaaaacgaattcaattatatttctcaaaatatgtatctgtaaaattagtatgattaggagagcacagatcggatatgatcccgtaaaggactaaccaggagccctttcctgattgatttttaattcgagggtcaaaaatttgtccaagttttggaactgaagccataaaaacggataaatatgtaaagaattgaatgaaaaaaagacaaatgtctcgtttaaattaacaggcattcatagttcacctgcaaaaagcctttctgcgtgccaaccgcgagcaaatcgccccgttctgaccaatggactgacgtcactgattcgttgttctccgaactcaaatcgcacagcttcacaacttggctgttgcaggcactccacaaataaacgcacgtgttcagcccaaccgaaagcatattttgggaggaccaatcaacctaaaaacaacaaataaaataatggaacagagcgagatggaccaaacttaaaaagccaggacacaaaatgggatatgatcttttgtgtttttaccaaatttgcggacaaacgcatttgaccaagaattatttgcaaatttaattgcatttattgttcgaaaacaaattcataattgagatggattatgaagaaagaaggcaaattttaaagatattaggactaattttcttgacaatttcgttagcatttttgagggtttgtttttctctactacggagtagcaaatggtgactgaccagtggtttacgtaaataagcaggggaaaaagcagttgttgtttaaaaacagaccaaattcaggtagaaatcatcctgcaactcgggcgcgtccaaaactttgtacggattcttcggcacttttctctgcggttttcgcggtgattttaacagacgttgactgtcttaacaaaaaggaaaatgataa

SEQ ID NO: 18155 - DNA, 1397 bp, Heterodera glycines
agtgaaaatgagacaaaaaagcaatttatgagagtcacaaaatattgatgagatacgtaacggaccgttatcaaatggtggcgataagagagttcaaaatcagagagtttttggggtcagaaactgtgacgtacatataagaaagaaagaagagaatacaacgcacaatttggtggaaaatgcgatgatatgataacaacaatatgcagcaagcatcagaagtcacaaaaatttaaataccagcgaaaccgagagacaaaaaacaaacaaataaataaataatttgtaataaaaaaggatcaatggcactcttacaaaggcaactcgtacaataaaattttacaaaacaaagcataagcttaagcctaggcccaagcaagcctaagcctaaagcttaggcctagcctaagccattgtacgcgttgcaatgacaccaaaacaaaataaggcactaaaatcgagtgtcaaaattcaaagagtcttcaccgctgtcgtcgtccgtttcgtcgttaggctagcggcagtgccattgccggcgacactaccgtttttgtcagttttggtggtgccaacattgcccccgccagcgccgcttgtgctcggctcgccactgcaccagaagttgtcgctgttattattggtgttgttgctgttcatcaccgtgccgttgttgccggcgctgccgccagtcatcggcccgaccctactctgttggggcgtcacacgcttccgtgaccggacaacctgtgaacaacaacgggacgtttttttgccattccgttgctgtacgggcggttttaaaaattcctccgcaaaaaacggagtaactcatcttaaaaatttgaaaatattgttagaaaacaataataaaaaaaattttttaaacatttttttatagaaattttctaaaactttttttgaaaaatttttatgcgaaaattttaaaaattttcgagggaagggaactggcgaggttttcaattcagcattggtgcgcctcccccgaattttttttctcagtacgggcctgctgccccattttgcctattttcggctttacacttattgttagcccagtccagacacctgcacattattctcaaccacagccttcttcgcctccaattgtttgtgcttttgtcggtccttaaaaaatgtataaaaatttgaccaaaaaaaatgatgttaatgtttttccaaaaaattttaattgaaaggaacaccgatgactcaaataattggaacaatttgcttgtgtactgtaatcacacaacaaatgcattactgtagtaaaagcactgtctaattaaaatcagaatgttatggtctcatcattgtcctcggttgcgttcagcaacacaaattttgtgggccgaaaatcggggccaaaaaatgag

SEQ ID NO: 18156 - DNA, 1500 bp, Heterodera glycines
  misc_feature (35)..(35): n is a, c, g, or t
  misc_feature (1471)..(1471): n is a, c, g, or t
attggccatggacgcacattgagccctcgggcaancaatgcgggggacgcaccggcgcacaatgcccgccccggacgcgacaacagcggcgacagacattcgcttctgcaacggcagaaaaaagggatcagtcagttcgtttctcttcgaagttccgcctccctctccccgataaatttaaaattttttaaaaagtttcctgttttttttttcaaaataatgaattaaaattgggccccgggtcagcttttggggtatactcctttcatagtagacctaattgaatggttttgaattattcaatagctcaaaatattctctatttgtatggcaaaattttgaaaaatttggttgagcttcatagaaattatgaatctaaatgttcggaaaccaattttgaagtcttttggtgttaacttttttttttttttgaaaattaaccattttttctagaatttttcagtaaaatggagaatgggtgatatcaaattcattcaattcggccaactatataagcagttatagacaccaaaaaatagcccgagtgcccaattgttcgggacccagtcgtgccggtccggggtgccccttcccgaaggattgcatatggtttttgaaaatctggaaaattccaaaaatttggataaacaagtcataattactgtttagtaggaaaattaaactaaaaacggacggaccatcctcgcaaagacagggcaacaggtcggcggactgcatggcgcagaacgagacgcattcgccggcacggcatttgccctcgtccgggcacgcggtgccgtcgggcaacgcttttggctgaggacatttgtcactgagtccgctaaaacaacaaacgaacaaacaatacttaggtatatagattttagctaataaaatggaattaaaaaaaaaattatttttgcgccgttttgtttttttgaaaattgcacgggccaaatcccgaaacccggcttaactcatcgtcaatttaaactgccaacctgcaccgtgactcgtccttgcacatctctttgttctgcgcttggcattgatgaccctttgccatgaaagtgcactgtcccgtacaacactcggaatgtctaaaaaacaaaaaatatttttttgttataaccagtctggccaattttcgaattttggcgtttaatttaatcgggtgaactacgtttttgcgcccatgtaacaaaaaagattaaaaaaaaactgaaattctaattatataaattaaaattccataagactggcaattgccaatgccgtccccgcctatcctaaaccgttgatggctgaccgtggcgagcaaaacgcgttcggcttcagacgacagtcagccgtacaacagcggtcagtgcctgtgccgtcggcgttgttgtcgtcgccgccggtctccggcgccgacatgccgcccccaatttgtgcacccccatcacactgttcgccctcctccaaaatngccgttgcgcacaacgagcggcgctcctc

SEQ ID NO: 18157 - DNA, 2786 bp, Heterodera glycines
atcggattgtgctcccgtgttcgggcttgtggaccaatccaagcaagcgattttcaactcgccgagcgtcttctgatcgaacttgccccaagtggactgtaccgatttggccaagcaaagccccgaggtacgccttcgcactgacgaacagggattgatcccccttgagaccagactcggcaactgtacagcaagtgatgactggaaaagcccaattctgcttccggaccagtcaccgatcactctgctgataattcgagatcgtcatgagaagatgcgacactcagaagtagaagccacgctcacttcattcctggagaaattttggtgccataaagccaggggcacagtgaccagagaggtcaaaaaatgccttcgttgccgacgaatccaaggcccggcatttgctctgccagccatgccatccctgcccactgaccgtgttgtgcgatctgcaccctttgagcatgtcggcattgactacttgggccctacaatgacgagaatcgtgaccggtccaaccaccgcaacacataaggcctggatcgtgctgataacctgcctggctactcgtgccgtctatcttgaaccggtcctggacctaacggcctcgtcatttcttctcattctgcgccgcttcacgtgccgacgaggcgtgccaactcggatccttaccgacaacggaactcaattcgttctggcatccaaagtttccgcggctctcgaagccggcagagtgccaacttcagcactggaccgattcctggcacgagaggcaatccattggcgttttatccctcagttgtcaccttggcaagggggagtctacgaaagactcgttgccttggtcaagagctgcttcaaacgagagcttggccgcgtaatgctctcatgggaagagctggtcacatacacagccgaagtcgaagcagtactcaaccaaaggccgctctgtcatgtctctgaagagcctgacggaatcctgccacttcggccaattgacttcctccttccaagagcaaaacttggcattgcattcactgccgatactgacctcgatgagttccgaatttcttccaccaatcaaagagatgcgcttatccagcgttggcattccgtgtcatcatcaatcgaccatttctggaatcgctggcagaaggaatacctgctgatgcttcgccagagattgcagtggaagttcaagaaacagaggaaccaaattgcgcgagagcccatggaaggagaagttgtgctgatctctgaagaaaaacttcctcgcaactgttggccgatgggacgaattgtcgagttacaacgctcacacggggagattcgaaacgccaaaattcgattggccacaggaaaggtgctaagccggcccctaaatcgtctttatcccttggaagtggcttcccctgccggacaagatgagagccaccagcagctcgacaaacccgccgcttgaggaacatcacaacagaacccaaacagcggactcaactccaatttgccaactcgcgtgcccggcgcaattcacctggcccgactcattctatggtcactcgctcaaaaaccaaagcactggcctccgttctgtccattctgatgtgcctatttctgattggcgcttcccaaaccaacgccagtagcacgaccaagccaaagtgtgggaaaggacttccaattcgttgccgtggatgcgaactgacctgcacaaaaaccggcgttgacatttcaataccgaatgggattgtcaaattcttgctatgttgtgccggtggaactcagtgcctcactcaatccggcattaggaaatccttccatcgcttgcccaaggaacaccttttattcgactacgattgtgaagccacttattggacgaaaaagaacaacaaaagaatcgggagcgtccaatgtccaggcagagatgcgtgcgagctcatcgattgttgggtgtgcctcgaacgactggcaaatcctgattgtcgtccagatgtgaccttcggactcattggtggagcgagcttcttcactttcctcttcgttttttggattctgccactgatgtgccacgtcacaatgttttggatcctacagcatctctttgccctgctcgtccgcttattgtgttgtttttggtcaagccaaaacgcaccgcagagagaagaatcccctctccttgccttccaaagtctgcctactccgcgcaggcgccaaatgagtcgcagtcgttttcgcccttttccaaaacttcaaacgacgctcctgttattgaccctctgtgcctttacttcatgtgccagggcacaagttgtctcaatcaccgcctctgctgagaaatgccaaaggtccgatttcggctcggtgtgccatctcgagagctcgacaacagttactcttcttccatcgggtctgccggtacgtctactccttcgtcaccctgacgagagagttctcggcacgcttgaaatcagcatgcgctcactgactttgcattgcctgccaaaatctgagcaatggcttcgatcctaccacatcgagacagcttcggttaagcggtgcccgagccgtggaaattgtacacgcgaattctgcgacgacgtcaacaacagaagaaaaacagaagttcctgagcttagcgagtgggctaagcatcccggattcaacagatgctcagcatcttgctcattttggtggtgtgcgtgtgtgagtgccggtgccagctgcatctattacccgtccacatgccattgccaactcgccaactgtctacaagctgatctcct

SEQ ID NO: 18158 - DNA, 3217 bp, Heterodera glycines
  misc_feature (266)..(266): n is a, c, g, or t
gtagagatttaaatttaataattggattaacgattttattaatttcggggcacatttttaaataaaatgggaattaatgaaaaaaacatttaaaactaatcattatttacttaatatttgccaatatttgttcagtagaacaaaatttattaaatcttaataatttttattttacattaaataatttttttatattgtaaaagcagaagatttagatttatattatttataaaaataaaaaattaccaaatttatttttgagaatntaagaagaaaatgaaactccacctattattagttttaattatatttttaatcatcgaaattgatcaaattaaaacggaaaaggaaaaattacaacaaaaatcatttgaggaaatttttggagaaaaatgggaagaaaaagaagaagaaaggcgaaatgaactcaaaaaaagagaaataattgcaaaattttataaaataaaagagaaaatcaagcaaaaaggacgaaaatactcaacaaaagaatgtaataaaattgaagaaaaaataacgaaaaaattggggacaaatcgaaggaaaatttatgaatggattaaagaattggggcttcaaaaacaaataaagaaaagctataaatcaaaaagtgatgaacaaaaacatgaaattgttcagaaatttattgaaatgacaaatgaatacaaacaaaaaggaaaatattcgcaaaaagaatggaacaaaaattatgccgaaatttgtaagaaaattggagtaagcaaagggacaattatcaaatggaagaaacagtttggcattagtcttaagagaataacggaaaaagaaaaaatggcaaaaatgaaaatttattggcaaataaaaagagaaaatccaaaaataagtgaacagaaaattgccaaaatgaccaacacttcggcgaagaacttttggaaatggaaagccaaatttggagaagcgaaataatgaggaagaaatgaaagccaaaaaagaggacaaagaaattctcgaaaattcggaaaattatattttatgtgacttttgtttttgttcattaacagggctgcaaaaaatatgcaaatgcataagtagtaacccctgccacaccttcgccgcttgacgctaattagaagtgacaggtggcggaggagggtgtcaattagtcactaattgggggggggggtgtgctaattggtcagcggtcaagagggcactaattggtcagccgtagggtgtggggtggtgtcaattaattagggaaacctaaacctatgcgaggggtgtgtaaaattttcatgtactttttttttgacataaaatttgattgatttaaaaagtgacagccgagggggagggggaatttgattggtcagcgaagtgacagatgagggaaaaattcaaatttctgatgggcggggatcggaaaattatgattgatcaacaatgtgacatttgcgggggcattcaaatttgcggggagcggggtgggagggtagagagggatatttctcatcttttctctgtccacccctgtccaaacagagcaatgcatatcgatttgacgggggaacgccgtcactttctcaccgctttactcattgccattaaatgaccaaacgaccttttccataattctcccctatttttaggtgtgttatttttccatatttttctcaacatttgttcaacaccaatggcgcccgggggcaaaacgtatgctcgacttaaaaatgtgagtaaatgaataaatttttgatttgtatttttcgtaagtaaatgactaaattttgttatgtcgttaacatgtttaggcatcaaagcccatcggctcgtcaagttcatcgtcagaggatgaacttcccagcaggaaaaaaaggccactgccaaccatgaaagcaccaatggtcagtttaagtgtttaaaatttttgaaattttttcgtccttttccgccagtgaaaaggatggattttaatgagaaaaatttgtaccaaatgaaaaaaaaaattcctttttttttcttaatactttagaacgttgcgaatcgaaccggcctgggcaccgacactgcactggtccaacagccagcaccaaaaaaattgcccattacacgcaaaagcgtgggtttaaaaaattaattaattttatcaaaataataaatattcctttttttttaataatttcccgttaattttgtaggccaagggaaatgccgccgcaccatcctcctccgtttccgtccgcaatccaacgcgccgcgctccttcaacccgtaaagctgttgcacaacaaccgcaacaacgcaaattagaaaagcgaaaagcggtaaatttgtgctgaaattttttatgtgatttttcattaaaataaaaatgacaataattgtattaattttggattttttttttgaatcaggcaacaccgcaactggacgacaattgcccgggggaccaccggcacccatcacagaccctgttggagcagcagaacaatgcgttgtaccggctcctcttcgatggcagcaacgagaactacttcacccatttggagcgagcccgtcacccgtcacctcgtccacacatgcgccgtgtgtgcgaagaagtacgagttcgtgttggtgcggttcccggacactggagtcgagacgccatggcatcctgtgttacaaaagcatcgcaacattcgtgatggttggacgttgctagacctagcaatgttggtaagcgaaatttgtttcaattttttgaaattggtcatcgaaaaaaaaaatatttgaggagcccgacacaatttacgcttttgacgcagcatggcaacaatgtgttgcacctgatgaagcgattggagggaatgaaaatgatgacggtggcgatgatgagaacggcagaggaaacaacagcggaggaagaaacaagaagaagggtggccaaagacggggcggaggaggtgggcaaaaagacggaggagggagcaaagacggagtgaggaggacgaaggaagaggcgaagaagaaacaagagagagaggagacgaagaggaaacgtaagaagcaagagaaaaattgaagagaggtgaagaaaaaggaggaggagagaaaggaggaggagaaaaggaaacgaatggagggaggcgaagcgaaggaggaggaaaagccaaagaaggacgaagcgaacgaggaggaaaagccaaaggacgaagcaaaagtggaggaaaagccaaag

SEQ ID NO: 18159 - DNA, 1315 bp, Heterodera glycines
ttagagaaaaagaggaaaagaaagggagagagagagccttctgggtggagcgaggggtgggaagggataagaagagaacatagagatgcacagacattcttcctctgggttagagtgtgaaagaaagagagaaaaagagggaagaaattgagggattagagaaaagagaaatattaaagggacaagaaaggaagagaggggggggggtaagagaaaagagagaaaggaagagaaaaagagagcattaaagacagagaaggaagataggataagagaagaatggatccacagatgcagacattcttcctttgctttttcatctctgtatgcccacaaaggcacgaacggaagagaaaataagagagagagagagagagagagtcaagagaatgtctggaaagacagtcagacaaaatgaaataacaaagaaagcgaaagagataaagaatgaaaaaatagtgcaaattgggggaattggtaattgatgagaaacatagaaagagtcacataagtggccttccagcgtcccaacccaagcgaagcgacgatgatcatttatatcggaagaaagtgaacggcggagccctttcattcctctccgttcatttcgttggtatgtataatatgcagaaagggaattttcacgaatttacgatttaaaatttctagaaaaacaaaaaattttgaaattttccttgtaggatttttatctggcatctgtgtaaatatggctgttgtcctctaatatgtacatagatgagacagataaaactctcgatttattcgagaattgtattcgcaaaacaaaatagtaatcgaaattggccactcgacctacctaacttgcttttcaccacactaagcatatgtttttgttacatgaagtggtcatataagccaaaataaatgacttgcttacggtacggtcaaagaaatgaaggtggctactgtaattgaccaacattgtggatcaaaaaacacaattttatcgcaaaatgtctaaaagtgaaaacccggatcttttggacaaaaacagacaatttaattgcaaaatatttaaaaaatgaaattcaccaaggccgcatattttttaggacgaaaaccaactcgtactaggccaatttgtactgcgacgactcgcgtactaaattacctaccccaatttgtggtaaatttctgcttttttcacagtacgtacgaattgggaaaattaatatgagtcggggtaatacgagtttgatttttccatttttctaaaattatacagtaccaatatatttttttaattcacacagttcttcgcttcttctttccc

SEQ ID NO: 18160 - DNA, 2146 bp, Heterodera glycines
  misc_feature (1799)..(1799): n is a, c, g, or t
cacagatttattagatttggatttttaaaattatacatttatttaaattttttcagataactcaaactcaaaaaaaaaattgccttttgtttcctcgattcctcgtcattttgcttcatatacaaaaaatttatacgcccttcgttctttcgtcaacaaaaaaaacacatttaaccaaacaattatgacttgcgggttggctgtgaaacgtccgttggaccttggacaggacggcagtttggtggacgtcaagcggccgcgccatggcggcgcatcgccacagtgttcaccgtttcgaccacagctcggcattctggccacttcattgatgcaatccgtgccaccaaaggtttttcgcgctccccaaaatcatggattctcatggcaattttttcaataccaaataaggaggacccttttgggttccaattttttttttgtctcataaaactcggggaaaccatatttctgggagttttcggggtcgctaattattttaagacgtacaacaactgattgctcttcccgtccaatttaagggcttttctagcaattcgcatccattcggcccgggctcggcattttgagtccccgaaagcgctgtcgggtagttgacagtatgtgccaaaatccggttttttctaaaatgccggtccggatactggcgcaaatctggctagtcctgcgctctaataaaattattgtgtctgcataaccgccgccctctcatttttaggtgcctagtcctcctgctttcactggtactgcttccgccggcgttggccccatcggcaatccgtcctcaccatttgcggacgtgtccggccgttgtcgcttgtccagcacccagctggactcgtacttgcgtgccgaaatccaggcgctgaaacggcgccggctgatcccgcgccgtcagggcaattttccggaggaagggttcccgttgagcaccaccaacgttgtcgtcaatgccaacaaaggcactgccaccgctgtggcggcgtccaccggtggcattgttggcacgccggtgagcagcaccagtggcaacgcgtttcgcaaggcgacatctccgtcttcatcaaatgtaagcggtgccattgtaaaaacgggtttttagtgtgttcgatattccgagaattaaacagagcaatggaatttattggaatctcggcactcgcatagatatagtggccccgaaaaatgttgaagttgggcgtacatttttggtttgcaaaattcctttctcttaaaaaaattaaaccaaaaacgcaaaatttggtcattttggacggttaaaaattaaaagattttttcgcggcttattgacgtagctccggcgcagcaccatttgcgcatgtattaaccaatttcgaatccttaacatattaaaaaaaccgaaatttgaaatgaacttttgacctagcatcccagcaaaaaaataaaaataaattttcagtcctcaggactcggagggtgaagcaatgcggaccggcaacgctgatgaggagaagcgtgccatgctcgaagcgctctaccagaatccccaattttcgctgcgtcaggtgaagctgatctgtgaacgcctgctcaaggagcaggaaatgcggctgcgctacgagtgagtgggggcgttttggtttgtttgttgttcaaactggaattttcgaaaaaatttccggttccaaatttggttttttcgtccgcatccgaaatttttatggcaaaaaatgtattttttgctgaaaattttcgattttccttcttcgtgttccctccaaagcctacccccccccccnctcccccactaaaaaatcttcaaaagatttttacaaattgcattcaaaatttttctcagcgatagcgatatggctaaaatgtacgttgaatttcatgaccagaaatgcgctttctctcgatttttattttgtatgtgtgattttttccctgcacagatatgagaccatcttgaacaagaaactggaggagcagcatgaccaatacgttcagtttgccaaggaacagttggacaccaatttggcgctcaaaggcgacgatattccatgtaaggggcaacaacaaacaaacaaatgttttacttacgataagtaatggacaaatgttgtcaggccaggggaatggtcaa

SEQ ID NO: 18161 - DNA, 2212 bp, Heterodera glycines
agcctgcaaaagttcaaaaaatttcgttcaattaaaaaaattgtgattcagaaaaccgattttttgaagttttttgtgcataacttttttaaaactaaaagaaatttttaaaattttttgcaagctagtagagagcacttggggctatcgaatggtatcaaattcattcaattcaaacaactctgaacagagttataccccaaaaactgacccggggccttggatttcaaaaaaaaaaaattttttttaattggaaataggggggagggaactttgtccacctgtacatctccaactggtgccgactctgaggctttcggcatggaatgtgccgtccgatgaatgttggctccccgccaatcagttggccaatcgccgtccgttcggcggtgccaattgtgccgtcgtcgccattttggctaacactgaccaacaattcggtgccattgacgcgcttcaaatgctcaaattgggccggcaatgggggcaaaatgcgcaacagtgcagagaagaggctaaagcaattgaaaatttaaaattgattaaaatcggtggcttagtcggtaaaatttctgtttttgggcgtcagggttcaattccaccttactgcatgcaatttttcttttgtatattaattttttttgaacatttaatatttgataaacatataaaaagaaataattacagaaacaaaacttttcagaaaatttcaaaaaaatcatgaaaaatttggcacaaaaatttcaacaaaaattgactcaattaaccgtccattaaagcatttttatgcaaaaaattgcactgttcgagaaactaaactcaacttttgtttgtaacgttaagcacaaccgcttcagtgagttcaatgtgttctgtgtgaagtgaagaaggaagaattggccgaatttcaaagctaaaaattaaataaaaatttttttgttaattatattttttattactttcgtaatcgttgaatttttgtgcttttttgattttcgtcaagcaaattttcatctttggtgcttaacatctaaaaaaattgaaaaaggaaataatttttaagttttaaaaaaattctgatgtgtaaaacaatttaaaagaacaaattttttgtgcctccggccatttcaaacaaaatgccaaaaggcaaacatttaaatccttttgaaattgtaaccgcaaaatttttgaaaatttgtgaaaattcatgcctaacaataagaggtattcatggtaaaatgtaagtcattagaaattagtaaaaaaaattttcaagcaatcgaagttatggtattaaaaatcgcattatctttataaataatccgatccccattttttcatttccgtacaaatttgctgagaatgaatcatcatcattatacataccaccaaccattatcatcatcagcaaatcagcatcattcaccaaccgagccataattatacatatttagtatgccttaaatgcatttttatcatcatcaatcagcaaacaaacaagttggttggttgctgtgttgattttgtggtggtggtggtggtgctgttccaacttccattcattccccccccctcccctcccattccttccgtttttgatcgctttgcagtcacaggtgcggtgggccccaggaccaattgggccccatctttactctcttctgctgcttacctctaatatatgctccttggtatcattcgacagcactgaactgttttgtctctatcaattagactgaacccaaaatggctaggacaattcgaatacgaaaaactcaaattttttgctcgatcgatttttttttcatttaaagcccggcgaactaaagaatgccaacaagtggacgggtcggttttctgttttgcataaaaacatgcaaatttacaaaaatgacttggtggtggtggtggtgctgttccaacttccattcattccccccccccattccttccgtttttgatcgctttgaagtcacagtggtgattcatcagttttgtgggtgcgttgggggatttggatcaaatgggcccatctttactctcttctgctgcttacctctaatatatgctccttggtatcattaaagcatttgtctctgtcaattaaagaccggaccccaaatggcttgatcacttcgaaaatgaaaaactcaaatttttgctcgatcgggggggttaaagcccgaaaaatattaaagaatgccgatggacg

SEQ ID NO: 18162 - DNA, 2244 bp, Heterodera glycines
  misc_feature (2220)..(2220): n is a, c, g, or t
cctatcaattccctgcaatttgcattttattgttttcagctggtagtcggccgaatccgcagttgtcccgattggtcgggtggggaggacgaggacgtgctcagtttgggccttttcccgggcacttacctcgaattctccatggacgacaggtggatttttaatcatattaaatagattaggtaattaattacaatttcctttttctttcgcagggttttcttccaatttgaggccgcttgggactcttcgctgcacaattcgccgcttctcaaccgcgtctcgggctacggcgaaaacgtttacatgacaatttcggtacacaattcaattcaatttaataattcaattaatttattcattttattaattgtttaggcgtatatggaaattgaaaattgtgcgcagtcggcaattatcaccaaagatttgggtctgattgtgtacgcacgggactcgaagatcagtgcggccagcagattttgccggtcactgatcggcggaatctcaaaaagcgcgggtaaatgggcgacaaaaatggcaacaattggcctaccaagcatttgaaatttttgggtttttttgacgtgccgtcatcgcccccttttttgtcggactttccaatgccaaaaatgcctatttttaacattttgccttcttctgcttgcaatgcaccgcttttcgatgccttcagaaatgaaccgtgtgcccggcgtttaccttctcaccgtaatggaggacagtgaggcgaacaacagtcccggcacggcacggagaaagcggcgaattttggacacatcgtcaacatgtgggaagacagctaacaaaaaagagccatcggttcattctttcattttccacagatgtgcgaggcgaagaaaatcttggcacttggaggttggcggaggaaaagcgaaaattccaattaaaaataataattaaattaaaattatttaggccccgaggggactcaatcattttggagcaccaattggagttggagaagctgagcaaacttcagcaagtggagcgaatgcgactgttccttatggtcagtgcttcgcatttggaaaaatatttttaatttagctgagaaagtcgcgcaaaacgggcaaaggcgacacaccggtgggaaaagtcgaaaaataaatatttaattattatttttggaagatttcaccatgtttgcccaaatttcccattccgaattctgtgaaaatgagtgaaaaggaacgaaaattggccacaaaagtgttggaattgatccgactgaaaatcccagtgaacaaagacccaccgacgggcaaaaaagtgggaaataaatgcaaatggaaaaatacatattcaattgatcgtcagacttttctcggagggatgattcgaacacttttattcataacaaacggcaaaaatcgaaggagaatgatgaacttattgtactcccctatcaattcattcttttgtcttccaatatttcccccaaaactccgtttgtaaaagcaatctcaagtcaaaatcagtgaacaaatgcaaaatcgaagctgccaaagtttttagttttgttttatatgaaaaggaaagactcgaaaaaataaattaaaagtgaaagagacaaaaaccaaaaaaagaaatagtcattgacgttgaattcaccgtcatttgctgagtaatggtcgattacaaaacgcaaatagaaatgtttctccattagtccaatctcttcccattcggcccatttgttctaatctcgcgaaatcggacaacggaacagaaaaaaatagattaaatatcaattcgttttctcagaatttgtttttttctgtcaagggcattgccgggcgcttaccgagcgacgacctttttttgctcgggcccgcataatctttttgtcgcgcttttttcaaaaaaaaaatggttaacggcagagaagcgaaaatacttggctctagtgcactttgggcgtccaatcttccgtttctttggccaaaatcttacatgggcaagcttacattcttaaaatgccaaggccaacatcttgcccggacccgaatcctacactattaaatttattctaccggcgccgggggctcaaaatctagcttaaaaaacccaataattcgaactcgtggcctggattacttcaaaacttggtactctttaagtttgggtcccccttttgggtcaaattttttcaaaaatgaatttcttttttattatcangaaatgctttaaataacaaataaa

SEQ ID NO: 18163 - DNA, 1025 bp, Heterodera glycines
ttttgtgttgctgctttaaatttgaataaatcgtcaagagtgaaatttttaagcgtttccattaatctaaaagcatttctgataataaaaaagaaaaaaaaatttttgaaaaaatttgacccaaaaggggggacccaaacttaaaagagtacccaaaactttatggaaaactcggaatcaaaaacttcttggggtcggaataaaattcctggcacctatcagcgattttaagcacctaaaaatcaggtctgctaatcggagacataaaaaatcaagtaacatttacatatttatacatggcataatttgcgcgattaacaggacatatatatcaagcacagatcagacaaaacaacacatgggaaatattataataatacgatacaatgtgtacatatatctttggggacatacagtaggataaatatttcaacaacaacaacaacaatacacgtgattgggatatcattgggttttcatgtcactaaacggtatttcgacatcgatgtcactaagagctctccgatgaagacgatgatgcgtccgaagttttgtcagaagtggcgtccgaagtcgaaccctccgatcccgagccagaggcagatgacgatgccgagccggagccgctttcggaagtctcaggggttccagaagtttcgtcggtcgtttccgtcgtttcctcagtcgtctcttccgtggtcgccgacttctctccgccggtctccgcggctgcctcctctttcttctcttccgctgccgacccgccctcctccttcttctcctcttcagctttgtcgccactatgaaagaaaagcaacaaagttcgatgaaagcaccaaaatgcgcccgttttgctcacccctcgtcctccttttgctgctcatcaacaacgcgttccgatggcaccgccacgacgtcaccagcagcagaaggtggagtctcctttctgaaaagggacaaaaaccgttattcctcttccaattgttgacaaataaaatcggacttatcgtcgtccgctcccttct

SEQ ID NO: 18164 - DNA, 1466 bp, Heterodera glycines
tcttcggctgctcgctgcaccaaattcaaaaaagaaatcgagttgggaagaatgaacgtgatgctttggttgatatttagatgttttattttttttactagtttggttcttaatacgttgtccaaaaataagtgtcaatttccgtcttttttatactatttcttgtaaattttcacaaaaatcactatttttattggatttttgtaaaatgagagtagaaaagctttatttttgaggtttaaggttcttttacggctctgctattttcttggaaggatttcgaccagcgggatttagacagcatgtcctacaaaaatttatattttttggggaaaaaaatttcttttttttggggggggggggtgtaattcagagggtggggttctaattccgaggggagttctatttcaataaatacggtatattaaatttaaataaaattttgcgataatacgttaattgttattgtgatttataagatttaatactgaataatgataaaaataattggtaacaatgaaatactaatgaagaagacagtatttacaaaattatagaaattgtcaagttgatgataacattttgaaactcgttttagggtcgctgatcatgaatttggcaataatcttgactgaccaatcactaacgtaaactagaaaaaagtcaaatttaaattttatgagttttagtttttacattagaaaagggattcgaaattgattgacctggatgttagaatggtaatcaaggacgatcgacgatcggagtacggtggccgggcagcaacgccaaatatcaacgagagaaaaagcgagggttgggtggattacccgaaatttgcagagctgacacttgcggcgccgacatctgcggcgccgacacttgaggcaccctccaaattatagcagaacatgccttaaattaaccggcattagtgccataactttcaaataaaattgataatcaaatttcatttcttgataaaaacaaacaaaagatacaataagcctgaaaatcacaataaatgctcgaaatttctcccattggccatatataagcaaccatgcgcttccgaaaaatggcagtaaatgtcgcgcacaatttctgctaccaaaattggattttcgcaaagtttggtagatttgtagaccagatttcaagctatcaaaatgcgaccatatttaatttgactaattgctgtataattttatttttcttattttcaatactaagaaacgcgaatgggtggcagtttgggtcggaaaaacccttttggcagtttttagaaacgcactggaaaatctttgtagtttgttttgttttttttgagaatttcatagcaaaaaaaacggtttcaacctagttgcctctaatatgaattttgaaaggcaatagaaaaaatttagtatcacaaatgtaaaattgggagatgcaagtgtatttttgctgctaatgtgcattttgac

SEQ ID NO: 18165 - DNA, 1826 bp, Heterodera glycines
  misc_feature (985)..(985): n is a, c, g, or t
  misc_feature (998)..(998): n is a, c, g, or t
aatgcttccgaccagcaattggacggcagttgtgatcagattcgttattggttgattatgatcatgcggtgaagatgttgtggtggcaatataaattgggatgatcaactgcaaatagaatttttgattgcttatgtattcttaatgcttaacaaaattttcaaaaattccttttggtgtatttgaatttgaagatactttttcgttataattcgttatcaatttggcaattaagtctcaattatctcaccgcaatagacatccacacaatggtgaacagatggtcccaattcttttcatatgttcggacaaataaagtggacaaaatgcgttcaacgatcagaacatggggcacaaaattacgagcataaatgccaatgaaatacatttttaaaagtgacgggaaaaattgcatagattcggcaccaattggatcccaaaggaaaatttgaacagatagatgacaaaacgacaggaaccacgcttaaattagaaaagttataattttttgttatttttttcgtttaaaaattttgatttaattgaatttgatttaccaagataataaagaaactctggaagatgagaatggctttcatgttcgggtggatgaccgatgtgcgtgccaccaaaatcaaattgacagtggacaacggaatgcaacaaaatttatcaacagttcaatggcaccgccgaagaacaaaagaaacagttcaaagtcaattggtgcagttgggttcaatgatgacatacctatatgtaaatcgctgcttatttaattacaaataaaaattattttaaacaatattaattatttcaatttaaatgaatctatcccacaagtaacttcttatttcaattttaatgaatagcaaaatctttggtaatagaaataattaatgaaaagtgacaatttaattttgttcagaatctcttttgtttccaggtgtaaaatgaaaaaaatcttatgaatctccgccaaatntggtcgattgtcnccgacggtaaagacgcaactcgttttggtcaaatttgtttttaccccaaatcgttttattattccaactcttttataaaattgaaacgcgaaaaatcgaggccgaatcaattagaatttttaagtcaattgcgattcaccttttttggacgaaatttttatttttaatagaacctgaaaacatatttcctgctgttttctgggtagctagcttatcacgaataacatacatttcttccgataacaattaaaaattctcaaaaaacaatatatttctttcgaaattcaaatctgaaccttaaaacattagttcaaaatcgcaaaaattggtattgttgataaaaaatctgttaataaatttggggaattggagatgggccaaatatattttgtccagtcaacactggaataaaactttattcaagtaaaaattgggaagcgacgatattttagaaaacaaaattgagggcagtataaaattaaaagaatttcagagcataaaaaataaactaaaagcgaatgatgatgaaaaaagggatggaattgtgaactagtaaagggatgcttccttgcgatcgagttgatagttagttgaccatgatccagtccggaaggttgtctccgatgttaaaagggacattgtggcatgcttccgctgtgaattggacttcaagatttttttttaatgctaacatggcgatttgcctttactcacaaagacaaaaaaaggcacctgccaattttgacgatgaaactttgccgttaattttcgttaattaaaaattgtttatcaaatcaaatgaatgaataatttgtgattcggtggcgt

SEQ ID NO: 18166 - DNA, 724 bp, Heterodera glycines
taaatatttaagaaaaaagtaaaatatttaagaaaatattgatcaaacagctagctacccaacttttgtggatctgcaacttggggaccctacatttggggatttaataaaacaaaaagatatatttaagaatttaattttatgccaaaaattagacaaatttacatttgccttagccagagttaattccattgcaaagaaagacaaatatttttttactaaaattaactttgtttccggactaatatgttaaaaaattaatttaaagttccgaacaaagccacccgaaagataaaaaacagaaaagatgatttcggcattgtttctgtacgcaagtaggaagcaaagccgttaggaactttttgaatgcccttgatgaatttcggttcccgttggcccttgggaaaggcgttctataaacattggaaaaaggtgtactgtatataaaaaatttattgcgatttgtatattgtgttgtggttagtataggctcaaaattctgctaatttttttttttggtgaaactatttacagatttagtcaaaaaaaattatgcatttttagtgttttaaacctaagtggttccaacatgcgccgccggggaaattggtggattttaacctgagttgtgaacagttttgcaccaaaatgcaatttttaggttttagcctatttttttcctgagctcccagttgcctgaaatgcacgaaatttttttttttgg

SEQ ID NO: 18167 - DNA, 1787 bp, Heterodera glycines
ctctgctctctctcttattggacatacgtctcgttttttgactcggtgtgtataaggtcaagaattttttcccatgcacgaatcgagctgaaattcgtcaataactcttcaaacattatcaaatttttttaaaattttgcaaggaaatagaaaactttaagggctatcgaatgttaccaaaatgtttaatttgattgaatttggttatgactagttttttggcgaaaaacagtacgagttcggtatttaccgttaacaataagtgccaaatgcataagatgacttttttctaaaatatttgattttagaatttttcttttattattgtacaatgtctattagtcgagaacatacaaaagaagatgaaattgaaatacgactgctgaccaattcgttgtgggtccaccgactcgtccgaaccagcaagccgtgcactctgttcgagttcaaaaacgaactttacaaggtgctttggacgcgtgcagaaggatatgagtcggttgcagagatcgctaacgaattgtagtgagtttgttttgttttcttcacggttcttggtacatgggaaattcagtatgaattccgggatttgcgcgatttatttttcacgagaaaggggttacgatacgtttgaggagatggtgcattcggaggaactcgaaaatggtgatttttcagactgataatttaaattttatttttcccttaaagtgatcacaattgagagaattccttggaaaccatcctacattatgtaactactaaaattatctttggagaattcatttacctaattttgttaagttatcactaccgtgcaacgctaaacaacgaagggatcttttccgatattcgaaagcgcaatcaacagaaaaagaaacagtcagcagaaaaggggaattttatttgtttttaaaaattttatactacaaatttaattttaaacttttgttgtagaaagtcttgaccatttttattttgccttcgtttgtttcactttcctaagcaaaaaatgttcagttacaggaatgcttcgttccaagatttgaatcgcaaattggctggactaccgacggaagcggagcttcggatgagtgcgagaacggctgcgaagagagcacgcaaaagcaaacaaatttgtggggaaataatctcttacgaaatcgatgttggaagtgacaacgatgacgaactgaacgaagtgacggaatttattggggacgacggcgacgaatggacagaaggcagagaggacggagactcttctggagggtaagcggagaacgaaggagggggggggggggattagcagaaagtaattggctaattagtgaaatgggacaaaaacgaattaaatgcaataattttaggtatttgttttcatagaaaattaaaaattctttttatgatacaaaaatattttagttctgtgtttgctgaaaatattgccatcgtggagaaaacgaaccatcacaacgaaaaaaggaaaagggacaatgagaaagaatacgcattgaaaatgggcaaatgcttttcatcagacttctacgagatttgatgtgatggaatgtgggatgatcatcagaaaccctatgaatgatattcatttgcgaagccttttgttcattttaattacaaagcataaacctcgacaatcaattagcaaagaatgtataaagagaattggtttagcacctttttctgtagcagatttaaagttaatgtgattcaaatacacatactaggaaggtatacatacatattacctatacacaccgagtcaaaaa

SEQ ID NO: 18168 - DNA, 2611 bp, Heterodera glycines
  misc_feature (1302)..(1303): n is a, c, g, or t
cgtatttattttagtttcgtatttttcgtattatgcattttttttcaattcgcaacaactttgatatgtatgtacatcaatcgtaataatacgaatctttaaaaaatcgcaattttttagatttatttcacatgaaaaatatcataggaataacgcaacaattgatgagcaagtcaattgaaaatgaaattatttcttttttttattcatttatgtaataatttgtaaaattagaagcaaaaaaataataaaatatacaaattaattgactacaaaaattaaaaaatatccattttttgtaaatttttatttattttttaattggaaaaatcaaaaatttcacggaaaaacctttaaaccgcgggaccctagcaattaaaaaaaaaaaattaaacttgtatttcggcatgcctatcataaatgttgaatttaattttacaactttcactattttacttttttggcactttaaggtttcgctttttgtggtttttcactaaaatttgtatttgacacaacttaaaaatgtgtgtctctaaaaattaaaagtcgattctttttttcccttaattatttcacgtgaaaagtgtaatgcgcatgagataaagcatcagtggatgaggaagtcatttttattggaaaaagaatgtcttttattttatatttgtcatttattaatttattgccaaataataataaaaaaacgtaaaattattttgaaaaaaattttttaggaattaaaattaaaaatgtttgaatttatatatttgtttcttatttttccaattttttgtggcggaatgcaacattattcaccttcatcatttaaaggaggaattataaacaaaattattcgaattccttattcaccaggtacaaaaaattaattattaatatttgaataaaattataaaaataaataaataaaaaacaaaaattcacgaaaattcacgaaaattaagaaaaaaatgaaagctttttgttaaacaattaaaactcagcaaataaattatggcgtaaaatttgtattggcgcaaaatcaaaccgaaatttgtccacagcaaataataaacgtagaaagacaaaggccatacgccgaagaaaagcggcaatttggcgacctaaagccgacaaaactccgatggcattttcctttgtttttttttgttggttttacgctcggaaggggaataatccgttgcagcaaaaagccgaagaaaagaacggacagaaagaggcagagcagaactccgaccaaataaaaggcggcgacactccgcacaaaggcgacgcgggtataanntttagatggtatgacaccctttttgaaaaatttttcgtgcaattttttcagcgagaaattccgaaacgcttccaacgcagccatattaattaataagctggaaacataaaagagaacgcaaaattatctttatgcgtcttttcgtgcatttgtattgctttagttgcatgaatgtgaattttgatgaaaaatgaattttcgactttttgttcgaattcgggtccagggttcggaattggtcgaaatggatgtcagattcgtgctcagcgtacctataaacccctagaaacatgtttttaagacttttgaaaaatttttcaaaaaaggtgtcataccatataaactattaccgcgacgcgcacttagaaaaacgaaaatagcgccaaaacaaaaggcatttggcacattcaaaaagccaatgggcaaaaaagacattgcggccacctcaaaagacctgtttttgagaaagactaattgacaatgcaatggaatcagctttttttttaatttgaccgctacagaagcaaggaaacacgtaaaaagtcattaaactcaaaggttttcattcaatcaaatgaagcaacaattcgaatatcgtttagaggagatcaataagtcacatataatccgaaaaggacaaaacaaatggaatgacccgtgaaggatgagacacaattaagagaagtgaagtcatcaaaaattagttaattctcgtgcattattacgttagttcgggggtttatttattgtgctcgtttttactcctcaattctccgttttctccacagcagccgatttcccatcagacctccgcaatttgtaaatgtacacgttgatgccatgcgcacacaagtgttgatccaacaattcccgaacttctcgctcttcgatctcgtcaagatcggaccaaatacgagacaaatgaacgctacaggcaaaacgtcgcgcgaacaaacgaattcttaacagacactgctccagagcttccaattgcgtaccaactgcaagaagtaaaagtcatatattgaaaacagcaaacattaaaggcgatcgaccccgtcaaatgcaaaaattaggaggtactcatgcagtttacatggtactttttacatacattttcagatgcctacaaatgtgtttcagaaatgaatgaaaataagtgttaagggggttctcgaggtctctgatcacaaatccgggctcagatcagcgctaccgctcatcacatgagctgaacgtggacaaaaaattgataggcttcctgcaccaataataccctcattggtatgatacccatgagggtaccat

SEQ ID NO: 18169 - DNA, 2527 bp, Heterodera glycines
  misc_feature (21)..(21): n is a, c, g, or t
ttaaatattaataataataanttgaaagaaaataatatacaaataatatatgctgtttttttttatcataagtataaaaagtgaataggaaataaaaaaatttatctctgattttttaaataaaaacattaatggtaaccaaaatatcaccgtggcaaattaccaggtgcccaacaatggtacttcggtggagttgaacgcggcagtggaaaatgttttattgtacccgtggaacgaagagacgccgacacattgctaccactcattcagcaactgaactgtacccaataaacacataactcgtttttatttgtcattatagcaattatgatataaaaattaaaaaaaaaattttttgaaaaatttgaccaaaatataggacccaaaccaaattagtaccaacattaattaccatcaaattcatataataacatctatctccagccggaatcagaaaagaaataatagatttcaaggtaatatgaatgattttaatagaatttctaataagtatgtaaacgagatagtaattaaattaaataaaactacaaaaaacaaatatatttagcaatattataaattagttcaaatattactttaaataaaaagatgagtaaaagtttacaaaacactcggactacctacaagaaaaagagaaaaatatggattgtgataatgagaaaatgacaccgtcacatttgaaacgtaaattaaattaaatcaatcaaagccgtaagacttttcccaatatttttcacaattgatataataaaatgttaaattattttactaaaccaaaatacattgaatgaatgaatggatatttgattctaacaaatcaaaaaataatacaaacaaaatttcattaaaattggaaaaaatcataaaaattcattcatattatatgcaataactgaaaaattcaataattcatcataaaattgattagtttttggtttaaataaaaaattacattaaacaaacaaaagctgaagaatatattttttacgatgactccgtttactacgagaaaatgaagtttaaataacttagatttaaatttccttccttttattttaaacaaaataaataacagtaaaaaaataaattaaattaaaaataaatatttgaatgacatttatgataataatatatatttttttaattagaaatatattctaggttgaaataatagtaaaaaataaaaaattctaatacaacttataaaactgaaagtttaaaattaaaaaaaaaataataaattcaaatggtaatccttaaaggagctactgatgaagaaaaatagaaaaaaaaaattgaacttaaagaaaatccgttaaataaaaaagtatagtgagaaaaggtaataaccgaagctctacctagaagtaaaagagaattaaaaaagggtaaaccaaaagggttaattttttctaaacctaaaggggtcgaaaaaaaacctaaatctatattagttaccaaaactaaatcaaaaaaaaatcaaaaaaacctaaaaaaaaatattttgacggggaccgggactagtcccggtttttcccgggtttcccagccaaaaattcccggtttttcaatccgaaaaggtccggtcccgatttagcctaaaattcccggtcccgctctactcttaataaatctgttaaattggggtaaaaatttcaaaagcaatttttatctgtttaaatttcgatttattttttccgtcggttcccaaaaattaaaaaaagacgccgcaaaaaatggcgtaaaaagtcaaacactgaacttttaatatgaaaaattaattttttacaaatatacaaaaattttcaaaaaggcgccgctcgtcggcctcatcttttcccaaaataaagaaaattaatttaaatagaaaattttaatacaatgaaaagaaaaattttttcattaacaaaagattcgcattaaaactaacctaaaataagttaataatatttgactacttaataaacattaatcccaatataaaaataaaatttgagacagaaaaaagcataaacaataaataagtttataaaaaaagaaattgaaacgtaatgtaaatatgtattaaattaagaaaaatttcaaagtttttaaaattaaattaaaaaataggatttttagttcatcaatgactaacggtcggttcaacgcaataagaaacaaaatatattaaaaaattgaatcctttaaatttatatttaataaaaacaatttaaattaaaaatcagattaatataaatatttacaatttcaatattataaattgcttctataatatattgagttattaaataaaacgactttaaaataaactaaaccgaaaaaaggttagtatgaataagttcgaaatctcctaagatgctaagattaaaaggaaaaatagaaaataaattaataaaaggtacagagaaaattacaatattaaaacagtatataattttaaaataaaaaattaaatagatatataaatgatatgaagaataatttaatttaatttaataaacaa

SEQ ID NO: 18170 - DNA, 3081 bp, Heterodera glycines
  misc_feature (1394)..(1394): n is a, c, g, or t
gcccacaaagcgacgaaaaagagatgatgatgtggagggagacccgaaaatcaaaaagtctgcatgcgcactctgagcgccgacaatcagttcagccagaagttccaagtgcagaggtaacagtcgactctctcattgaaaatctgcccggcaacctcgagtcactgttccgctcatagttcgctccctgcatgtcaatcgccctggtcgagtcacagcagatcgggatcaccccggatcaattgggctctacaatctcttctgatgtgctaaatccgagcatatggattcccatcccccgcatttgagacaactcccctgattcaattatgaaccgcttcctttaggtggcacagtcaaagtagcgggaggtctatgtgtgggtctcgcccttcactgtgtacatcacaacgcatgatgttatgcaactttttcattggcaacaggtgtttgacttcgggtcagggattaggaattgatttaaacgggccctggattcatgatcagcgaccccgaaaaccccataaaaagtgtttttatgacttttgaaaacataaaaaaaagtttcgaaaaagtgggggacaacaaactgaactattaccgtttttttaccatagttgcaagtcttgtccccactttttgatcacttacaaaagtaccaactgctgacccggtctgatccaactcaccgtttataaatgcaaaaaaagaagcattggacaatgtcatatgttggtgagaggataaaatgagcataataagtgagaccaaaatgcggaattgtttttttctcgtaagtgcatttaaaagcatcaagacggtcactgttccgggctttctgcgtgaattaagttgagcacttctccgatcaattcatcatccaactccgaggcagtgattgtcccatggtctgctcgaccttttccgtcactaatggtttctttctctgcagcattctgccccacggatcttcgaataaaaaaaataaattaaataaaattagagaattaggaattaatgagacaattttttataattaattaatgttgttatttgatcacattcactcatcgtatgcattcgtttgtccccatttttgtgtacctccgtggaacttttgtcagattcctccggccctctgcccagcgtttgcactccatgcgtctgctgctcatcgtttctcccccatcgttcatccccctcccgccttcctcctcctcctccctattctcctcttcctcctcttttccataggctatcttccgccgtttttcttcttccattccgtcccctccatctctctccccctcttccctccttttctcctcctctttcccccttgtcttttctccactttctcccactccccctttttgtggcgcaatttttctggngcttctcgtggacgaaagagtgcaaaaaacgcgacgagtcgacaacaattttggagtgaccaataacaactaaagtatgaagaaaaggaatcattgatgaacaattaattaattaaccttccaaatttctatataaaaagaacttggaaaaggagtgcaaaaaatgcattaaaactgatttggatttcagaatttaaagtatggcatttgaatcccccactttgtcatcggcaggcgatttgcttttggtcggcgttttttgagcggaagggggcgttttgaattcgattcgaccatgctcaagcactttgaccgtcgaggtggaatagagtggagaaatggaagcagcaggtgaagaagcaccggaagaagataatacggcgtaattattggattaacggggaaaaatcagcccaaaattcctttatcccccggcactttttagcggggttcgaacaccgccggcgccgctttgttgggtcggctgttgcggagttagcatccaattcggctcctcctcctcttcacctccttcgttatatgccgtcgatgttccctctgtttcgcatcttttgagcattttccagcgaaagtgaggcgaaacgctcctgacaaatgagtggtgatggatggcattgtaaatttatgccaaaaatgaattaactcacggtgaaacgatagatgatgcagcggaggagcatgctgccgactgtgaagtgggcctcgtccgttttcgtccgattgcgtcaattacggtagcatttggtggagttacggtagtcggcgactgtactgctccctcttctccgtcgtttcgtgttggcaattgtatggcattgtgctcatcgtccggatcaccaattacagtaaaactgttcgtgtcaaaacaatcagaaacaatagaacattcgttgtcccttggtctgtaactaacgaatccgaaagaattttttggcggaaacaattccctggagagttacagaatggctttggactgaaccatccaacgtctaaaaacgcatggaatttacgctcactaattcgcttgtgagttcgatatttcagtccttagcctaaactcattaaaaataccaaaagattcttaaactagagaccgaaaagaaatgtatttatattttttgttgtagacattggacggttcagtcccgggtctgtaactctgtttagaatgtccgccgacacctaaaaatagcatcattcgacttgcctcatcgagacgaatgacaaaatcgaaaattttcttcacacatttaaccctttccccgagcttccaaaattacccaaatttatttgccttcaaccgctatacgatttttgaaaatgtgtgatcaaaatttgtgcggtccaaaaaatttctgagctattcaaaaatggctaaatttccagtctataggcgtcaaaaaggccaatttagcttcaacttttatgggcccaataggctcaagaatttataaaaacaagaaaagagcaaatatttgcctcaaaaagaattataacgagaaaaataagaaattcagcctcagatccaaatttattcactgtaaattgtttatctcgcagatgcataatacaatataacttatacatttacggaatcatattgcgaacaataatcacagcacatacaaaaacgctgtcacataaagggctcgggattgacaacaaa

SEQ ID NO: 18171 - DNA, 3567 bp, Heterodera glycines
  misc_feature (55)..(55): n is a, c, g, or t
  misc_feature (85)..(85): n is a, c, g, or t
accgttgtcagcttgaaattgtgtgagaagtgcacgaccgacaactgttgtgcanccgatatttcttgtcattcaagccaaaganatagaccaagtgatggaagtcgaaaatacgatctttgattttttaataataatgataagttcgataattataatgataaattcggtatttcaatatttgtaatgataatttcgataattataatgataatttcgatattaattgtatgcagctaattgataaatgttttttttataaaatcttttttatttggtcatctcgcaacttctcgcccctaatctccattacctcccaaaccccctaaaaaaaaggcaaaattttgttttgtttgcatagcaacaaaaaaaatgccgagcgcggaagcaatttgaccttttgctcattccttacttgatttaacggctccgcactgcaagggatgtgcttattcattgccttgttggggtaattggcggtagcctaaaagaaattgcccttccaacagttcaagcactttaatcgtcccaatattcccccctaaatgcacaacggagaaatatgagatgtggcgtaaaatgttatggactgttggtgggcgggattaagatcgtcatttattctgtgagccccttttggcatcttcctttttccctttttttacctgctttatattttttaatttttttagcaataaaattaattctgaaaacatggactcggcggcagattccattcgacagctacaacgtgcagtgcgcgaacagcagcagatgatctttttgctgagaagtcagatcgttgatcagagagcagtgttgcttcagaatatgacgcggattgaatcaacggaggggtacttggccaatgtaagttcaattttcaaacaagtatttaaaactaattaatttcgcttatttttataaataatcatttgattatttcagtctcgcgggaaccagagattcagcccgagatactctcccatggcgggagtggagctttcgctgctcggccgtcgacttgaggaacgagaacgccgacaacagtctcgtttgggtaggctgtaattttttttattgaaataacaaataattcaagtgcaagtggagaataataataatgctgcgggtccaagtgatggaaatgttcggcccataccaaatgaaaaccgtaaactaggaaatttttgtttaataaatttcgatttttttttgaagagcagctgactccgctaagttcacgttcgggaaacaatggggctctgcaaaatcgtactaatggtgtgctaattttgaaaaaaaaaacaaattatttttgttttttttttagagagcaatgtggctggaccaagtacggcgagtaatggtggtgacgatgaacgtgaaaacggtgagatgaacccttaataatttgaatcaaataaatgaatttttgacaggccccgttctaagcgctgtgattgaaggccacatgaaccgttcgcggatgcgtctaattcgggacgagatggttcatcgtgctgtgcagcagcaacttgagcaccagcaccatctgttgcttcagcaagcgcagcagcagcagcaacgggaagaacgcgaaagacaacagcactttgatcaacaaatggaagaagcagagcttcttcacgaacaactgcaggcagcagagcaggaaaacgacgagaacatcgaaccacagccccctcagcagcagccgcaacctcaaccgctgattcgtcatccgcagctgcagttcgaacgtaatgttcgactgcagctgcgcgagtcgcagcgatttgaaaggggagttgcctcgttagtgctcgttccgccagcccagctctattgggagaccgaatgcatcatctgcaccagcaaccgcgcacacttctacagccgtaattgcggacacatctacctgtgctcgacatgtgcggtgaacgcggtgatccacaagatcgcgacttgtatgctgtgccgtgtccgaattgatggaatttatccatttgtacgatgattgattgatgtatttgataactctcgaacaccctttatcattttgtccatcctatcattatcctattatcacaatttttaaacgatcattgattgccacttggcatttgcaattctcactcattatttaaactcatccaaccaatccaataaaccttattaattgaaaaataaataaacatcaattcgttatgcatttataagaggggggacgggaatgaatgagtgaatttttttagaaaaatttagtgtccataagcacggggttgggcactagcaccgtatccaacccttcgccttaatgcgtaggtcggaggccgcaagccgtgaccaggcactagcacgccaaccccaagcacgggttgggcactagcaccgtatccaaccattcgccttaatgcgtaggccggaggccacaagccgtgaccaggcactagcacaccaaccccaagcacggggttgggcactagcaccgtgtccaacctttcaccgcaaaagcgtaaggccggaggccacaagccgcgaccaggcactagcacaccaaccccaagcacggggttgggcactagcaccgtgtccaacctttcaccgcaaaagcgtaaggccggaggccacaagccgcgaccaggcactagcacaccaaccccaagcacggggttgggcactagcaccgtgtccaacctttcaccgcaaaagcgtaaggccggaggccacaagccgcgaccaggcactagcgcaccagccccaagcacagggctgagcactagcaccgtgtccaacctttcgccgtcaagcgtcaggccggaggccacaagccgcgaccaggcactagcgcaccaagccaatatcaaaacaaaaaacataaaaatgaatgaatgaatgaatgatgaaaaatatttagacaaaattcaattcagtaaatattaatgcatgagaaaggtcagagaattgctggacgtgcaaaagaaagagggggaggagagaacggggggttaattatctcataattcagttctgtacgatttttatttaaatattttttttataaataattttaaaaaactttttagatttttaaaaaaaaatgttgtgcaaatgcggcgaatgcttcgagtgcgaagatgaaaagcgccgcctcaagcgcaatcgggagctcaatacccgcaaagagcaaattaagaactgcacaggcaatcatctagcaccggctatgatggacctcaaacgccggaatatggaactgtttaaaaaggcttataggccggtgaagggcgtcatcaataaaataaccgggggtgagtttaaaaaagaaattgaaaaaaaaaaacaaaaaaaattttttaggcccttggaatgtagaatgtgaggtctgccatgagaccttcacatacttcatggtggagtgggaaaactcccggaccgacttctcgtggggtcccgggaggaccatggtcgaagcggataacatagtaaaaatttttgaaattttataaaaaataattttagaatcagaaagaaattttggctcactatgtaggccaaaatgat

SEQ ID NO: 18172 - DNA, 2167 bp, Heterodera glycines
cttattcttttgtgtccatattccctgcaccaatctttgctgatcgccccgagccaaacaaagaaagataacatctgtatgaccatttctacaatgaaaagacgacaaattgacaaaagaaacaaaaatttggagaactaaagtggatgggaagagggggggggggttaagcgatcgggccatactccgctggtcatttttccgaatattcgcgccatgcagtggattaaatttaactgcacgctttgtccgatcggtctgcattgtttttatccgcgcaagtacgcaaagcctgtgctttgtgcgcatcccagcgtccgtaacatcacggactttttgagcaccggtcagcttgacgaagctgcaacgacaacaacaacaacaaccgcacttccgacaactgcggaggtgtcggcagcggcagaatgcgcacctccgcccgcgcatttgaccgcgtggatcgcggtgtgcacagcgctggtggcgcttttggtgattgcggaggtctgttattaattttggtcatttatccgctaaacccctattcctcaattaagcttgtgcgcgccggattcaaagtgcgcaaatttttgaaggaccgcgccttcaaaaaggggatgctgcgccgacatcgccagcgtgagtttctcgctattacattttagcaaattgtaattaacaatttgtacaggaatgagcgccgcaaggcgcaaccgccagccggcaagcgcgccgactccgctgattttgccggctatgttggccggcgtttctctgcgcccgacgggcgtcaatttgactgtggaccgggtgggcaattttaattaaattaaaatctttatatattttaatttctcactcattaaaattacaatttaaatttaaaggcagcggggcagcgccgcgcggatggtacggacgaagagcccgtgtacgatgaggtgccgcttgacagcgacatcgcggtcgagatgcgcgatggagaaaatggggaggaggatgaggaagatgatgacagtgatttttagtgattcggcaagcgatcactcaccatttaactaatcgatcgatttttcactttaaaataaaattttaaaaatgtttgaaaataggatcgctcactcaaaaaatgggtcataaaaagtttaaaaaataggtataaatccagcaaataaaattctaagtaaggatttagagtaatttaaaaatgtgggtgggcgctcgcgctatataaataagtgcgcgtgtccccatcggcccatttcaatttattcctgtcaaacatttggccatcagtttttcatgtcggataaaaaagcattgtttaagcgtgttatcgcagaggtggacctcactataagcacgggcggcataactttgagcggcccccgcctgtctgttccccgtttcattccgtttgaggaaaacgggcgttgccgagcatgtaaaggaactgaggctgaggtggacacaatggtcaccaaggagggaatcaccttatggtgcacacgcatagaaaaagcgcagtttgtcccttttgatgttgtctacgagctccccggtcattgttttttccgcgtaaagaataaggcaagggtgttcagcgttccatacagcgaactgtcgtcctcagacaggtgcgcccagcctctaccaccaccaccaccaccaccaccaatgacaacagcaaaacatcaacggacaccggacgacgaggaggagaaaaatttgaggcgtaaggcaaaggtggcgcttgacttagtggaagctggtctagcggcagacgcaatgatgcaggatgggacgcgttggaagaaagccaaaaccgcgatcaatgtgctggccaatttgcttttggcggaatcattaacagatgtctcgccaacttttgatcaacaacaacaacaacaacagctatcgtcaaaagaggaggagaaggaggaatgcacaaacagcagcagtgctgcagtaacaactgaatctgcttccgatgctgatgtaatggacgatttcgtcaatagcattcaagcggcgacaagcaatatgcaatagtaaaaaaagcttaaacgatggactcgctctgccctatatataaaagttgttgattgctcaatttgtagttctccatactattatttcaagttctaattttttaaaatgttaaatt

SEQ ID NO: 18173 - DNA, 659 bp, Heterodera glycines
  misc_feature (62)..(64): n is a, c, g, or t
  misc_feature (70)..(70): n is a, c, g, or t
  misc_feature (73)..(74): n is a, c, g, or t
  misc_feature (99)..(99): n is a, c, g, or t
  misc_feature (111)..(112): n is a, c, g, or t
  misc_feature (119)..(119): n is a, c, g, or t
  misc_feature (133)..(133): n is a, c, g, or t
  misc_feature (153)..(153): n is a, c, g, or t
  misc_feature (181)..(181): n is a, c, g, or t
  misc_feature (564)..(564): n is a, c, g, or t
catacaatcattctaaaatgttaacgaattttaatttgtcttctgggttcagagaaaataannnaaaaanaannaaagaaaacttttaaaaaggaaagngaagaggggggnngttgtgntgtgatttaattanatagattataaattaaattnattttccagtgaatataaaattggattngtttttcaaattatttattttaattaaatgccctattttttgcatttctgaacaaaaagatttaaaattctgatttggcctaaaatttaaaatttgcatcaaagttaaaatttgatggccttttcaaaaaaatataaaattcaaaatttaaaaataaaaatgaaacaaaaaggctcaaactcgtcttttgtcatttccaaacgaaatattatatttttagatcgatttgttaagaagaattattaatttaacagcatattttaccaaagtaaaagcccaaacgattcgctgttcccaaaataggtaaaaaataatcattaaaaatatttttgttgcttttttcgggggccggaaaattggacaccaatttatatattttttanattataagaaataagaattaaaaaaaaatttatgcttagggaatagtttaaaaaaaataaaataaattccaaatgcttctgggggtttttatact

SEQ ID NO: 18174 - DNA, 1148 bp, Heterodera glycines
tcatcggttggtgtttaaggctcacacaaagacttcaaatatatgatgctgccccttcgcgagaaagggctgcgttcggtcgcattcaattggccagggatgggctacactttgtgtaaataattgcaaaattaccctaattaatcccccggccccttttaagtcgaccgtcgtctccgacttaccaattccgagagaaccgcctttgctcgctctttgatcgatcagctcctcccctctccaactgagttgatctttgtaggccattcccgcggtggtgagaatgcccttcgattggcccgtgaataccccgttggcattccgttcttttcccattttcattccaacttttgaagggaaggactaaggcacttctcttgctcaattcatgcggctttcgacctcacaaaggcgttcgtccccatctgatgatcaaaatcgcagcttggctgtgggctttggattcgcgattacagcattgtttagcgccgatatttcacaaaagtgataaattcaatcgatcggaaagcattggctgatcattgcttttcagtttacagcttttcctccggactgaaaacggataacggattcattgcgggcatttcgacgatcactcactgcacttatgattttgacaaattgaaattgttgactgatgacctgcagaaggagcagccacagctgaaggtgttgttcgcctattcgggaaaggatcatctgatcgagacagaaatcagcgaggaattctcgcgggcactcggaggaccaattttggtgacaatggcaaaaagtgattaaatggcacatttaacgatgttcagatatcaacgaccaatcctaaggaagaggacagtgaactgttagcaaagtttaaccaattaactgctggagagcatggacaaaatcgactttcaatattatttaccaaagaggtacggtgattgattaatgatcgataaattaactcattatgatatgggtattatattaatcaatgaatagtagtgtaatctagaaatgggtactataataattagtaatttgcaatgtaattaattacttactgatagacatactataattaattgacgcttaataatataattaattgaagatgagtactgtaattaataaatacagtaatt

SEQ ID NO: 18175 - DNA, 1110 bp, Heterodera glycines
aattttgtttcttccgctgtcgtagaatttctgataattcgtgaggttcgcattcgttaaaatcgcataaaatttcaatgagagaattcatttttgagcaccagtaggcattttcatattcggtgcaaatccttatataccgttacctcaccgccgtatgatgaatttttgccttttctctttatttttaaaattctgagaactgaaatacagatgacgaccactaccaaatctaaaattgacaaaaaatacacccaaggatttgaacttgaaactctaattttctcaaattctttgaacacgacaaaattaaaaaattcactatctgtgtctgaaacatatttgggaagtatctcgtttgagtcaaatcggtctttgtatattttcttttccttaattagataaatttgcccctcatttattaggaaatcggtgtatgccgatggcattgatccgatcggtttactaataatttcggtttcattgtgttttgtccataaattctctattgttctaaggtcaatctcgtctattcgatcgtctctgattacgaaaagtcgaccatcaatatgatcaaatctaaggtccccaccgggaaaattcctgacaaccatttcttgactccctcttgttatagaagtttcatttgtcttttcgttttggaaaattaaataactatgatcgttgtaataaaagcacgctcggggctttaattgtcgaaaatcctggtaaagcttaacattagtgggtccgctcttttctattgaattaatttcttggattgataggctccaccctgaaatcagattcctatttatcgtacataatctcgagcgatcgaacccgaactgtctttcattgaccgaactctttggcatagtgagatacttgtcgtcaaaaagttgtgtatcagaaagaatagtaactctttctgcaatcacttgactggctatcgttaggagaacaattaaattaaacattactgacaaattgcttaactaaaaatcggccctcgggcgaaccttatatagaccgtcaatgacctcacaataagggattccggagcagcgctgtgtcaagaaaataatgcaaattgaccacacgcatctg

SEQ ID NO: 18176 - DNA, 1404 bp, Heterodera glycines
agaggtcatcgggataacaaagaaacaccacccgtttacaaatttttgtatatttatcgacattgtcctttctccgtcgtccatcccgagtcctgtatacatgtcaacaaatgctcgaatgtatttgtttctatcaaaattaagagaatagggtgacccggggaatatgtttccattcgcttcgacaccgatagagcgtatttttgcatgttcaaagacgaagggtgactctttaggatttccggtatacgcaccggttgaaacaaacccgacgattaaacgtctcggaacaatgctggtaaaaacattgtgtgagagatcagaagtgccccgtgggatgaaaaaactcctgatctcaatttttctaaccgggtatttggccggggtggtttgtagctgattgcttattacgttatttaatgactgggtaatgtcgactgtttttacataaattctaatatcatgtatgttaatacgatatgtgtgcgggttcgctatgactgcatttcctgaaacatatggcggtgccataattagaaaatcatcggtgttacggtgtatgctaaaaatgacatccgagttattaagcaaaagattgggctgacggccgagatcaaaattaagtttcaccattgtttcacattttgcaccatcagcaaaacgtgacgctctgtttttaaagccactgtttgtataatcatcctggtcgacatcgtcgacataatagcaggacgcttcacagagaccctttttgacatcttctgaaaatcccaattcattcatcatatatgccctaaacgcatagtaaatgccggaatcataagattcgacacctgaaattgacacctttaaggttttgacaaagctgtgcccaaaattttgaatgacaccgacgtgttggtcagcttcactgtccttggtaatcggaatccaattgcttttatcttttctctcaattgaagttgacaaataaagaaaagttttattgaaatcacaaaactgattatctgaaaaaagtctaaagatatacggtccagattgatttattgctgaaagagggagtaattcccgaatactggatttattaattgcaacgttcgtcggagggatgtcgaaaagtgaaaggcctccctcgagaccgtcctcactcgccgtgtcgattttcttgagagttgtcatttttaactttttatattatttgttctatttatacctttagatgaaacttaactgatcaaatacccgttttcggttcttattagtgatcagggccttttttcctttaccacattgttgtaacttgtcggtaaggttagtcagcccctgtcttgaatgttccctgacggcatcccttaaatcacggccaagagcgatgtcactcagaactctctgccccgcggcgag

SEQ ID NO: 18177 - DNA, 2906 bp, Heterodera glycines
  misc_feature (2132)..(2132): n is a, c, g, or t
ctcacacaggcgccgctcctcacacattgaacggtggggccgcccgcgacggcggtccgcaaacgctggcgcgacagcggcgtcaacagcagcaactaaagaaacagcggtcgtcaccatctccacccgttgcttcctcaccaccgtgagggacagcgacggcggcggcgacgcccggaggcggtgccggcggaacatccacgcgccggcggtgcgcctcaaagcagtacgctttcgggaacacgaagcggcagtgttggcagaacgtgccgctgctaccatcgccgccctggcgccggcatgggaagcgcagctcgtcgtagcgcatgcacaggccacacacagcgcgacagcccagtggatgcgtgcgccggtcaaccggatgctcgcactcaacacagaactgcttggcctgtgcaataaaggcacgattgaatgatcaaaaaaaatgcatacgccatacagacttttttttgctgttttttaattttttattaaaatttcaaatcggtatgattttgttcacttgattttccatttctctctttctttcattcatatataattaatttttgctttttgcatggatttttaaatcactttgcccttattttgattttaatttaaatttttttttacttttttgtctttatttccttttgatgaaatgaattttgggtaaactatttgtattcttaacggttgcttgacttttctttattatttgtattttttcttgagatttgtttgacttttcttaattacttttatttcacttttgcacatttttcttttcatttttcattttgtgtttttcttttcttttctttaaatgaataaaagcttttaaagaaatttgcgtagactttcctgtatttttagtgtgtgtgtgtgtgtgttttccttgacatttgcttggcttttctttattattgcatttttttcttgaggtttgtttgacttttctttattattcttttctttcctttggcacatttttccttttcttaatttttcaaagtggtgttttttcttttctttgctttgctttaaatgaataaaaattttaaacgaatttgtgtaactttttctgtattttctataagtttgtgctgtttcgttgacatttgcttagcttttctttattattcttttcactttgacacattttttcttttctttttattttttctttttatgtttttttctttgctttaaatgaaaaatattttttagatgaatttgcgtaaatttttcgataatttagtgttttttttggcttttcattattattttgtgcgccctgctgcagcaacaagcagatgttgaagtgcgcacgcagtgcgcctttccacagcacgcggcatccgtgctcccgctcgaagatcacgaggcgcacctgctgtgcgcccagccgcgtgtccagcgcctgctgtagacgctgcgcatcagcaacgccgtagtctggtttgtcgagcggcagtgtggccatgtggagcagctgccgggccgcctgcgcaccgccaggcccatgctgtgccagccagaaggcgcggaattgggccgccgcctgtacgcttccggccccgtattgcagctgggcgcggcggtcggccagcccgaggacgatggcgcgcgccaggcaccatcggtcgcccgggttcaccaccgggaagaaggagcggcagcgaacggtgccgcgcgcctcctgctcatccacggcacacgcccccgccccactttggcctaaattatggccccatttttttccttttggaaaattcggcacatccctcactgtatcctgcacccaccccgccaccctccgccccccccctttcacccaccgctggcatccaggggccaaacagcactgatgcggaacagcactgtgccgccgaacaagtcgaccccgccggccgactgggcggccagtcgctccagctcggcgcccattgcggccgctgtgttctgctccggcgcgcgatgcggaatgtggtagggggtcgcgaactgcggtggttggcatgacaacccgatgcgcagcggcggcgcacggccggaaagcacacgctgcagcagatgctcaatgcagcgggccaacagtgtgtcggggcggcgcgcgccctcancaaccgcgcagcgacacctcaaccgcctcacaacgcgtgttgcggctacggcactcggtgcgctcccaggcgccaatcactttgcagaaacggttcagtcgctgcccgtcggcttcgccggcatcggcttcgtcatcgctcggcgcaacgttggcactttcggcggcacttccactgctgctgctgctgctgcccaaattagacaccggcggatctctgctgtcgcgcatcggcggcgctccgctgacgtgctgttgatggtcggagcgattggtgctgctgctgtcgtgatcagactgatcggtgaacgagggccggcctcgcccaatttgacgccaggcattacactataaatgcaaaaagccatttttgcgcatgtccctattttccaattttgtgaaagcccttccaatataatggcaccatttctctcccccaaagctctagcgcttctcattttttacaagccccccccccccggccttaatcacatcaaaacacacacacacacacacaaagaaaaatgaataaatttactgaattttgaaatataaaaatgaataagttctattaaaaatggcagaaaaaatatataaaaattggcaacaatataaaatatgatagaaagaatggaatgaatgagaaatgatgaacaaaaaaaagcaaaaatgcgaaatgaagaaaaaattaaaatgttttttattttttaattaatttattttgagcggtcattgacatcctccacccgaaatttggccctaacgactcattctt

SEQ ID NO: 18178 - DNA, 2630 bp, Heterodera glycines
aatttataattaaattttaatcgttaattaaattcattgacaccgatcaatcactgagttttttttggatcgacctagcactttttgaaatgggccctaatgcttagaaattttcaaatttgatttatttccaagattgtacttggaatcagcaattttctgaaaaaggacaaaaattataattaaaagtcattgtaacggtaaattataaactcggagaccgaaatgaattttaatttattatttatttttagcacattttttgttttttttttaaatttattatgacttcaaacaaaagaaaaaattttttcaatccgaattgggaaaataaataaaccagcgcctgaaggcacataaaaactttcccctctacacctcgagaccgagactctcgagcagcactaatgctcgctattggcgtcggggttggatttttagaaattctacccttgtttctagtttctcaaaaaaatgacatttttttggcttttttttcaaaaaaactaccgacaaaatcatatgaagaaaagcatattgctgtaattttgagaccagacgctttttatgggggggggggcataacggaattaattaatacaattaatttgccgtttttatattccattcattctcatcgattctctttttttcatctctattctttatttatttttatttttttgcattataaaccgcgatcacttttaggaaaatgagaaaaaataggcataaattaaaaagcattttagaggcattaattacggataaataaacgatggctttaaaaatggcttccataaaacaaatttttattgtccctctgctggtggtcgtcccattagcatctaattattatttttaaattattcctcctccaatgcttttcctctgccgataatttcttcatcattttgccgttgtgttcgttgttgttgttgttgttgttgttgttgttgttgttgttgttgttgttgttgtcgctgatcactgcttctccgtcttctccgtctccttctgatgctgctcaattccgtgatggcactgatcagcagccaaagtccgagcagtgccagcaacacagccaagcaaatgccgacagtgaccagtgctgacatgggcaccgcttgttccacccgagcgctggcattttgctttacaaaatatggggggatgaagacttgatgttgcttgtttggaattatggacctggcttgatcccaaatttttgtgaatttcaatagaatgggaattgccaacggaaatgccatttttaattgattttgaaatcggtttaactccttttttgccgaaaaacctgaaaaaggttaaaatgagtcttcaattttattgatactaattcactgagattaactaacaacaggcgaatttgtggattctaattttggcaaaaaacttttttgtgaccccaaatattttagaagcaaaacaaagtaataaagaattgaaagtttgaatttaagaaaatgcctgaaatttattatatttttcctttgcattttccataatttgtttttctcaattaacccttttaaaaaatttgagttgctaattatcttagatcagcgtgaatttgcatttttacactacttggacgacgtcgaaattttccgtacgggaaattatgtccatagcacaatgattttcaatcggggccgtgaacggggcgggaatttaaaaaatgcaaaattttgagaaaaatatttttagttaaaataaaaattgttttaatttttttttgcctttcattatgctcctatttgagtgcccactttctgcattgattgtttggttgtaatttttgtccgaaaattatcattaaattggtttttaattacgacaacgtgttgcacatcgctttgaatggcggcaaaattggcgtcgaaattggccagcgtttgttcgccccgggcgccgatggcctgcactttgtcaccagcctaaaacgaatggcactttgagatgggcagcagcagtagttgcattctcgagtttaggggttgcttagaggtgctcaattaaaaatagtgatttacccgacatttttgctaaaatacccgaaaaaaccgaacttttttctaaaatgtcaagaaccaagctcttcgagttccatgcttatatatattctgggttttcataatttaggagcacgagaatctcgactcactcatctgccagttttattttgagttccgaaaaatccgaaacttcctttggcttttcccggttccaattattcgttaataaattatgactctcgaattcgtatcggttaatttttctacgatccaagacataagccagcgctggttatcagtgactccttaatcataacaataattgatcatttttcataaatttttgtctgttgactagtttttcaatcaattttcgcattttttgggtgtccatttttaatcggccaccgtttttatttttcgaatgtttaacggtgccaatttgctgtggccctttcggcggcagcagattatgccaactgctgtttttggttggtccgcttactgaatgggccaagtcatggattgcgctggccaacccgtgcactcggtcaatgaccgcgtcaatggaatgcgtttcgttgttcgcgt

SEQ ID NO: 18179 - DNA, 1207 bp, Heterodera glycines
  misc_feature (1183)..(1183): n is a, c, g, or t
actgatcattttcttatgatttattcatgatttttttattttctttttataaattgtcattgacaaaattttgtttggcttctttaatttcgtccaacttctattttagagcatatttatttttttagaaatattttcttttgttcgcccaaggaccggcaccgcaatttaagcaacgaatatagcaaaaccagaataatacaatcaataaaaaggagaatatattcatgaaacattttaaagaaatatttgctcttttttatttgatcattagcgcgctccatcatcaattttttaattaatttccaatataatccgtcgattggcattctgtgccgtttgttgtgcgtcgtctccgttttgttgacgcggtgcaattccgcgatttattttgtgcggtatcgttttaggcaccattttaatgcaatctttaaaaattgattaaaaaggacctttttggcatttaaggtaaattcataaagataaaaatttttaaagttttttgaaaaacgaccaaaaatttttaaaagttgttttaactgaagaaaattcttaaaatttaaaaagctgcgccggaatcctgcgtcttaccagggattggacaaacgctgtggcacaacgtgcaacccgtacaattctcttcattaactttggccaaatgtgtatgtttgtcaaatgaaattgcctggtagcccgaatcattgcatgtcatatagctaaatgatttgtttttattattaacagaatttttaagataatctaaaagattatttaaaagataatctgaaacattatctggaaggataatgttttaaagataaactaaaatatactataaaaactataaaaatactaagcatattactagtaattaaataactatacaattactattatcgtttaccttttagattcatctaaagactaaagataatattttttaaatttaaattttcccaccattttccacaattaatgcataagtcatcatcaataacggcgaccacctaaatatagaatcgtttttttatcaaatttattaaaaagctgcaacatttaaaaaaatttgaccaaaatgcataaaattgtctttttaggttaaaaaaacctcaaaaaatgctaatattatttttctgcaatatcttgggtagaaaaaataataaaaattaaaaaatcacattanatgatttattttataaatggaaaa

SEQ ID NO: 18180 - DNA, 1431 bp, Heterodera glycines
taagtacaatatactaaactcaaatatatttttaccgataaatcagtttaggtagttttgtcaaaaataccaagaagcttcagataagtagtctgtccggaatcttagtccgattaatttttttaaaaagaaatcaaatttacaattttgctttgccgacatttggccatgcagtgccatctgagcccagtcccatcagtccggacacagtgttcgttgcggttacgccatccgctccgccatcccttgccgcttgtgccagaacgcgtacatccgttatatttggtgtcattttgacaaagaatgggatctaattgggtaaaaattaggaaaatttaacaaaaaataaaaacggcacaaaattatttaaatttacaaatagcggatcaatcatcaccttgactgctgaacggacccattccgaaatttgtttgaccatctcgggattcttaaacaaaaatttattttaactgatcgcacaccaaagtgtaaataggtatgtaaatagaattataattgtaaatttccaaaatatttatcaaaaatttttcaatctttttggtcttaattgtctagaaaataacttacttaataattttaaattctattactgacttttaatatttaaataataaaataagttgaaatattttctacttttgttcagaatgaaaaagaaatatatttaaaaattgaaatttgaattacttggccacaggcaaggcccatgccacgttcgcccatcccatgaggacacgacaaattaagttccaaagcatcagcgcctgcttcttcagaacgggatgccaaaaattcccaatcttgctataatttaaaaatattttattttatttccaaataataatttaatttcacttggttaaacgatgccatgattgatgcaattacaattttttgtgaaaaatcacgttttaattccttcacgcaagtcaaccaatactaaagcaatggaaaatatttattttttgaaaatttaaattttggtatttatgggacttgacaaaagtaattagataaaattaaaaatagttaattgttttattataaaatttttaaaaaaattgttttggtgaaaaatctagaaattaaattaacaaaacaaaaaaaaatttgaggtcgattttttgtacattttttggtttgaaattttggcatttttgcacaaatttaatgaatatttttccattttgagaatattaaataatgaccttttttctagtttaaaatctcacctcagctgatttctccgaaatcaattcaatgttgagaaaagagccctgccctgggccgaatattggcccactggtcgtcccacgaacaattcgaggcgaaacatttgtcaccaagtccttaccaagaaataatttttaaatatattttatattaatttcggattttcctgttctgcaa

SEQ ID NO: 18181 - DNA, 1131 bp, Heterodera glycines
cgatgacattatcggaagtgaattgggggggggggacgttctaaaggggtgaaacaaggatgagaagggtgatgtgaaatacaattggggagagagggtgtgggggagaaagaatggtggataaatgaaaaggggtgacggaaagagagaggggaaatgacagtgattatatgaaagtgagagggagagagagagagctagagagaaagtagagagatagagaaaaaaagcggagcagagaaaacggtaactaaatgctaatgatgctcgtaagtcttggtcttgaatctcgaatcgagaaaacattagtttttggtttctctgtcttgggttttttagcccggtattttcgagacagagacttttttgtacttctaattatgttgagtcattgaagcgaacacaaagaaacagaagaaaaaaagaaaagaataaccatttgaagaaaagaaagaatgtttggaatttggagaaaaattttaaaaatcgaaaaagggggaaaataaagacaaaaacgaatgcaaaaagttaagtgttgacgaatggagaaagtgactgaaaagcaatttggcgacgtggggtgagcattgaataggtaattaccctaataatccctccctcggattatggcagccaattaaagaaaatgataaatgatgaatgcacgcaaacaatgagtgagcaaattgacgccaattgtcaaaattagcaaaagaccagacaaattaaatttaagggcgggaggagagatcgccggagagaatgccaagtgattgaagcgactgatcaatggacgatcaatcgacttttccattttttgccattcatttcgttatcgctttccgcactataaaataatgtttccccctctcatcagtgcactttgccccatcgatgaaataataaaattatccgaccatcgcccgtcgtccttcgccgctgggaatgacaaaatatgaagcgaatgcccccaccccctttccgaaccacacagatgggcggcgaagaaaaggcagaaaaaacagaaaggagccgagaagattaaatggaataaggtgaagtaagtcggaaattaagaaaaacgggtgggggaaaatggacgaggtaaatacggaggaggggggggggggg

SEQ ID NO: 18182 - DNA, 1262 bp, Heterodera glycines
ttaaaaaagcgtaaaaactttggcacgtcatatctcggcactcatgctcatttggcaaaaatggttaaaatttcgcaatagaaactaggggtgatttacccactcaccgaactgtcataaaaaaacaaaaaaaaggtcacttttcaaaaccttcttttgactaagtagttttatttgtgatttttaccaagttgaacatcgcccttcaagagtaatcgatcaactttttgcaatcaacatcgaaagaacccattttttaaagaagtttagtttccatagataaatatagtatgtagttgctcatttttaattttggacccatagttttaataacagcaaattacggacaatttttgagaaaaagataaactattttagtttttgtttgttaatttaattggtttgacatgccggaaaaaattaagctctcggttaactaaagcgtggaagtgaaacaagataaaaaattttcttggtataaaattcttgaactgacttttatatttaatttagctaattttttcgccaatttcacagtttaattataagttagaaattctataaaaaagaaagaaaaaagttatgtcaaataagacttctctccaattgagacagatcgctttgcatcagcttaccttcactaatttcaatttgggaatattgaatttattaaaatttcttattatttttttctttatttagacagttctatcgagaaataatggtccgcaaatgtcggtccgcaaatgtcggtccgcaaaagtcggtccgcaaatgtcggtccgcaaaagtcggtccgcaaatgtcggctaaccgtcactgtcatccccccccttccaaattttggaaaatattgatcatagggcccagagccgaaaatggccaaaatatataccaatcgatagctctcggtctgtaatggatgaatccgaaagaattttggatgaaaaagaaatttaccaaagttatgagtcctcaaaaccggttcagacaaaaaatgacaaaaattcgtcaaatttgaaaaattgaatttagcttattgcgctaaaaaaccgccgcacacttgactttttcaatttctttttcatccaaaaattctttcggattcgtgggttacatgccgagaggaatcgattggtatatattttgtcgcaattccatgcgtttttatctgttggacggttcagtcccaaagccatttggccatttcagtctcgggtctgtaactcttcagggattggttgccgcaaaaaagttctttc

SEQ ID NO: 18183 - DNA, 1538 bp, Heterodera glycines
cttgaacaattctcgatcatatgcgtcattaataatatttatacactaataatttaataaacttgctaattaacaggataaacaaaatatagaagacagaaatataaacattattgaaaacatttcaacgtggaatacactttcctagacgatagcaagagataaaagcccgaataaatataaaatataaaaacaaaattaaataaaaaactgtaattgctctggattttaatgaatcaaattaggtaattaatatttcaaggaatctacattttgccaattaaaacaaatatattacaaacagttataacacttttagttaatcactgcactaatacaaataataaaaattatttaaaaataatagatatattaaaaagactatacttataaaataattaaataatgaaacatattaatgtattgtaaaataatttaaatttccaatttctgttaatagaacaaggattaataaagacatacaaattgttcatgccgggttttttggaatttattttaacaaattacaaataaattttaaaattttctcccttcggttccgctagcggagtctgggtcgttacggcaccagctcaattttttggatgataactttttttttctttgttaaccaaatcgaacaagcaaaaaaagcgccatttttagagttttttcttaagaaatttttacaggcgagtaaatcttttagcattttgtaagcataattgagcacgtgaagggctttcgaatgataccaagattgtttgttttggataacacgtaaaaaagttatagtccaaaacatgggatggtgctgaaacgacggcgccaaaacaacctagtccccccgctcccccgctggcgcccgccatcccaataaatttttttttgaagagcggcgtaaataattattttttcatttttaataatattcagtgcttttcatgtgaacttgaaccaatttgataagaggattaatgatcacaaatcattttttttctattttcgatttatgtggcccaattcgattagttatttttgttttattacccaatatttgaaatattacctaaaaatcgtaaatttaaaattgatcacaaaattattattttcattccattcacaattctattcaaaaagcaaaaaatttaataaaattcaatttaataaaatccacaattttttttaataatttatgtttattttgaaaatttctgtccaaaaaaataaataaaagcaaaggaagaatcaaaaaaaaatcgatgaataacaggcaaattaaaataaattactaagctaaattatcgatttaaataataaataaaggatattttattaaattgaaaatttaataataaatttaaaaataaacatttgaaaatattcctcaaaaaagaatcatatgtgaaagatatatcaatgaatttgaagtaaaaaaaataaatatattcgggtaaagaattcttagaaaacttagacattttaatatatccccagttaaaaggaaaatgaagtaataaaaataaataacatttttc

SEQ ID NO: 18184 - DNA, 1595 bp, Heterodera glycines
  misc_feature (16)..(16): n is a, c, g, or t
catacacatttttgcncatttttcattcccccataaaaaaatctagctatattttaaaaatttctggcggcggcctcaatgataaaatgatatcaatttgtaaaaaaagaatctgaagtaattaacttttatactaaaaaatagcaaaacaccattctatttttgatgacctgaatataaaattaaattaataaattttatttaaatggcttttaaatatctttaaaaaagtaatattttgttatcagcagtaaaataataaaatcatggctcactaaccaaatcaataaaaaaataaataaaacttacaaaaaaaattttactgctcgcaacaaaaaagaaatattatttaaaaatgaaatcaaccaaagcgataataatgaagaaaataaagctatttatattttaattaaaatatatcgccagaaaggaggtcgaagaaaatcctctgtaaaacaagataaattaatacgaattatctttaaaagaaacagcattaataaagcatatagataataaaacttaattaatttaagctaatcacaaaacattagaactattttacaaataaaatattattttataaaatatacttcttaacctaaaggaacaatttatggaatattttattataaaaaatttaaaaaagaaatttccacaataaataaagatttaatgtaagataaaattaattaatcattaaggttttcgaactaaaaatattgtatcaaattaaattaataaataaaatgaagtgaaattcgttatgattaaatgtgctttcatgaataagaacaaaaaatgataaatccttctaatatttctgtaagtaaaatacaattcttataaataaatacatttaaagacttaagtttaaaataagggaaatcaaataattttaaaaatatttaaatttataatagaatatttaactaatctaacaaaaattttaaattaattattaatttaatcaaaatctagctgcagacctacatttaaggaaaatgatcaaaaaaaggcgccattaatggacttttgaatttaggtattatcaaaattaataaaaattatcccattttaaaataatttatccattaaatacattccttaataatcgcttaattttaaatttagaaataaaatattcagaaccacgaaagaacatttatgagcgaaattagaaaatatcaatattgcttttaatgtaatttagaagattctgggttcatctaataacgaaaagcagtcaaatttatattggaaattttctcacaagatcataagaattaatgtcagatttgaaatatcaaaatatgaaatttttttatcaaaaaatctttaatgaaaaataaatgttaaatcatctccaaaaattaatgcattaaatatttatttttagacaatcctaaagaatgggggtcccaaatttaaattattattttttatttgagctcaaaatgagtatttggggggtttcgagggcactgatcacgaatctgaactcagatttacctaattccgaaccccggaacccgaattcaaacaaaatgttgaaattttttgcacaatgtaaatttttctgggtaaaagcttcg

SEQ ID NO: 18185 - DNA, 2043 bp, Heterodera glycines
  misc_feature (1993)..(1993): n is a, c, g, or t
aattttaaagaacctttaaaggggtgcaccccaaaacgtcgccgtgacactttttggaccataactttgttcatcgtcaatcaaattaagcattcttggtgttcttcgatagctttatatgtttattattaataggcaaaatttcaaaaattttagttaagtttcaaaaaagttatgaccagaaggaactcaaaaacttagttttttgaactttttgccctgatttctttttacatgaataaaaaattttgaaaatttgcaggtttatacagttttttataagtttttaacaataccaagaatgtttaatatggttgagaaggcaaaaagctatggtccaaaattcgcccggcgacgtttcggctggcgacgagttttcctagtccgcctttaaaaagagcagccccgtgtatggctgtaaatttgatgaaattaccaaaataagaatttaaaatttaatatgtctaatgtttatcgattttaattgttggccaaggatcccttaactgaatttctttgcaaaataaaacaaacaacaaacatacaataaatttgtccttttctgtgatattttgcatgagaaagcattaattaattaatattactaattaattattaattaggataaaaaattttaattcctttcattaaggtgcaatgactaacgaaaactttttgattggatttttattttattttatttattgttccacttcatcccattttcaacaacatattgaatattgtattgttcttttatttcttttcgcccaaacataatattgttatttttatttatttgattttattttatattgaatttttatttttctaaaagtaataaaagacgtcagtgcaaaaaaaaggctcatttaaatatttgtttatttatgcttgataagtaccttaatttgtcatatttttgttgaaatcgtcaattcacctaattcaatgtcctttgaataagggcaaatcaattttcggttaattaattccattactgagctcaaggtagttgaaatccatataatctctgctgaagtgatgaatgctttgactggccaataaaaggcaaacagcgcaatcaataatttacgcgaattaatggtaattagctaattagtgcagcaaccgcccacacatatttatttatttttattctaatagggctttgtattgattatttttatatggaaagagaccaattattgacaaattaggcgctgaaaatgcgtgaaaacggggtgggccttatcaattgttattgacagccgcccccactgtctgtcggctgtctgatcaccgcccgtccaattccatcgcattattttgataataaaaaaattcatttttcaaaaataaaaacataaaaatccatcgattttttgaagtaaatttgggaggacccaaaaaaagtttgtgttgaatcgagcagagggaggaacatcttcaacttttattttttgttaaatttaattcgtttcaaagccatatttgttataggtgtttaaattatattggaaaccatttttttttttgatttatattatgaggcttaaacaacggaaattttcaaaaactattaaaaaagaactaaaaaatttgctttttttatttatctcaaaaaatatataatcttattatttttgggtagttctttaaattgtttgtaatacaacatcatctaccactttatgggattctatttaaatttaaattttaaaaatatatttagcaccactaagcttttttttaaaattttatccaatcagtgattatgtttaagaaagttttcaaaggaagcaaaaactttagattttggcacatttgtttacacaaagtttcactatttgtagaataataattcaggaaatcacttggctaacaatttcacgcactcgtgcaaaatcggcaattggtgattcggatatcgcagagagtgaaaaggagtatcaatctgtagaggaaaagataaaggatgaggttgaccaanttaggtgcagggaaaaaagtgaatttgagtgtttattcgtgatcacagta

SEQ ID NO: 18186 - DNA, 1061 bp, Heterodera glycines
tcttctcttctcttctcttttctctctctctcctctctttctctccccaatccgggtgatttggcattttgcgaagatccgccgtctgccggccgtcctttacgctgactcgcgcaaatccgactctcgccagctggaggtgctgctccgcgacggctacggcctcccgctggtcactttttatgccgacaaaattggtcggttggccgcggtggaggcaaatttggccaaactgaccgcccatcgggaaatgccattcctgttcatctgcggaacgttcattggaagtcagtaacaggaaacagacagcaagcagtaatttttgtgggcaaaacatgggacaacgagggagtgaatttccaattcaaaaagagccgaattagatcggtcggacccagggctgcatgcaattacaggtttccgtaattacggaggtttaaaaactcgcgtaatcacgtattacggctttccataattgaaaaccctggtcgggagaccgatcagggttttgaatttagaattttttggacagtgatttcaagaaaacccctgttgctgctgctcccttatgaaattaattggacggttttttgtggccctctcgaagcagtacaaccaattgtcgagatcaaaaatccctcattcacatcacaggcctggagcacatcaagaagtaccatgagcagaaacaaatgccacgactggtggaatttgaattcaataattaatcatttttctggctgggattgctcactgatcagtcgatcagtgagcaaagatggagaggattaattgtctatcggagtataaaatatatataaatggtgatcttatattgtacgctaatagtatagatgaatgccattttcattttgtaaattcccttcccaaaatgttatgtaggaaagcaaactttacttactcataattaattctctgccatattctaaacaattttttcgtcgggaatataaagaaggatagaaaaagaaatagcattagttagaagtgaaaagtaaagagaaagaacgcagagacagacaacggaagaaaaggaaaga

SEQ ID NO: 18187 - DNA, 2037 bp, Heterodera glycines
agagtgccacgggaccgggccgggaattctcggtcatccaaggtcccggtcccggattttgaaaagctcaggtcccggtagggcaaccgggaaaaacaagcactggtaagaatgggggtctgagtgaaaaattagtgaaccaaaggaagaaaattttaaaaaatatgaaatattctttaaaagtgacactaataattgtgaaaatggcctaatggctagtctccttgacttttcccttctttggtcccggttcccggtcccgaaaaaaatcgaggtcccggtcccggcttctcaggtcccggcaagtcccggttttgtcaaaaattcccggtcccatggcactctaattgccaaccaagtgaaaaacatccgtttttgtgattgtttaaaatctctgaaattagtctttttttttgttttttttctggtaaatattattgatcatgatcaatgatcatccgtccccaattttgatgattagtttaccagaaaatttaaaaaataaataacaaagttcgaagaatttaaacaaccataaaacgggtgtttttctcttggttgatatcactttccaggttattttgccacaatcttatattttcttgaaaaagtgacattctgccataaagtttcaaaattatgagtatacactatgagtatacacaccgtccgaaaaaacgagatatgtaccaataaatcgtgtccagacatttgcgccccacacatttgcgcctaggtctaaaatcggggtcaaacataaagttttttcaatccctgatagcttaaacagctttaaaattaagaaaacatagtcttcttgtttccaagattgttggtatcattcgaaagctcttcagatgctctattagcaccgaaatgattttctagcctggaaaaaattttttaagaaaatcttcaaaatttcgactaatttcgaccttttcgcaagtataacttttttggtaattgtctaatcgcgaagtgatttatcgatttttcaagcaacttttatcacaaaattttgccaaaaaattttcggctgcccttacgacagattttgggtaaaaccatttttggagaagagatgactttaaaagacaatctaccaaacaattttataagaaaaaaatttaaaaaaagggtaaaaaatggttttaaaaaactggaaaaaatgcacgatccgcggcaattttttgcacgatccgcgaccgcggcaaattgaattcgcgatgcgcgatccacgaccacgggatttttttgtgcgcgctccacccctgataagtaccgacaaatgtagccggaagggaatgctggcagaaaaataacatttaaaaattgccattttgtttttataaataatttaaaaatttttgtaaatgatggaaacaattttcggattattcgtttgtgcaattactacatagtatctagtagttagtttttcttttttcattgtttaccaaatctaacaatcttggtatcattcgaacgctacatgtttctaagctattgcttcgcgatagacaattaccaaaaaatttataatatgcaaaatttttggggttttttcttaataaatttcttagatggtagaaaatatcaaaatattttcgctttttgtaaggctaatagagcacgtgaagaagggctttccaatgatatcaagattgttagatttggtcgacaatgaaaaaagttagaatctaaaaattcgggctggcaccaacgttacatattcttgcattttttattgcatttcttatttagataatgagtgaaaataccggcttccaaaagcaacttcttgaaatggtaaaggccctccgtgaaaaagtcgccgtcgattgaaaaaagcgtcgccgatcattgaaaaaaacgtcgccgtcgttgaaaaaaaagccaccgtcattgaaaaaaatgtcaccgtcattgaaaaagaagtcaccgtcattgaaaaaaatgtcaccgtcattgaaaaagaagtcaccgtcattaaaaaaacaatcggcataaaggtaattgctttgacctgccagg

SEQ ID NO: 18188 - DNA, 3584 bp, Heterodera glycines
  misc_feature (758)..(758): n is a, c, g, or t
  misc_feature (797)..(797): n is a, c, g, or t
  misc_feature (3555)..(3555): n is a, c, g, or t
gttgagtaatttgcgcatttccgtggacgcctatcactgcccactgctgggctcgatttcgtaaatgtcctcgtgcccttgttggtggatcattggcaccagaagcaataacagatgatggccaagaaggtggagccaaccctcgggacggattgcgtaatgcgtaatgagactaaaacgaagaataattaaatgattggttggaggcggtgatggggcaggtagtacaataatacagtgctgggttatttcgtaaaatccgccattttagcattttgaaaaatatggttacctttgcttaaaagctattaaaacttttgcattcttggtattgttcaatagccaaatattttctcaattagctgaaaaatttcaaaaagttaatcagctttcgaaaaagttgtatggaaataagtaattaaattcaataattttatttgaaaaatggcggatttacgaaatgaataataaaattatgatctgaaaacaaaaccgaatttagaatgactaaaatggcacttaaaattagattaattttttagctaacagtttgatactctaagcgggtcatttaataagatcagcttaaaaatatattattaaaatagtaatagaatgtgatttcatttaataaacattttctgtctctttgacaagtcattcttattattgtacttaaataagcctttttaaaaagcactgacccgtgccattgttggcggatggtcacgagaagcctcaacaacgggcattgctgngccgccttccgaggggagcggagtcaattcacaaattgngggctgtaatttaaacggcaaataattagtattaaaaaacaaaataaaactataaaacttaaaattattagtctttgacattatttttatgattttgtttgctttttagcgcttttaccattattaaaataaatattttaaaactttctaagatttttctttttattatttttaagacaagttttaaaaatttattatttcgtttaatttctttttacgaacggtgatcccctcacacccattctcacgcttgtcgcacagtgtaatttggcacgcaaaatagacaatcatttggtcggcatatttaaaggtgctacaaaaatgcaataaaaaacaattaactaattaattgataattaaatatttttttaaaaagtgtttttactttattggtgtagaggaggaattcagttggctggtgtaagtcagtggggccaacaatgatgaatcggtgacacatctgtgcaggaccaaaaaataaattcgaactatttttaataaagagagctacaaaattttaaaagttattttaattttctttaaattaacatattaatttgcattttttttaatttttacccagcccgcgttggtccaacagggaaaaactgtggccaagtccgtcacggataatacacgaatggaccagcattccaagctccactaaaaactaattgattaatttcaaaaaccaatcgatcaatattaatgcgattatttaaaatataaaaatcgtttgttttttaattttggcgtattttcgcctttttgtcgctgaactcttggttttaaagcaaaggacgaagaattaatatggcattttaccatctataaatttctgcactaattgagtcaatggcttttaattgttattttggttttggccattttaagtcgccgctccctcacccgtgtcgcaactccaacgatggaccaacacatcgccaacatttgcatatcgaatgggttcgccatctttgagcacctcataagtgcataacggcgcttctttggtgccgttcacatcaaatagcgacaaatcccttcaaaataatttaatatttgtcaaactcgttggttcactggcgacaaaacgtcggcgaccaaaaaggtgccggacgatttttggaccataacattgtcaaccaaattcaacattctttgtactttcggaagcaaccaacaaactcaattaacataaaaaacactaggctagcgaatgccgagaatactcaatttggtcaatgaattgatcaaaattatgccccaaaaaaattcgtccacccacgtttcggtgtgcaccgtcacggctccgctccccacatggaacactgttccccaattctcatcactcagattagtgtgtgggtgccaacttttactcacccaacttccagcttgcgttcaaacagtccctttgcctcatggtaaaaacagttgaccgcgtacgccttgtcccgattagtcacaaacaaacggtggtgcttaattgattattgattcatatgaacacagtccatttaagaatgggtattgaaataagttaattaatgattaatttattacctggacaatcacaatggtactgtagctgagtccgctcacatttctgccgttttccccctcaatggaccgctctcttttcacctaaaattcggttcccttcgatccgttatcagctgtttttattgatctgctgacgtcatatcggtctgctgatttggtcaaattgtgttacgacagaaattggataaaaaaaacttctaatgattattaaaaattgataaaaggaataagaaatgtgttatgatatttaaaaaatggccgagacaacataattttttaaggtttaaatttgccggaaaactggagaattttggcactaaattcgcagtttgagaagcataaataagaaagaagtatttctaattcaaaaaactaaaaaaaaaaaattaaagaaacggccttttttattttctcgggaaacaaactaaaaatgagtttttcttggcacaattttgtcaaaattacggtacatttaaattttcctacgatataaatatatttttcgacagttatttgtggcacgcttgcctggcaatcgcttcgaaacggaatgtgaaaatagaagggctgatcaatgggttgctttgtgtagtccaaatggcagtggtcagtgaagaaaaagcccttcaggtacacgtggccaccaaacggtggcacatttgggcccatttcgggcacaaaatggagacgaattgcattctccaaacattcctttcaaaaaatgcaaagtaaaaattgaaaacatattttaaaaagtaagaaaaatgaattaatattttttttaaaaaaaattcggcacattttaattttaaaacccacgatgcttttactttagactccacgaaaaaaatttttataggggttttcgggggcgctaatcataaagctgatactaattttgacaaatccctaaccaaaactcaaaaaaagtgaaaaactaaaatttatgtgaattttggttgttttttttcaaattgggaaaagcattcggaattaaatatcagaatcttaatcaacgtcatcaaaaccaattatggactaaagtttttgaaaatattgtccccctttggtttttcggggggtggggggcataaagtaaaaagtgtcaaaaacttccatgcctcgctgaaattattgaaatgaatttttcataattcaattttaattttctgtagtccccgccggctcccgngtaaattggacacaaaatggaaattggag

SEQ ID NO: 18189 - DNA, 1289 bp, Heterodera glycines
  misc_feature (22)..(22): n is a, c, g, or t
gttcctagaaatgttttgaatnttctgaaaaaatttaaaaaatttttttgagaccaatgaatgatactgattgcccccttttttaaatatttggataattgagggtcaagcggtgtgctatagttgtaaccgggaaatttttgtttttttttcaaatttattaatatgtgcaatttttttattgcctaatcttgaagactttgacgtcaaagaactgatattttctggttgtggcggctatcattttagataaaattttgaaaaatttttccaccttaatgaaattatttggccatcttttgctactgctgcttcctttgccatcattatttggttttatttgttgcttggatttcgcattcgttgatgctgttaataaattcagagatcggtcttcagtttcattctcatttggaatatattttggttttatatttgtagagtccaacgattttcttccctataatttgttaaattaaaaaattggaaataattataaaaataattgaagatttgactattaaattttccgctcgaaacaatcaaatttctgaattttgttgttctttgtctagaaatattttaaaagcgatttttaaaattatttgaaagattgagggtcaattggtattgacaccgggaaattttgatttttttatatttactttaataatatgtagtttttctctaaaaatactaattttaaacatattaggggtttttgttattctaacgaaaagaattggtattttccgttggttgcggaagtcacttgtgataatttaaaatatttcccaccttaaaaattttatttggccatctgttgctgttgctgctgcttcctttgtcattattttctgttaatgactcttttgttggcactatttgttgcttggatttcgcttttgatggttctgctaataaattccgagaccggtcttcattttcattctcattctgaatataggtagtttcgtttttacgatagtatttatgtgctatttgtaatagttagttttatggctaaaatttttcacttttttcgaaaaagtcaatttaaatatttttgaaaattttttgttcgttttaatcttttgcatctttatattctaatattttttaaatgtgaaaaatttccaaaaattcaccaaaatggtgatttttaattaactctattgccattctgccaaaattttctaatctgatcatttcccgcacctctacaatttattaagcagaagatttacactaaaaatccgtgatcatttaatctatttttatcttattat

SEQ ID NO: 18190 - DNA, 3374 bp, Heterodera glycines
attatggacctcaaaccgatataatcccaaaataaatattttaattttgttgatgatttttttaatttccatttttccttgccttttgctcattgtgcaatttgtccattttttgttttgcctgtttttgtttctgcactgatttgccggatttgctgctgttctcattgaacatcaacaatgtttttcgcacaatgtcaatgccttttggcgatgcggtggtctttgaccgttgcagttggtgattctttttcgcacttaaacccgccattttttgttcattgctaattgactaaatgttctttcatcttttcggcatttagggtgcgaagattcttagggtttgactagtttttctacggctttgtttcgatgagaaaggcacgaaaaaatactttttttcgtccggaaatctcatcttccttttaaagccctattcgtttatagaaaattctatttatttaataattattgcccaccttcctaattttatctttaatcacagttttatcagcgtggtttatttttatgccatttgctgatgtggtcgatgaacgtttcaacaacggcgcttgttgcagttcgccactgcttgctgccgaattggatgaacgacgttcaaagtccaatgaacggcgagccttttttatataaacaaaatttttgagtaaaaatttttttaaaaattatggccgtaaagcactgagtctaactaacaaattatctaaaaattgaggtaaaatttaatatttatattcttatgtattttttaacctccagtttttcgattagtctgtaaaatttcaaaatttcacaaggcttaaaatcatctgacaaaaaaaataaataaattttggaagctaatacagagaataattcgattaataattgttgcatttttttataaggcgaatttaaaaacaactcacaaaccaacgccaagtaaagaaaaacctttatatttttgaatatccttttttactgttttcctttttttaaatcaaataccaatttttcttttttaatttaataatttaatttaaattcaaattgtaatttagttttaaaaccaatacctgaactaacagttcaatttcgcattttttgcgtgctcccgccgcctccaataaagtatcgtcaagtttatcgtcatacgcatttttttcaacattctttttccgtttactcaagaatattttgttcaacccctttttcctgttttcatttttgtattgcgaagaaacacttatttgctgaattatacaatttcgaaaatatttttcacaaaatgacccataacttaatttttctcaatttagaaaattgttatgaggcgaacttatgaaaatccagaattaaaagcccttttattttgttaacattaaaaacccaatataaattttatttaagtgaagtattttttaaatttttatttctattttatttaattatttttattttattttttaatttatgaccagcatacttaaacaatggacatttggacgaaataaattaaaaataaattaactaataaataatttaaataaaaatactaaaaaaaattccattaatttgctgatattattttgaaaattttaatcaaaaataatgaaaattccattaatttgctgatattgttttgaaaatatttgtcataccattgttgatttgaattattttggcgttttgttttagtttttgtgaccctttattttattttgttttgtttggggtatgtgtgatatatgtgctcttcctaaatttgtaattgattgctgtgtgctgttttattaattggaagtaaaagaaagcagtgaaaagagacggcgatttggttttggatttgggatacaattcccctttcccattggactattctttttcctacgacgaaacaaaaacttttattttgctaatttttatgctcctttccggaagcctctctaattacataatttacatgagtaaaacaggaaaatcaagaaaagttttatcatggaaacttttgaatttcaatcttgttagaataatttaggttaaaattgagtggatatccattaaaaaattttcgattcctaacttgattaaaatttaatatgcttttaattagatttttgcaatttatagacaattaaaaacatttgtattttttaaatccttaacctcccgattcaacaccatattaaattataggtcataaattgcttttgaacggatcgtttttggttggatctgaattggaagggtccgatttggacttgatttgtgttgtgtccaacaaaataattgttcaaaatttttatggatcagacgacggaacattatttacaatcctaaaaaaggttagaaatgaaaataataaatagggccgagatttatatgaaaaataaaatataaaaatgctaatatgaaaaacttacttagtgaaattgttaagtgttgtttcaacctaaaaattgactttttgatttaaattacgaaattttattatttttttgaacaaatactttgtaagaaatagaacaggaaaaattttttataacaaataacctaaaattggtatttttgattttaattttcccattttattgtgtattttttgatcgaaattacgcttaagtaagtgcttttttctattaatttaggcctataaaatattttttaattatctaaataataaacattaatttaaatggacagaaattggcaaatgccaaagtcaattgcatttcgggaaggattcagctgcttagaattgagcttgaaagtttcgaaattgatctgtcttttgtgccagtgccagaaaaatatttagaacaaaatgacggcggtgatttatcacgggaaaaaatcattgaggaaattaaatacgaatctggcatttattcgttggcgggtgaacaaaaaataataattttaaatgaaaattcaaaatttaggttatcaatcggcacattttcaactctcaattttgccggacaaaaatgcatttgtgaatttattgaaaatcgtcaaagtttgggcaaaaagtcggttaaatactactaaaattattagttcaatttaaataataattttataaaaaataataatttttatgcgaaatttgataattttttttcagctcgcctcatttattcgggcatttttggttattttaatggcatttcttgttcaattatggcatccaaaatttgtctgctctttccaaatgcgcctttgtcatatttattgtaccaatttttctcgatttactcaaaatggtactaaaattaaaatttgaaatattaaattaaaattgcctaatttagggattgggcgcgtgttccgattatgcttaatgaattaactccaatcacaaagaataaaat

SEQ ID NO: 18191 - DNA, 2325 bp, Heterodera glycines
  misc_feature (1325)..(1325): n is a, c, g, or t
cggagagggtcggggcactgaaaggggcggggataaagggaatggataaagggcgaaaatgccaaaggatttatttggctaatgccctcccttctctccccactcaccgttctgcagtatcccaccacacatttgcgttggtcgcccttcagcaaattgatgcactgttcgtacaccgactcggcccaacttccgttctcgtggcattgtctgctcgctttgtacacttcggccaccttctcacagccgggcacagtcggacaaaaggcgaaagggcacggcctttggccggtggagcccaacgaaacattaaaccaacagagggacctgtcgaagtcgggcggacagaaactaaacgggggaagggaatttggaaagtgaattcgagacaaataataagcattaattaagccaatttgaaagagagacgaaaagcacggaaaaattgacaaaaaacgtaaaattagcaaattattacccctgaaaagcttcgacttcttctggtgtttcgtacgaagtcgtcgccctcagccaaagacaagtcgcattttcccgatttttagtgatggacattttggagaaaaaggtcaaatgaatctgagtttgatcaatgaattgatttgtaaaacaaattgcaaacggaaggaaaggaaactgaagggaagcgaagggaaagaaaggggaggagaaaaaaaagaggggggaaagagtcggcacggcacggaatgccattgccggacaaaggcccacgagcaatggggcgaccgcctaattgggaagtcgggcggcccttttggcgaaacaatgcccaaataaaattggaagatgggatgggccacacattttcctccccctcccccacccattcaatcagcgattgttttgcccttttcggcagcaacaattttcgcgattcgtttggcgtttcgttggtaatgggcaaatgagcaggccaattaattatttaatgcgctgtcagctgaattaatggccaattgaattgcgttgggaaatccatgaaaaaaaaacatcggcaaaaaagaaaaatgacacgcaatggaaggaaaaatcagaagaaaagtcgaaaagggaaagaattgtgaaaaatggggagagatggaaggaaaggaaaaaagggggacaaaaccaaaagtgaaataatttggccataattttggcagggaaaaagagagttgagaatgggaaggaaggaatgactgactcattcattcattgtcagtgcattcggcaaaaaaatggacgggggcaatgagaagggggagagaaaggggggggggggagccttttgggcgggaaaatgaaanttaaggcacaagcaaagcgatggccggggaggcataggcataatcatgccaaaaaagagacgggaatattcattcattcgaccattcactcctatcacggcacacccaacaaaaaaccaattcatctgacgttgccgtccctttcttccgccactgattattggataatgaatgcaaatgccaagggggcgacaaagaaacgaaaggcattttcgcgaaatgtcggccttttttgggaggggcaccaaaaaggacattggtggaggaatgaatgatgggcaaaggcaaggaaaaggcattggaagggcatgacggcgtttggctatttaacgatgtttaaattcttagcttttgatagagtgccagatttgttgcgtataaattacaaataaaaagttaagcgccactgccgaaacgtgggcaaatgggcgaccgacgaatgaatgaatttgtgtcggtcgccaggttcactcggcacacaataaactctctaatggattttacaagcgtaaacagagcgggggaggggagcaattcgcattcgatggcctttttgtgcaataattctctgctcgctgagattgccatgcctccgcaaatgccaataatttttgggcctttgccttttattgaaaagtgccaattttcactcccatttaaattgcttttgtatcacttatttgcataattcaaaagcattttatttaatttataaatgggacagaaatagaaatataaattatcgcccccgccccttgcggcagcaaaattagtcaattcgggggtcctttctttgacgatttattgccgcaattttattagcgggaatttatgggctcattaagttgaaaagaggtgaaatggaggcaacggagagaaaaaagcagaagttgatgaagaatgagtgatggcatttcagcccaaaacaatctcgggcaaaagcactttaacagttggggagggcaaaacacgaaaaagcgggggaaagggggggggagag

SEQ ID NO: 18192 - DNA, 2791 bp, Heterodera glycines
aaaaaatagtaacgcccaaaattttttatggtgcgtcaactttcttacagattagcaaatgctttgaaaaaggtttcctcctcttcaagagcttttgtgattgtcaaaattagttggcagaaaagatcaaaaaattttgaaaatctattttttaagatcatcttttttcttaaaattaacgttaaacaattttaattggataaaaaagaaatactgtgttataaatgcttctgctgaacaccaacgcaagaatgaatacatatatattgcatgcagttttggagaaatttctcaaattttgatttaagcgaagctttttatgctgcacattttcagatgtatggtgtaacatgcgcaatggtattttttgggacgaactcgttttatgtgcatttgtaaaaaagcacatgagtagtaaataaaaataccaaagtaattttgtaacgaaacaaacatatgagcaatcaacgggtgaatgttggccgatgaataagctaactgataagcgtgatcagttttgatggtcataagttgtgatgatgacctttgccttattatggcagtgaatgatgagaaatagcgaggacattgaactgtgagagaagagatggacgaagatgagtgggagaatatgggaacaatttcttcatttgaaagttggagagtgggcagagacacaaagacatggccgaatcagcgacggcagtcagtgcggccgcaaaagatacgcaagggtaaggcagcagagcaatcgttgctcaactgcttcggaaagggccaccgccagcagctggtgggtggtggctgtccccgaagggcttgacacccgcgaacgcacattttggatggttttgtgggcacacttagagagtgagagagagagagcggtggggaagagagagtgagtgaggagaggggaaagagagagagaaagagagaagcacactgttggtatgaaaggagcgatgacggagaaaaatgaggagaaaagggaaaagagacgacgagaaagcgatggaaagagaggatttgcccaagggcaaggcgcaaactgtgcatgatggcgtggagagagaagggaagagcaggttttagagacagaaaagggaggaggaacgtgtggtgcagcaccccttaagctgaaaagctcatcccaaacatcgcaataaaactgcgcctccccccgccttttgtgcctcgggggagagagggagggaaaagtaaaatccagctgtaaatgtagacaaggaatatgatgaataaggggaggaggaggaggatgaagtgtcgaattcggcacaaaaggacgccttccgatgataaggaaagtaatgaagcgagaagagaactcgtcgcaaaggcaaggcaattaaaccaaggggagaacaccaccaaagtgcgaggaagtacaacagaaagacggaaggcaattggagaaaccgaaccaacagcagaatgtgcagggaatcgaattcctcaaattcctacgacccccgccccatttcacccaccgaaaaccgcgtggactgtctgaattgtttatcagcaaccaaacagtgttaagttgtgcactgtatttgcaatggtcgtgtcagccgaaaaagtgtcctcgtgttcaaaacagtgatggctattagaaaattaacctcttacttcctccgggaatttttacatggttgaatttcagtaaaaaagattataattttattgagagaaatacatactgtcaacaagtatctaatgagagagagagaggttgtgagacaaaatcaaaaatgagttcagccaaagtccagaagaaaaatgtgataatgggagattaaaatggcagaaaatagatagacttgaaccagaattataacaacaaataaagaccaaaatgaatttaaaagcaaaacgagcaaacaaaggaatagacgaaatattcatataagttaatgttttgaattatttaaaacaattgcctataacaatacgtagtgactcgaataggtctgttgggttcagtcggtcaaagatcaaattccaattccgccaattactgtcccttctcgacatcgttggcactgtcgaaaatcggcaccaatcgttcacgcatccaaaacattgccaagacgaaagcacttgtgatggccaagaacagaaaagagaggccgaaaattttgaccgttgagaattctttttgctccactttctgacaattggcccggttgggaatgaacaacggattggtgtccccgagcggaggcgaacattcgcgaaagtcacgacgatggcgcaaaacagaagagtcgtgggaatcaagcgacttgaaactcctccggaaattatgcatttcttttggcgagagaagtcgaatgctaaaaaatgtaagtacaaagcaaaatacaaacaaatattatttatattattgtattacaaacctctcggaaggctcgtcatcgtcatcactgccttgctcattgggggcaggagtcgatcttggagtcggttttggactgttctaaaacaacaaaaataaacattccgtaataagggggggggggggaggagggttcgtcttggtggtatcaataagcatcagacgggaaataatgtcagtagaaatattctctaagcccacatataaccaagcctaaccttacggcaaaaaagatggttgggccgcccttttggacacgtatcaaataagggaatgcaaacgagtttttggtaaacattagaaaaatacagcataaaaccgggttctagtcggttttacgcgtcccatgacattttacgcgtcccatca

SEQ ID NO: 18193 - DNA, 786 bp, Heterodera glycines
  misc_feature (7)..(8): n is a, c, g, or t
  misc_feature (16)..(17): n is a, c, g, or t
  misc_feature (29)..(29): n is a, c, g, or t
  misc_feature (703)..(703): n is a, c, g, or t
ttgcatnngcctgcannggtctgaattantttgatttgggccaaagcccaattttgaagtaactttaatttaaattatgtgagtgtacaattaaatattgaatttgtaatacacaaaagaagggaaaataaaacgattaaaaagtccaaataaaattggaaattgattgaataataatgatcagattatcattggacggcccaaaaaaaggatacggtatgagtgattacggtataagtgattagaaattcgatttgggaagaaaaaaaaataatgccatttgatctgggccctgacccaattttggaataattatttttggaaaatcgcccaaaatcgaggagaaaattaaatgtgaaaaaaataaaataaaaatagtgatcagaaatgtgaaaaaatgtaattatttctgattaaaaatgcatgaaaataaattgggtataatgaatgcataaattaacacattttaggccaaagcccatttaaggaagggactttaactcaataggcaaattaaattgaattattagcaatgcgcgcaaactgatcagaaatttttgagggagataatttcaaactgggccataacccaaaataaatcttctaagtgttcgatcaggcacttttctgatcagttttaaattatactgtttttagtgcataaatattaaaaaatgtaaaaacatatttaaaaatattttanatcataaagccgcaaaaatgcataaattaaatgggatgggcaaagggcgctgaagaaatggtggcgtcgcttcgcaggagaaa

SEQ ID NO: 18194 - DNA, 2571 bp, Heterodera glycines
  misc_feature (272)..(272): n is a, c, g, or t
ttcttagcctccggtattcattgtttagggccttggccctttctcggggtttttaaatcgcgtttttcattggaccgccattgagtgcggaatttctttttctctttccatttgccggcatcggcattcttttttttttctttgccggcatcgatattctctttttttcttatttgccggcatcggcattctcttttttttttttttttttattatttgccggcatcggcattcttttcattgccggcttcgaccggaattgatttttcgtntggccagcatacggccaaaattacattttcttatttagaccggcatcagccatcacttttttcttttttttgtgtttgttggccggcatcggccggaatattgagctcagggccaaagccctccccggggtgatcagcaccctttcaattccactccgaaccaaatccttgggcccaggatttggtcagaaccatccggtgctaccagttagagttgtgccggtcccacggatcccctcttgtccatcccgggccgtagcccgcgcgctgagctctccctgggctggagaagggggacgagatcgatggatggggaattgaataggatatagctgatcgtcgcgactcaactgcctgggaaggaattcccgggcttataaggaggggccccgggagtgaacgggaggggcggcccttccctccgattggctgatcccttttacgccttacaaatcttttcgattcgctcatacagacctaaaggaaccggtgctaggtcgatgcgaaaaaactcaatgattgataaattagtgtcaatgaattaaataatacgattaatattttaaatttctatttaaaaagaatgatataaaattcaccattttatataatagcttatattttttaagattcatttttaaccatgtcgaatttgcttgttaggtaaattcatataattattatactcatcaattacatagaagtattttttaaattaatagataaaatgtttacgaaaagaataatattttatttacttcgaggttattcttgtaccaggaagattagaaagaataaatcgtggtttatatgacttgcttaaggcctaattaaaaatctaaaagtatttaattttggacatagtaattaaaaaatggcaaaaaatttggaacgcttcacgaatttgcgtgtcatccttgcgcaggggccatgctaatcttctctgtattgttccaattttagtatatgtccatttggaatgaacgaaagcggcgggagggacatttcttatatatgatggaagaaaattttgagtaaaattagtgatgggttataaaagcagttaggcactttctccctctgctgccttcttttcgtttactctttttctttgtccaatactatctctttgcatctctcatttctttgctttctttctctcatggtctcttccctctttttgccatcctgtgcatcatcatctctaactgctgctgttgttctttctaaggaaaagaaaaagacagcgtgcaaaagagtgcataatattttagccaagtgacagacgagcatgggaaggaaatagcacacgtatcattgggaaaagagacgagtagtcattgggagagagtacccattcatccctttttctgtccatctctccccatctttccaccccgtctccccctcatccttgcatcgttcctttccttggacttgctgccgctctttaaacttacctggctggggagttcctgcgatcaccaaggcagggctcctgtggcgaggctccaccattgcactttcggtcggggctgacccgcagggcggtcccgaactgggataggcccacagctaaatttttgagtgcggggacggcgttcgcgcctcccctttaaaagcattgctctgcttcgttcatttgttgttttgtggctttttcaattctccgagttaaattccataatcatgagttcgaagctcaaaattgtcgcaagtttccataactataaaatgcatttttgatgcaaagtctgttcacaattcaggctaaaaaaacatcaaattccatccttgataggttcttgaacatttatgaaatattagcagttttttgtttagtttatttgcaaattaatgtaaagatttttcacggtgcataaaatgcgaaatttcacacaagagaaaaatgctattttcgagtttgacgtttttgctatttttctgactgaatcgatttaaaaaattgctagaatttgtttcttttttgtccaaaaattctttcgaatccgccatttactgaccgaggggaagcgttgctaatggtttagatttttgcctatttttttccctgagcttctcgtggcctgaaacgcacgaaaaacaagttttgcgttttgcccaaatattaacaaaataatacagccataagaatcgacccaatatttctgaaaaaataatgaatgatctggatcagggatggcacggaattccgagttccaaaatctgttaacaaatcgcattaaaaatcactaaaaatttctctgcggcgcctataggcaccgccgaacccctcccc

SEQ ID NO: 18195 - DNA, 1270 bp, Heterodera glycines
atctctccactcttctctctctatctatctttctctctctctctaagtttcttcctgttttctctcactttctctgcttctctcatctgtctttatcaccagattctctctgcctttctcattttttaaaattctctcccccccccccccaccagtgccatttccctttccattccgttccaattccatgccaatcatgtcacacacacattgacctttctgtcatccgcttcacctcatcctcctcttccaccttgtcatccttcaacacgttcttcccccttcctccccattcttccaccccaattcttccgtttccccctcccccctccgttcccatgctttgcctttgcccccctattacgccaattcagcgcccaattttccgctggatgaattttgtgcagcacacagatgagaaagatggaggaggagggaggcgctggatgaaaggaaaacgaaacgacgacaaatggaagaaatggggcgggggatggcaattaatggccaaaatgaggggggcggggggagacgacggcgctgcgttttgaagaagccgacaaagggcggaaggcggcgggagggaggggagggggaagaatgaacaaaatagggggaagaaattgatggaagaacggagaaagaaaggatgtgatgatcggaatgggaaaacggatgaggaagacggaggaaaatgatgtgattggaagagaaccagcaacagatggggaatgatgatgaggaagaggaaaagcattatgaggaggaaaaggaaaagccttgcttgggcgggcttaataatggcgcccaccgaatttgtacggtgccgggtcggttcgatgccattatcaataactttataaaattgagaccatatctatgtcctgcaaaatttgaaaaatcccaaaagttatggccaaaaaacctcaagaattatccttttcgggactttttcggcgccccgaaagaatttagaatatttcaaaatttggtggcgccgaactgagcccaacccatttgggaatacatgtactggtttctaagaaaaatactactggtctcaaaacatcatcccaaatgtttgtcttattttgaataatttcctgaaaagcataattttgcatttttgaacaagtaaatatttaaatttaaaaagctttataaaaaaaaaattcataaaaattattttcttttttcgcgtttagtttttctaatttgaattatatttaaaagatttacagtatgacagaaaatatttgaacagcaaaaa

SEQ ID NO: 18196 - DNA, 1316 bp, Heterodera glycines
  misc_feature (1282)..(1282): n is a, c, g, or t
  misc_feature (1293)..(1293): n is a, c, g, or t
tttttaagttattttttttttgcaacttgatatattttttaattttacatattagcaatgccattaggcaactgtcaagactctcggggtttaattatgtggaactaatcatttttgtgacaggatcatgcccaagttttttaatgccaggaagatgccaaaaatgcatatgaaatccctggcaccgcaatgccatcgtttgttggcacacctctgactgtggccagcatgaacacgtgctcacgacggtcgaaccgtttgattgccgtgcgcagtgccgtctcgtacactttgtacatggacaaacacttttctaattcgtcggcatttaactgaaatttaaatttttaaatttttaaaattttttaggcctacgggaggtgactcgaacaagcacaggttggcccccttgaagatcagaaatcgccgttcccatctctgtttggcattctcaaagtgtccgtccggcatgcgctcctccacccaactgatgtaactgatctggccaaaaatttactataatataaaatattaaataaataaataattcaattttaactaaatggaataattttttaataaaaatttaaaattaataaaaataattatttttcgaatttatttcagtttacttgttaaaaatattgtattaatgtatttaaatactaaatgaaataaattttttgaaataaattttaaattaataaaaaagattttttataattagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatgtcgaaatattgatttattcccgnaaaacccccanaaatatggatttatatggactaa

SEQ ID NO: 18197 - DNA, 1621 bp, Heterodera glycines
atttggttaaatcccgccctcccctattgttttctttttgggtgaaaaaaaattatggacctaaataaaaaccacaattttagaaaatttctttggattattaaaaatctacccctccccctctgtagacctatgacattttttagtgcgggaaatcaagaaatatgaaattgagcgaaaaatgatttttattactatttttctcgtttttatatcatagaatttctagtaaaaatattttcatttccggtgtaaatcgttttattgtcaattttagacagttcacgccctcagctaagctaagcgctatatttatttttgttgtttaaattgtttaaataaataataatattatgctcgagaaaacaaagaaaagcgattaaaatgtaaagagagccccggccactaaaaaacccagcctaatggtattctcaggtatgcttcgcatcactgcgcggatgcggtgccgtttttttgttatccccaattaaacggtatcaacggaaattatcgattgtgaattacaacaattctaattcacacaattatgaattgaaaaataaataatttaggaaattttttaaattccttctccccttctgttttctgttgtcctacggtaatttatagtgcgggaaataaggagtatgaaagtttttataaagaaaatgctttaacgtggtagatttgctaactaaattatacattaattaaaagtcgaaacgaaggatattatttaaaattaatggaaatgaacgattaaaatcaacatcacatatgtaagaatattgtcctctcacccaaaggaaactgtattggttttattaatcgattaaatcagttgtaattttttagggtgtaaaaattaaaaggaaattctctgaaaagattagaagaaattaaaaaataattgaaaaataaaatgtgaaaaattatgacaatttcgcccataatcttgtaacctgttcaaagaaatcgtatccgaattaatctaaaaatactaaaggatcaaatgaaatttgtcaaagttttattaaaaaatgattagaaaaattacaattttttggaaaatcaaaagatttatcgtctgtattttagcgaaaattatttaaagttaaaaatattgttatatatttagaagtatattaacggaaagggaaagaaaagcaaaatgaataaaagcaaaaatgttgaaaaaaatttgaaatctgaggatggaaaaaaatctattactaattggtaaaaaccacattgaaatttttagtaaaaaaacaaatgaaaaaaacggaaattgaaaaattttttatctccgttttaaatcgggcgaaaaataaaatagagttgcggtaaaaataatatggaaattgaaatgaaaataagaaatgataactaatttaagttacaacaaaaaacaattttcttttgtattcaaacctcaaaattggcgcgttaaatggacctaattatttccacaaatcttggccgtgctaactcagctggcaatttaaatggattgatgactcaaaatgggtatttttttgcatctaaaaacaccacgtgactgggtcaggtgactcttatttcacaataagcatgggactcagcgggcactccgtgcgag

SEQ ID NO: 18198 - DNA, 1475 bp, Heterodera glycines
  misc_feature (72)..(72): n is a, c, g, or t
agtcatatagtgcatttgatctgtgccatgagcagatctcatgcattatacgactttacagtacacccgtgnggacaggtaaaaaataataattaaaaaaattatatgtttttaaggattaaccctatgggattattgtgaaattaaagaattggggagaattaacgttaaaaagtcggataatttttgtaagttaaacaaaataatattttaacaacaaaatttttaggtttattttatgcattaattttgagccagttttaccaactgatcgatacgaaagaagatgtgtcaatttctagggaccaattcaaaaaaataattaaaaatgagaaaagacaaagggaagcagtgaaaaaactaataatcgatgcaaaaatttctatggatgagaaaaattatggtcttaaacatttacaaatagttcaggattattgggtatgtcaaaataaaattatggacgaatacctttagaatatttttaatgaataaatttaggactcaaaatttctggggaaattccggattgttgcattttcaagagatgttggtttgcgaccgatttttaaggggaatggaccccgtaaatataatatttgcgtttttcacgaaaataatcattgggatggtctgtttatatagttttttagcaatcaaaaatattttaaggaataaaaagtatcggccagttttttcctataaaaaataaatattgtataagctgtgaaaaaacctatcaaagagaagaaaaatacagcctggaatgtgaagaaagatgtaaaaaatgctgtcgaataggtaatagttatgaaaaaaatcaaaattgaagaaaaatttaggctttgggttcccgtgccccccggaaagaaaaacattaaattgcgaaaattgtaacaggactttttttaatgagaattgctttgagcatcacaaaaataaaatatgcatactttatcaaaaatgtacgaaatgtcaaggagaatttagaactgacacagaacatagctgcggtaggttttaaacatataaattaaaatatttataataatttagatcaaaaacactgtagaaaatgtcacttaattcatgacccgaaaaaactgtgctttatgcaaaaattgaaaattaaaaaaatggctccatataggattgttgcttatgatttggagtgcacggtaattaaaatgctggtcaataaataatatatttagtttagacgaatacaattttggatgaaaattcacggagaaaagaaacgattcataagccgaattttgttagcgtgagatttacttgttcattatgcgacggagaaacaaaaaattgtgaaatttgtgggaccggaccgcggcatttaaaatggtgtagcaaggatggagttaagccgctaaactgttttattaaatggattattaattttgaaaaatatgatacttatgcatacgcacattttagcggtaagaattaaaaaataa

SEQ ID NO: 18199 - DNA, 1968 bp, Heterodera glycines
  misc_feature (853)..(853): n is a, c, g, or t
  misc_feature (1756)..(1756): n is a, c, g, or t
  misc_feature (1780)..(1780): n is a, c, g, or t
  misc_feature (1788)..(1788): n is a, c, g, or t
cccatggaatttttgattttaattttccgtctaaattagtccgtgatgatgacattccgtgccgatatttcgcacgcgcgggacgaggccaaaatggcacagtgggaaatgcgggtgtacgaattttcgcgccagctcaacaattcgttgattgaggtaattaactgcctagttaattaattgcgggtaattagttaacagtgtaattattcccaattaattaatacacattacgacatttttaaaaatgtgtagttacattaggcgctcgtgttgggcagcgaaattgtcgaccgcgagatggccaaagaggcggaacggacggtcccatactttgtgatgggtacggttttggcaccgtttccccaggcattttgggcctcggacatttctttcgcccgtgcccaaaatcggttaaaaatgtcacattttttaattcgagtcaacaacaatcagcaagaaattaattagctgacagaaaaatgtccggggacaaaatgttgggtaaccaaacgattttggcactgcattttatagacaaattgggaaattagggtccataaaagccccccccctctccaccttttccaccgtggtttttgctttacaaattgtttttttaaagttttttgcggctttttcgggtcttttaagagacaattcctcattttttcaaatggtgacttttttttattattttcaaattttatttttttaaattaattttttccaatattgcttttgttgctgttacaggctttttcttcatgttcggctttgcggtttacacgctgctttgcggcgcgttcatctacggcgtcatggactgggctaaaccactgctcgcccttgngatatcaaaaaatgtttgcctgacatgagcaatttcaattaattaaaaacgagttttaaaattactccattttttgccagcatttgcctttgccccgtgctgtccgtcacttccacctttggcgtctgcacaattgcgggccatcgcacaaactcgttgatgctgataatgccttttttgtgtgtgccttttttagattttttgcattttaatttaaaaattgcccttttttttgcagaatttgtggaattggtgtcaatgatgtgagtttctaaaatttgagttacacggaatttgggatttcatttgggattgacattcggggacccaataatgcttttccccctagggcaaaatcggtgtaaattttcaactaatttcacgacaaatttgcataaaaatatgcaaattttcttaaaaattgtgccaaaatttgattgttttggcccaacaatcgctctttccacccccgaaaatttgtagaaagctgaaaatttttagttttttaactgaaaaaatgccaaagtttacgggaggaagtaatgtttcaattatttattactaaaaaaaattgtgagttttataaatcgtcaacattttccaggcctttctgatggcccattcctggaatcggttggcccatcaaaaattggcagcccccaaacggattggacttgtctttgaagaggtcggcccttccatcaccatcaccacggtgcggactcgttcgactatatttttgatttcgtttattgaaattgaatactttccaaaaataaaacaaaacttttgttcgattatattttttagttgccgtatttcttaaaatagagcgccggagggtttattcaagcccctttagtgggggataaagctgggtggggggagggctcaatttttcanacccctggggctctatttcacggngactctanatttagggggtcggctctattttaggaaatatgctatttaaaatttactcatttttcatttttgcagttgactaacgtggtcaccttcgccatcggcgccttaacaccaaccccgggtttgtcttgtgattgtccgccgaagagaagaaggatgtgcgaggaataattttttgccgggga

SEQ ID NO: 18200 - DNA, 1750 bp, Heterodera glycines
agtaatgaagaactgtttggtgttcataataatattgaaaaaaatatattaattaaaaattagcattatttattaaaataaatcgcttagctaaaaatattatggcattaattaaatctaaatgtaattataaaaaaaaataattaatacaaaaatcggggctaaatatgaaattacaaaatagtttaatatcatttttaaacactaattcgcacggaaaacaaaagcactcaccgcgtcatgaaactaaaagaaaaaattatcaaaaagttggagcgattggctatgattttattaaacctaaagaaatatttaaaacaaatagttgacaaaatatttttcatgttcaataaacttttataatttgaataaataaaaattgatcaaatttataaattcttataaggaaaaaaaagtaaaactcctgtttggaacatgagtgataaaaaaagaacaattattattttataaactgaatacggtaaatgaaaatttagaagaaaatttataaaatgcaaatacaaaatttagtataattaattcaaatcgaaaattttaatttttttattaacaaaggtaaaagaatttcatttcttaaactttaacgtattttcataaatttttgggttgatcttaagagtgtattttattattgcatttttgttaataattttggataaaacgcaaacataggtcatgtcataattaatagggcttctttttttaggcaaatccctaaaatttttgcgcacttaatacgcacagataagcacgaaaaacgcgttttccgctttgtttggggtgtctacgatgacttttataatgcctatttttgcctattttggactttttgtgttaatgcatatttgcctatttttgtgcctatttcgccatttttgcgccttttacaggatttttggaaaaatctttaattaaatgcaataaaaataacaaatacacccctaagaatcgacctgaaaaaattcagaaaatacacccttaagaattgaaaaaaatttcacaaaaattcgtcccaaaaattaaaatttttttttcataaaaatttttggttaaaattttttttttaccgaaaacaacattaaaacaattgaaatataggcaaaataagttgcttgattaattttttcgtgttttctacctaaaaagcgttaataaaattttttttgcctattttagtgcctattcgatgatttttttgcctatttaatgcctattttgcgattttttaatgcctttttaggtgcctatttcgcgattctttgtgcctaaaaaccgcatccctaataattagtgaaacgaattaaattaattatttttttaattaaattaaattcttgaaaagttggcgttccgttggccgcaaatgcccgatttacagcaggccgaaagtgtcagaaatggcctttaagaaaccggccgtaaatgtcgtttttggctgggcccacaaatgtaggaacaccaaaaaaaaaatgaaagaaatctcaaattgtctagcaattttttaaggagggggttggggtgatacttttgaaaatttttcggaattttattttctgttcatcacaggcaaacagttcaccatcctctggctgcgcgagtatgccgagtattttgagttggcacgtcagtacgactttgactacttcgcctccgacaacagcaccgaggacaccgacacggtggaggcggcaccgcggtccgagaccgggctggatgtatgtgccagcat

SEQ ID NO: 18201 - DNA, 2199 bp, Heterodera glycines
  misc_feature (9)..(10): n is a, c, g, or t
acagatttnncaatgaaaaatcattatttttaccaaaaaaatcaattcttaccagtgaatttttactcccgtttttgggtaaaaatttccgggagcaggagcgggatcggagtttcaaatttccgggacgggagtcccgaacgggattcccgtaaaaatcccgctcccgttaaaaatcccgttcaccgaaaaaagcgggagtcgggagcggaactcccgtaaaatcccgcgggagtcccgatcccgccggactctacaaaatagcagagaaatttgaagaatatgaaaggacagaatgccaaaaatatcgcaaatatttggacattttgtacgaatatttgtacagagaatacgtcggaattccaacagtgaagcccaaatttgggtttaaaaatgaaattgaaattgaaggaccaataatttatgcgataaattgcctgaaaagaatttcggatttttattgctggaataaaagtgtaggcaaattagatggtttgttcatttttaattttgaaccaaaattattgaatcatgggcgattaaattatgaattaaaattgaaaaatgaacaaaaaatgccaattaatgaaatgattttacaattacacagcgaataaatgccaaacaaatgaaaatttagacggaataattcgacaaaatttaacaacaatttggaagaaatgcttaaaaaatcggaagaaaggacaaaagatgcttatttttggagtttctataaaataatcagggccaacattttttaaatttgggttcgaaattcaatgattcagatcattgggtgatcttttattaaataaattattattttttttaaataaaatcaaatttaacttgagcacgctttattttcggaatttgtgaagagattatcgacaaattttgagaatttttttaagctaattgaaggaatcgataaatttgaaaacgtgaaaaagcatttggtgcaacaatatgtggaacttcttggcgttgtgtatttgtgcgaaagaattggcaatgttactatattttgaatcaattaaatgcatatgaattggaacaatgccaaaagtatcgcaaatatttgcacattttctactaatatttattccgattatatgccgaaggtttgtttttgagttaacatttcttttttctatttaaatggttttttcgcagattttgccgaaaaataccaaaatttttcattttatgccagttttttaagaaaattagccggcgttgccgatagtcccctccgggaaaaactgagttttttgtacgatttgataacagattttgcaccaaataatgccattaattaataaaaaaaatatttgtataaatttcaaaaaattgtaaaaatttgaatgtttttttctaatgccgatttccaaggacatcttggaaatcggcactctttcaattttccaagaccctatgcccaaatccaaggacgtccttggatgccaaggacgatggcagccctggatttattcaattaatgcttgcttgctaattgattaagctaaaaatggtgaggaatcgaaacaattggcaacggtgaagccaatattttttcacgtaacaacaaaaatttgtttaattgatgttgtcagaaaattgaatgaaatttcaaaatgtttatgggaaaaatatcaaagcaaatctttgaatatcgatgctattcgcaatatcaatttggaaaatgaggaggaattaaattttgaaattaaagaggataaagatgggattaacgaaaatgtacaaaagaggagaaaacaaattaattttgaaaggaccaacggacaacggaaaacttcggaaagaatttgagaaaaaaatggaaaaattatttgaaaatgcaaaaaaaaatgccaaagatgaaaaggcctaaattggaaaaagcaaaagcaaatgcggcaaatgatgaagaaaaagtaaatctagaaaaaagaatttaatcgcaaattttgcatttttaattcgtcgccatttttataaaaattaattttattaaatcctatctcttttgattatctatcaatccttttcatttttctctattaaaatgcttagcgcccggaaaatgtgtcagtggaaaaagtaagtggaaaatgcgtcattaaaatttattgtcacaaaaacagttccttgcgttttagaggtaactctgaccacgatcaggtaacccatttctgc

SEQ ID NO: 18202 - DNA, 1832 bp, Heterodera glycines
  misc_feature (1716)..(1716): n is a, c, g, or t
  misc_feature (1732)..(1732): n is a, c, g, or t
  misc_feature (1757)..(1757): n is a, c, g, or t
taagaaaaaatctttttaagggtttttgaaaaattttcccttgaaattttttcctcggcggagttatgtctcgacggagtttcgcggcgggagttttgtcctgcttcgctatggatggggtcatgcaaaataaaaaataaatgtcttttcaaaaacaattttttctacagattactaataatacgtaattttatgatgttttcctaaaaatgtgagaatcaagcacgggcaggtcttcccccccccctgaaacattttttaagaaaattcaaaaaaattttcatttttttccatcagatgcctttgcgtggatcagcccagcggacattggcaaccgaatttgttgatcgaatcggcggcggcgcttgtgttattgccaatgatccgccgttgccattggcacaggcgtcacccgtaatgccgtggcttcacattgcacacatttctcgggacatcagcgacgcaatggccttcatgcatggcaaagggtttttccaccgtgcgctgaccagcatgctcaactcgtcctcaaattgacacttctatcgccacgtttcaatgcactggttgacaaacatttccattgaattacaaattgaatgccgtaagtttcaagcttttaatcacttgtgtaaattaaattttatttatgatatgcaaaatgaaaatttctgctttatcattttctgtttttttgtttttgttagattatttaacattcaaaaatgttttcaaggggctaatgatgtttttgatattcaatgcataaaattgaccaaagaatcatatatatataaaagcagaaatttttattgctcttttaagtcatcgaaaaattttcagagttcgataaattttaaattataccttgctatatatagaaatagttttttctgtcccaaatctgaggatagaataggtaatgcaatatagcagaggtacgctataagttctttcatagaatacttaagaacaattaaactgccaatttaaaaaatatatattgtgcaaattcttggcgtgcttaattgttctgtccttaagtcacctttttgattcacatttctttatggttcgctgactggcccttcggggcatgtgtcgcaccaaagcggttcgctgactggcccttcggggcatgtgtcgcaccaaagcggttcgctgactggccctttgggcatgtgtcgcaccaaagcggttcgctgactggcccttcggggcatgtgtcgcaccaaagcggttcgctgactggccctttgggcatgtgtcgcaccaaagcggttcgctgactggcccttcggggcatgtgtcgcaccaaagcggttcgctgactggccctttgggcatgtgtcgcaccaaagcggttcgctgactggcccttcggggcatgtgtcgcaccaaagcggttcgctgactggccctttgggcatgtgtcgcaccaaagcggttcgctgactggcccttcggggcatgtgtcgcaccaaagcggttcgctgactggccctttgggcatgtgtcgcaccaaagaggttcgctgactggcccttcggggcatgtgtcgcaccaaatcggttcgctgactggcccttcggggcatatgtcgcaccaaagcggttcgctgactggcccttcggggcatgtgtcgcaccaaagcggttcgctgactggccctttgggcatgtgtcgcacaaagcggttcgctgactggccctttgngcatgtgtcgcactanagcggttcgctgactggccctttgngcatgtgtcgcaccccaagcggtcgctgactggccctttgggcatgtgtcgcaccaaaagaaggtcgctgactgg

SEQ ID NO: 18203 - DNA, 1237 bp, Heterodera glycines
tgatgagcgggtaccaccagcaggaacgattcgggcaacgtacgcaaattcggtcattttgggacgcagaagggacaccgtgtgccatgcgtccgactccgtccgagaatatgaacgtgaagttaggatttggttcgaggaaaaagatgttatcgacgggtattaaaaacaccgttttttacatttttttatttttgtttttatttgcatattttattttggaaagtgtaaaaattttatttttaaaaatataaaattgcccattcatccgttattctaaaaaatagtgattttaactattttagtgacgaactcgccaaaatagtgatttctagtgaacgataatgacattagaatcgaaaatttttaatgaatgcagaaatgcgttttttgagctcctttcttcaaaacaattgagcaaaaaatttagttaaaacctaaaattcacacccctagttattaattgccttggtatgagtcgagggttctagtcggttttatgcgtcccataacagattatgcgtcccatgaatgaccatcctcagtttcttaggccataacttttttcttactcggtcattacctatattcttggtattaaacaaaagcctaaggtctatagaagcttttgcataactttatttttagctaaaggcaacagacaaaaaaattatactcgggaaagttgaatttcgttttttttcattgtaattaaaaagcgcccatataaagtcaggggtgccaaagtgagaatctaaaacggagatgaaacgctaatagtaaaggaggaagcagaagatgcttacgatcaaaaaattgtgttcatgtcttaagaagctttgaatgagttgacgccattaaagttaaggcacttttttataataaatggctaagcgatcacagaaatgagaaatgctgaacaatggcacattcagaaggacattgaaaagaattcaattcattactttgtatttaaattgtcattgtcactgaatgtgccacgaagtcaataacaaaatgatggttgacacaaaaagaaggcaagcatattgtataaacataaaaagttgttctttgctgggatgcgttcacgtcgtcggcatgtcgttgccggaactgtccatctgtggcggttcggctgactgcggtgctgcggccgcgtccgtctgatttttcgattgggccattctcgcatattcgtcacatccactaatttctccaacagccaacagcaccg

SEQ ID NO: 18204 - DNA, 405 bp, Heterodera glycines
cctaaaaataggaatttttgacttcatccccaccccccccccccccgaagccaagggtctggctacgcccttgacttttactggtcccataaaaaagaataaggcggttttttatgattcttcatccactcgggggttattagggccgctgatcatgaatatgacaccaattttttaccaattcctaacccggacccgaattcgaacaataaattgaatgtcaattttgaaatttggatttattttcggaaacggcttaaatgacggaaataaacttaaagcatcattcctgtaataaaaaatcacataccgtattttctttaattaaggccccgggggaattatttttcaacctcttcagaaagggggacataattgaagacagggcctttaatggagacgggg

SEQ ID NO: 18205 - DNA, 3325 bp, Heterodera glycines
  misc_feature (3128)..(3128): n is a, c, g, or t
  misc_feature (3303)..(3303): n is a, c, g, or t
  misc_feature (3309)..(3309): n is a, c, g, or t
ttaaaaatttaagcaattaacgagagaaaaccccttttaattaacatatgtttttataaaataaaataaaaatttaaacaactcaacaaaagagaataatgaaactgacaacaaaaattaaaagaaacagattctttaaaatgtcgtgccattggttgcgtgatgtcgtgaaagatttcccgttaatgagaccaattagtgagtcgcatgaaaaaatgttaagcaatttaaaatttacctaaatattttgttttattaggaaaaaacccgtgaaattggactcatttctttttaatgataaacaaatataaaaacgaacattttaatgaattacaaagatttttgtaaaatttaagcaaaaagcttgcacttttattttatggagtttggatacagattagcaaagaagattttataattggtaattaaaacaaatttatcgaaaaaataaataatatttcattgaagacagattatgagcatgaacattaattaaaatgattaatcttgttttttcataaatcaactaatttcacctgttaatataatctacttaattaatcaattaattcatgccttcctctattccgtttaatttgccaataatttcaggatttgtttgactaattaatggtttggagcaactacatttggctgtggttcgacttgattttggtttgaaattccttttaaaacaaatgagaactccgcttggaatgcctgtcgatattccgtactaaaatataattaaaaaattcaatttaattttcaaaaatgccacctcgtaaaatataaaattggtccgttcgatgcggcgccaatgttcaaaggaattgcggcaattaattgcaggaaccaagcagtgatcggagacgaaattgtcggattgatcagaacggtgtagaacaaatagatacaatagccgccaaaattgacactgacaatgcaaataagtgcccgaaaagcgcgatgattgatctgaccagctgatggcaaacctaatgtgacgaaaatttgatcattagagaatgaatttttgcgggttttaattttttttttaaaatttatttcgtatgcaatatgtaaacgtatccataaaatcgtgaattttaattttattaatgctttttttttgtttttagtcatagatttaattgtttgaataaacttttttagaatttgaatacaatgaaatttttttcctatattttaactaattaattcatatttaaaatttttgtccatataaatcagtccccaattaattagagagcagcacgggattgcggggtcccagtccgaaatcccgcattttttaatagttgcgagtttagtcgcgcaagatcccatcccgcaaaaattttgagtactaatctctgtatttttaggaagttgcgggattttgcggataaatcaccccgggacccggtcccgcaaaatttagggatctgcaaattagaactttccgatcttcactattaattattaataaataaaattctgtaaatttgaaataaaaaattacctgctgttttcttttttatcacaaatccaacaatcaaataaacaacacttgtcattaaaacggtacaaaaccgtatgattttttcataagaatagccctaattagacaaaatatttgaattagcgcgttcagcaattgtcccagtgatcatctgatcaccgtacaatgacatattttggtaaaaaatatagcacaaatttaagccgaccatacaacaaaaaattgttaccatagacaaatagagtcggattttccgtgtgttctgcctgtattctgatttaattaattaattaaaattaatttgctttttaattttcgctatttttccgctatgccgcagccccctataaatggcatgattcaaacaaagaaaagcacgtttctagcataattttaggcactaattaagaatcgggcgccaaaactgcaaaaactctatgattttagctatgaatcatgaaatttttagaggggggggggggtgcggcataacggaaaataccctttttttcttacatttcatcaaaaattattccgatcaatcgatcaatgccagtgaaaaacattgtcgggtaaattccaccttaattttatcaaaataatatatataattttttgatttttgaaattatttgccaagtccaaacgctgagacaaaaatcagttttgtggccaaacgaaattcgatgaaattttggccagaaaatgcggtgtacacaaacaaaaaatgtccttgttggtgaagcaattcaaaaagagagcaaagcgccaacaggtaattaacggtgccgcgaagtgccctaacaaaaaagtaatttaaaatttcaataattattaattaggctgtgaattttagtcacgaaattacgaaaagtcattaaaaacgattaaaaagtcagaaaataatgcaaaaaagttataaaaaattaaaggcactaaaagtcataaaaagcgctaaaaaggcacaaaaaatacagaaaaaatgttctcaaaaaattagcaaaaagtaaccattaagcaaagtataaaatatttttaactcattttaagcacatttaaagtcagtaaaaaaaagttatttgacataaattcacagccctaattactataaataaatttaagaatttccacaatactttgtcctaatggttacataaatgacagaaaaattcaaaatgattccaaacagagcaataattccaacaattgaagcgcatccaatgagtgaccagctgggattttcatttttgaatgtcaaataaaactaaatatttattaaaagtttaaaaatatattgaccatttaccgtattgttaattgttgtgtcagtcattagagccaattatttaatttaataataaatttttttttaaattaaataaaatatgaaaagctgtctctccttttacttctgtcgatgctaataagcagaatgaatgaagcaaagtgaaataatgggctaggcttattttttgtttgttattttttgttttttaccttttaattaaatttttgtcataacgaaaaacacaaattggtacctatttactttatcaaattccggcatgtcacctgcagctacttactaatcaaagataattanattttttggcgagtttattacatatttagcgcattttttcactttagtttttgtcgctttgatttttcattccctttttttgacattttaataccaaaagcacttaattaatctgcccaatttcacatgcccaactaaataaatgaatatggaagaatttttttctttttagggnaaatanactgattttcataaac

SEQ ID NO: 18206 - DNA, 2481 bp, Heterodera glycines
  misc_feature (2253)..(2255): n is a, c, g, or t
  misc_feature (2257)..(2257): n is a, c, g, or t
  misc_feature (2259)..(2261): n is a, c, g, or t
  misc_feature (2263)..(2263): n is a, c, g, or t
cggatgatcaccgccgcagccgcggcggccgctgcagcgggcaccgcttccgggcggcaacggtgtcgcgacggacagtaacaacaacaatggcaccggaagtgccacaacaacaacaacgagggcatggcaaatggaggcggaggaggagcagtgaactttggcaccaccgcgccaacatcgacacctacagtaaacccatcctcaaacaacagcaacagtacaccgtccccgattccaattgcaccataatttgatcaattgatcatttacaataatgcttaattacattgttgttcaaaatatgtttttttaaattgttactgattgtatttatttatatactgtgtgtaatggatgtacagtatatctgatctgttatattgtaagtctatggaggaaacattgatgacatacacacacacacgtaccagcaggggtggaagttcagagacccgagaaaatttgggcggtccgaacccaaaaatgtcggaattccgcgccatcccttacacgtaaatattaaagatgggagccgatatggatttccggtacttttggggtcggcaggcacaccaacaattctctagtttttttgatgcccagaaattccaattcccctgaaaaattttttttttgttttttcgcatttgctttcttccctgatacacaaaatcctattttaatttcatcatcatcatcattatcgtcgtcgtcatttaaatttatttttgccttcatttgatgcgcttttctcttccctttgcgcaccaccgccacatttttgtatttatttgtcatcatatggttgtcatactgtatcatcgtcacattcatttcatattcacttttgtgtttcctttccaaatccgtcgtcacagcagaaaaagttcaaccacacacagccaaaaacaacaaaaagcaattaattaattaattaattacctactaattatgcatgcaattcattcacttattaatttctctcttctccccaattttttcgattaaaaattgctcctatttttctccaatcacttttaatcaaatgttcaattattaatttttcattaaatttgctgcaattccaaagcatatgtttacctttaaaagtttacttttaccattttaaagtacgaattaaaaatgtgcccttttcaaatgttaattaattaattgtgcaaagtcaaaacaagatacatatttttaattatggttatactttttttaaaatcaacattgggaaggataaaagtgtttagggtcttgtattttggagtcccactcgggttggatcccgtgcctcggttgaggaatccagaatttcgtgcatatggatgtcaaaattatttgaaaagggatattaaattaacttgtgttgtcgtgcatatagcgcagtcggtagcgctgtccttgcaagtaaattacatagaagttcgaatccgctcgaacgcacgcaaatgtttttaaattttttccatcgcattttcttgtacttattttaaacatttaagtttttctttataaaattatatttatttttatggaaattccttccagcattgacaaaattgaaatttaattgacaccgcaccgggtgtgaactttcataaccccacctttaatcaaagacgtacggttgactccgtcactgacaaatgagccattgacccttaaaattttaacaggaaaaattgtacaagaaacaattaattaaatacaatttttttttttcgttacactattaaatatcattgaaaagggatattaaattagcttaatctgtcgtgcaaaatagcgcagtcggtagcgctttagcagtcaattaaatatatgaaagttcgagtccgcgcgaacgcacggctaattttttaaaattttttccatcgcattttcttgtacttattttaaacatttaagttttactttataaaataatatttaaattccttccagcattggcaaaatttaaatttaaattgaaagattttttattggtccctaagaatttgatgggtttccgtgtgaaatttttcaataaattggcaaaatttggaaacttttttggaaatttaaacaaacaattttcttaacaaattgcattaaaattattttaaaagaatttcatgggagcttaacggcatcatcggaccctttgcttatcatttttttttgaaaacttgcccccaaaaaggcagaaatagtcgtttaaaaaatgtttttgactactgacgacacattggttcaaaaccnnngncnnngncccgcacacgcgcccaatataataatccatctccaattatgaataaaatgaatgctctattttaactgcccttcaaaaaatataataatccatctccaattatgaataaaaatgatttttgagccaaaatctgggatcaggatcatttgaaactcgggaattacacatccgggagcggggtttcttcgaacaaaaatcattaaaaaattggaccaaaa

SEQ ID NO: 18207 - DNA, 3572 bp, Heterodera glycines
  misc_feature (40)..(40): n is a, c, g, or t
  misc_feature (65)..(65): n is a, c, g, or t
atttatcaagatttgataggctgcggactgagctaaaatntaaaaaaattgactcaattatcgtntacagacaaaatccagtacttttaaagttttgcctacatctcaaatttaattttgtttaataaattaataaaagggcatacaacagaaagcataatttttttttgtgagtgtggctcagattgtggtgatatatatagccaaaatagtggtgcctaaattcatccctttgctcacctctttttaaactatcaagtgttggaacaaaaatctgttaacagatcttctaatagaattaaatctattttaataaaaaaaagttgcatcgtaattttaaatttccgtgccctatattcgaattttcaaattttagacagccattttttctattttgcatttgaaaattcggtgtgtccacaatatgtgacggagaaattttggaagccatttcgagcgttaactgtgccggttgtgttgcaccgctctgttctcgaaggtgaaggggcactgaattgtgcaaatttttaaaaaaagctaaaatctaatgataaaacaaaaattgtcctcgaaattattaagtaagtaattgaacaaagtctaatatttaaaaaatttatctaataattataattaaaatatataaatattcttaaaacttattttcttaatagaataaaaattgcctattaattatgacaattaaaaaaatattttttttgaaaaaattttctttatttttgctttaggccttgatgtccccccaaatgctttcatcgcagccgatgactttgacacagtggaagaattggctgattacttaacgaaacttcgaaatgacaccgaacgatatttaaagtaaaaatgaaaatttataaaaatgctaattacctaatttaaaagccaaatttttagattttttgaatggacaaaaacttaccaaaagaatcatttcgccattatgcattcgccgttttgcaaattgtgtgaattcgcccaccgacagtatgacgaagacctgaaaagtacggtggattttagcaaacattggacgacgagagactgtataaaaggatttgtgcagaaatttttaatcgaaaagaaacgataaaatgttttttttaataaattttattttaattttctctaaatcaaaatcatttaatcagtacacatatggtaattgacaaaaaaatgttcaaaacataggaaaatttcgcaatgagcgcaccggattaaaacaacattggcacattcattcttttggcattgatgtggctgcttttttgcatcaaaacaatatttaactgggtgcgtaaaaattgggaaggagtcattcccataaaatccagcttttcgccatgcgaaatttatccaagcattaaaccggcttgcttggagctggttgtgtatcagtgattgcaatttaatgatattgtcccgagtgtgcaaatttaaatcaatttcacaaacaataacaaattgagtgactttccttgtaaattctttccacatactaaatttaaactttttatctgcattttcatcaaatgcgagatcttcaacgatttcaatttcttcttcatttttaaggcatcgttcaatgattgaaataaaattattagccatttcaatctcgacaggcgaaatagttgaatcattaaaattattcgaaaaatgtttttgaagtaaagaaataatattttggggattaacttgcattataattaaattatctaaatatgtaattttattaaaaacaataaaaaaaatgtttgcgtaggggggactcgaactttccattacaaaaatgaaatcgtgacacacaaccaccctgccaaccggtcgcttgttgcttctccttttaaatttaatataatataattattaaatatttaaagcctcatatctcggcacagaagcttattccgcagctagaaaaaaaatttggcaatacaacccaggggtggtctacccacctacaaagtttcatttggaagttccaccataacccgaacactctcctttgttagggacctcaaatttcataaagtttgaacaacaagtatcaaatcggatatttgaggttaatagtaataaatggacaaaaattgcctctttttggtggcccctaatttggaaaataataaattttaatttttaggcgaagagccaaaaaaagccttaggattttgcgcccacctttgattttttcctttctgaatagggcctggccttgggaagtgataactgacttttatttgaaccattttatcgcgaggaatagccatagctaatcatttcagaaaatggcaaatgcaatgaatgcggaggaacggagaagacccggaaaattaggagcgattgggcaacagtttgatgaaaaacccagttccggaagcagttttttcccgtaatttaaaataaacccacgcctctcaatggtgtgaatttgagaatatgacaccgcaatgatgacaattttgaaaaaaaggatttagcggagcaatgagggggaggagagagtattattggcccacttttgccgtgggccgacgccgttcccccgcccctaatgacaaacacttgggcgacgtccaaacataacacaatcaacacataaaatacaattcattttgttcctccgcccgcccttttttcgttccaaatccgggggaataaagacgggggaagggcacaaaatgtgggacgatggccctccaaatttgtgtgctatatggcggcggccgtccctgctcccaccaccgcttttgctgctgatgagatgagcccccccccccccccccccccgctccattctcattgggctttttctctgtcacgggagaaaggggcactcattcactcttcacaccgcccccaaaaaagtgatgagccggccaccatttttagctccttttttcttgaaagccaaagggcggaggagaagaaaattttggcaattaaatgccaaagtgcttttgcattagagaaaagggagtgagacaattagtgaaagtttgagaaaaggcacaaaatgccctacttattttactgttgttgttgtttttggatttagaaaatttgtggctttttaaaaataaatatttgacttcaaatagccaatacgcttggcgcgttacgccgtcgaattaaattaagcgatttttctattctttggacaaacaaagtgtgacgaaagtgactataatcgtgatgaaatgtcattagaaaagggcttactattgggtgacattcgtcacttttgtatctcacgcccaatgacggaaactcagtttataaatgacacatatagcaccagcgaaagggagagaaaagttcgtgaatcaccaatgaatgtgtgaatgtggtgctaagaagcgatcacttatccgtacaaagagttggaggaggagagaattaatgcagaaaaattggaaggcaaaagttactattaaaagggagcgaaacgagcgaaagccaacactttggccacaaagtaggaataatttctcaccttgttcctttacaaagtataaatattgagtgaaaagatcaaagagacacgcctg

SEQ ID NO: 18208 - DNA, 1264 bp, Heterodera glycines
  misc_feature (1184)..(1184): n is a, c, g, or t
gggtcatggcatttttaaaagggtacgacaaaacgcgttagtaccccattttcttttcccccacggctctttcacctgaaatccgacatgaattgtctgctccaacgtcctctgaatgtaaacgcgcaatgtccgctgttcgggtgccaattccgcgcggcatttggcgccgttgtcgctgtagccggagggcaattgggtgattagcatcatcaaagtgcgcagcgagtacagacaggcggtgatgaacagcgtacgacggatgaccaacacgcggtgtttgtgcaggacgaaaaggaaaatcagcgacgcggaggaaagactgacctggcaaaaaaggggagggataattaattttaaataaattaaaataattatcaattaaattcaattataaaatcaacaaatggattaaaacaatttataagcattaaataataatgaaaataataaaataatcaacaaagcaaaaattggacagaattaaaataatacaaaaataaatctaaattaaaaaataaataattaaaataaataattaaataattataaaataaatttattttaaaaataattaaaattaattaccaattaaaattaattgtaaaagcaataaatggcaatggtcgaatggaaataaataaaataagtcaaacaaaacttaaactggtgaattaataaaaaaaaaataaaattttattaattagattcattaatatgtaattaaatagtttaaaataaatctgaaatgtcagtcagatttaaattgaattcaaattttaattgctttgccaaccataaaatcgcccacggggtgtgcccacggctgttcatcaatgaaagtgaacacaatgtccggaagaggtgatctgaaaacattcaaagctttttgagaagcaaatgccaaaggatcattcggcccatttaattagtttaaaaaagccgcgatcgataatctcggaaaaattccctcaaaaagaggacaaatttccccgcttaaaaagtaataattttgtggttatttaattgatgaaattggaataatcgagcaaaaactaaccgaccgatgaagtcatgcacataggaaagagctgcccaattggagagagcagcaacgacgagaaaaaggaggacgaaagagagtttccgaggttcaagcggaatatttgtctgttggaccatgngaaagggaggaggagagagaagaagaggaagaagaagcagctgaacggacggacggataaagccaaagatcggacaaatg

SEQ ID NO: 18209 - DNA, 1742 bp, Heterodera glycines
  misc_feature (1678)..(1678): n is a, c, g, or t
tcctgcttttcaagtttttccctcccctcccctctcgatcatccattccattcaatatcattatcatcccgtttcctcgatcagcgtttttggtcgacaacgcgggcgttacactgccctccagcgtcaagtgcaagctgactaatgacccggatggaggggggggggggggtggaggggaagggatggcttttcgtttggtcagtattttgctgtgctcatattagcctggtgagatcaacgctgaacaagcctctgatcagtgttgatcaattctcttggtcacttttcctccatttctctgctcactctgtcccccgttgacttgggaatgctttcggctttctttcgccgtttcgcctccactggtccaactccaactttgcttctgctgctcgtctccgtctttttcctctgctttttccgtgttttaattgctgaaaaaggtcacattttacccaatgaaaaatgcctgtataatttctgagcattggccaaaatgaaaatgatgatcaaggcaatggcaatggaagggacggcacaattcgccggagaagcacaggggaggagcagcaacagacgacgggggacgaagcattggacaccgcaccggttaagagggggggggggggaggaggcgaaggggacacggcacggagtcagaggccgacgattattttgatcattaaaatgggcccaattaatcttaatctagggggttctttgcttaaattgtattgtccgttggtcactttgcccaattatcggagcaattcaaatgatcatcccaacattttgtttatacgctggtctcacattatgggtcaagcttaattttagacaaaatgactcaaaagccaatttacgaaatttgcgcaattttgcgtgttaattcaaaattaatactgattggtgcttttttttgtagagatagtacgccaaagtgagagaaattacaacgaaaaagaaacgatgagataatactaagcttttctctgcacagtggagttgaccaatttgccaacccattagcccataataaattttgtgatcaattatttttttaatcaaaatctgatcttttgaaattccctccccattcgattaaactctgatgaaacttcataatcaaatttcgctttttagcctgatgtggcggtcccgcaattttcgtcggaagaggacggacaaacgaaaatttcggacgaatttttgcgccaactcagcgcccagcaggtggccgaccgccgggcgcgcctccaccggggcggcaacaatttgcggaggcccgtcgattttgaagaggcgctcaaaatgacagtgccataccaaacgaagaaaaaactgtgacgacagattcggacggtgtttgatcagtttattattactcgtgcaaaaaggacaaaagacacgcgagggaacaatgagtgatctgtccgattcaacgaaattgggaaaaaagtgaatggacggagtgattcgaattgaaaaagagggggaaagatcgggccaagcgatcggatattggggaaaagtacaaaagcggggagaaatcggacgggaatttagagtgatcagaattgacactgattgagtcaagtgattggaacaaattaaattaggatgggctaagtaattaaggaatagggggtaatttgttcaaaagtaaataatttgncctggtgattagaattaagctctataagatggtaaaaaagaacgggccattggttggaatagaa

SEQ ID NO: 18210 - DNA, 2215 bp, Heterodera glycines
ttcggtgagtcaaccaattaattaattagctaattactgttttgattagccaacggatgaccgatactaaacagcatcataatctctctccgtttaaaggtgcgcgaccgtcgcacaggtcgctgcgtgtgctgcgtggacaacgaccggttggcacgccttggcgaactgctcaacaccgagttccattccgtcgtattcgcccatccgatcgaattcgatgttcacgaacgcgagttgaaactgctggtgtggcgccgattcacgcaaatgttggtgaccatgtgggcggacagagaacggaatgagcagcagcaaagggaggagaagcaatgagcagaagcggagcaaatggcccataattaatattggttaatgaccaaattaataaatgacaaaggaccgatcagtcgcccccgcccctattccccgacctattagcatttaattgtccatttcaatccccgacatattattattatttgcatatacattatttatagaataataatttaatatatatagaattggttctttttctcaaattcccaccttgtgctggtttggtcgtccgtgtgcgtggctctgatcaggacaaggttcagtccggccaatgccatcatcaaatcctcccggctggccggtgatccgttctgatgttcaaagttttgctgcacaaaagccgcatttattaatgatgcgtttgcattgtggttaattgcctcgtaagtgttgacggaaatggtaaagggctgtcccggcacgaactgcgcctgttggtcggtcggtttgtgcacgagtgttaccccattgcccttaatggacgcaattaacgcattgatcgatcggcactgatcgacgtatggcttgctgcctacttggatcacgacaagcggctcttcccgaatttgggcttgcccatcgtattgcaactgaacagtgaaatcgcccccgtaggcggtcacctgcaattaattagttgtttacattgataggctcaaaattatttactttattcccgaggaaacgtttcggcaatttccaatagagcgtttgtgaaaagtgcggctccgtgtgcgtcagatagccgtacttttcgaattcgaactgaacaccgggctgagtctgtccctgcacatttgacagttcaacgccttgtgcatcgtcggcgaagaagagcttttgctgaagagagtaattaagcaaaaacaattaatttattatttaattaattaatggttttaaaaaaactgaaaaatgttatcagcaaaatgaggaaaaagcaaacaaaagtgattcgggtgaatttgtgaagtgattaatggatgaaagaggtgaaggaaagcgactcatttaacaataagcatttaggcagcactaattggaaatcgctaatttaattgttttttttattttaaaacataatttaaaataattataaaaccaaaaatgttaaaaaagtgagaaaggcggagggaaatggccaaaaaccaaacaaaaagtaaacttattccgattagcaagcaacttacacaagcaatgtcctgaaaaggaagaagcgaaagcgttaaataagcccaaaagttaaatgaactaaaaataaacgaaagaaaaacgaaaagaaaattgggaaagaaataaaattgtaattaattaactaaagaaaagcttttgaggaaattcaaaatgttttttttggggggggggggggaattataaattgtaattgtccacctttgtgcggaacaatccgctcgaatagcattggtcggtgacaccgaaacagaaacacttcagacacccctggggggcgcggtcgctcaaatggtaagcgcccggcacacattgggcacatgtcgggccggaagtaagcggctgaaagccgtgggaattttcaatcaaaatcaattatggaaatttaattattgcgaatgcatttttggaattttcccacggcatactttgcattggcattgcccccgcgcgtcgctgtacgggctgtacgcgccctgtgaattgcaagccaatcgttgtggctctggcggtggtggcggcggaggttggggcgtctgcggcgcgggaatggacacaatgcgcacgatgcagtcgggagtggccaacacgcggcccttgacattgatgggctcgcaggtgtacgcgccttggcccattggtctgatgggcgggggagcaattagggtaattaaggcaataa

SEQ ID NO: 18211 - DNA, 2997 bp, Heterodera glycines
  misc_feature (13)..(13): n is a, c, g, or t
  misc_feature (30)..(30): n is a, c, g, or t
  misc_feature (34)..(34): n is a, c, g, or t
tggaattcaatcnccatttgacacatgacnaatntaatcagctccatgccccgacgtatcgaatcagttattaaatcgcgaggtggaccgacgaaatattgagttatatgaaattatattttgtgttgttaaacatatgaccagtgctttttgaggataaaaaattttgagatcaaatattatttgctacagaaaacggaatgtgatcatttatatatctttggatagcccattaaatggtgtatcaaaaacataaaaaaaggaaatcgatatttgttttatctaagcatttttgcaaacatttattttaaaattctttcattttattggtgttgttaaacatatgaccatgactgtatattaaagtcaagaaatatttaaaaaaattacaatcacattttaattcaaaaagttaatatagtaaatttctaatttttaaatgaaataaaaataagaaaatttaataatttttgatttaatgtttcaaaattttaaataattcaacaaaaattccgatatttgaggatttatgctttttatggcccattaggaattttggtgttttttttttttgggttttcactcaaaaatgactagaattttgtttctggtccaaaatttgttaacaaatcactttgaaattcaaattttgactcggcggcgtttttcggcaccgttcgctcgtcaattatttatttttacaaatattttggtttctataaataaattcaaaaatttcgacttttttgcaatttatgtataacttttttttagaaattatctaatcgcgaagcaatatttaaaaagaaacttctaaacatttccgttatgccgccccccccccccataaaagatgatcccgacaaaggaaagcacttttctagagtattttcaggccataaccaagaatctagcgtcaaaactacaaaaggctattctcattatcctataattttcatcatatgatttgatttgtgatttttctctttaaaatacggaaagttgaaaagcatcatgcggcttgaatgttgaaattttccgagacttgaccgaaagctgaggccatggcctcaaaaataaaccgagaaattaaattcgtctttagaatagagaattgaacccgaaaacatttactgccccccgctccaaaaaacaaataaatggttaaaaaagaataatttactgttctattttttaaatatatagtttcggattttggcacgaaacactaaattttagggggttgagaggaaaatatttttggaaaattggaagaaaatgaaacattttttagaaataataaattgatcatttcttttaaattaaattttttttcttttcaaaatatagccggaaatcaaaaaaaaatttctaggtgcaaaatcgtaaaattgtaacaaaatttccgaaattccggatgagctatcggcacctccggccctccctcacccaaaaaaatttgggaaaatagtgcggcaagaaaaattgaaaataaaccaaaatttcaaaataagttgatttcgagtatttttttttgattgaattaaatcttgagaatgattcaaaaatgttaaaatttttcatacatttaaaaaatttcgtgtttcgtttgtaagtctcggtcttcagaaattcctagtttatggagtctcgattctcggcggccagataaataaatattttattcggaaagaatcaccaaaatttatgagcaaaaatgagcaccaaaaatgatcagtcaatttgtccattcactaaactccaaaacagccgatcatttctcatggagaataattggtattaatgtagtttgggtccacattttcggttaaattttttaaaatttttttggtttagtcttgaaaacaagtatatactcggtgtcgctgaccacgaatccggaatccatttcgaccaatttgggatgccggacccgaattcgaacaaaaaatcgaaaattcaaattttcgagtttttagtttttaggttgataggcctaaatgcattaaaatgaacttaaatgtcacataaagtgctaaaaaagattttttagacaattttttgggctaaatgtgcaagattcgaaaaatttgaattttcgactttttgttcgaattcaagatcccgaattggtaatagtggtcagcgacctcgaaaatccacgtgtgcttgttttccggacttttaaaccaaaaaaaatttaaaaaattttaccaaaactgtggacccaaactacattagtaccgaataattcacttccgcactgttcgacgcccttttccgtcgccgctttggtccgcctctaatggggacaatggcctaaattaagtgcagttttaattcgataaaaaaactttggcaatagcaaatcaaattgaaaacattttgagttttcaataaaaatggtaatctgctgaggaaaaggccatctttttttgaaaaaatattcaattttttaatgaaagaaaccgagtttttttttgttaaaactctggttcgcgttttaaatgggaaaaaagaatgtcgaaacctttgtcagaccctgaaaatgccaaagtctattctttctcgaaaattttagaaaaaaatttttttccttcaaaaattgaaccaaaattggtgggagatttataaaaaaaacttgtaaatttatacaatattgttttttttaattcttttctgtctttttttactaaactcttttttctcacccaatgcgtttttcgtcgccacttaaattaatgatgactctgttcaaattgcttgaatttccgtcctcccactgaaccgccgtcgtctccccaattgggcatcgcttcagcagccaataaggacaatctaaaggggcagctcatttcctctcccgtcattttacccaccccgaattaaaaaaaagtaaactcggaattttattaaaaaaaatgagaaaattttttataaaaattttaaaaaaatgaactttactagctttttttcaaaagaatctgacgaattacc

SEQ ID NO: 18212 - DNA, 1399 bp, Heterodera glycines
  misc_feature (421)..(421): n is a, c, g, or t
  misc_feature (1350)..(1350): n is a, c, g, or t
  misc_feature (1364)..(1364): n is a, c, g, or t
tttattgtaaaagggctcttgtgtttttgtatttggcttttaattttaatgccattcccttttttcttttttgcaattgtccctttgttcgctgcaggcggacgtgccctcctgctccaccgccgccggcatcagtgacgaggcggaccgggacgagctgctctatcggccgggctatttgtgtgccgagacggaggtcaaatacgtgaagatggcgcgcgctttccgcaccttttccctggatcaccaccaaacgcatcacaacgctggagaaagcgacacgacaggcgatttgtgctgacgacgcattactacgctgcatccgtggagacgcattgtggaggaaaacattgtgatggattaacagatgcaagggtgaacgtgaggagagacatacaaatgacttcatttccggcacagncaatgggcaacgacgagcatctgacctcggatagctctttcatgtcggccgacgatgtgaagaagttcgggaagggcatcaaaacgtacgggaaagcctttaacaaaatcaaccgggatttgcttccgcaccaccggcgcgagcaattggtggccttttattatttgtggaagaaaagccgagacgcaactcggccgaagccgctgagcaatgcgatgaagcgcaaccaagctgcactgatcgctgcgggcactgcggcggcacgtcgcatcaaaaatggaaatggcgacaacggaacggtcgcgacgggagccgcggcgacgacgccggacggtgtgactggggcagcaaattgtggaggaacaattacaggaggggcgacgtggcggtcggaaatgagcaacggcggattggacggcatcgaaaggtgcggagagagacatggcaattggaaaatatttgagttatgaggagcattcagtttaaatgccatctcgctggatgatctcatggattatgaaagtgcctcagaaattgaagccgaacaaatggaaagtgccgaacgcatgccgagccgtgcttgccaccattgttttggcataagtgcgtcattcttcgttttattcaatcggctaaatatttttctaacagctattttaattgcgcttccttcagagagcaaagattggcatcatgtgggacacgagaggctgctgatgtgcactgattgccggcttttctacaagaaatacggacaattgaggccggtggatcgaccggtaaaatttgaaaaagaacggttcggcctttaggggtgccgttttaaatatcccagttatcatgccttcaaaatcgactgcctttttagcgcactgtgcctccctgtctcctgtcgaatacgccggcccgtacgaccaccaccagcccanacggtgacgacganaacgaggaaccgtcggcacaaacattgcccgtcaa

SEQ ID NO: 18213 - DNA, 1533 bp, Heterodera glycines
  misc_feature (222)..(222): n is a, c, g, or t
  misc_feature (232)..(232): n is a, c, g, or t
  misc_feature (287)..(287): n is a, c, g, or t
cagcagcaacaacagcaatcgttgctgaacggacagcacccgaacccagtgggggcagggcgcagtaatggccaaatgcagcagcaacaacaacaaccacatgctgggcacgtgttaatggcataagtgcgcggcagtcggcggcgcaaccatcaacccagcaacaaccggtgagagaagaaagaaagaccgaatgtgataaggtttttgttttcagcaccnagccaaaggnaacaactgcaccccgcagcaacagaaccatccagcagatgctgcaacaacaacanccagtcacagcaacagaacgcggcggtggccgcactgatgggccaattgttcggggcggcgacattccaacagcagcagcagcaacaggtggggaaaggggggggatagcccatttatcttgtaattaatcctcattaggcggctatatttgccctccagcaacgtgcggctgctccgcccgctgttcagcaacaacaggcacctccaccagcccatcccccgtcggcactgccgtcaaacactgctcagcacattggcaccgcacaaaacggaccgaacgtggctcaacaacagcagcaggcgatgatgcttttggagatggccgcagcggcggcaatgaacccgcagcaattgatggcactgatggccgggagcggactcgatgcgaggatacttgacgaattaagaggtcgagcgggaaacgaaacatattacacacaaattcaatttgacgcttaaggacatctgctaaaccagcagcagcaacaacagctgacagcgaatgctgctgcagcacagcaccaacaacagcagcaagcattggcagcacagcagcagcaagctgtacatcagcagcagcagcaaatgttggcaatgttagcaacttcaggtgctttgacgcctgaacatctacaaatggctgtcattggccaacaacagcaggtgacataatcaaactaaaacacggcacagtgtgtaaaatggacattcatttcacagaattctgctcctgcgcttcatatgccgtcaacttcgtcgtcggtacagcagcagcagcagcaccaaatgcaacagcaaatgcagcagcaaatggcactggccgcaattcagcaacaacagcaagcaatggcaacgcagcagcaataccaccaccacaaccatcagcagcagcaacagtttgtacagatccagcaacagatggaaatgctgcgaaggatgcagcaacaccaccaagaacaacagcagcagcaacggtgacacggcgggaggacaaacgccgtgccgacgacgacggccaaccaccgttgtgtttgttgtgtgccgctgtgctccgcaactccccattgccttcccttccctttgattttgcattctgatcactgattgatctccgctgatcgcctgtcagtccgtcccgtgcacttccccccccccctccgctcatcagatttttcattttcatccttttgtttgctgattgttgttactataatgaaaaactgagaaccatatactggtattttg

SEQ ID NO: 18214 - DNA, 2461 bp, Heterodera glycines
  misc_feature (2449)..(2449): n is a, c, g, or t
cgccgtcatcactttcttttcgcttctttctcatcgtcctctttttatcttctcaaaatggaattgtccactcataaacttttgttgcttcctccgtccctttctctcctcgtcgttttctttttccccaattgaccttttccacgccaattcaaattccgcttttccaaaatcgtaaaattcgcgttccatccgataaactttatgctgcttgaatttgcgcaatgtttcaatggttggcggaaacttccgaagagtgtgccgcaaagattttctgtcctcttaaaaatttaatgtttaattgcgctaatgaggcagagaatccgggaataataaataattgtcgtcctgagacaccttacttttctatgtctcaaaatcataaaacatttttggcattttttgtcgaaatttaagtagatttttattggccataattttcaatagagagcgtgtacgggcccgggcccgtatacggatttttacgggcccgtaacccgtatttttttcggctgatacgggtttttacgggttaagggtttttagcccgtaacccgtatcgatgtcaaacccgtaacccttatccgtacaattacgatacgggttttacgggttattttattgggttgtttaataaatgaatagaaagtggaagaggaagagaaagggaagagtttttaagtggtcatattaaaagttagagtttaatgaaaaaattaattgaattccatgccaaaaaatccattgccatcttataaaggtttttggcgcgtagcgccctctagagacagtgtttaatagcgaagctatttcaattttaaaaataaatttaaatcagttactttcagtgcccgtaggaaaaaataattcacatttaaccataaattttcgtatcttacaaattaacggaataattaacaatggaattggtccaacaaatattatgagggaatatgtaaaaaaagacaccatttagcaagcggaaatgttcgccggcgccaaggaaaaaggcgggcaaaagttgctccagcaaaaggacggtctcttcgatgcgttccgtcagcccaaccaacagaaaatggtccagcaaattgcgctttgccaactgaagggcctgcgcattgccgggaatgcttaaaaagggaagaaaagtgaggaaatcagaaaaaaagaagtcgtaaagcctaccaattaaacaattagttagtgagtgacaaataatggaaaagggggggggggtaaattccgtattttgggtgaaaaagcccaaagttcagcatttttcaataatgtaaaaaataaaaatcaaattttgtgccttgtaaaaacctaattgctcattttttgagaaaacccattagaaaattttgcttttggacaatacggcgataatttcgaaaatagaaaggatttagggccggagaaaaagcctaattttgtgaatttattaaaaattgttctagttttagtgggtggattcattcaatggcggccaaatggttgggttttctttgacctgcagaaatgggcagtgccgcaaaagtacggaatttgtagccaaattgcgcttgggtcgcactctctgccgccgcgccgaaagcattcgtcaaaagtctaagtgaacccttcaaaatttggccaattcaactcactaaatgttcacaatttacctcgttgttccccgctttgcttctgcgaagtccgacccgaaaattgtcgccgtagcgaagaaaataaaaataagagacaaagcgatcgaagggctcgcgaagcaaattaatccaaatgggagggggaaggccgaatctgaaaataatgaggaatgcagaaaatatggggaaaatgtattaatgagaagggacccaaaggcgaggacggacagaggcaatttgcataaattagtgattttggacattggccgacctctcaaaatcaaagaaagcgaagtgtccgtggaggaaaagcggatgcatccgttgccaatttgtgaggttttggaccagccgcgcctggtcaattgcgttcatttggtaacggtttttcgtcaagttcaaatgggcgacatggaaaccattgacagtactcaaatcgtaggcaattgcatttacaaatgttgtcgaacccgttttgggtatctgaacagaaaggaaaagcgaaacataacgaaatttagaaatttaaatcctctggtaaatccaaaataacaaaatacaagcgtttaactgtttttaatgttttaacgcttgaaaaacttactctgttgtaaaaaaggagaagcggtcgaagagaaagtccattcggacctttgttttgtggggaaagaaaaaaccaaaggaaaacccaggcaaaaaggaaaaatatggcgacgaataacgcatttttgcgtagaattttcatgtgtgagcgaacattcaacaaatcattccgtgacttttatattcaaaaaaanattttttttaaa

SEQ ID NO: 18215 - DNA, 1134 bp, Heterodera glycines
tttatggaaaatttttgaaaaatttgaaaaaaaaaatttttttttttaattcttgaaatttcttattgcgttaaatggttaaatgaggcccaaatttgagcacggtacattattgattgtatattactgccacattagattctgttttttattttattttttcacgcaggtatttgttagagctgtccacgctccattacattgcggtgtatcgccacttgcccagcagattagctgctgccgcatttgtgatcgccgcggcatgccgcccgacgacggtgccaacgacgacgaccacgaccaatacgcctttgggcgaaacggcggctcaacagaaacaaaatgtgccaccaccgtcggtggctgaggtgcgtgtgctgtatgtgtgccgtgccatatgtactagggatggcacggaatattccgattcagaaatttttttaggccatggatttatgattttaagaaaaattttagggcctcggaaacgccaaatcctctgcatgtgcacaaattttttatgcctatagcacaaaaaaaaaattctaaccagataagggaattcttggaatatttttttgctaatcgttccgatttttgcgctatttaaaaataaataaattttttcttttttttttactcatttattttaagaggccttcccccccccccccctccaaaaaatggtatttgatgggttgtgctgtcaaaaatgaccccttttatttccaaatactggcacataaatatttattttggaataaatttttaaaatgaaaacattttaatttttctgacctcctccccccccccttctttttccctcaagcaaaagcgtaaaaatggggacgaaaatgcgaccgaattggcaccaccatcagcatcattttcatcatcggcaacagcagaggaacaacaaaaggagaaggaggggccgtttaagacatgggagccaatggagcagaaaacgcaaattttgcgcaaggaactgactgagcctggtgggtaccaatttaaaattgacaatttttattcttatttaatacggcattttttaaattaaagcgcactcccttaaataatgcatgctcctttttgaaggggttgaaaaattgcggactgcgctggaaaaat

SEQ ID NO: 18216 - DNA, 1968 bp, Heterodera glycines
  misc_feature (22)..(22): n is a, c, g, or t
tttatgaaagaaaattaatttntgttttaatattttcagatagtcgccggagacacactaaaaaaaagttttttaatgaatcttattgtaaaaaattgtagaaaatttttcattttgaaaaaattagtaatttaccaaaatttaaaaaattcagacgtaatgaaccgacggagataaaattgaaatggcaaaatttcaaaaaaaaaaaattaattcaatgtttcagtcaaaacgctgctcaaaatccatcggcaagcatgcgcgtccgcgccggacaccaagctgaaggcggtgcgcaagaagttcagtgacgcgcgccatgaccgcgtggcgcgcatggaattgccgagcgcattcgctagtcaaattgtgtgattgaatgactgattaattgactgatcgatttaaaaaaatcaaacttttaaagaacgcattccatttttgtttttcattcaaaatctcatctcaattttcttgtatccatccatccgactgacttacacaacatataatttattaattgtcgagaagcgcccgagagtagttgatttgattggccttctttcaggcgcccgtaaccaagaaaatgggtcgcatttttttttaaaatttgaaaaaccaaatttatttacaaattgcgtgaaattttgcaaaaaaccaaaattcccataaattttgcaaaaatataaatgaaacttttaaaaaaaagtgaaattttcgcccatggcgccgcgccaaaatttttgttaaaattacacacaaaaaaattttcggagctgaaggacaacaaaaaattttctggttgcgggtccgccttctcccgccgatatatattttttctattgtacaagaaataagtgtatttttgcttgcctctccatctctctctatgttttccgttcgttttgcccatttattgtttttcatcaattcacctgcttttccattctctatcctatgaatccatgcatcagcccccgcccccctacagaaattacaaaataatgacgtttggatgactcactcctcagcaaagaattaaaataaataccgtattttaaaaaatttatgaagaaaaaatagagaaaatttgggttggccccacacagaaaacggtgcggaagtgcccgtaaggaaacagtgttcccaaagattttcaccgtgctggccttgttggtcaataaaaaaaatttgtgatttcaaagaatttttcgataatttattttctcaaaatttagctttgtaaattctaaaaataaaaaaatggaaaaaattgtgctatctcggatttattcttcaaaaaaagcatgaaatgaatgaatggcttttgagaaaagaaaagcacacgcgcataaaacaatttcaattaatgaaacaaaggcgtcaaatgtgtaaaaaaacaataaaaataaattgtgaaagcaattaggcgataataatgaattgattgatcagtttagttgctttgcaccatcattgattagtcttaaaaaatcacatcatatttcattcaaacatctttcttttttggttcatcacccatcgattaattaattaattgcaattcattgcatctgacggccctccacaaacgcttgctttggcacaatgacgtcactctgaccggcggtgcccgaacgggagcgcattccctgccgaacaacacctgcagcacaagacacaaaagttaaaaaaaagtgtcaacattatgtcaggcaaaaaaaataaaataaataataacgaaaaaaataccgtcacttgagagaagaattggaccttacgtgtgaaaaatcggtggtaatactagtttgccccccccccatttttcgaaaatttttttttgttttcaaaagtcatgaaaaatgttttaggaggctttcggggtcgttgattacgaatccggcatccattttggccaattccaaatcccggacccgaacaagaagtcgaaaattcaaattttcgaat

SEQ ID NO: 18217 - DNA, 1479 bp, Heterodera glycines
tgcaggtcaaaaaatgggtagtgggctcaaatattacattgttttgtgcctccctccgatgattttgccctctcctttgaatccgatcgtctcaatttacattatacgccattatcgcaaattgtttgtttatcagaggcgtcaagcgatgcggtaaaattttttagaaatgacggcatttttcttagttatccttgattaattagaccaattcatcctgctgtcctcaaatacaaaatatgcttttataaataaggtgagaaattttatttttccttttttgaataaatttttaatgccttttttaaattccaaaaagcgttgaaatcgaaaagctttttaatcgtaaaaatagataataaatatttaaacaattaattaccagaattctttattaaaatgcatgaaactttttgtttagttttatggatttcaaaataagaagtaccagtggcggttttctagtgccaccggtagtggtgttaacctggtaaaatttgcattggtaagaatgggaattcgagcataaattattcatgaaaatttggaaatggtgaaggaatattttcataaaggtcggacatttacgccaattttaaaacaattcttttctttttttaattgtttattcttaggaaagcaatgggcgtgtggtggcacaacaaaagtatatattgccactacaatttttgacaaattagcgtaagaatttcaaaaaaatatacagtaaaacaaattacacatttttctttgccaaaaatattatatttgatgattgatttatttgtataagcaaataaaacttaaaaaatggtataaatctgaaacaaaaaaaaaatacagtagaaagtgtacataagcaatccaaatgctcatctccaatgttttttcgaatttctaaattaaaaaatttttattatacttaattaaaccgtcttaaatttaaatttctgcaatttttcttaatttacttgtgaattggttgaatttataatggttccataattgattaatttctgtgttagctaatatccattatttaattataacgccgaaaattttgtcgttttagctccatttagtaatagattttggcaaaaaatgccaaattttgaggatttttggtcaaattttcgaataatttaagaaagagtggtccttagccgagacagacgccgccataaaatttgctaaaaaaaaaatttgaagaaaatgaccgagcctttctaaaaatttctataattataaaaaaacataaaaattaagtaacaatttaaacgatttgccttttgcctattggcgtttcgttgcgtttgaccaatcattaagcattagccaatttgggccccgccccgttccttttttttgtgtcccccgccctggccaacattcttctgttcgggagagggattggcttagccaatcccccaatctctctcccctctcccgctaatatcccgagaccgaactgggagtccc

SEQ ID NO: 18218 - DNA, 1196 bp, Heterodera glycines
aattaatgtaaaaaataaatccatgacttataaggccccattatatatacagtggcgaacaccagccatattatgaccgaacaactgatggttgaatgggtggacaaagttctttgtcctgctcttcgcccaaaccaaaaatcgcttttgatcgttgacagttggactgggtggaacaattttcatccaaaaaatggaattgaataaatttagaatttggaaagaatttaccagaaaaattacgcagtttgttttgtttatgacataaatatcaatctccacgaccgcgacaacattataaaattacattcattaatacacaatcagctccaagcaaaaaatttaacaattggcttaattttgcatggcgcaaatcagggttttatggtgatgagcctttcccagaattcattcacccagtaaaatattgttttgaagtgcccaaacacaatgacgaatgccaaaaattaaattgtgacaataacattttgctccgttgtgctttttgtgaaatttttttatgctttaaacatttttttaatgattatcatttatgtgaaaacgaataaatttaaaaataatctaaatgggaatcaattttcctcggccaaataatttgcataaagtgcaaaaataaatgggaaaaaatatttacataatgaaaggtcagaaaattgaaattggaaaaataagggtaataaaagtgtgaaattcccacccgggaaacattcttttggcaatcgacagtttttcaaaatggattatggcaaaggctatttccgatcagaaggcagagactattgcaaattcatttgtcgagatggtgatgatccaaatttggaacaggaggaggcagaagaaagtgaagaagaaggattcgagattgtcttgagtaaagagaaagaaatgagtggggaaatgattggcaaaagatgagggtcccgaaattttctttgaaaacagaaattttgtgttcgaaaatgacgagacaccaactttgttggcagttatattgaacggtaaaatggttacggtgtgtacagggtggttaaatcccaccataattccccttacttcatcggtccctgagaaccaagtagaagaaaattgggaaatttatagtaatgaagacggtgagagatatgtgacgtgttggatttttggagagaattttgaaatgtacattagcagtatta

SEQ ID NO: 18219 - DNA, 2551 bp, Heterodera glycines
tcattggtgccaaagacaaatggcaagctgcggttgtcctttgactacaaagtcacggtaaatccttggttggatatacataaataccaacttccacgccccgaggagctgttcagcatcttgaatggaggcgaaaaattcacgaaaatcgatttgaaggacgcatatttacaacttttgcttgacgaaaaagccaaaagttgtctcacaatttgcacgcacaaaggacttttccacttcgctcgattgccattcggagttgcttcggcacccgcaatttttcagctagtaatggaagaagttctgcagggcattgatggcgtggcagtttatctggatgatattctgatcacagcagccactgatcagcaacatgtcaaaagaatcgaccaggttcttaaacggttgtcagagaacggacttcgagtcaagcgtgaaaaatgtgaattcctcaaaccggaaatcgaatatttgggacacattgtggacaaaaaaggtcttcatgcgtcacctggcaaaatcgaggcaattttgaaaatgccgaagccgaaaaatctgaaagaattgcagtcatttctgggaatggtgaactactatggaaaatttgtgccatccctggcaacgctttcagaaccgctcaatgaattaaggcgaaatgacgccaaatggacatggacaaagagccaacaaaaggcattcgatgggatcaaaaaggttttgacatcaaccgaagttttggtccattatgacccgcaaaaaccactttttctggccgctgacgcatccgactatggagttggagcggtcatttttcacatagatgaaaaaggaaaagttggtgattgcgtatgcctcccgaacgctaaattcttcggagcgcaattactcgcagattgaaaaagaagcgagggcaatcatttttggagtcgacaaattcaagcagtacttgtacggtcgaaagttcgtacttcaaaccgaccacgagccactaaaaaagatttttgggccaaaaggagagctcccgattgtggcggcaaaacgacttcatcgatggtcactgacattgatgaacttcgactttgcagttgtgtactgctctacaaagaatttggcaatgcagacggtctgtcgcgattgccgtgtccggaagagacaaccatcgactgtgttggactggaacttcagcaagttcaggccgaaaatatttcatgcttgccggtcacagtcagtgccatcgcaaaataagtcaaaacggatgaaattcttcgaaaagtgaaagaattcatcgaaaaaggatggccacaaaaagtcgaagaaggactaaaaagttttcatgtcctccgaaatgagttcgccttaatggaagggtgcatcatgtttggaaatcggacaattaaccggaaagaccgtggaaacgaatacacatcgatttctgcggaccattttggggataaatgtggctgatcatcatggatgccaaaagcaaatggcctgaagtggtcagaatgcgaacaacaacggcattggccacgattgaggcgctaagggttgtcttcacagcgcatagacttcccgagcaaattgtatccgataacggaccgcaatttagttcaaaagaattcggtgattattgccaatcacggggaattgtccacacattgatcgcgccatataatccaaaatcgaatggagccgctgagagatttgttcaaaccttcaagcaaggcatgaacaagctcaaaaaggaggagatgaagcaagaaattgcattgtctcaatttctcctgaagtaccgtatcacgccgcacgcagcaacggaattggcaccttcagaaattctcttcggccgcaggcttcgaaccttgttggatttggttaaaccaacagcggcgaatgaagttgaagcggccaaaatgcaaaaaagttcctacacggaacgaatgaaaaggaatttcgaccgtgagacaaatgcgcgaaaaaatttcaaggtgaaccaaagagtttacgcgagaaattatcgcgacggatcaaaatggatccaaggacaaatcacccgacaaattggcacggcaatgttcctcgttcgaacggcgagaggaatttggaagagacactttgatcagttgaaagaaaatggaccgaagagccttcggacaattctggttccgaaagtgcggacaattcgtattcggaagacgaagtgccgatcgaagcgatggacgacgaacagcagcttccaccgccggaggaacagcaacaaccggagcagccacaacagcaggccaacgctgaacctagacgttcaacgcgcaagcgcaagaagacacagatcttcgacccctcggcctgatcacggcttcaagaaggagggacgaatgtggtgttgaaagaccaatcaataagtggagtgaactttgttcactcctttcccttaggcacataccccctcacatataagcgctgccttccctccctccctcgttcattctgtcatttattcctcccattgcaattcccttcgccttgaccattttattattttatttgtgct

SEQ ID NO: 18220 - DNA, 2326 bp, Heterodera glycines
  misc_feature (51)..(53): n is a, c, g, or t
  misc_feature (55)..(55): n is a, c, g, or t
  misc_feature (57)..(57): n is a, c, g, or t
  misc_feature (63)..(64): n is a, c, g, or t
  misc_feature (66)..(67): n is a, c, g, or t
  misc_feature (70)..(70): n is a, c, g, or t
  misc_feature (75)..(75): n is a, c, g, or t
  misc_feature (79)..(79): n is a, c, g, or t
  misc_feature (105)..(105): n is a, c, g, or t
  misc_feature (108)..(110): n is a, c, g, or t
  misc_feature (113)..(115): n is a, c, g, or t
  misc_feature (118)..(119): n is a, c, g, or t
  misc_feature (122)..(124): n is a, c, g, or t
  misc_feature (137)..(139): n is a, c, g, or t
  misc_feature (141)..(141): n is a, c, g, or t
  misc_feature (144)..(144): n is a, c, g, or t
  misc_feature (151)..(151): n is a, c, g, or t
  misc_feature (153)..(153): n is a, c, g, or t
  misc_feature (156)..(156): n is a, c, g, or t
  misc_feature (164)..(164): n is a, c, g, or t
  misc_feature (178)..(178): n is a, c, g, or t
  misc_feature (180)..(180): n is a, c, g, or t
  misc_feature (186)..(186): n is a, c, g, or t
  misc_feature (197)..(197): n is a, c, g, or t
  misc_feature (208)..(208): n is a, c, g, or t
  misc_feature (218)..(219): n is a, c, g, or t
  misc_feature (221)..(221): n is a, c, g, or t
  misc_feature (226)..(227): n is a, c, g, or t
  misc_feature (230)..(236): n is a, c, g, or t
  misc_feature (240)..(244): n is a, c, g, or t
  misc_feature (248)..(248): n is a, c, g, or t
cagcagaagttcatcagggtaggcacaaaaaaaatgccttttaaagagaannngngncggaanngnnggnaaggngggnacctcttggaggaagaaaacacaaanaannnaannnaannggnnncagaagaagacannncnccnccaagcnangangaacgaanccaagacaaggggncncaaaangaaaaacaaanaccaaacgaanaaaaaagcannanacaannaannnnnnncacnnnnnaaancggaataaaagaatcgcaaaacgggatatggtatcatagttaaattgtttgagaaagaatttatgcttgtttggcaatgtttttttatataaagcaaattggtaattaaaataagaaatgggcaaactgttagaaagtcgtgatccccaagtatcgtaaaaataattggagttttttaaaatgatggtccgtttaaagaggaaactatttattatcaagatttattaattgattaagacaattaaatcttacataaaccgtttaattctttaaagaaataatgatatttgtgaaagtcattttcattttatcttcttttgatctttcgtcatcatatttcacaaaacattgaattgttgagtggcgacaattagcgcatggaccgcacaaagaatgcctaattagcaaaaaaattatttatcaataaaaacttattaattcaccaatcattttcaaataacaatgcacagcattgctggcgcgaacaccatttcctatgaattatatatataaattttgttaaaccagggtgcgcatttgtccttgggtgccaaggacgtccttagattagggcctcgccgattggaaaatttaaaactttttcaaagatgtccttggaaactagtattcgaaaaaaacattcaaaattttacaaattttttgaaatattttatcaaaaatgatcagcagaaaaaaaaattgaaaaaaaattcattccggcaaaaaacgcaaatcttttgaataaaaattaatcatttctcattacatatgatatgagttttgcgcgtccatggattttataaattttccccttatgtccttgggaattagttagtatacccgtccttgtaagccaagtttttccaatgcgaaccctgtgttaaaacaaataattaggtaatctaattgcaccctcattaatggttgattgagccaattccaccaatgttgcagttgtcttaggcttcgttggctcctccgtggtaactgtcgtggttgtggtggtagtggtcgtggtcgtcgtcgtttcctccatggtcagagttgtcagggtcggagtggtcattacagtcgggatttcaattgtgagattttcattagagaagtcaatgtccttctcagcaaaaagacacaggcatttgtccttaaaattgttaattcgaggctaaatatatttgaatcaaagcaatttctatttaatagaaaggcgaacaccttcgattaaatgaatttaaatgaactaattaagatattttattagaaatttagaaattcctgaaaaaaaccttttttttttgttttgaaatgaaaactaaactaataatttcaagaaaccaaaactgaaatgaagatacgaaaattttaaaacctaaaagtgaacgaattttttacggtgaaaaacgaaaacactgccgaaaaagaagggacaaaacgaaaacgacagttttgtttagctcttacccgaagccatgggttcgagtcaatggcgagttaacatttaatccctaatatttactgtcaaaattaatgcttttaaaattttattgggttgtttatttaagaaaaccctcactcatacatcgtctcttttggcactgacaaaatcacaattgccggcaacggtagaacatccccacttttgaaaaaatttcctgcttagcagctagctatcttttgatgctgaccaaaaaagtcttttattcaaacttgaatagatcacttcatggtggtcagaacacctcaaaaaagactgaaaaacagaaattcttgaaagaaaaattcatagggagttgggaaatttttttggaaaaaaatgaataagcaagcaaaagagcataaaattctctacaatatgttcaagaccgaaaatctctacgatttataatcgctgagatatgggcactcagtttcggtgtcaataaaatattaaaatatgaccatgactatgctttacgtattttattttttaaatttccattcactgtcgtaatgtccactgtccaattgtccacttctgtccaaatgaccttcactgtcctaatgtccactgtcgaaatgtccactgtccaaatgtccgg

SEQ ID NO: 18221 - DNA, 812 bp, Heterodera glycines
attggatttttttgtttaatttccacaaattttttcacatattccaatttcagagcatcggtgtaacagtttctttgtcctaaaaaatttaattatttttgtataaaattaaaattcatttttagtataataataaaaaaataataattaatgctttttcatatttttttacttttaactaagaaatttttcaataaaaaattttgaactttccttgacaaaatcatataattttaaattgattaaaaatttacgtctgattaagccgaattttcttttccatttataaaatgtaatgaatttaacgccaactttttctgctattttttcattaattttcaaatttggtttcaaattgaattttaaagtaaattctgctttcactttttcaaattgttttattttttcaattttctgttgggttgaaaatattttctctctaccttagaataagtaaaattcatttatgccattcgtttcttaccaaattccctcttccatttgtaaattatatcccgattaatttctaaatctttagcaattcttctttcaattacatttattattttcttgtcatatttaaatccataaattttttcttttctcatttgatcaaattttccgatcaattcgctttttgtgtccttatttatgtccatatattcgttgtaattccgggtttgtcctaattttttcttcaatttataaattttgtagcgattagtgcccaatttttttgcaatttcaccttcaaatttattaataggcattgttttataattgtaccgtaattcccttttcatcaaattaaa

SEQ ID NO: 18222 - DNA, 1256 bp, Heterodera glycines
  misc_feature (9)..(9): n is a, c, g, or t
aaaattttntcgtcaaatttcaataatcttaccttttataataaacgcttttaatatagaaaaaattaaacgatttttccttttttgttatttcgaaaaagaaaattaatttctgtgacaggattttgaaaaattttaggcagaaacagtgacttaaataaaatgaaaaaaattgattaaagggagcattttttatttaattataaatataaaaattatttttataaaaaataatcatcttacaagaaatagtctttaaaaataatccggatcaaaattacggaaaaatcccaaaaatccgtaatccatcatccgtaacccaaaaaccccgtaatttccgtaatccgtgattacaagctcctggtgccaatacgagttgggtttcgtccttttttatctgtgtattaccttattattgtaatcctcatcatctgcagaattgctatgatcaatagaagaaacattctgatcagcttgctcatcaaactcattcctaaattgttcttcgttcaattgtttcatttcaatttttggcacttttatttttaaattatcattttgttcctccaatatttcaagggcagacaacatttgttccaaaatcatgttaaatccgaacggcgcactggttacaaaaaaagaaatggacccttgttcacagcttttacagagtattggcaattttttgtgtaccaaaacatcggatttttccattaacgttggcaattctgtcctttttgcgtgcaaaatttgctctttgcaagtccaaagagttttttctctgatcagcttgtacaggaatatagcgatattatgacaggggaggtatccgtccttgaaaggacgtcaaacgtttaaattttaccagttaatattttatttgatccgtgcctttcttgaggggcagacaaccaatgtcgttttaaaaaataattttccaaaaatttcttgtgtgattttatattatgtatgaatttctcatttaaaaggcatattaattcctaaattagttttattttcaattccattaccaatatattcgagtctacacaatgttgcttaatcaatattctttatttgtgtattaatttgttcttttagttttactggaaaacttttattttcttagattaaaatttaatcgaattaatcactaattttataaatagaatttcattaatttattttcacatgttattttcccagtttagctcgcctttcattggaccatttttattttgaattttcgattttat

SEQ ID NO: 18223 - DNA, 984 bp, Heterodera glycines
tattattaataaaatggatatggaagtaaattaataatatatttcatagaaatgaatatataataaaaatagcatttaaatagcaaataaaattattttttatgggatggttttttataaaagttaattaattcgtcaggaaatcgaaaagttgaaaaagttatgctcttctgtgatgagccggcatttaatgtgaataaatgaacgatttatttgcttgtaaaggtcatttgttctcagccaatagatggaaaacggatatgcaaatgggcagaaaaataataataatgacctccaaaatcaaggagaaatcggcaaacaatcaataaaaagaagcaacggaagactttcaaatgccaaatttgggggtccaaaatcccatttaaaaaaatgttttacaattagattataaataaatgaatttaattttatgggatttaattaatattttttgtttgcttaaacaataaattctttaaaggccaactaaagtgagtaaaaccgacaatgctgatcagaaattgaattataaaaaaggataaaatggaaagaaaataattttaatcattcaaataaataaatgtttttaaaatttttcattaattttcaaggttttacattcgactcattattcttaaaccacagatcgttcgtcaattccccaaatactcatgaagcacgggaaaaatccaactcgtagcagaaattgagtgagtaaaaataaaataaatcatgaatgaaaattggataggaaaatgatgactcaattaatttcttacttttcacgtttacaagcaaataaacgtttaaaaaatgaattttaaaactccactggctcggatagataaaactatctcattagccataaaacttgaccaaaacactaattaatttataaacaaaattgtgcaaaataaagcattgtaaatcatttgtatgaattccgttttaaatgaaatcaagctatttaaaagacaatgtcac

SEQ ID NO: 18224 - DNA, 1359 bp, Heterodera glycines
accgcaagaaaagctgggaccggaccaaccaggaattttcgaagaaaaattttttttgaaaaaatccaaaaattttcattaaaatgcatagattaatgataatttagacacttttaaatatttctctatgtaaatgattgagtatttttttaattaatggtatttttctattgttttaataattgaaatatcttaaatttttgaaaatataaaaaaatttttgttcagttggggaattgaacccaatcgaaaaagaataaaaggcagaaggtttagtcaacagaccacatttgaatttgagttatccaaaaataatgttctttgattttaagacattaaggaagcagagaaagagatttatgatgtttttttgcgtaaatttgaatatttttatgactgctcaaaagttcaatctttaggggtgttttttcacctctcgtaccaaaaaacgagaggtgggagtacccaaaatggcgagagttggcgagagacgagagttgtcccacccctgtgtgggtcttttaggaaaatgccgtggtgagccgaagtgacaaaagtataaatgtggcgaagtgacaaaagtatcaatgtggataagaagccaatggtttcgagagcagtgctgcgtgagggggaaaagctagttatcacacagtcccaacataacccggaatgtaaagcagaaacaatggtaataataaaagctgaacaagtagatagaaaacaaaaaaaaagaaaatcttcaagtgtaatacggatgttaagacaatctggagacaaggtcttgaaaaagttagggaagaagatgctacaagcacaaggatcagaagcagcagacccctttgatgtgccgccaagactccagctaacaaagtttggcgctataaagctcataatgggaaaaacaattgctggaagtgaatggatgatttataaaaataaacaaattggtgttactattcgcttccaaaactcaattggaagcagcaaaaaactgtcggaaatgtcgccgacgcgacattcgaactcacaccaaaaggtttcagacagatttggctcatccatggcttggtatatatttattatttaaacgaataaatcggttgttttttattcagtatgcgacaaataacggggctgaatgggttgttttcgcttttgtctttgatgaaaataaaagaccaactttcatacgaaacaattttaaatgagcttcacagccattggggcagtgaaacagttgaaataatcgagaaaattcatctcgatttatttattacattatattgtgctctttgattgggtcattgactaccgccatcacatcctggtcataatttggcgttccagcgattatca

SEQ ID NO: 18225 - DNA, 1503 bp, Heterodera glycines
ttgaggttccggtcgtagttggattggttgcatatttcttgaaattttttaggtgaattctcaacaaaaaaaatagctcaaaaatcatttgcgctcaaagggtggcgccgaaaaattttacggcgcccaaataatctctcgcgctgaaaagcggcggagacgcgcggcgcgcccggcccaacattttccatcggccaattgcgcgcggcgtcgcgcgatttttcgcaaatgttccgcgcgacagccggacggacagagtgatccggctccaatatttactcaccgcaccgcagattttcccacccatttgagagccattaaagggcccccgggggacggataaatagggaaataaaatgctcagtccggtggccaattggtctgccccacccctctcagcagaccgtcgtcgtcatcattcggtcaacacttttctcatactcttttcctgttcctttttttctttttccttttccttttcctttctctcttttcccttacatttttcctttttctctttttctcccttctctccttttctctttttctcttttccccctttttctttgtcctttctccctttcccttacatttttccttttcaacttttctttttccctttttttcttttcctttttgtcctcccccttttcctttttctttctctcttttccctaaccttttttctttttcttcctttccccttctctttttgctatttttttcttttccttctcacacctttttctcctttttcccgtttttcctttttctttttctccttttcacccatttctcttcctttttccatccgttttcctttccaattttatttttctttttaaccaaggatgtgacggaatgccgacttcgattgcccgattgccgagattaaattaagatacgaaaaatttcgtcatgcttccaagtgtacttatttttatttgcactgattttaacgatccgaatttagaaattaaaatttgatccaaaattaatatttttggtgaaaatctgtttacaaatctcgcaactaaactttcaaaattttccctggcggtttgacaccgccggcaaaaaaaaaagtcaaatttcactatgaaaaagttgaaaaaattacatttaaattagattattcaattatttaatctttactcttactcttccccatccatctgatcagcacagatcacctctgctgatcttttaatgtatacgttgtgtccctgatcaactttttgatcacttcccttacaccccttccccgccgccaccatctctgatcactagagacgattttccctttaagagagagaggctcttctactgttagttggttgctgttgcaactgatcacgatttttttatgtgtttgcacaacccccccccccccccccccaattccaattccttatgaggtaaaatgcgggggggggggatgaaatggttggacgaggagtgaatgacgactgatctggaattggaattgtgggggcggggggg

SEQ ID NO: 18226 - DNA, 1780 bp, Heterodera glycines
cgttggcattgtgccaacttttttttctgtaaaaagttttagcggcgttcaattgccatccaccaaatccaaaagctttgctgttgctgcacctgctccatcccatcccacccattctttgtcgctttgttttgtgtgtgtgtccattcaaatcggtcggcgcggctttttgctgttttacgccgactctttctttgtcttctccatcaccacccacccacacaatccgatccgttttatgttaattatgcaaaatcacttttaaccccccggggcaggggggcaaagtccgtccctttttctgccccggggggatgacgacggaggtgctgtcctcctcctcctcctcctctgccgttatattcactgctccaccggtgcccaccactttatctgaccctgtcatcttttgtgtgtttgtcccccgtttccccgttatgacttttctttgtcgtcgcccggggcaaaggcaaatgcaaatggattacatataattacactccgctgaatgccccccgggcgggcaagcggccgctaagcgcccggagggctaaccgatcggacacagcggcggaaagagaggagttggcgaagcgatcagataaatagatgtaaattgtgctctcgggcgacgcggaggacgggagtgggataaaatgggcgattattgcccccgggggacagagggcaccaccgcctccatgaagtccgaagatggactgcgacttgctattactcgtcgaatcgaaggacggtagaaacgagggttgagcagtttacgacatcgatgatgatcgacggcatgggctaaaaacacgacagcagcagggacgagggacgggggtggtactgaatttaacggggcagaatggggtggagttgggcgcggtacggattttattcacacgacggaatgggtatggcaacaagagcttggcattttgaaaaaagtctgggcctggcctggattccatattggacctgctggttcattacaaaaacccaggaatatccaggtccaggaaaaatccaggcttgacgagacctggatcaaggcctggacctggattttttaaatttgtttaaactaaattacaacgtctaaaatcaaccttaattgttaaaatacttttaaaatctatcatttatcaatttaatagaagttgttgaacaggcgaccagtgatttttaaaatatttcagttgagaaaattgcttaaaaatttttatttaccaggggatgagggtgccaaatttgccaaaatttcctctaaaaacaatcattttccattttgcccgcaatgggcacggcatattccctgctgctggacacaggcacgcagtctaggctaaggctggactgatttggcaccggcacatggttgtgacgcccgccgggactgaatttgccgggctggcacagacaacgaacttttgcccccaggcgtgggggggggggcggcgcggggcgggggcatcaccgttttacatcattttaaccgatccgatcggcagaaggagcaacaacgaccccggcgacaacatttaccccccgccccctccctttttcgagaacggtgtcaatcccattagccgtgctttgccgatcggtcggtgctcactcatagccccgtggggggggggcacgcacactttgtcctcccccgtttatgtgccctccgtgtcttcacccgtcccttgggggataaaagtccgagagttgagtcgagaaaaatgagggcgggacgagaatggacggattgtggcgttgggggggggga

SEQ ID NO: 18227 - DNA, 3610 bp, Heterodera glycines
aatttgggtgagattttcgttttgatgctctattaaaaacccaaattattaaataattgtaaacattatgccaatttatcaaaatttaaaaaattttgaggattttccccaaaagcctcaagaatcctcaaaatttctcaaaaagccacaaaaatcctcattttccaaaaaatcctcattgacctatcaaaaagccacaaaatgaggataaatcctcagatctgggagccctgattattaccttgttcattagtaaagttgagaccaataaccttaaatataatgaaaatctctctaaattgcttcaagacatgaattccttagaagtgtttatgtcagtgttttataattatatgttcaatcaaagaattgagtcagcacttttgagacatgccatattatcgaaacctcattttcgaatcaggaaaggatttttagagggaaaagttaaatcggaaaggatcttgggaggaaatgtccatcaggccaaatagaattataagttttaagattttaaagtttaatcaggcagtaaatatatgcttttttgtcagatataaacttgttttcttttgaaatttataactaacttcccttccttcaatgctatccaattacctaatatttcagggatatcagataatcaacaacaggaacttaattttgtccataaaacagattggacgtaatttaagcaaaaatgacaaaataatatcgtgacaataaacaattcttacttgcttatgctcatttcgccactgatgaaaagatggagtggccctaaagagaaatgaaaaggattaaaaccattcacaagtaaaagattactctttatatttaagacgatggaatatatgttggttgacgagtcttttgttatccttaaagatttagtatagaaacaatcctttgttatccttatactaatgagtaaagaagtgatttagataacagttgaaagtatgaacttaaaaataccctatttctaatggccacaattctgaagaccaaattgacattgctcctcatcaattgaatgtttgataaatgatgcgaatcgggtaatctaaaaacttaatgaaaaaaagataaatgagaaactctaactgttgaatgttattgatagcatcaggtcgaatccattgagatccatcgtaaaacataacgtcagcagttgcagaaagaagaagggattcactaaaacccatttgtaaatgtcctattgtacatagtcagaatgaaccacctcattctgagtttaatttggagagtcaaaaattcaaaaaggctgctaaaattgtgcagctcactcccagtcgcttataatttaaatatataagttatatcacctaaataaattgtatgcatagaaattgtgtaaatgtgagacatctggacacaaaataaataacaacaaatgatcgcgaccctgaactatacagcttaaaaactacaaatcaaaagtcccccgaaatttgtatgtactagcctattaggcttatttattttcatttggtttttttcacttcataagtccaaccaactaaatcatcgctcggacaatcagtaacttgaccgacccgactttttgctagaacattttttgaacataaaatctatttctgattaataattgatcagaaacctcaaaagggccgacaagaaaagaatgtaataaatggagagttcctccgatagctaagcacaaggaagaaaagctgtcacaacaagcattcgaccagttagccattatcgaagacaagctcgaagagcaatggattggtcctcaccattttggcaaatggacgttactgatgtgagggagagtgtgaggagaaatggcgagagaataagacacaattgaaggagtttgttgtttgaatgggcacgagaatgtaagaaatggaagtgagtgtgggagtgagtggctgatgagaggtcggtcagtcagtcagtctagcagcggactcacattgagtggactgtgtgaaatttttctgtttccgatggatggaggggactcacatacaatgtgtatattatcttatgagggaaatcgaacttccatttactgaatccgggagtgcatgcacaaaaaataaaggagaaatggaaagttgacagtaatacaaatagtccgtttgtgaggccactgtaaaaaagaaatatcaattgatagaaaattgtttaattaaggtatgtaaaataggctcgtaaaaaacaaaaaacttaacttttcttaacattcaatagctaattccaaagctcttgttgagctctacacatctatcgataagtttttatgcccgattaattttcttaaaatttttaaatttatttttaatcgggaccgcaattctgcaaattaccgcattttcattaagaaaattttcaaaaaaatactgaaaaaggcatgaacaaggcatcaaaggtcaaaaaagattacaaaattacgtgcccagcattaggcatcaaaatcgcaaaaagcgcaccaataagttaaagctagaagcttcaaaccatgttaaaaactcgtttttcgtctgtattaggccgtagcaagttcgcaaaaaaggcataggtatgcttcaaaatccggtcgctattgataacctaacaaatattctgataaaataactgcgttgttttcgcaaatcccactagcatatacatatatatatttattgtataatcttttgctaaactttagatcaaaaaataataatttatgatggctgctcaaaggattttaggcgctcttggacaaattggtgttggacttactgccgctggagttcttgctcaagctgcactttacaatggttgttttcgagaaatctaaacttctaatttgtacaatgtgtgttcagttgacgctgggcaacgcgctgttattttcgaccgttttaccggagttaaaccgaatgttactggcgaaggaacgcattttttgatcccatgggttcaacgtcctatcatgttcgacattcgctcgacaccaagggctgttaatactatcactgggagcaaaggtaaagcggcacgtcttacttattttacttggtgcaaaatttagacttgcagaacgtgtcgatcactttgcgtatcctccatcgtccagacccatcaaaattgccacaaatctaccttaacattggcacagattatgctgaaagagttctgccatcaattacaaacgaaattctgaaagcggttgtggtaagtgtttttaattgaacgaggctctcagctacatttggatgtaaagtacaaactttgatattaaactccaattttagctataatatataaaatttagagtactcattcgttttttaccgtctatataggcacaatttgatgctcacgaaatgattactcaacgtgaatcagttagccaccgtgtgtccgtcgaactcgcagagagggccaaacaatttggattcattcttgatgacatttctatcgtattcttttgattttacctttctttttgcagaattagtctgattctgcaaaacttttttggggtctcaatccttcgcccgggtcgactattaaacaattattcatattgaactaattttagaacaaaaatttgaaaatcgaa

SEQ ID NO: 18228 - DNA, 2898 bp, Heterodera glycines
ttcccatgattttttggtgagaattcatcgactcccctagcatccgtttcaaataattgaagcatcttttttccttataaaagtgcccagtaatgcaaaaaaaggttagtgtcgtcatgtgccaccacctccccccccccctctccgaacggcaccgtgcaaagtttgtgacgaataaatgtaaccgaatccaccgccgacctttgccgccccccacgccccctattgtccctattttgggcacaagtaaatattgtaattttaaatgcgttttttcttttgttcgcgactgtaaaaatgccaaaaaaacctttaactgatctttatccattcactagcagaattgcaaaacaaatttcatttcaatgatttttaggcattaatcttcagtttgcaatccaaatatgtacttaagaaaattgtccattttctatataatgcaactaattcgcttttggctactgtatttattttaacagagattatttttatatttttttatattattattttaggaaagcattttaatttttttttcatttgttgtggctaaaatggcagtgcttttcaacggcaacaattttcggctttcgtgtaaatccgccgggtgccgctgctgctggatgacatttttgtgcgcaacaattttaagcattttttttgcttcaaatcgtgcggaagggtgtgttttaaatttaaattcataaaattttcttgaatttttgtacaattcttaatatttgttaagagagggtatgcttggtaaaattttcagctttatagggccatggaaatagctgaaaaacaacccaaaaaaaccctggcgctataattttgttacatactgtatttattatcattgtcccaccatttcctcacctttctttgagtaccgttgcctttttgtcaggttcatcatgctaaacggcagacaacttgaagacatgcaaaatgtgttgaacactcagccaaattgggcttcaaaagaggttgcggaaggaagtgccgactttccccgttttgcacccatcgccaaaaaggcggctgccacgggggtactgaacaaattcggaggaagtggggcacggaactgttactttagcccagtgagctgcatgcttcttcatgtaagcatttatttgcaaattgaaaaaatagtaatatttataaataatattttaggatgtgccgaagtacaaaaagctaatcgaaagcactcccaacggatgggctccgcttcatttcatttgaattttgaagccaaaaagaatgccaaaatttttttctctcacaaaacaatttgcgaactgtttttgaagataaaattaatggtttaaatgttaaatttcgatgtaatggcaattataattttggatgcaaatttatattttaaatagaatttaatgaaatattgtggaattattggattgcttgatcccctttcaatttaattagatgtaattccgttaattccttaattatttgcaattttctttttggtttctaatttagtaattttttggataatttcaaaaataataaaattttaaaatgtaaaataaaggaaatgccataagattaaatatcttataatgttttaggttattttaaaaattaatttttgacttccttattttgaaaaaaaaaaatctatttatacatttttcaaaaaaaagttcttatcaattttcataagcagaaattctcaaaaccttaaaatattaaaaaaagaaaatctttgttacaagttgtgaaattttgagttttaaattggacatctaagaaagatttccttgaaaaaatcccaaaaattgcgaaatatacaagaaaaactgcaaaaaataaaaaaatatgtagaaaaataagtacctaagtaatataatagtaacaacagaaaatatgtaaaaatactctaaagaaaagtcccaacttttgtttgcaaggaaaagaaaatcttttttattttatattcagagtatggagagggaaaataatatatattcccatgaaaatttacatccttattaataagataaattaaaaatcaatttttataggtatcaacaaagataatacttattgaagtatttaatatcaagaatattttgattgggcgaaatttgtacttttcatggccaattagttgaacgtataattatgtccattcattgggtgctaagattttttttattggtttttttattttcctttttttaatagatttttttaaatatttttttctatcgatttttttcctttaattattttttttaatttatttttttaaattttttattttttttaaataggacgaagtccgaatagtgcaagtgtgggcgaagtccgaattgggcaaataattaaatttaattaaaaaaattattatattttataaactgttaattttcatttttttatattttaaaacatttgaatatacttttgagctttatttttatttaatgaagttattttaatatgttttaatgtaaaatcattgtcatatgtctacgacacacccattttattccgtaacttggtcaagtgacggtcaatcttaacgattttggtatcaaaaaatagcttaatcgaaatctcagttgaattatttcgacatttcttggaagaattcagttaaaccaggttttaaaccggtttaaaaagtatgtcattttgcttaccaaaggaaaacatttttggtatgaaaaaaacttgttgtttctacattgaattctctacaagatgcatataggagccgagttataaatagagagatgggtaatttaaaaaaagtgcaaatatgcacctaaaaagtcaaaaaaaaaacccgcaaaataggcacaaaaatatgcaaataaaattttttattaaggctttttaggtagtaaaacacataaa

SEQ ID NO: 18229 - DNA, 1201 bp, Heterodera glycines
cagagagaacgggaggagatgaggacgaggcgggcagaagatcgacgacgcccgtggaagtggaggcaacggccgaagaatggaaggacgacgacgacgaccggtcgagagaggaggagcaaggcaagtcgagcgcaacgtttgggttggaggggggccggtggtgttgctgatggtgctgggacgacgctttggaggtggactgattcgaagagaagaaacggctgaaatgcaataagtgtaagtttgtgctgttgctggccctttttagtttggaccctcaaaatcaatttaagaaaaggaaaaattttgaaaattgcctcttgagaaaattggttcctcaactaaaaaggtgcttgctttaacggcttcacacaggcagacaatgcgaacaattgtgtccaccacattcaggaaatcgcttcttattttgttagttgtgccaatggaaagccccgtttcgcttgcttttcatcggccgtccctttgccccggcgatgcccccaacccgcggttcttctcccccataaaccattcacaacaactactgaacaaagaaagaagaatacggctgtcgctgtcgagtgggtcgagaggacttagccgtgggcattgaacgcacattgccctaaggggagggggggggggggaaataaggcaggggaatggcagagagacggagggagggagggaaagggaggcaataattgttttctcgccagcagcagaatgctaatggcccagtggggatggatggtgatgatgatgtcccacgccctgtgggaaaagtcgattcgtaagaataagcggcaattttataaaggagacgacttggaaaatggcaaaaaagggaaaagagagggaggaaaaggtggaaaaaagggaggggggggagcaatgagaaagacaaacactgaagatagaagaaaagagaagagaggggggaaatgtcaaatatttattcaaaaaataagggaatgaaaaaaagtccacattatttgggtttcataactgaggtgcgaacggactgcacagcatctattccattcctaaaaaggaatatggccatgtttgtccagcggatggacttccgttgggaaaatggcaaacgaagggaaagaaatggcgcggggggagggaattaaaaaaggcagcgactcattcagccggctgaattaagcaaaagaggggaagggggagg

SEQ ID NO: 18230 - DNA, 1390 bp, Heterodera glycines
ggcaaaataaaggcgaaatcaaattatacaacaacgtcctcccccccccccccctccctccctctcccctttttctccaccttacgacgccgtcgaacggccggtccaatgaagaggcaaagggaaggaaagggtgggaaaatgacttcttcaccaaaaatgtgattggcttgcataccgaattccaatttgtcctcaaaacacaatctcttcccattcttttctacgtttttaaattccaaaaaattcgattaaattgggaaataaattttaatatgttaaaaaaggcaatcccatttattgaaatttgcatttacatttattctaagaaaattttatggaaaccaattccatttatgaccgggaaaatttctatgattaaattttaaatttatcaatgaaattttgaaaaaagcaataaaataacgcaccgaatcgatgtccgtttggcatttaaagagttcgccattgaatgagtttcatccgccggagaatgagcactgacccccgatggcgagtctgaaattgggtaaattaatttttggacaaaggattataaaaatacgattatcttattcatttatttttttaattatgcaccgtttggaaatttttttggcacccatcattgattagcacctttttcgggattaccaatggacaaaaccaccgaaggcaactccgaagtgctcgtccgacgagaactttcagtggtggtacgtccgttgtgctcggcggtggtcgtggaagttgaaaaccatttcttgcgattgatcgcgaaggaaaaacgctttggcaaaccgaagccctccatttcggaggttcccccctttgaatggaaactttttgtggatttgagcacctgcagcaagaaaattttttgttcgaatctcaacaaaaatgagagaagagaaggaagacgtgccttgggagtggagtaacaactaaactcttccgcacttttctttttgaccgactgttgttgcggggagaaaggtggccaacgaatgtacgagaaggaagactttttgacgggattatgacgtgtggcaaaatttgccgcctcgctaaatccattaaagatggctgctgcagacctacaacaaggacacattttccccgttttgtgtgtgtgaatcagtgtttaattaagggcgcacaatttctttcgctgttgatgaggctccttcttcgcgcagctttcgttgttctttttatggtcctcttcaatggtttgggaacggccaaatttccgtgtaagcattggcggacagaagcaattgctggtgattaatcagacaatttagcacaagatttgtaatcagatgaaaattaataagtaaatctatttataaaattaagtaatcaaataattaaagacatgagtgtg

SEQ ID NO: 18231 - DNA, 943 bp, Heterodera glycines
gtagtgtaattgtaaatttgacgctaatttagcaaatttgtttttcgcttaggactgatcactccgtggaattacccactaatgatgctctcctggaagatggccgcctgcctcgccgcggggaataccgttgttcacaagccggcccaagtgtcaccgttgacggcgttaaaatttgccgaactcagccatcgagcagggttccccccgggggtaattaacggagggaatacaaaaattgaaaaattaattaggtaattaacattgtgaccggcaccggctcggagattggccaggcaatttctgaccatcctcggatcagaaagttgggcttcaccggctcaacagaaattggggcgcatattatgtcctggtaattaattagtcgctgtttatttaatgggttttcccattttccttttctctgcttacatttcgctttttcagttgtgccaagtcaaacgtgaagaaagtgtcgctggagcttggcgggaaatcgccactgatcattttcagtgacgtcgacgtggacaaagcggcgcgaaaagcaatggacgcggtgtttttcaacaaaggcgaaaattgcatcgccgcgggccgactatttgtggaggagcgaatccatgacgaatttgtgcgaaaagttgtcgaaagtgggctaatgggcaagcaattaaaataatcattgggatggccaattaagagacttcgaaaattgtaattggccatccgttggacagacgcacccaacacggcccccaaaatcatttggcgcacctccaatcgctgcaaaaatatgtcgagaaggcgcgtgggggacggcgccaaattagcacacggtgcgaaaagatgcgacgcgaaggattatccttcgagccgaccgtactcactgaagtgagacaaaacgacaaaaaaaaaaatgccaaattggtagtgggaaaaa

SEQ ID NO: 18232 - DNA, 1496 bp, Heterodera glycines
aggagtcattcggaccggtgatggttatttccaagttcgacgaaaggtgcgatggcaataccaagtgctgccaatctttagtgccagcttttgttcagagacaccgaattggtcgtcgagcgggcaaatcgcaccgaattcggcttggccggcggagtgttcaggtaagcgtagttaatatgtgccgaatctccccccatttgatgacatatgctaattcagcagtgatattccccgtgcgcttcgtgtggcgcgtcaactccgttgcggaacagtgtttctgaacacttatcagaagactgacgtcgccgcgccgttcggcggcttcaaacagtccgggttcggcaaggacttgggggaagaagcattgaacgaatatttgcaaacaaaaacgatcacaatggaatattaggggggggggggggaagacgagggattggaattaattttcaaaatgattttttctgctgattcgaaataggtataaaatgagacactgtttaaagcttctaacatgcattgaaagggatgggtttgtctctacacatttaattatcaacatatatcaaatgttgcacaattttggcaccaacgcaatagaataaattaaatgttttcaaaatgatcaacaatgaaatcaacacatcttcttcactccattatctatatataatcaatgcgtatttccatctttgtcctccttcgcgagggaatttgcgagttcggccaatgtgctaaacttagagcaggagaaggcggccgagttggcaattccttcattgccggtcccaattttgggctcagaaacacttctcggctgtaattagcagttaaacggttttgaattcatcgcctcctttttaccacttcgtcttccttttcctcggcatctttcgatgtttggccgacgagtcgaagttttgagctcaactcaatgcgcatgaagcccgggtcgccactgtccgatggtgtcaatttaacatgacctgctgcaaaaggcggaaatgctaatgccttagtgagcgaattcaccgccatcctcagagtcccaacaattgtccaacgtcttttggactttcttcgaattttcccatctcctcgctcctcctccttcctcaattgagttgcctagttctagcaatgtgttgaatttggtcgaagaaagggtcaattttgcactttccgctgcaattttattggccaccatttgagcaattggaacagttttcgtctgtcaaaacgagttaaaatttatacatttttggttcctttgcccttccacctttttctttttttcctttttgggtggatttagccaatgcggcggcacaatcggatgcgggtcgggcaatcccaactcccgcgccttcagttgctcttgcattccttcaggccaaatgtccgggggcggaatgacttttgatcgctttggctcttcttttttcgtccgcaattgctcgggtttgtttttaaactgaaattaggcatttgctttt

SEQ ID NO: 18233 - DNA, 3077 bp, Heterodera glycines
  misc_feature (2930)..(2930): n is a, c, g, or t
  misc_feature (3027)..(3027): n is a, c, g, or t
  misc_feature (3060)..(3060): n is a, c, g, or t
attaaaacatttattaatcaaaaaaaataatttaatataaattaataaaacaatattaaattaattagagcaaacaaataattaattttaagacaaacattttttcaccaaaaataatttaattcgaattaaaaattttatctattattaataaaacaaaaatatctttaaaattaattaaaaacatggaaaaataacaaaaaaatggatagaaaataatgtacaccgtccggatccgaacctgcccccccccctcaaaatgatgcctcagaatccccaatcacacagggatcctgaggtctaaacgatgtcaaaagtagaatctgatcacgtattcgtgatcagcggcccaaataacccctatagacatgtttttggaagatttttggtgaaaaaaatttttcaatcaaaaatcctatgctcacccctttggtcccgaatctcaaaatcacttttatttttataaaaattcttaaaaaagtgataaaaatgccaaataaaatttatataatagagcaaaaaactgcggatttttgtagtattttatttttccagaatatcttttcagaaccgagttatgaatttttttctgaaaattcgaatttttccagaaattctggaataacttttttccttttttagatagaaattccaaataaagtccataaaattctcctgatttttctctatttttaaggctttatacctgtaaaattgatcaacccttcgatttgttatgaattttcaaatattaggccaaaatcccgagggccaaaaaattgccaaaaaataaagaatttttaaaaaattccaaaaattatgaaacttaaaatagacatcatattcgtactcagcaccttattttaccccagaaaaatatttttcacactctttttcgaccccaaaaaattttttgaaaatttctagggggcctagctcgaaaatttttgaaaattttacatcatgtagtacaccattcgatagcatttaaaatgctctacaaaaatgttctaagacaatttttcgataaacttaactcctgccgagttataggcccgggactcaaatgtcccgctcaggccaaaaattttttctatttccggaaaaaaaccgaatttttttcaaaaaaattaccaatcgatagagctcgaaaaactatgttttggaagtggtcttcgtttctctgggaaaaatcgttaaaaaatcataaaattaaaaaacacgaaaaccgttttttaggcctaactcgaaaaattttgaaaattttcgaaattttaaaatttggaaaaatcgggcttttaaagctctacaataagtctgctggccaccctgcgctcaggtcaaagcctaatgagttattcgcctggtactgaagtggggaaaaaaaattaactgagtctccgtgtctgtacaggtccgggatttggtctgatcaaaaaataaaaaataccggattatagaggacacttctgcggagtgccctcacagcgggcactttttgattcgggttttagaaaaaaagttacgggccctaaactgcaagaaaaagtgagaaatcgctcctcgggactcagttgggcgtcgagaatttttttctatagttttcccgaattctcctcaaaaagttgtaagacccttccactactttcagggcgctcccggccttcggccgggagattttgttttttgaaacgaaactccttgtcaatataacatatatagtaactagcgggtgcgtgaaccgtcggatctggcacagggataaagcgcttcgcgcttcgggagcttcgctacctagactgtgaagcgattcaaattgatcgaattggttggggaggtttttttgaatttttaaaaaattattaggggtttttagtccacatcgaggctcaagacgggcgcttcgtgcccgtttttcaaattttgttggttcatacgggcgcttcgtgcccgttattcaaatttttttggccttacagagattagaagaggtacaacagtgattaaaagaggtaaaaagtgattaaaagaagtacaacagtgattaaaagacgtacaaaagtgattaaaagacgtcaaagtgattaaaagaggtacaaaagtgattaaaagacgtacaaaagtgattaaaagacgtcaaagtgattaaaagaggtgcaacagtgatcagaagaggtacaaatttgatgaagaggtacaaaagtgataaaagaggtacaaaagtgattagaagaggtgcaacagagattgaagaggtacaaatttgatgaagaggtacaaaagtgataaaagaggtacaaaagtgattagaagaggtgcagcagagattgaagaggtacaaatttgatgaagaggtacaacagtgattagaagaggtacaacagtgattaaaagaggtacaaaagtgatcagaagaggtacaacagtgattaaaagaggtacaacttaaaatctgattacgtattcatgatcagcggcccaaataacccctaaagacatatttttggaagatttttgcgaaaaaaaattttccactcaaaaatcctggtcactcccctttgatcccgaatccaaaaatcacttttattttgtatctttttttaaaaatgcgataaaaatgtaaaacaaagtttatttaatagagctaaaaattgcggatttttgtagcattttacttttcccgaatagcttttcagaaggcagttataaatttttttctgaaaatccgaatttttccagaatttctggaataacttttttcatatttatgttacaaaagccaaataaaacccataaaattctcctgatttttctctatttttaaagctttatttgctcaaaattggtcaacccttaggctagatatgaattttcaaatattcacccaaaatcccatgggccaaaaaattggaaaatatttttgaattttntaaaaattctaaaatttccgaaactgaaaacaaacatcagattcgtgctcagcacctcaaaataccccagaaaaaaaattttcacccccattttggnccacaaaaaaaaatttgaaaatttctagggggnctagctcgaaaattttt

SEQ ID NO: 18234 - DNA, 1620 bp, Heterodera glycines
  misc_feature (36)..(37): n is a, c, g, or t
caatatacaaaagaagaattgcacgcaaaaaatgcnnttgttcgaataatcttttcttataataataatacactttttgattccaattgtcataaatattgaaaaaaaaatacagttatttattgtgtattttttattattacacatattacacaaaaggcttaggtgttttaactattaattaaaaaaatatttcgtgtaataattcattttattttaaatatagaaactacgattcaatttcataaaatatacccatttttgatttttaaattgttgaaaaaattattcatttaactctttaattaattaaaaatatttattcatttgtgaaaaagacatgtaattatagtaaacaaatttatatatttttgagtcaattaatttgttgttgaaactcttaatcaaattattcaattattaaaaatgttaaatgaaatattgtatttattcaaaaagattatggttaaacaaaatttgataaatatattccaagaaattatgactatttatttatattattcattaattatcattataacataatttctgaattaattcttccgttcttttacacttgctcaattagccgggaaagtgccgttcagtttgctgacgcaaaatgtcggcgagcggagaacagcaccgcaagcagtgccgttcaacaattcagcgggcaaaatttgaaaaagccggacacaatgtagcgacggactcaatgcattcacctttccctccctcttcagccaatcaccaaaattcgaattgattttttggaatttcatgttataacttttttggtaattgtcaatcgcgaagcaatagcttagaaatatcttctaaacatgttaagctttcgattgataccaagattgctggatttggttaacaacaaaaaaacgcgatagtccgaaaacttgggctggcgccaaaacgtcggcgccaaaagccaaaacgatacggaccccccgcccggcacccactcgggaagctcgtctaccgtggctttgttggccaatgcgcagatgcgcagatggacatcgcaaccccggccggtccgaaacgcgcgatgggcaactggctggaggaggtccgagcccagttgaagcagtgcagaacgagttgttgcgcctctcaaacgcgttgttcatgctgccaccgcccatcgaaatgatcaaccaactccccaagaattgacgcgcatggggcggcatgtcgcggaagcgacgagggggtgaccagaagcccaattttattctttttttgtcttgtcatcgttccccacttttcagtaattttcactgttttctcccctctccgattttctgtcccttttttcttttgcttttcacaaattggacttttagccctcccccccccccgggttggccaacattttattttttcatccgcctattatattttggatgctttccccctccattttgatcatcactttgagcatggcgatttggtgatgttgcacggttaataaatcaggacgaagttacaaaatttttccggcggcacctatcggcaccgccggattctcttccctcgcccatcgaggtttttctcaacccgaaacccgaacccgaaatttttctcaacccgcgacat

SEQ ID NO: 18235 - DNA, 944 bp, Heterodera glycines
tttttctttttttcgttttaggctaattttctgtctccagcactgttcagcctgcacacaaaagggcatggcattgaaaggacaatgagtttgccaaatttgatgaaggaaggggcccaattgttggacagggaccaaaacgaatggctgaatctgatcattgaagcatcgggggtcaacgatcaagtggacacagtgaaggtggatgaaacaattatgcaaaaacatttattaaaaaggaaacttttgtattccaaaaacatcatgtccttctaaagggcgtacttgaaaaaaggacattttatttttctgatctcaaatcaatgatttcaaattttaattcataaactaatttatcgcgtttttaaattctatttagcttttcactaattaccatttttgttttggacataaagcgtccatttggctgaaatctcctcgaattaaataaaaagtaattcactcacaaatgccttacaattctcagcatttgttgtcctctgctgatgatgggcatggcactgatgaggagatggccaaaaaagtggagaaacgatacaaacgcgaatttaatggcctctatctgacgaaggaaaatgtgagggaaatcggcaaaataggcaattagttcgctcattaatttgaaaggtgcgcgaaatgtatggagagaacgaacagcgaaaatcggacacaatggaaaaactgttgcaaaatttgagcaaggatcaagtaaatggaaaagaaaaaatgatttaaaaattaaaagcatttataatttccatttcaagttgacagcaatgaacagaagtggcattgtgttgatgaatgccgaacagctccgtctgatttacgggcccagctctcccttcaacgactcgcaaacattgcggcgcttattgacaattgtgaagaacggcacttccgtcagcaaagtggccaaacaa

SEQ ID NO: 18236 - DNA, 1639 bp, Heterodera glycines
  misc_feature (13)..(13): n is a, c, g, or t
  misc_feature (37)..(37): n is a, c, g, or t
  misc_feature (51)..(51): n is a, c, g, or t
gtcaaacagcttngagtttgaaagccatcggaatccnggaccctctggacncaaatgacgacgcattggccttggctcttttcaatgattcagtgcaatttaaggggggcagatacgaagtgggttggccatggcgcccgggaggtagagacaggctgtctagcaatttttctttggctttttcccgtctgtcggctttatctcaaaggctcagggctaatcccgaattaagggaaaaataccaagcggtaattacggaccaaattgaacggggaataatcgaacccgcggttcggacaggggcaggtgagcatttcatcccgcatcatgcggtcataacccctaaaaagctgcgggttgtcttcgatgcttctgctcatgaaaagggaaaggcatcgttgaacgaattgcttcttcctggccctaatttagtcccggaactggcgggaattctgttgcgattccgggcctcggcgtaccccgtccttggggacatcgaaaaggcctttttggccgtcggtcttcgggaggaagaccgagaagtggccaagttcttgtggccaaaagacccttcccaacccctaaaccccgggaatttggaaatttaccgatttaagagaatcgcgttcggcatcaattcgtcgccttttttgctcgcctccgttcttcggcatcatttgtcatccctgggagaccccctggggatggctcgaaatttttacgtagataacttgttaatttgtagcgagacgcccagcgaagcggccgccgccattcaaactgcccgtcggaccatggccaatgccggaatgaacctgcgcgagttcgttgcagctgatcccttgattttgtcggcactttctatcgatgatgtgttggtgggcgacgtccaaaaagtcttgggaatttcttgggacctaccaagggagaagctaatttttgggttccctaattcgtgtgatttccctccaactcgtcgaggggtgttgagtgctgtggcttcactctttgacccattaggactttgcagtccgtgtctggtcaaagcaaagctctttttccaatccctttgggacttgggaaccggttgggatgagccaattggagaggcacacaaaaagacatgggcggtaattacctccgaatgggacgcaccccccttgactttcgctcggttgaccccgtgtagccaagcagctttacaattacacattttttcggatgcgggtcctaattcctttgccgccgccgtttacctacgcgccgagcgtaacggtcgggccgaggtttccctcctttttgccaaatctcgcctacggcccaaaaaattcaaaaatgacggcctaaccatcccccgtttggaactgctgggattggtcgccgcaattcgggccaaaaattttgtggccgccaattttgacttgtcttttgagaaaataattttttgggcggattcccaaattgccctttcttggttggctagcaatgccccccaacccgtgtttatagccaatcggctggcagaaattaggagggagaaaaatgccatttttaaatacgtccggtcctgtgacaacccggcagatttgggcaccaggggaaagccccaaacgaattaagggatcttagtctttggcat

SEQ ID NO: 18237 - DNA, 735 bp, Heterodera glycines
aatttttcctccgggccgggcccccaaaacttctttttccttaaaaaaatttgctcaaagtcgaaaaaattggttatttttggtgaaaatcagttaaaaaatgcattctaattctctaattttcaaaaatttttcgcggcggcgcttactgacactgccggacccttgttcccgaaaagttttttgtttttcaaatcatttttttgcggcgcgtttctaaagacttttaggagaaaggggtccggcggtgccgcggtgccgatagacgccgccgggaaaaattttgaaaatttggatagatctctaacagattttgtccaaaaattataaattttttcgattttgagcaatatttttaggttttttggggtgccggcgatgccgataggcagcgccgggcgaattttaaatttaaactttattttctaagagattttcaccaaaaaatttatgaatttccgtgaaacttttatttatttttttatattttgtcaaaaatattttgaaaaatatttacttttcatgatttagtcaagaaaaatttaactttttaatttcaacgaaagaaaaattgtttttaaattttgccaatgatgaccaatttttatgggtatttttgtttaaaaaccctattaatcacaaaaaaaaaattaattaaaaaaaagtcaaccaggatagaactcttgacaaaagtagtgttagtgttaacgcactaactaccacaccactatccct

SEQ ID NO: 18238 - DNA, 1351 bp, Heterodera glycines
caaaatgaattgttcgtcctgttatgtcgccccaacccgaaaaatccgccagctaaacgacgaatgtcatttttgaacgtctgaaacacattacaggcacaaacacaagtgagcagggtgatttctggtctataaaaattaaatttataatgaatttaaggcgtacaaacatcgcaagacgatgacattgaaaaagaaattaaggaattttcaaagtcgcccgtgatgtttttgattatcaccgttccaaattatcacccgaaactgcagaacaacttatttttttgaacaagtctctcccccagatgaattacaattattgaaaccatttatttgttcattttattaaacttataatatttagtatttgtacatataattgatgaaaattttgcgggtttttttccaaattaacacaagaaaattaaatgtttaccaatccggttccggatccggcaatatgaaaatccgggttgaccggattatgagagaccggatccgggatccggtcattttttaaaataccagtccggtccggcccggagaatttggaaatctcggtctctactaaaaagggtaaattgggtatttaagaacactaaaaagtagctaccaaattttattaaagttgccaaaatatttatggttgtgttttttatggtcctgtgaactgcaatagccgaagaaaatatttggccaattttatcaataagcggtttattttcgaatataggatttgttaatattagttaaagacgtaaatgaaatttcctttaatagtttaatatttggcggtgttcaattttcagtgccaaagtttcgatgtccatttttctgttgttttttccagtacctttttttaattaaaccatttttgtgcctgtaaattcaaattttcatcttaataatttcgattttaaaataatttttaatccttttttgtattgttttaatattgattttagcaataaataaattctttattatttaaatggtgcataaaaaacaaaacttcaccagtgaagaaaacggagagggaagtggcgataaaaagggttgtacgctcccttcaaaagctgctcaaaaggttcaaagctcctttcaaaagcggttagaaactcaaacccaagaacaaattgttattaatttggatgattctgaaaatgaaatggatttgtctgaaagtacaatgaatattcaatcaacaagttgattgattcttggggatacatttgatagaactggttttagagaaagagagaaaataagagctgaaacttggagaaaaagaaaaattgaacagtcagttaccgatttagagacacatagacaaaatgagaaagaaaagggt

SEQ ID NO: 18239 - DNA, 2499 bp, Heterodera glycines
  misc_feature (29)..(29): n is a, c, g, or t
  misc_feature (59)..(59): n is a, c, g, or t
  misc_feature (218)..(218): n is a, c, g, or t
caaaagttggacacaattcggcagtatancagcgcgacatcattcgtacaagccgccanaacggcaattgaagtgaatttgtttttttcgaatcgaattagcatttcactcatccgtagtgcgcagatttcaggaattagggaaagactcaaaaccgggaattcggggggtggggtgtccgtatttattagactgtctaataatcgtgggcgggaggnatatgtggtggattagggataagtccttaatagtcagaagaattgaggaggctactgggttaagccttttttaacagattccttttctatatatttttttgaaaatcctctaatgaattttaacattaaaaatttttagtttaaaaaaattttccttgactttggataacagagtaggataaaaggtcgctgaacgattttttggatcataactttttctttctaaaaaattaaatcattcttggaactcttttaaatttcgtcatgtacttacaaaaagttagggctaaaatacgcaaaactgaactgactttttctgactatctttgtcatagaattttagttgaaatttaaaaaatcgtccagcaataatttttgatttttaaaagttttaatattattatttttttcaattccacaggaaatttcaaaagtacgccgacccaatgctggactgctggcgacagtgttttggagcggcttaaccggcactgacaaagcaaacgaattggcaaatgcaatgaatcagttcaacgaaataaatcgtacacaactttttgtggtctcacttaatgcaaaagccaatttgacaaggcttaaggtgattattattgatactgattataattgatcaaaaaaatatttttaaattttgattatttttgagtaaaaaaacattaaattatttaaatttatgttaaattgttaataataaaattagttaaaattaattgcataaataaatttgattagtcagtgtaagattggaataaaaaatttaaaaaaaatatattttaaggaattggccggagatcaatggcacgtttttgtggagggacgcgccagccaatttattggagagggtaattttttttgtttcttaatttttgatcatttgttttatttatattcttaagttattctttgaaattttatcatgaaatttcctaaaaattttttagtgtttgatagagatgccattttttgtcatgataatttcataaatcaggattttttaaaaagttcttaatgtatgagattttatgaaattttccaagctgataccttcatgcaaagttaaaaaaaaacccttttttcaatattttttaacattttttgtttgaagcttcacaacatcttctcgactgtgtgctgcctcccagcggtgcccaaatgcactcatcaaacaacaatgacgagccggaactgctggacacccatgagccattgaccagcgttgaacgtgttgagcatctgcaagcggctgctcgtgcattccaaaaacatccgcttggcaattgcaaagatggtaataattagagcatgaatttttaatttttttttttttaattttctgtgaatacgtcgttaaaaatttcagggaattagttgttttttaattttatataatatcttaaagaaaggatgatttatagtttctgatagatatcatagatttgtaacaatggcaatgaattattaatatttattaagttttttttttaccataaattttaaatttgtgataataggtcttaaagtttctgtgtgattgttttgaatcagataaacagataaaaaaatttaataatggattcttaatattcgtaaaagttttcattaagtaacatagattaataatgggtgtttgtatttgtattgtttagttgtaacaaacaccaaaagtttgtaataatcatagattgtaataagtggtattaatgttttgaatgtgttcatttgactgatatcatgttttgtagagtttgtgacaaacatcatatttaataagttgtattaatgtttcgaatgctttgatcagacatttcatgatgtgtaagttgtaacaaacaccaaaagtttgtaataatcatattctaataagtggtattaatgttttcgaatgtgttgatttgactgatatcatgttttgtagagtttgtgacaaacatcatatttgtaataatcatagattgaaataagtggtattaatgttttcgaatgtgttcatttggctgatatcatgttttgtagagtttgtgacaaacatcatatttgtaataatcaaagattgtaataggtggtattaatgttttcgaatgttttgatcagacatttcatgatgtgtaagttgtaacaaacaccaaaagtttgtaataatcatagattgtaattagatagtaataagtggtataaatgttttcgaatgttttattagacagctatcatgctttgtaatttttaaacgaaacgattatatttgtaataatctaagttattt

SEQ ID NO: 18240 - DNA, 853 bp, Heterodera glycines
cgtctcaaactaaaaatttaaatatttcaatttttaaaatttaattttttattgctcataagtttgataaaaaaacaaccaaattttcaattcatgatatcattcaatagatctcgaaatattctgttttcctgtcaaaattcaaaaaaaaaattgtcacttttccaaaagttagtaaaaaaacaattttttttttttatgtttttctggtcattatttttttgaaaatttacgaatttttttgaaattttgaagcctcattgtaaacattttgagctatcgacagggacggtcccaggattttggcttggggaggtacctcagcccgggcgacgacctttttttcacaccaaacttttttgcggcggtttttccaaaaatttgagacaaaattaccaagaattatttatcaaaaattttcaatttttgatgttttttgactaacatcccaccacccccttaaggctatcgactaaatttttttttttaataaatattttaaattttgttgaagtaatttggagaatttttatttttaaaatttgtccacgaaaagttcgttttgtttgaactttaattgaaaatttttagggggtagaaaattagtaaaatttaaactttacccggcactccgtttttagtcgaacaaattccttggcaatttcgtccgtttgccgttggctgagaatgcgcagcaaaatcagtcccgtctcgtcaatgtgcaggcgacggccgagttggacccaacatgcgcaggaacctgaaaaacaggggcaaaaatgttaatgactgtactgtatactgtatgacaacagaaaatgatacagttcactctcagctttgagcattttga

SEQ ID NO: 18241 - DNA, 2262 bp, Heterodera glycines
cagcgacaaggcatatttcaacgattggagttcgggcgatttttcgaaaaacgattttttcaggccctgccctccggcgtggaaacactgaaaaaacaaccaattaaaggtaattaattaattaattaattaattgcccggacctctttgattgcatccaatgcggcgtcgagcaccgcgcactgtttgggcgtcagtgaacgttcgctgtcccgggcaacttcctaaattttttttccaaaattaaatttgggttaaacacaaataattttggccttttgatggaattattgttattgtaatcctttgatcagagaatattgtataaaatttttgaacagggctctctctgttcatcggtctgtaaatctcgtgggaggaagtttttgggaaaatgacttagaactctggtggcaacaactttgatcagtttttcgttttcgtttttagttttaattttgggttttggcatttcttcgttaggaatacaatacaatcattgccatttgaattcggtttcggcattttcttaattcgatctgtggatcagactacaactttttggtactttcaaatgaaatttgggcattttatttccaaatttttaattcagttttggaatttttatttgaatttcggtccattttctaaatttaaatttgagttttcaattaaactttggcatctcaaccacaaattgtttcattatttgatcgacgaaccgaaccctgtcgagcttaccatcatatctttgacggagctcatgctcttcacgccctccttcagatgggtggacatcagcttggtgacgccgccaatcttcgcatttggcaactgtttgagcaactgaaattatgccaattttttgcaataattaaataaaattttaattaaatttaaattttaaaatgataccgctttttcggatgaacccaacgggggaagcacaacaaatttttccatgctaacaatggtgattttccaaagttcctgcataaaaatatgaagaaatgtttaagaaatcatttaattaggggtaattagttaaataattaaaattttaataactgtctaattattgacaattagttaataattctatatttttaattaggggcaattagttaattaatgaattaggttttaatttttttgcataattatcgagatataaaattaaattgatggaggacggcaccttcaaaatatatttgagcacagttttttcgcattgtttggcgtaacgttgcagcgaaccctccaacaaatccatcaacggttccaacacgagatcaacctcctaatattattaatttgcaatttaataaatctcgaagataataaaaacaaattttgaaaaattttaaggcacaaaaaataaatgaaaaattaatttaaaaaaattaataaaatttgcttaaaaccaaaataaataaattttaatatgagcaaaaaacaaaaatatattgaatataattttttggcaaaaacaaaggttaattaagcctaattaagggcaattaatgcggtggaataattaattaccccggccatttgactcttctgcaattgtgggcctttgattttggtgagcaaaatgccgagtttgttgatctgctcctgaatgccatgctcaaggctgaccacaaattgggctgacagtttgtccaacacattgttaagcttaatcaaatttttaattataaaaaattattgtaaaaattatatttttttaaatttttttaaataatttaaaattatttgggattcacctttttctgcaaattgttcaacactttgtttgaatccgcatccaaatttgttccacccatattctcgtaaattttctcaagttgtaccctaaaaatttcaaaatttaccctaaaatttcagcaaaatgtcaaaaagaaaattttcaaaaaaactaattgtaagaaaaaattttataagaaaatttcaagaaaaaaaaaatttttgaaaatttttctaaaattttatgatgaattgctaagcttttccaaaaaattgctgaaaatttctcaaaaaaattttttttttcttaattttcttatattgtaaaaaaattcatggatttttttgaaaaatttctaagtttggagaaattttttttgaggaaaaatgaattgcgcccattttttgtttttacctcaattgctgcacattgttcatcaaaatgcatgccaatttttcactgctcacaaatttgacaaaatctttttgcaccatatcagcataagcgag

SEQ ID NO: 18242 - DNA, 1333 bp, Heterodera glycines
atgaaaatgacaatgggaaggagcagtttttctgttctcatttccaaagaaaaagccaaatcccttccgccggagggtctcagggactaacaatgcctaataagctaataacgaaggggcagatgggcttaaacttgataaagaagaacattgtttatacattcgatttctttttccttttacactttctccaaaaagttcggagcaattaattaacaaaaagaaaaaacattgaaattaattgaagaaacaaataaattaacgtaatgtgcatggctcagcccttggccgaatttgttcatttcgctgtccattcccttaaataccgtatccatttggcagaaatttttggatggcactgcaaaaaaaggacgaatttggtggctgagaaacgaatgcgaatgaggcaggggggagatgaattggcgtggaggggtgggagttggggtgggaatgactctttgtgttggccaacgaatggcgggggaggagggcactttttgcgatgccacactttgggataattgtccattttatggagtgaaaatcaaaccaacaaaaaaaaaactgatgcatttgcctcttccgtcgtgccctgtgccattaatttaccgtttccgttggccacaaattgtccaaattggagactggcggcgtaggcacaggccaactgatggtactgcccgtagttgggggcgactgtcggaaaaacggcggcacaattcgcatttggatgagaggggccgagaccttaatcaaaggcatttcgaacgaagtgtcaaattgggaaaatgccatctgatcggtcagaaaagtgaaaagacaaaagcaatgggaaaggaaaaggagaaaatgggacggaacaatcaaagggtgccttttaagaagggaattgggggcgggacaggttgaactttgcggtgaagagatgatggtcagttcagtttagccccatcccataaaacgagaaatggcggggagggcacccgtccccccccccaattccccccaattcccactcatttcgtcccatcccccgtccttaatggcccttggcgaatgggatcgatggattggtcggctggggacgggcaatgaacgaacgaatgaatggcagatatccccgccgccaaattgcccaattcctgacggaccgcaacacttcccgccgaggtgggcgacaggcggcggaaagggcacataaatctcccaaaattggccctttctctcgtcaaaaagcgctctcctccctccctctctgattactgaccattctccggtaagttgctaatttgctccaggcaatgcaaagggttggcggccgacgcaaaag

SEQ ID NO: 18243 - DNA, 1598 bp, Heterodera glycines
tttttgggcgacggcgtcggaaggatttgccccatgggatgcaattttgggaagcggcgaacggaagaggaagaggaagagaagggagggcagggggagggggaagagtccttcttcatccatcgtaaatcagcaccaaagggttgttgtgagttggccttgaatactttgggggggggggggaattcgaattggcggtgcgaaacggaggaaaggcatggaaaggggggaaaccgcacgaatggcatcatccgacaaattggcaaagaatgaaatgtctgataacgatcagtcacttttgacttgcttctattgactgatcggtcgttcttcgaagttcgactttttgcctgaggccaaaaaacccaaaaataaattctcgccaaggcgacggacggacacattcccggaggggaaagtgggagagatcaaaggataggccgactacttaataaatcacgcgaaaggactgagggagaagaaggggggagaaagtgtggtggaaaccaacgacgcaaaagtgagaaatgggtagggaaagaaggcgggggatgaatcagaatcagaaccagaagggagggaggaggaagaagaggaagaatggaaggtgaagaagagaatgatgaggaagaggaggaagaagggagggagaagaggaagaagagagtgatgagaaaaaggaggtagaagggagggagggagaaaaggaagggagagaaagagaggaaggaagagtgaggaaaagagagaaaaggaagaagagcgtgatgagggaggaagaggatgaagaaggaaggagagggaaggaggggaagaggaagagagagaaagagaggaaggaagagggaggaaaagggagaagaggaagaaaaaaagcgagggaagaggaagaggatgaggggagtaaataggaggagagaagcagacgaagaagcgaaaaaagcaaattgaagaggaagaaaaagagaacgagaggaggcaaaagaggagttgaagcgaaagacacgaccagttggaagggaatctgcagagaagatgaaaaaataacaaagcattcgaattattttaattagacacatgcaattaatttgtgagttaattgagaagcgctcgagcagagggaagagggaagagagtccgtcgcgttctcttcccatccctttgctcgttcctccctcttttgctccgtttggttcgcacatttttcggctccatcaaaggggccggggaggaggagtccccccccgggggggggggggggggggttcccttactctcttccccccccccattcagtcagccgctctttccttttgctcctcaacaaattcgacgcaaaaacgactgcgggaagatgggcagacggcacacttcaaaggcaaacggaaggcgaaaaaagggagaaaaaggctgccgaagggcgccacacacgacggaagaaaggaggaagaagaagaagcaaagctcataaaattggagggattcaaaaagtgaggggaaaaggggggagaggggaggggggtaactctttgggagctttgggagtgatgcctttggatttgaaacgccgtcggcggacctttgggaggaaatgggcg

SEQ ID NO: 18244 - DNA, 1141 bp, Heterodera glycines
  misc_feature (22)..(22): n is a, c, g, or t
aaaatggaattttataaaattnttcataggaaaaaaatgtttctctaattgtaagagcaaaaaacaagaatttgtagccacttttcgccaaaaaggggactattttttgggaggggggggggtagtttcgccatgaaaaatttcgactttttgggggtctgagccccgaatttacggcatacttccgaccctttgagtaccaatgcttttcgaaaattcgtcccgtgacatgagcggaaaacgaattttgtaaagtgccgggccgagcatttggcgtcgattttcgcctgtgcattctttgccatttttggcacattgctcatccgcccaacggagtgcctaattaataaaattgattaattaattttaatttgtcttttctttttcaatttttaccgcattccaaatggcaatttcgccgctgtgcttttgcggaagattgtccaaaatttcgcacaaaaattggttgttaactttcaagaactgtttcattgtgagctcattgttaaaattgatgtggtccaaacatcggcaagcgaaggcctaaaatttttttttttatgaaaatccaaatatttcacgcgttttggttttaacattttttaatacctaattggacccaggccggtatccagaaaaaaaaattttcggctgaggcacctgatgaactttaataactttgccttaaaattcttagaaaatttcacattttcttgaaaatttattaatttttattcacccccatccccatccccgaatatgggcctgtctggacctgtataatgcaaattgtctgctttttttgagtccgagatttttttcctcggaatttgaactttgatatcattcgacagacctatgttttctctattagactgcaaaatttcaaatattatagtaaaaaaatggttcatttttggccataatattttgaaatttaacgaaattttttgagttttgcagactaacaaattggttaaatttggccaactatgaaaggagttgtaccccaaaaacacggcggtctgtcagtcgaccaaatgtcccgcacatcgtcgggattattgtatgatttttgattgatgaaactctttcccactccctccccataaattgtgcttggataacgcatcaaaacatt

SEQ ID NO: 18245 - DNA, 1336 bp, Heterodera glycines
tttcatttcgaatagttccaaccaatgctgttctgctgtttgactgcaaatccctaagctcattctcttataatgggcatggggtcttttgttgccaattattttgagattctcatgacaatcagtgacatcccaatagttttgtcggaaatttgaagatgccttaaactacttcattggcaaattaatggattacatatgcaattaatgaaaatactatctaaaaatatatttataccccttaattcacctttctttgctctggttctgtgctcaaatgccctaatttagctcccaattatcttgtgatcatttcgtatttgtgaaaatggatccacagcgcttaaaaatgaaataaatttccgaatatcaaaggtaacatctaatacgacagaaagcacttctagttttaatatcgcctcgccttacgtctataattcacgcatgtctttacacttccgagattgtgttacaaattttcatgtggatcttccttgaatttctgagaatattgttcttttaccacaatctttccatttattagttccccccccccccccccccaatgttcccaaaaagttttttggaaccgcccacaaaaacgcgatttaaaaaattaatagattgttaatttattcaaaaaaaatccagaattttgggactcagaaaatccaagattcccccccccccgcatgaaaatttaaaaaaaaatttctatataatggaaaattcttcgaatgcctcccccaatgagtacatattttaatataggcaattttcgtaacaaagtgcagtcaaattttcaaattttttttcaaaaaaactttcacttgggaaaattttattgattaaattgaaaattttgtttttaaatgcgtggtccgcggccgcggcaatttgaatgcgcgatgcgcggccgcggtttttttctgtgcgcgctccagccctgatgcacataacgccaaaatctcgcgcacaaataaaatttgataaatacggactcgcgccccagcggatttttggctatgttcgggtgggacccgaagagacatttatttaaattaattattttcatttatgtttatttgtaggacgaggatttctagttttttaactattttttctgcagctttatttagacgggaattgcacgaaaaacacatttttagctcggcaattcttcgttttaatgccactattcatcactaggaatcactattttggagccttgtcattatttttgccactattttggcatttttggaaaacttcccaaaattgcaataaaaacgaaaaatacacccctaagaatcgacctaaaaatttttcaaaaata

SEQ ID NO: 18246 - DNA, 1378 bp, Heterodera glycines
taaatttggaaaaattgcatttaatttcggtttctaattgttaggaatttcttcgtgccctcaccacttcttcggcgagctatataattcgacttgtactatttgatgaatcaacggaaattgggccatttgaattggtgaatgaacggaccaacgaaatgctaacattggagaaagaagaaaacaatgatgaaaatgtggatgaatacgacgaagatgatgaatatactaattgcgattggctgttcaagcgatggcagattgggaagacaattcaatgggaggacaaaaagacggacaatttgaacaatgtcaacatttcgatttgtcggtttgggtgagtggcaacaacttttaccattgttaaactgtttccagctgattcaactacccttaggccattgactccaccacagccgggccaaattaatgcaaaagatcttcttgaaatgaaacccgggcccagcggacagcagaagaaatgaatgaatgaattattaggaaatgaggatattctgatcgatcattatggatggaaagtgatctgataattgctcctcatatttatatgttcctttattcctttgaatgcagtttaattcgtttgggttttgggacttttacaaccgaaatgattattcggtactaatgtttaaattttcattgatcctaaaatcaaattgtgtagaatttgccagaggcgacaaataaaatgtaaaccaattgattttgttgaaaaaaatgaaggtttatgcattgtttgggtgaactttaatcaaggccccagaaaaaatggcacaactgatatagctcaaaatcggtaaacctataaagaatgaagtgtccctttcaaaaagtggatccgaaatctcatccaaatttaaaagtaaatacggaattataaatgtttcgaatagaaaatattcagccaacaaaataaacactttaaaagaaaaaattataaaagcaacaattttcattgaataattcaaattgatagccaatttctccaacccaattaattaatttccatataattaggcgccattttcgctgctttgtaccgcttcttctttggtggcggatacaatggcctaaattaagcgcaaattattcaaaattcgattaaaaaaataaatgcttttcattgctcaccacccaatacaatttgcggaattggacagccaaaaatggacattgttcaaatggttcgaattttcaacctcccactgaacgatttgtccaattgggcatcgcttcaacacccatcggaaaccagaagcccaggcacaatatttcgtttctttctccaaagtcagcttttcgttggtccgttcgttcaccaattcaaatggtccaattcccgctgacgccaaag

SEQ ID NO: 18247 - DNA, 815 bp, Heterodera glycines
tcccccccccccttcagagacgcagtacaaatgtgtcaacaaaaatctgtatgtacattaattccaaaatatatgcaaacttattcttctccattttctctaattctttgctccgttagacatttatttttcatttaaattttatttttaaaaaatattttttgcggttattagtttatacgggtgtttttttaaacggtcaaatttggcatcattcgaaagcatttggcggtggaggacaaatgagcgccagccagacttttggagtataactcctttcatagttgtacgattcgaaccaattttttattatttaatagtccaaaaaattctctttcagcctgccaaattttgaaaaaatttcgtttagtttcaaaagttactgtccaaattggttatagatttttgaaatttatcgggtttttgaacaaatagaattcgtatttgttaggacatatccaattcatatgaaagaaatactccaaaaaccgggtcaaaaaacccaaaaaagccaaaatatatgccaacatttaaaacaaacttgctcaaaaagctgattttttatcatttcgctataaaaatcccaaaaaatttattttgcgataggagccgacagaaattttgaacattatgcgtgccaaaacgctatttttgaaaaaaaaatcaatttttttttaaatgccaaatgtgccaaaatataaaaccctaaattgggcgcgcaggttgggcgccagcatgtttttccactataactttctataacttttttctttgtcatccgaaatccaacattattagtgtcattcgaaagctta

SEQ ID NO: 18248 - DNA, 2496 bp, Heterodera glycines
acaatataaaacttgatcagatttgtgatcagcgatccccgagaaaatatttatataaacagcatcgtataaaaagtttgcaaaaattatgtccctctaattgacccaattggataataattaaccaattaggcaatcattttattatgtccaggtaagttcaattctccctaaacacctttatggtcactgtttgcatggcacttcggtcaatcttcggcttttggtgacgagctttggccaacaattttcggctcggatcactggcctcgcctggtccagctttgttcactgctttcacacggaattcatattctgaaatgtcagaaaatcactcttgaataaatctatatttttctcgaatcttcccaaattctattaaaaaatcaataatttatctaaccttctccctccttcagtccctgcacggtcgctttcgttgtcggtccaccaacacgggcgcactctttccagttccgatcatgcttgctcttccgttcaatgatgtagtcctcaatcggtgctcctccgtcattctttggcggctcccacaccagatcggcacggttggcatcccaatcgacaatatccggcacaccttatgaatttaatttaatcaattaattaaaattattttaaaaaattattttttctctacccggtttgccgggctcgtcgtatggatttttggcaacaatttcctgctctgtgctcagtggctccgatttgccttccttgttcaccgctttgacacggaattggtattgctggcccttcttcagccctttgacttgtgccgcgcagtccggcacttttgcgcatggcacccatttgccaccctccaatttctccacctaaaattcaaaaaaatgcgatttgcaaagataaatcggagtggaaattactataaaagacctaattataaaaaggaaaaaagaccaaaattaagacaaattagaaacataaatgatataaaaaatttcataaaattaattttcattcaaaccattattttttcgggtgggttttcatcaaaaaattgactttttataaatttgtaatcctttgtaaattagtaattcgtccatcctaaattttattttattttttaatttaaaattctgtcaaataggactaattttaataataaattttgcgttttcgcctatctgacggtctcaaacaaccaatcaaaaaaagtcttatgacgagaatgaaaaagtgcctttcttggatatgttatcgtgtcccccccttattcccgatcacttttacctcgtagtgatcaatcggcagtccaccgtcatcctcgggcggcttccaactcaacgcgcagccgtcctccgtaacgtcgctgacttccagcgggccgcgcggcttgctcggcttgtccagcacggtcagatcagccgttacggtgtccgtgccgctgctgttcttcaccaacaatgcgtatgcaccgcgatcagcacgtacagcagccgggatgcacagaatggtgtgatcattctttttggtgtccacctgggaacaaatggataaatgaatgaatgatcagggaatggctaacattgatcggaaaaaatgttgaatggtcagagaatagctaatgggaggcattgattgaaaaaattttcaatttaaagtaaattttcaattaaaattaagaatggcgacaatactttgatgacaaaatcacaaattagcggtaaaaaaaaaaatttttttgtttatttaaataaataatttttgattaattttaatcggaattctaaatattaattgctcaaaattttgtttttgtttgaaagtaggcgttgaaattaaaaatgttttaaaaaattgaaaccattaagaaattcgatgaaaaaatgatgaaggtttaaaataagtgcaaattgtttgaaacaaaaattgccaaaaaattaagaaatgtatcattaatttgaagaattattttaaaattagcccacttgtattgatccgctcagatcagtgattggctgttgattctttgaccatgtcacttctggcgccggtttgccgccaaacttcaccacccatttggcagtttgaccagcgcgcacaaccaaattcttcatgtcgtcatggttcagccatggacgaactgaaaaaacaattagaaataaattatgatgatcactaatggtttagctaagcattgaaagtgaccggagagaaaattgaaaataaaatatttaattgttatttaaatataaaatttgcattcattctattaactatttttttctaaatgaaatgaaaaagttaatctattcaataaaaattgaaataaatgcaaattatttatttttaaaaaagcaattttattttttagggcactggaattttgaaaaagtcggaattcgggattggcataaggcgggataatctcgggccttttcaaaaagccgggatcgagatcccgagaaatcccgtttcgacgggattcaatcccgtcaggctccaattttt

SEQ ID NO: 18249 - DNA, 655 bp, Heterodera glycines
gtgcgggggtttgcctgcaagttgttttggtcgggatgggatttccttaatcccctctcccatttattttttatttttaacccctcctcccacttttctattttttaatcacccctaccattttcctatgttttaattaattaaaaaaaattttttagtttgggcatatttttagagatggcattccgcactcatttgttcatttgttgaggttctttctgatcaatcactttttaaactgttatgaaaaatgaaaatttgctaaaaatagtagtgaaaacctaatatctcgacaagtcaaaaaattcaaaatcattatttctatgtcgcctttatgcctcctattaattaattaccctgtttttgcccacctattatctctccaaaatttggtgtgattctgatcacttttgaagagtcttgaaatgaaaatttgaggaaaagagtaaaaaaaaaatttcaatttaaattcgaaaaatccaaaaaacatttatcgtttaattcttctttgagggattagcctcatttttgctccatcattgtgattggcccctggggcaatgccattttttacttgcctggcactgtgtaagggtttttggcgagaattgtttcaccagtcaatggttcagattcgccaatttcgttgaatgct

SEQ ID NO: 18250 - DNA, 1998 bp, Heterodera glycines
gaagtcgtcaacgcatcaccaccgaccacttccaccagcagcacaaccagcggaagggccacgacggtccatcagacggcggccacggcggccaatccatcgacaaacgccacgggcagaagcagtaccagcaacagcagcagcggctgcggcggcagcaaattccatttgcccgagttgaaagttggccgaccgcaacagcagcaaagcgcggccggcgcatcggccggcggcgatggtaaggggaaaaagtgggagacggacggaggaggacaaggagatgaacacatgaccaaacttggttgggcatttaggacacgaacggcacgccggggaaaaaatgccatcgctaaaaatatccaattggagaaatcttctttttattcttttttgtctactcatcagattttacggtttgtgaaaaaattcgtcaaaaatgaaaaacaaatccgagttggaaaaatgaggagataattagacaaatagacacgaattctttccttttttgttgttgttacagattgaaaatgccaatgtcttttgttcctttagcgacttctgccaattcctacgagcgcaaagcgaaaagggaaacgaacgaagcgaaagacgacgcaaatgcgagggtttctttttcaatttaaaaaactattttttgtaaatttttaattttcatagaatccccaaaggcattaaattcgcgattatgaaaattatcgtttccggaagcaaccaaattcgaaatattcttagtggcgttcgacaaccgtacaattaaatttccgtcagcaaaatttaatttatttcgtttttcaaaaaaaaagtactaatgaaaaatcagtttcttaaattttggccataatttttggagtagtgaatgataccaagaaaagttgctttcgcttctttttatgtgaaaatttttgtctacccctcaaagaccaatcaataattgtccctttttctctgtcttccctgttgtcggttttttgcgtgtctgtcccaaactcaatcaataattctgccattaatttctctccctttctctgctcagattgaggatgccatagcgtcggcgatcaatggcggcggaagtgcaacggtggcggacattgcgctgctgcgcaacgggcgactgagcggcgcgtcgtccgtcgtcgccgcgggcgccaacgacgactttgtgcggcgactggtggacctcgtccgacgcgagccggcactgtacgacccgagccacgagcactacgggaacagacacgccagcgcacactttcgaaccgcaatttggcaacggttgtgcaaggagttggactacccaggtgaaaagcggattttatgggagtggggaaatggataaaaatgaaaggattaaaacggagggactgaaatggtcgaaaaacaggggccaaagcgaacggaaggggtcaaatgcgtcccagggaactttaaaaggcttaactttttttctcatttggccaaattttccaattttggcagcatttgaaagctctatatgtttagaagctgctttgaaaagctattttctaagcgattggacaattttaaaaaattgttacatgaataatgaatgattgggggactaaaaacagtgccattttcagatgatccgcaggcactgcaaaagcaatggaaaagcattagggacaaatacatcaaagagaaggagcggagaaaagggggcacaacaacaatgatggtaagcatttgagaggtttttaaattttgtagaaattttactgacattttcaggaccattccgaatcgatgacaaatggcacacgaaatttcaacggtaaaatggacaaaaaatattcttaattgccgcaattggttgattttcctgccatttttcaagagaccaaaacactgacaactttcaaaaattggccaatcccctcaaattccattgtttttcaatttatttattttttagtgttggattagctggacgattacatcggcgacagcgcaaac

SEQ ID NO: 18251 - DNA, 1895 bp, Heterodera glycines
ttccaaaatatcgtgccatgagatggtttccattcacatcgtatatgagtgaaaggttataagctgcttgtcttcgcaggtcatatcttgaaaacaaaaacaaaaatgccaatcaattccaaccaaaatgttaggggagagggagaagagcagcttcccccccccccgggtcagttccccttactccactagaaaaaaagaaaccaaaaggaatttttcaagtaaaaaaatcttagaaatttttttataagaaagtttcaagaaaaattttctttgaaagattttccagattttttatttattttttttattttatggtgaattagtctttttctaaaaaaatttcaggaaatttagatgaattgctaattgtaagtttttccaaaaatttctaagtttagaatttttttaattttcgggagagtgtaatggggggggggcgagggggggagggataactggcaattttggcctcaccataattgaccccccccccccctccaccctcccatcttgcccatttatgcccacctggtcgatcgttccgctcgcagtgtccccgtggccgggtcttcgctccacaccaaaggggctgggcattcgtaaaggacacgttcataacatttgagagcattcgcgaaaagacccatctgatggaacatccggccccatattgtattgaatctcttgagttggcacggacgaacgaaagtcggcgtatttcttcataaaggtcaatgcctgaagagaaaattatttgccgacggagacagtgaccaaaccctcagggcgaccatgtgacgggaagaaatgtcctttttgcaggaaatgtgagtgaatgtgagggcgatgagaaaagcgacaagcggattgcttttatcacgcaaatacacagtaaaaaactcgcctgttttttgagggttttaattttggttaactttttttgcgtgtaatttcttgccgagggcgtgtcgataagcgccggtgaccaaagaattgttgccagaaattatgtgcagaatttgtgagtccgactgttttgccaattgtcgcataataaaacgatggtaattgacacctaaaataaacgaaaaatgatgggaatggagaaatgtgactttggtgctggcaaaaaatgtaattcattgccgaataaatacgccctaattgccatgactcatcggttcttttgcccttttctttatttgcaggtgttaatttaggctgtaaaatacaaatttattggcagtcaaaggtttctgaaataccaaaatgtaagtcatatgaaatcgaagaaattcgaaagcgagttgatggtaattggccttcagactggcgaaaaacagcaaattgttgaaagtatgtgaacttaatggaaaatataaaatgaaaaaaagaataacaaatacccaacctaaagtttttggttttggggtgcagaaaagcgtagctaacgacgtgaagcatttcttcaaattctccagcagaataaagtgcttcagacaatttgaaagcaaaatcatggaactgaaaaagggaagagagagcatggaaggagataaactgtcaattttgtggttttggcatttctgcacgcgttatgctttatttatgcattattgctcacttcattggggctaaggtcagacaattgtcgatgagccgaatgcgcaatttgtccaaggcgtttaaccatcctctccagagaactgcccttgacagcttccaaagcatatttctttaacgaagaatgaataatgttgtctaaaaaattgatttcatatggtttttgatttaaaaaaatccagagggaagagcttaaactgtacgtatacttgtagtactcccataaacgagttcccatacttttaattgaaggaccaacaaaacacact

SEQ ID NO: 18252 - DNA, 1934 bp, Heterodera glycines
  misc_feature (1825)..(1825): n is a, c, g, or t
  misc_feature (1922)..(1922): n is a, c, g, or t
atggtagcagaaaatccatcgtaaaattggcaccagaatattgggcacaatttcacggaataattgctagaaaatgctctattttttgctccttttttacaaataataaaaattttttgaatatattttggcaatgtcttaaatgccaatttgccctaaattttttggcaatcttcaaaatttgtgagggagttggtacagaggggggcggcaggggtggaggatgagaaaaactcgataatgacactttcagctaacattcaccacccccccccccccgccccatacccaccgcccctcggcgggggagcggtgggaggtgcgcggagagagcgccgcgccgcccgccgccgggccggcgcatcatcggacggtcggcggatcaccgacggacgacggttgagtgaaccgccgccgagcggagctaattggcgcccagcaacagcagccaccaagcaccatcaccaccatcatattgcatcagtgaatatagagcgtgaaatacatgatgcactttagacacggttgtgtgctgattttttttttttttgaggaattggccctcctcaaattttggaaaaatttggcaaaaaagggagtaaattttaatttttcataaaaaatttcatttcttgggtgatttttcctcgatttatatttttttttgtgaaatttcattgatataatcgtaaaaatgcttttttaatgtggttgtgtgctgattttttcggtgaattggccctcgtcgcattttgaaagattgacaaaaaaaaaagcgtaaattttaatttttctaaaaaattttcatttcttctacggatttttccctgtccttctctccccacctatcgcagttttgtaccctgcaattcagaattttggaaataacacttatactcgctgtatatcaccttacaaattagcatattttcttgggcatttctttgcgtctgtctacaccggagcatgtgttaattatttggaattaacgttggattagtgctaattaccctaaatttagaaaataaatgagtcagttggattggattgattttgtaaaacaaaaaaaaaactatttatgtacatttataatattgcggttctgctgtaaaatggagcattgtgaggagagggcgaggcatagcgatcaaaaatttaacgatcacaagactcgcgcagctgcgagtggggggtgagagtgaggttgggcagaggttggcagcgatagccggcgctagggggtcagtgtagaatggccaatttagtacgaggatcgaaatctaatacagtaagtatgtacggtatgagggtagtttcgaatattcattgcagtataaggctcattttagtacgcaaaattatggtattaatctaatacagtaagtatgtacggtatgagggtagtttcgaatattcattgcagtataaggctcattttagtacgcaaaattatggtattaatctaatacagtaagtatgtacggtatgagggtagtttcgaatattcattgcagtataaggctcattttagtacgcaaaattatggtattaatctaatacagtaagtatgtacggtatgagggtagtttcgaatattcattgcagtataaggctcattttagtacgcaaaattatggtattaatctaatacagtaagtatgtacggtatgagggtagtttagaatattcattacagtataaggctcattttagtacgcaaaattatggtattaatctaatgcaataagtattgtacggtatgagggtagtttcgaatattcattgcagtataaggctcgttttgtacacaaaattattgaattanaaggcaagtatagtaagaatttttttaatgagagtgaatcgtattgtagcgcccacccaaaatcgaaatgaaattttggagaaaaaaaaattgtttntggtcaaaaatg

SEQ ID NO: 18253 - DNA, 1726 bp, Heterodera glycines
  misc_feature (244)..(245): n is a, c, g, or t
ttttatgtaggactttttatatgcatatttgcaattttagtgcaaaatttacatgcatattttgcgattttgcatgcatataattatatgatctattcataaaaacattactgttttctcaaaaaaaaacagtagatgatgtaccaatacaaaaaaaaaacgcaaatgtactgtataaaaaagagagtgagagagaaagatgaattttgaaaaggaaagatattatggaatgtgttattttggnngtgaaggccctctcattaaatttccgaaactgcttgattgattcatcgggcggcccaaaccgattttgcccatcgccgaaatgatgacgggccggcgaaaatagtcaaacttttcgatgattaattacatttggtgtgggggggggggggtgggcgcattgaaattatatattatgtattatttcaaatatgaaggaccaacaagtttttgtcacccaaaatcatgggatcacgagaaatgtgttgaaaataggaggcccgacagttagagaaaaagacgagagtcgacaaagtttagcaaaaacatactagcaaaaaaaaaaatggcagacagttagagaatttagcagtgtcaagagagtttagcaaaaaatagaggacagatagttagagagtttatgggaatgtcgagagagtttagcataaaagaaaaggacagacaattagagaatttatgggaatgccgagagagtttagcataaaagaaaaggacagacaattagagaatttatgggaatgccgagggagtttagcaaaaataaataaaagggcagacagttagattagaggttgtcgagaaatttttcaacgaggtacccaatattattaaattatggtagaaaaaaatttcaatgacatctttttggacgggacgaatgcctgcccccacccatctcccaaatgatggatgttgtttttatcagaaatttatcattaacaatttttgagcgatgtctgctgatcagcaccgcctatcaccgccacaattaactaattagccatacggtaggggggcaacgccgtaccgcaactatgtcctgatcacaccaaatttgggactgactgcagcctatttcttttaaaatagcgatacaatttttggcatttgtcttggctccattgtgccctaatttagtgattttttctttttggcacagacttcaaaaataagtcgaaaccctagaggtgttatggtgacacagaccctaaaatatgaaaaattggcatatatctcaaatgatatgaatatatatgcagagagttccaaaaatggcaatatacaatattgatcaataaaattagctaaaaaataatattgttaaattatggcaaattgcaaaaaaaaaaaaatatatatgtcaaaaggccattaagctgatgaaggctgctcgaatagaaatttttggaaatgtcaaaatatggacaaattggacataaagcgcgaaatatggaaactgatcccatggtcccataaaatttttcaaacctactcattttcaattcacaattccgtgaaattctcacagtaacataaatatgttattaagtgaatgtgtataaatgcaaaaaggaagaaagaagtgaaaaaaagcatttattattattttaaaacgtgataattaattaattttataatcagtttgagaaaatgttggtcaagaagaaaaaagagaaaattctcttttttttccacctccgat

SEQ ID NO: 18254 - DNA, 2183 bp, Heterodera glycines
atattcactttttttttgaccctttacttttccttttttaattacatcatcctttcaattttaattaaagtacttcaattacatcttttttctgccttttctctgattttcacacattcattccttttttttggcttctcccaaagcttattttctgcatttccattaaaatttcatcgaattatgcattgtcatttattcagtaaaaccaattttggcattaaaaacggttcaacatttaaccagttaggcatcacataatacaaacaataacaaaaaatcacacaatggctttatgccttcaaattcacaattcatttttgtcactaagcccttggcacatagtcattttaagcacacagcgttacctgccattttcgcttgacactaggagcacacagcttcgactagtccatggcttacgctcatttcacccattaattggtctcttttctgggagcacacagcttcgaccagtctcgtggcacacagccacaacggcactcagcccagctaggagcacacagctgcgactagcttttatcttttcatgctcaaaaccgttgcacttatcctttcgaaaacagccaaaatcacgaaaattaacatattatcacattaaaacacaccgcattgatcaatcaatgatcacaaaatatgccataaggtttttgtattaccgtactcagccaaattagccacagaaaatttgccaaatttcttttgcaagacaatgcatttttgttggctcatttgcgttttactgaaaaatagcaatttcccattgctttagtcctttttttttgttgccaaaacgtactttaatttactcttcctatctccaacaaggaatcaaaatttaaccagattaaaactgcttttgggtctgcgtccctttttaagtctgcattgttcaaattagtctttaatagcctcagacactttttgtctggaatgctctggaattttaattctctctctctctctttcttcaaaagaaaatttcacgcgggtcgtggcaccaaaaaggtgttgtgtccccgggtttaaggcttcaagccatttcaaattaccgttttaggagagaggaatttattataaggaaaagcattgacaaataattatgaattgaaaaccaggaataagtttgagtcaacaacaacctcagagcattttgggtgggtcagtgcaattggttatttgggaaaggattgccaaaggcaaggaatgacacagactgacccaccgcagacatctcgcagcccccgagggggaaattggatggacttatatactggtacaatggggatggactttggataggatgaggggtaatgacggaaaacacaaaagggaataagagaaatggatggcatatgcaacagaggtgaataggaagaaatggcacgataacattggaaatgagagggataggattggcttgggatgggatgaacagatggataagtttacgacgggattggtcgggagaaagtagggcaatgtacattatgcacaaaatatgaaattttgaatgctgcggatacagcatttctctcctcctcgaaaaaaaagcctcctggcttttgcctcatcacttctgatcagcttctcgcgtccatcgttctgatcagccttcgggcgcccattgatgaacatcatcatccgctgccgttcagttgaacaagcttcccatttgcttcattcacttatgtcattttctcttgacacccatctcgggttatttcgctttcacgttaatggcaaattttgcttttcctttcttcaaaacagtctccggttttttaatttttaatcttcatttcatagaagaaaatatccgcttacttcttacttttctttttatcaattttatctttgcatcaattttctcaaaatgtgctgctttaccttttcgaaggttttttattccaaaatattcactttttttttaccctttacttttccttttttaattacatcatcctttcaattttaattaaagtacttcaattacatcttttttctgccttttctctgattttcacacattcattcctttttttggcttctcccaaagcttattttctgcatttccattaaaatttcatcgaattatgcattgtcatttattcagtaaaaccaattttggcattaaaaacggttcaacattaaccagttag

SEQ ID NO: 18255 - DNA, 2172 bp, Heterodera glycines
tccatattcttgcattgttttggtgtcctcaagcgcaagaccaaatgtgttgttgagtctcagtgtttgtagagtgagattaaagcccctcccagtatattttctaatgttatccatgattttctccttcaatgttgccacactgtccgtgccctctatgtcatcaatggtgattgttttttcttgaacttgatcagaattaactataattttaatgccaccagtgggcaatggctttatcatcagcacaagcattgtcaatagacaagcagcagcgatgccaacggggaacagtgacatttttggggaggatttagtggcaatttgaaggcaaatgggagggtgtaattaggatgaatgtgcgggatgtgaagaactgttattcatcaatgtcaaaggcagccttttatggagcagaattctgctcaaacattgtattttgtagtatataaatgtagatgatcatatttgttcgtaaaatgaatgaattttaaggatttacatccatgtgtgtaaatgaaaatcataaaaaatgtaaagcaatattatcattgaattggtcgataaaagtaataaaatgacaataataataataattattattattataaatttgtgtatcacaggtgacagtttgcgggatattccggggtgagaataaaactgggatttgcgacatacctaaacattatcatctttcactcatcaaacgaagaaaagttatggcctaagaaactgatgatgaacatcgattggacgattaaacctcaaaaccatttttcaatgaaaatctgttaaaaaacggttaaaatttctattttttctcccgcgacgcctatcggcacagccgagcccccaaaaactcttattttttcataaaaaattggctcaaaattataaaaaactagtcattttggtgaaaatatgttaacaaattgcactcaaatgttcaaaaaaaaagtgatcacatttgttcgtcacaattctgatttctccataaataattgtgttttgtagcataaattatttaaagatttacttcaatggatcgaaatagaaaatcataagcaaaatgtaaagaaatatgaaaatgctcttttataaattggattggtcgataaaagtaataaaatgcaataattatattattaatttttctatatcacagctaatagttacgggacattccggggctcgaaaaagctgggatttgggatgtcatggaacgtcctgctgctgtgtatcgagtgcggagcgaatgggacacggactaataaaagaagaagaaatttgtaaatttactaaaaactctgcagttgaaattttcaaattttacaaaaagttcaataaaattgaaaaaatacactcctaaaatcaatttttcatatttacaaaaagatttatttttatttcgaatgatgaaagatgccaaatcgaattgttcattaattggtcatttggatttacgaaattccttgctggaattattcaactgacaacttttctatttataaaataattttatcagaaaaatgaacagttttaccctcgaacacctccaaagcaaaatttcatcaaatacgtcaacatttcgctgttttggtttacttcagttgggccccacacatttgggctctaaataaatcaaagaatttttcaaagttccaaaaaatattttattgaaaataacaaaaaatgttgacaaaaggtcggttaacataatggtgatcatcgttgttgggaatgtcggcgtaatagttctgaacctttgcaaaattctggcatcggcatgatacggtattttttcgttttttgaggcgaggcggctcaattccttattgacttgtttatgattgcaaaaaactaccaatccagcatcggttacattccggtaaatttcggaactcaatccaatgcattgactgcctttgtgagctcgccaatcgaaacaaaagtaatcgatgtcagcatttttgctgactcagcaagaattggcttaatattaaaacgtttaaaatgaataaaggttgagaatattgaatttcaaaattgattacaacctgaatcaaattttgctctcccaactttttcttcatgttacgcacaaaatgaaaaaaacaaaagttatggcgcaattcccattgaataaattttgtatgccattctcagttg

SEQ ID NO: 18256 - DNA, 1669 bp, Heterodera glycines
tagttaaatttgaagctgaaatggttcgtcatcaaaattcaactccatcaatccccccccccacattgattctctctttttcaatgtgaaatttgtagtaattaaatgcaaaaaaaaatgaccaacattcaatttggtggccacgtcggacacgtaaatgcgcgaatatgtcgtcgaaattttgcgaattgcggtccgaatgacgctctgatggatgcgctcgacaagcgcagcggtgcggtccttcacaaagatgggcccgtgctcgcgcttcgtctggtcaaagccggccacgtcgccaaggcgtacagctgatgagggctcagcaatttttgtacattttaaaaaagaaaccacaccttttctttttaggaggggggggggggggggggggaaatttatctaaaaaattgttgcccttggaaacatcggactctaaattttcgtcgggaatggatgacaattagagacaacccggactcaaatgtccaaatgtgcgtttccattcgccgcgcataaaaccaactttgggtcagcagcaaatacggcgccaacacgtggcgaagttcggccgtgtggaagagactgcgctcggggatttcgccgatgagcaatttgaccagcacgacccatttgttcacctgcgaacgatttggggaaattaaagcccaattgaatgtggcatttctgcttgtgttcacttcctgtttgaagccgacggcgccgttttgtggggcctttcgaagtgcgacctgagaaatatttggaagggaaaacaatgcaatttcaaagcgaattgtttgacccaaattttagatgttacaaaaataattttactttttcaaattttgtgtacaacccttaaaaattggctcgtgccaaaacctcaaaatgtttctctgccgctttgtacgtctcggcgtcggtgcccttcaacgcttcgatgcgtcccaaataataaaaccaccgggcccaatcgctgttggaagccgactcgggcaaattcttcaacgcctccacaaaatcctgggcagcactaaaatgaaaccaccgcttttcatgcaaaaaaatgaatttataattttaaatgtctattaggaaatgtgaatttgcttaaaattgtgaaacctgaggttgtcgcagttgacaaaaaaggccaacactttgaccgccaaagtggcgctctctttgttgttcttctccgctttaagcgcaatcagtcgctggttaagttcaccaaaactaaatttacaatttttaaacgatcggattagtttaagaaacaaaatgttaaagggaaagcggacaaggaatccattttttaacaaaagtcgcgccgcgcacctttcgttttcggtcctttccatgtcgacgtcattcgccccattgacgtggttgttgatcattataacaaaaaaatacttcagacagaaatactaagcaaaaaaaaacaatataacagagcaaaacaatgaatttttaagcaagtacaactgaaaatttttgattctcgggcaacggaaacggaataaaattgatgattttaattttagttattttttggcgtaatgtttgttgcatttaatttaaattcaatgaaaaaattttaaaattaaatctggaatttttcgaatgtacgcgtaagggatacaccgctggacatctaaac

SEQ ID NO: 18257 - DNA, 2645 bp, Heterodera glycines
  misc_feature (24)..(24): n is a, c, g, or t
  misc_feature (40)..(41): n is a, c, g, or t
  misc_feature (70)..(70): n is a, c, g, or t
  misc_feature (2583)..(2583): n is a, c, g, or t
aatataaatgatatttatcatttncatcataattattatnncagttaattgacaaaaaatgctgggaaanagttggacaaaagtgtcaaaaggttgcactttcaacggcactaagctatgcgtttggcttaaacaaaaatacttgtccaaaggtggcaaacccttgagcgactgttcattttgcaattcaatttccaactggcgttgcaacaacaaaattccaaacggtttaattgaatttttattttgaggcatttcatttgaaaattttggatttaaagagattgttgtgtgtttgaatggaacagtgaatcatggcgaggaaaatgacgaagcattcaccgaaataatgtgaagaaattttgtgggaggttgagggaaccatattagcattaattatactaattatgtaaattcaaagagggcaaattaaggtgtgaagatgcgcaatgcttctcagtgcgttgcgttgggacggacaattcgacgcttttccacaccaaaggatgtgttaccatgaaaacattgtggactgttagactgccatttaatgaatttggactaaatgaatgccaagcgatgaatgggccgacggagcacaattcttgtgatgggaacagatgcaacggacgcaatgaaaaggaaagcgtaagccatgcttttaaagcggactgacagatgagatttttcgattgtttttgactttatagagtcctttttaaagttgaatggactgggacggcattcactgttattgtggtgccatttttgaaaaaataaaaatattccctctcccaacatccgagcccagtcggtcgggccatgcccaactgaaaaacgagtacaaagatattatttaataggtaattttaattaggaaaattaaatttgataaaatgcacaaatttaattatataattttggttctttacggcagcataattaaacataaatttcccatattagtcatttgaagcaacaaccactcgattcttcatccattattatcgaatgccattgccgtccgtcgctttcattcattgcgcatcaccacgttgtgtaatgttctcctcccgacggcactgtcgacgacgccttcacttttgtctggtctcctccgagcattgtcgtcgtcttcacttttgtctgggccccgcctcgttccattgttgctgttgatggcgctggtcgtgatggtccaattgagcgtaagctttccggcatcagcattcgaaataagaacggctgcttcgtcttcattgttggcatcttggacatcattccgctcggcaccgccgtcatcgcaccaccaccgcttcttcctccacgaccatggccagcagctgagggcggcggccagtccatcgaatccgttggtccctgccgcgatttgtagtaactgcttggcactgatgtcgaaagctcatcgttgtcctgctggccggcacggcgtttacggcacaaacagcaaatcacaacaatggcacacacaacaacgaggctgaaaagagggggaaacaggagaatgattgtgattgatgatggcattggcaaaatgaaagccctggaaaactcacacgagcaaaacagagacaccaatgatgatccataacttgacactgaggccagcaaattcatttgtcgaagtcgtctcatcggttggtttcttgtgcttaacacgagtcgaagcgctggaaaaataggaaaatcagaaaacggaattgaggcggctctattgcatttttctcgacctttaaaaaattgcacgggaaataaattaaacggaatttaaaaactcgtttttttcacatttgtttcttttttttaaaacttggagaaaaccgaaagttttaaggtcgtggaaattgcaatagaacatccgccgttgggctgtgctttttgtttacccatggcaacagttgaaaacgatcagagtaatgaacaacagacggagggcattttgaaggacagtggaggacatagtgggagaaatgtgaatgaatgaatgttaatgcaaaaaaatgggggagacgaaggcgcttttatagcggagaaaaaagagatttagcaaaagcaatttttgaaaaataacggattaaaaagctttttgttcgaattcgggttcggggttcagaattggccgaaatacatgtcatatttttgattagcgagcctgaaaacctcggaaaacatgttttagtatgattttcataaataaaaaaaaaatttgcgaaaaatgtgggaggggaaagaaaattttgtataaaaggacaatttttcacgaatgcgaatcatttgcccaataaatttgctattcaatcctttttattcctcgccattttctgcccaaattttcttcatcgccgccgctaacaacaacgtaattcaatgtcttcgtcaacaaataatgatggagcccaaaacaacgccaaccccaacaacacgcattcgcctgggcgttcatgcaactcgcacaccatggccattctgacgccgatcaaaggacaaccgacggaacaatcgcatcagcaccaccaccaccagcagcagcaacaaccgacgcaacacgtgcccatccagcgngaagacatcgcaacacagacggaccaacaagcggacgaagaagcggcgacagcaccagcact

SEQ ID NO: 18258 - DNA, 1821 bp, Heterodera glycines
agaataaatttctgggagaataataaaacatcgaataattcatattttgtacaaaaccaagcaaaagtcagggagaatttgagttcattgaaattgcgcacaattaataggaataggaaatattgtaatatcaaataaaatagaaaataacataaaacaaaatttaaaaataaaataaaaatgccaattgcacatgcaaaatgtcgtagagaagtgttactttaagagaaaacgaagaagagattaaatgataaagaataaacaaggaaaagcggagaaaagagagagagaaagaatcaccggaaggaaaaagaagcgccaaattaagcgatgccaattaatattcaaaaatgatgctcaatttgattaaggaaaatggggcgaaaataatgcaaaagaaaggaaaggaggcgtaattctgagaaaatgaaaaaagaaatccaaagcaagcgaaaaaatgtaataataaaaggggcagagaggagagagagagaggggcagagaggagagagagagagagagagagagagagagagagagagagagaagagagagagagagagagagagagagggaaaatgagaaagggggagagagaccctgccaaattagggtaattgatcgagtaattaacatttggcaatgggttcgttttttcacctgtcgcaccattccaatgcttgtttatccatccaattcatctgtcgtttgtgaatggaaatgtcaacggtccctcgccctttcgtccgaccaataaaaaagtgtccattccgccgtcgacgcctttcacctgagcaaaagcagcttaatggcgaaatgagcagtgattatggcttttacctgtatcctatcgcggtattcgaagtcgtatcggtcgatgagcaaatcgcgagtgtacgaagagacctaaagacgacgaattcggacaaaagcgcacccaaagcgaacttggatacggttttttacgcccgtactgtacattcgactcgcaatgttcacagtgtccccctgtcaaatggtgaatatttgcaaaacattgccatttcaaacgcacccaaatgtcatagtaaagttttgtagttccgatgacaccttaaaaatgtttatttattggaatgaaattacaaaggggcaaaaaaaagaaaacacccacagtgacagggccaatgttaaagccgattttggcctcgaattcgaagttgagaaggtctgaagggggggggggcaatttatgatgaaattaaaacagaaagacaaggcaaatttaaattaatgccgatggatgggtggagaaggcacaacaacaccttggttgaagaaggccaatgcattttgcagcgcaatggcaaattccatcaattggtacaaatgttcgtaggggtgcagggaaaggcgacgccgttcggggttcagcccggaagcggccatgtaacaggggccaatggtctgaagggaggccgaaccgtagaagcaccagcagaacgacgcccaccttgatcttctccacatgggcaaagtccgctctgtccagcaattcgtcaaagtcgccgatcacttcgttgagaactctcagaaactcgcggcccccctcgaagttctcctcgtacatttcgtgccaatttgtaatctgacagagaaaggaatgccttggcacaaaaggggcggggcgaaccgaggcgaacatcactgcggtgagcttgtggttctcgctgtacttggtgttggtcttcaacgactcgaccgcatgttgcggaatgatgttggtcagcagccaatccgcttggtcccgcatcaaagtgcattttggcggtgtccctgcga

SEQ ID NO: 18259 - DNA, 1183 bp, Heterodera glycines
atttgattgaggtcacgctaatatattcataagtgcatttattcaaatgcatttcatttatattatatttttatggtttcaaaatttatttttattaaaatatttctctaaaaaaatttttgttttataatttctattaatagcaaaaaattattaaacgacaaattcccatttatttatgaaatgatgataaccatagattgggttaacaaataatgaggggtttaggttaaatttataattgctttaatataatatttaaaaaaaatctaacttttagaaggccgagaaatgtgcaaaatttcctcatttttaatgatttttttcgctgtttttttgtccgttgcaaaagttgacggaatgagtgatgcgtttaaatctaccaaagaatgggtgaagaaaaaattatcatcaaattcatcacaaccattatcatcatcatcctttcatagaccattattagatacatcagattcttcttcatcatcattttcctttaatcctccaatatataaaagtaataaattcataaataaaaaggtcgaaaaagattaataaattagaaacaattactataatatagataatttagaggacaactcatcttcgtcatccgtatttggaactcatccatttcgtaataaaattaaaaaggaatattttcaaaatttgttaatttaagaagctaaatcttccacttcggcgtttggaaaaaacagtaaaatttaaaaatattaaacaattaattcaaatttaaatttgaagttaaatcttccacttcggcgtttggaaaaaacagtaaaatttaaaaatattaaacaattaattcaaatttaaatttgaagttaaatcttccacttcggcgtttggaaaaaacagtaaactttaaaaataataattttaattccgtcaatttaaatttaaaaaatatttgaaaataataattaaattaaataattgcttttatctaaggtggcaattctgactcgtcatctacatttagaactcagaacatcaatagtaaataaaaactttaagcaataataaaataattttaaaaaaaattttcattcaatattagtttaagaataattaccaatatagcaaatttaaagggaaattaacgtcatcatctgcatttggaaacccgccttttttgataataaaaaataaaaaaaaaaaa

SEQ ID NO: 18260 - DNA, 1004 bp, Heterodera glycines
aactggacatctcgccaactaacacttcgccaactggacatctcgccaactaagccaaatccggacgtttcgccaactaagctaaattcggacgtttcgccaactgacatttcgccaactaaactaaaacaaattttttagtcatatattgattcaatgataataaaaagttatataaatgtgtatatgctctcttaacaattcagagtagtgaattttctatttcttgggtcagagaatcagaatcctgtgtacatttcatgtcagaacagaatcgaatgagttgtttttttgcaggacacgatgatacatagagattctgaattctctcatcaaagaaatacagtcactgcgatgaattgataagtgatatgataagcagaaaaataattgagcccctggttttcatagatacacatttgcatgaaattatattactattctctagcaaaaaataattttagagtagttggcgaaatgtcagaattatggttagttggcgaaacgtccgaatttggcttagttggcgagatatccagttggcgaaatgtcagttggcgaaatgtcagaattatggttagttggcgaaacgtccgaatttggcttagttggcgaaatgtccagttggcgaaatgtcatggagccgactgaaaccttctttaaattggtagcgagtgtgtcgactaaatttttccaatttgatttagcatcgtacccgcgcaaatacaacggtagaatctgcgcgcattgaacaggtgtccatctgtttgccgtaacaaaaagattaaaagataataaatagttgtgaaaatccgatgctctatctaaagtccccggagtcagtcaatcagcgccaaatcgccgtttttagtcgcttaccgacttctttaattgccttttgtccacagcagcaatcaatcttttttttcttttcctcaaatgttacgattgcccaatcttctcagtttttcttgtcaaatctgttttccctcccttgatgaatt

SEQ ID NO: 18261 - DNA, 2192 bp, Heterodera glycines
cctatttctggggccaatttcggttttgggagttttttgagcttggtacaacctccgccccacctcctctaccgtatctgcccatttttgccttccgaatttaaattataattatttaaaaaaataaaaataaattttagaaggaaaaatggaattaacaatttttgttttgaaatatttagaatttgaacaaaattttatatttttaacatctttttatttccgtatttttaacatttctttatttttatcaatatttcaacattttcacaaaaaaaaatatatgaaaaaacaccccactaaaggtcaaaaatttcagttactctcttagagatggaaaattctgaaaaagaattcgaaattgtcgaaaattttcttgttaaaatataaacaaattttatttgaaaattacttttttttagtttctaaaaattaatggtttaattttttcaataattgaaattttttttgtccatatttctgaaatttttcggcaattttaaattaatttttgtttttgtttttgtccattaccggtgtctccattaatttctaaagaatttttaaaaaattggcacggatcagatgttacaaaatccccccccccccctcgcagtgccatcctgaacatgctgttgaccgtcaaaagtgatctgatcggctccatcgcggtcaccatcgtttgcatggcggtcgtctgttccctgttcatctacagtcgacttggcgtcggtgccattgcgctgtgcatcacctcaatttgcttcagtcagtagtcgtcaatgttttttattttacggcattttatgccattttgcgctttttgtctgtcattcatttcaaaaatcgctttttcagcgctcgtcggtgtactcagttggtgcggcgctgacttggacccggtgacaatggtaagaagctttaaacgctgatcaaaagttaacggatatgggtttgatcattgatcaatttattgcattgatcaaacaatgcgtcagtcatcgattggattacggctatttgatcaactgactgattatagttttcctgccccttaatgacggatcaatgattcatcatcaaaccatttaatctttttggctaaactgattgattgggctgcttcccctgcatcgttttcaccacgaaagaatttttaaataacttttaacgaggacataaaaaaaaattttcattgaaaataataaaataaaaatatgttttcgattgggccatgttttgatcccatcgatttgttcctccgatcattactgatcagaccagttatgattgcttgaattcgtgtgctcgttcaaatgcctttaatgtccccccccccatcaggtggacgtgctgttggccaccggatttagcgtcgattacactgcccatgttgcgcaccaatatcacaccaagaagggcacaagcactgaccgaattgcgcacagtctccatggtaagtaaatgatttgttttcttgacaaaagctctctctctcgagagagagagagagagagttctcaatatgggaaatttttatcttaatttccaaaagcagaaaaattagtttttcaaatattaagtccaacattttaaaaacaaaaatttactcaatattttcaatagaatccggactttcaggattagagaagatttgactcggattggtggatttcgagattaaaaatcctctttttcaggactcctgatccaggtcaatttttcaaaatatacccggatcaggatcagcaggagtcttgaacaaatgctgacaaggtccggtcctgctgtccgtgctctaatattcatgccctcgggggcaatgttggctttcaattgcgactgaattttcattttatcatgatttagtttaattaattaagccccccaccccaccccttattcatgccctcgggggcaatgttggatttcaattgcgactgaattttcattttatcatgatttagtttaattaattaagccccccaccccacccctgttttttttgttgaactgatcattataaccctttgttcttttacagaaatgtgccctccaatgcttcaagccggttggttggtgtttgtttggttgacacgagtgggagggagtcaagggccttttttcaaaaaaaaattttgaaaagggtgtagggcagggatggcacggaattccgacttccgatttccgaa

SEQ ID NO: 18262 - DNA, 508 bp, Heterodera glycines
gttttagcacccacgttttccttcagacgttttggcgcccatgttttggcgcccaaggtcgggtttttaaagtttgtctatgtttgaataatatgaaaatatatattctttggttttctgggtcgctaatcacgaagatggtattcattttgacaactgcgaagcccggactcgatttcgaactaaaagggtttttgaacatatagatcagggattgtatctgttttgtttgtatcagaactgttttaatttggagggtccaaatcttggggtagtgaccaaattttgttctaatttcttcgtcaaggttatgtttataatcacaaacttttttgaaattttaacagaaaaaaaatttttgtctcatcgagactaatcgaatatatatatatataatttatattaaaaatcaaaatttgtagtattcttcaattttaccaaaaaaaaatttatggggttgggaatttttttgaaaattagagtaagcccattggaaggtaaaattttt

SEQ ID NO: 18263 - DNA, 2012 bp, Heterodera glycines
  misc_feature (17)..(17): n is a, c, g, or t
aagccatttgagcaganagtccatttgggcgggtgccatttcggaatgacaccaaagcttaagactaagaaatatggaatcgaagagagtgaattatggtcgaattagttttaaaatttttttttttgcaatttaaatggaccatagcttttctagaagtatccaaatcaaacattcttgataccattcaatagccccaagaatcctctattagtctgctaaagttctaaaaatttcattgtgtttaaaatgtcatggccataaattttcaaaaaattggtttcctaaacatttcgggccataactttctttaaacgcaacagattttactgaaattttacagacgaatagaggactttttggggtaccgaatgataccaggaatgtttgattttgatgcttctagaaaatcactttgctttattcccccgaaacattggtcccccgtcgtgttcatccgcagcagttaaatttggcgccgttgttgttgctttggccaaatgaaaggcgtaggtggaggaaatgtgtgggtttggcctccttttgccatactcacactcttccatggtcatttcgtggtcaccaccagccgatgactcacaatcagacgacggcaattgggcggaacggaaaactgcagcaaattctgagaaaaaaacactttgtaaataaccatttacatattttaaatttaatacttacggaggtcgaccccctccccctccactttgcccacaaagtgcctcaaaacggataccccccaatttttctttaaaaatttttcaaaattgcaaaatgtagtcattttttggacaaaatcattaacaaatcggaataaaaattacaacaatttttcccggctgcggcgccgcatctccctgttgcgcaaaagttttcggaaaaagtgcgcccccaaaaaaggcagttttcaaaagcaaaaaataaaaaaggttgtagatttaaatggccggaccctttgcaaaattggccgctgaccctcccccctcccttttttactgtatgatctaattagtagtaatttgtaaatttaatctgcccccttaacctttttgtccatctccgccaaattcggctacctcaaagcaccggtcgttgaaagtgctgtggaaatgactcttcgggatcagttgcaacacggtcggactgcgccataattttgcaccaaattcggagggaattgacgacaaattggcaatgatttgatcaagcagctcttgtggagcattttgccggtccacaaaacgcgtgcacgcaattcgacggttgacactggcgcaaaaacgccaccaaatttgggccaactaacaataagcgcaactttacattttaatgctattatgctaataaccacttaaactttaaataatttgcaatacttgtgaaatgacgctggcacatgattgtgtgagccaaaattccgtttcagcaataattttccattcgaattcagacgaaaacatcggaaatatcgaaacaaatacaaattttcaccaaatgtcgaattgatgcaaaaaagaaatgtgttatgccacatataattttggcacgacgacatttcgcctactcacctaaatcggacattttgcctgagatattattattcccatccctgttgtgttcccacagctccaccaatagagatggattttacaatggaagaggggagggaaaggggtcggggtcactttgccgcggccactttggcgcggtcgttttggcgccctatataaaatggcttttttggcgccgtaaaagaattttttaaaaatttcaaaatttagaactaaccctgtcaaaatcaattttttcctgctgtgcgctacattatcgatgtaattttgcttaaaaaataaaatttttatttttgaagtcttgtgtaccatcgaatccataaagaaagacaaactaaaaattttttggagatttttcaactctggcgccaaaaaagccattttaaatagggcgccaaaatggcccgcgccaaagtggcc

SEQ ID NO: 18264 - DNA, 713 bp, Heterodera glycines
ttttgccccaaattttcaaatttttaagcatttttgaccgtccttttaagcattgaactccttcttctgctggcgctgcttccaccccctctctaagctggtgtttcccgttcttctgctctccgaggtcaacaaaaactctttctcgctctctttttctctatctccactctctctccttattttctcacactatttaaattttttgttctcaaatggccattttcagcccatcgctctgtccctcttctcctctcttcatcgtcccgtccattcgacgcctctttccaccgtcagcagtttgcctttttttgatatatttcaatcgttcttgacctttgatgggtttattttattatgccattttaagagcaccattttttgaaattatttttgtcaaaatgatcgatcagtcgcattgaaatactgtaagggacaaaccgccgggagaggagtgacgggagggtttgctgaccgcgtgggttccattcccaccctgccatacagtactcttgctcatatgctcttcccacccacccccaacaatcgtaccccttattaccgtatcctatgattgattgtccatttcatctgtgtaaatccccccccccccctcccaaagatgatcgattggatcggaatcctcggctgttctctgatcgtcgctttgctatttgacaccgctctgacccgttcattccgttggatttgtg

SEQ ID NO: 18265 - DNA, 1210 bp, Heterodera glycines
  misc_feature (1204)..(1205): n is a, c, g, or t
gttgcgtgcgatgaataataataaaaaagatggaatcaatgtggcaccccgaatgagtgttgtgtgttttatgtgattttattaattggacaatgccctgtcaaaattgaatcaattcgttccctttgcatttccctttgcctttccctttgtccatttgtcctgtttcactttgtctctttgtccgtttgtccctcaccttccggtgagctcgccggttggtttgggtagagaatgtgttggtgatggccgttgtgatgcgcatccgcgtacagctcagacggaccggcaaaaccatagtagaagccgttgttggggtaataagcagaggaagaagcggtggagggaagggaactgacaaaaaaggcggagggtaagcgaaaaatgataatgaccatgactaatgagggcgggggataggggaaaagtgataatggccatgactaatgagggcgagagtgggggaaaggcattcaatgctaaagtgaacttggacataaaatacaccagttttttaacaaaagatatttgttattaaatgaaaaacaattgctcaaactaggcgggagtgaagccaaaggcatttatttggtgccgccaattgcctcaaatgcccacccatttgaaatcagaaaagccgtctccgccgcggccattgctgcggcggacgaagtgctcggaaacggcttctgatcgaagctgttcagatggtcccccattttgccgtgctccgccaaaaggggaaaagcaatgggcggcttttggtccacggactccgtgccgccggcaaatgcaaccatcagttcggaggaggagggcgcggacgacgaatagtcgcctgcagcagccgaagccgcagccgacgcaagagcgtcgactgaggcggcggtggcggcactgacaatggcggcgtcgagaggggcggcagacatcgaagggggcaatgatcgggcaattagcctggaagggaggcaattagggagtgggccaatctgctggatgagaggggaagggcaacaattatggagggagtgggggagcaaaattggaggagatgggagcaagcggagaggtggggagagagaagagggggtaaagggggaggggagagagggaggggaaagaggaaaggggaagttgatgattgttgagggggacgaacaaatacaatgtgtacacaccccatttatttctctcctgaccnntgcag

SEQ ID NO: 18266 - DNA, 1060 bp, Heterodera glycines
ggggacctctagagtctttattttaattttgcataaatgtggttcttcggcacctactgggaaaaataacggccaaattataattaaaaaacaaatagaattaaaaataaataaacaggaatatctttgttataaattaaatgatttttcttactttttgatttacttatggcaacaaaaattaagaaaagtaaagaatccattgaaaaaatatggaaaataataattattcgacacaattttgaaaccaatgctttatatttaattaattctaaagtcatatttatgaattcaacttaattaattcatgaacatttcatttgttccataattgttgaagcattttgaaatgagcagccatttcatctcctccgtttgttggatttgcaacggtaggggccaattccatggtatttgttggcacatcgccaatttgattttgattcaaatgaaatattttcttgagaagaatgatcagtcgccgtttcaataatgggtggtgcctaaataagaaaagaaatttaaaattaaagaaatttaaaatttttatattgaatattgaaatttaaaaaataggataggattcaattaaaaaaaagcagaatcatgctgtgaaagaacaaatcaagtgccctaagaaatttttttttgggccgtttttaaaagtttttaaacaaaaataacgtaacaaatagacaaaaacaataaggtaaatgctgaaaaatgaggcactcaaatcggaacaactaacaatttggtgactgctctagatataaaaacttgaaactaatgctacaaaaaatcaaaaaaataatttaaatgttgaaaaaaaattaaatttaaattaaattaacgtcataattgtgagttctgttgcggcaccaaaaagtgcctcagtccatatgcccaaagcaaacatgaaactcataatggcgttatcattgattctgtaaaaagatgtggctatgaataaaatatttgcgcctaaatttgtcaaaataagcataaaaatggttggtgaaagttgattggccgttttcacattgtctgagaccttaaa

SEQ ID NO: 18267 - DNA, 1764 bp, Heterodera glycines
  misc_feature (77)..(77): n is a, c, g, or t
  misc_feature (140)..(140): n is a, c, g, or t
  misc_feature (1755)..(1756): n is a, c, g, or t
  misc_feature (1758)..(1758): n is a, c, g, or t
atcatgaaattggcgatatgctttaaatttatggaaattttctcacgcaaattcatacgcacgcaaattttcaacanaaatccagggactacttttgaacctaaaaattaatttgtgagtatcataaatgtaccaatctntaatgaagtaaaaaaagtgatattttaaaaatattttaaatttaatttttgacctttaataaaaattctggaattaaagttttatatgtatgttaaaagccaacttttaataaaaactaatcattttagtgaccttgcaaattttttgtttgagttttaaattaaaaattataacaaataaacgttgctaatatgatgaataatttaatgatttgtgaaaattttatttttttgatattttattgaaatttttttcaataactttgcttaaaaaccaccaaatttttaattcttgtggtcattcgatagtcctaaatgttctatattaaactagcaaaaaatttctcaaggtttcaaaaaacttatgaacattaatgttggaaaaactgttgtgtgttattctggccataactttcttgaattaatgtacccaacatatatatgtttttcacacagagaacagaattggtgggtaacatgccaaaagaaaaaatgtggaattcggaatgaatttttttaggagagtaaataaaaaattttggtcggaaattgaagaatttcatatgaacagagtaattatttttggattgtaattatattttgaataaatattatccactgattgacgacattaagccaaaaaaagttaaggtgcaaattgatgctaatgaaaactagtaactaatcacttcccataacaaacttataaatcagtttaaaaaaatctgtatttttaaatccgtttgattttgagctccaaattaaaataacgccaaagaattttttcaattattttttgaatacaaaattcattagggcattttttgatttttcttttgttttttcaataacattcatttttatcaggaaacttttggtttttctttttgttttttcagtaatatttcagttttagaaggaaatgcaatacctttatttttaccttccacaagtctgattatggtaaaattgatcgaattttttattatttgatcaaattttaatgacaaaaatttggttaaattgacattattggtcatttaggtcgaaaatcagctgattttaagttcacatttaggttgttcttaagaaatattcattttttttttaaatttggcgattttttttgctcttgcactttttctttgtactattttttaaaatttctatgaagaatgtgcctcatgtgccgttaagaaaaatcaagaaaagtaaagaatcattgaaacaatatgggaaataataaattatcctacacaaaattatgggaatttgaaacaaatgctttttagtgttaagttttgaaattaattttttgaatgatcatcagtttttggcctcagaaatttactgagatttggaaaattaaaactgaactcaaaaagtttcaattggattaaagtttaaaaaatgagaaaaatttggcaattttatgttctttttatttggttttcaatttatggaaattctgaaacttgggtcaagattaaattaacaaaaatcaaaatattttacatatttttgatggaaatttttgatgaatttttgggtactcttatttttgagaaaaagttactaaacgacctatttgaaatgcttatttaccgacaacganncnctgcag

SEQ ID NO: 18268 - DNA, 1211 bp, Heterodera glycines
tacacagattcgaacattaaagctaattatgaacgttcgactttctgttcgaattccatcccggcgttcgaaataggtcaaaatggataccggattcgtgatcagccacactcgaaacccctggaagcacgttttcatgacttttgaaaaaaaaaaaattttcatcaaaaaaggggggcaaccatcggcagtattttcccccttttgctcacacaattgccagcaaaaggaatcattgcgacctaacaacgctatcaaaaatgcaaaattactaaaaaaatcaaaaaattcacttttctattatgaatgcatttttctacttttattatggaaatttattcaattatataaaatttcgaatatgtgaaagaaacaacaaatatttttacacaacattcaatcgattgtcccattcaatttccctcctcaggatttccatcaatcgacggcaatttgttttcgccggaagaattactcgaggcagacgacgacgcctgaggtgttgggctcggaattggactaggatcttgattgtgttgaatctattaaaatatttgtaataataataataataattagaaaagatggttgtgtttatttctacaattttgaaaaatggtagtttgtggtttctgcgaaaataattttaaattttataaaattttcgaggctaaaaaagctgaacacgatctgagcttaagcttagcaaaaccataaactgattttttcaaaatttttaaatttcaaaaaattcaatcactcaaaagaatccgctctattttttccatcatcttgcgccacttattcatcgaattaacgaaggttttaatctgaagaacatcccagtccttaagtgtttagtttaataaacaattattaaccccaaaagattatttaattttatttttaatcattctttctttaccagtgaatttaatggcatgagtgtgaactcacacaagtacttctgattgaacttgacggaattcacaacgaaatagttacgaacatggagtcgctgaattacattttcttttttactaacaaaaatcgctttcttatttggggattcccttgtcatgggcaataaaaaataaccagaaatttccaattaccaagatttttaacgaacatatttttgcatgggttttaatttttgtccccatttagcaaatatgacggatcttatcctttttgcaaccccttgattt

SEQ ID NO: 18269 - DNA, 599 bp, Heterodera glycines
gattacgagggagaaaaggacacagagtcacatttgaaaaggtgtacgttgcgttggcctcccgttcctcgaccaacttaaaaggcattgcactaagtcataggaaagggacaattattagagctcttttaaataaaactacattttaaaattaaaatttaaaagtgcttaaatttgctaaataaaaacatgctcaaaaacttgatgggttttcagttttccatacttttgctttccatttgttgcttttttcactcctccgaatcaaatcataaaacaaaaaattagagttagccaaaacgcttcgacataaaaactcgggggcaaattgaagcaattcgttgttcaattctgccggaagtttgcggacaattttaggtttcattagtaaagggccaaagggttaacaaggggaaagggtttccgacaaaacgtcggaaaagcgatcaatctgttggattattctaaaaaatcattttaggtgagagttcgtattaaatttagcaaaatgggaaagatatggtgtatacaaatcaaacttttaaaacaaaaaacaatcagttaaaaatagtttgtaaatttgtaaaggaatcattttt

SEQ ID NO: 18270 - DNA, 363 bp, Heterodera glycines
cttaaatgcgtcgtcccccgtcctctccctcaatttccctcacaatttcgcacttttcggagcgacccctacgagccgattaatccaattcccatgcacaggggcacataattgagtggagaatggattaaaggagagatttgagggggggggggggcataatgggtacaattgggaaggaagagggggggggggacggatgcaacaagcaattgtaagattttgtcccttgcggggattatccggaactccaaccgaaaagcacataaccaattcacatagatgactttctccgaagagggggcttattaccttattattcttatattggggggaggcatatgaaaaactgaagaaagaatt

SEQ ID NO: 18271 - DNA, 880 bp, Heterodera glycines
tagataaattcgcttttttgtttaaaatcctttctaaatccaattaattaattaattattataattaattaattgccctccctccctttcctttccctccaaattcccatctttcacccctctcttcgtccatttcattttcatttcgttcattgcctttgccatatggcgccatccttcgcatcgcaaatgttaagaaaatttatcaattagcgcaaatatttccttttgcctggggaaagtgtcgtaaatttccttcaacaattttttcgaattttaattagcgatcgcttgcacttttctggccaatgatcacataacaataagcttcattcttttccggtgaatttgtgtcattgcttttggggcaataaaaccaatcccttccctcgggtaacaaaagaaatctgacaattagcatatccaccacccaattgctggtgagttgggcagtgaataacgccgggggatggatgaccttgggatgaatggaagtggcgactgagaacaaaagtgccattctttttccataaaaaccaaaccaatcaattacgaaattgtgcaaatttaattccatgggatgtaattatgtaatattgcggcaaattattctgtttttcatcattggtgcttcttttgccgacttctcttcatcgccgcttcttccctgtacaattcgtccatttttttcctcctctgcttgaacatatgtttaatgagggtgaaaccaactgaaaagcaaaaaaaaaaaaaagatgaatcattggacaatttcacagatcaagggcgtagccaggacccttcgtttcggggggggggggggcccaactcaaaaaagtcggtgcttaggggtgtatttttttcgtttttgtaaacctca

SEQ ID NO: 18272 - DNA, 1359 bp, Heterodera glycines
cttcttctttacatacacactgatcgatttgtttctgcagtgcttctcgtcaaaaggcattggacgggagtggtgaggtgactgtgccgatgaccttcacattgcgcaccctccccccccccccctcccccatttcaccaccccttttatccacacgccaatcgccgattgtctgccaccgccaaatagtacaaacaccgccagccgccgttagtgaaggaggagcagttgaggagaacaaacgcgctaaaaacactaatggaaaaattccaccaattttaaaacacaaaaaacagctttaatgagacaaaagtttgtcggttggcccaagacaattaataaatgaaaaggaatgcgagaagagattatgcgaccaatgccgaaagtgacaacattttttgtggaaatttagagatcaatcagtccaatgctccgatcactcgtcactgttatgaaagtgagcaaatggcagccaatatgccactcccaactccttttggcgctcatctcttcccgtaactcataagttgtccatcgtccgcatcaattacaattacggaccgttattcctcgggcgactgaaggccgcgttgggagcgcattatggccgatgccgaagagccatcgacgccgtagagacttcgtctaaagcgatgaagccgcacatttcgagaaaataaggcattcaattcgcaaaattacctccggatgacatttaaaaggcactataataggcaccaaaaaattgaaaaaaaggcatgaaaaggcacaaaaatcccgaaaaggcatgaaaaaaggcatttaaaatgattattaaacattttataatgtttttcaaataaggaaaatttttaaacctaaagtttttgatcaagaaaaaaaatgaaatttggcgatcaatttttgagaaaatttttcaattcttaggggtgtattttctgaaactttttcgggtcatttcttaggggtgtattttcccgattttattcatttttaatggaattttttggaaaaacctgacaagaaattttaggggctggcgggatgcattaaaagggcgactaagatttttcgaatgggtcagacggtaaaaagagatcggaaatcaaatctgttaatggtcatattttttgcttttcaaaaatgctttttttcggcgcaattttttcaaaaactaggaacaaaggggtccgtccgtctatgcagataggcgccgtctgactttttttttttatttattcaaaaataaaaataaccaaaagaaggatgtcacaccttttgactcaattctacaggattaatgtcgatccagtggtgtcgataggcgccgggaaatttttttttgcaaattctaggtga

SEQ ID NO: 18273 - DNA, 746 bp, Heterodera glycines
  misc_feature (26)..(26): n is a, c, g, or t
cgtccggtgtgaagtttcacaccttnggtgtgaaaccggccaccgtccgtagggtttaggacctggttttcgcgcactttgcggacggtaattctcccatttaaaactaaaaggtttgggaccaaattttcgcgcacttgggggagggggctaccgtaataaaaattaaaaaaaaaaccaaaaggtgtggagccgaaatttcagagggttaccgtaatcaattctaattaaaacgaatattttagggaccaaattctcgcgcattttttttttgcggtgggggtacagtaatataattttttcaaatgaaaacccaaagtttcggaatactttttcacgctctttttaggtataattatgctacagaaatgtaaaaattattaataaaaaataactaataaattataataatttaaatttattgccctcagcaattttttggcaaatgaaatatccccccgttccccattcacagcgtctcttttttgaatgtgttggaggatcaatgatgagcagaatgggataagggtcaacgaaggtgggggggagtgagggagagtgcagaaggggaaaaggattacaaaatcaattataaaatgaagtaaaagtaaatatttattctcttcataattatgaaagtattttgatgaattatttttaattttcatttaaatttaaattaaaaattattttcctttttgattaaaagacaattcacttctaaacaaatcgtcgcttccaaattg

SEQ ID NO: 18274 - DNA, 2383 bp, Heterodera glycines
ctgggattcggaattgatcgaaatggatgccggattcgtgatcagcgactccgaaaacccccggaaatttcgattcaaaaaaaggaaatcttgtaaaaaaaaatctagtatttcccagaaaattatctcaattttttttatatttatatcacaaaaacttgaaatcaaattaaatttttttgtaagcataataaaaagctaaaaaatctaagcaggtctaactgatgatgtcaaagagttaggaatgttgagttgacctttttgttaatcggaaaaaatgttgactgtatttaccgtatttcctgtatttgaaggcccccccttggtagaaggtccccctctaatttaaggcccctttttgtaggggttgaacaatagaaggcccccctctggtagaaggccccctccaattaaaggcccctttttggaggggttgaaaatagaaggcccccctctaattaaaggcccctaaaaaagacttcatggggcgatcaattttattaaaaaagaaaataaatttgatcaaaatattattcattagcaacgtcgacagagacatcgctttcatcttgtcctaaatcaatttgttcaagtgctttcacaacattttcttcattgcgacgttggctcaatttcctccgtaattccacatgacaggaaagatttgccgatcagttccttcgagagtgagttccaggcggtgacaatccatgcagatacgtctccattggcggaggagccttcatatttccggacgccgttgtttctttctctccattcaccatccattcatcgtaaatttgcctgattttgtttttaaacggtgcgttccaacacacgtctgggggctaaaataattttccttgatttaaattgaattgtctagtacttgaatgtatttcgtagtaccaccgggaatgacagcagattcaatagataaccgcctgagtgtctgctttgtatcgtcactgatatgacaacgaaagctgtcccaaataagaagccgtctcccgaacgcaaaattgccaagcaccttaattacatacctaatttatttaaaaatataaataaacattcgcacttcctctaaaaactttgttgttagttcgttgtccatccatgtacggccacaccaacacaacactaaatcgttcttaaaacgtttggcaatgtcaggcacaggtctcttcttatgcagtaaaacaaagggacgcagcttcgtcccgtcagatcttgccgtcaacatcaccgtcacccttgccttttcatggcctgttgttagcaccgtaacggacttggcacccttctctgaaacacaatttgcgcctgttgggtcaagccaaactgctgtctcatcgcacgcaaagacaccagagtaactaaaattataatctgcttaacactttttccgcttatcattactttttttcgtgccataatttttgaacatagacaataaaattgacaattgctttggcataatcatcgggtggtttttgtgcaagtgttgttggttttcgcaacgaaaagctgtggcggctcataaagctttccaaccatccatgacttgcctaaaaacttaaaatatgatttaaattactcgaattcttacagaaaaattttccaaatttttgtagttggggctggtttgttgtgcccttgaaaaaaccatggtgcgcgtcacgcgtaacttcttctgtcgaagttcgcgcacccaattcgctagagcatcatcgaaattggcgtctgtcaatttccttccggcaccaaagaggcgcttacgcttacacgattctgtccttaattacaatcaatttaaaaaagtagttaggtatcatagttttacatttttctcaaatttgcttcttctttcttccaacagcgaatgttgtctcggctgactttgaaatgtctgctggcagcgtgaattgatgtcttttttgcgtgttcaatgatgtccaatttttccttgatggtaaatcctcgacgctttcgcgaaagttgtgaaaacaccatatcctcggttgttgctttgctggtagattgtgccgagctaacggcatttgcatttccgtcgatgtcactgtcaccaatgaggtcgcatccgccacagatgacttttgatccgtatcctttttcaccatcgcttgagagtgagcatggtggaatggcgtgacaaggcctggagcattttcgacatcggtgagcaccagacgtgggtttgttgcaaaagcaacagaccttaataaacattattcgagagcaaatgaataataaaaggatgctttactaatttgtcggcgtcgccacatttatttgatgggtccattttataaagaaaattatttaaataaatttgtatatctaggtaaataaattttat

SEQ ID NO: 18275 - DNA, 2430 bp, Heterodera glycines
ttaaaaagcacacatatctcctacctatatctgcatatatgttatagagaacaagagctttcggatgagctattgatatttaatgtagttgggggcattggaattttttagagcataccacgcaacatcgtagttattactgttcgttctttgtttaatgtcaaatctttttagcaaatcgatcgtaaaacataagaatagacaaataatctagcacttcaatcacttattgtttttttcacatcttttttgcagtgcatccgttttgtttattttatgatgggggaggagagagtgccagccccgaattgtctaaaaaggcaaatcattcattttgagtaggaaatgcgcttataaaactttaaaaaaattctttaaagttttttactaattttcagctgattttttttaatttattaaattttttgaaaatttaagtgtttaaaaaagtttttctaggctaaaaacccatttagatttttttaactaaaaattctaaggtcattttccaatttcaacagataagtagcataccattggatagcattttttatgggctttccaatgataccatatttgcatttgtgacataaacatttatttgatttattttaccatattcacaatttgatcaaaatataggtggtcaaaagtgttgtagagaaagaaattaggaacaaaatgtaagggtttttaagagcaaaaaaagggttaactaaaaagttatggagtgattaaaattttttgcattactttttctctctttttggcgtactattttcatgtctctaacacatggaaaaacataaattcgtaaatgctaacaattttggttataagggtacaaaatcgctttggacatttagaattaatagagaaattaatagttttagcatttttgctgaaaacagcagtttaggacttgagttataacgtgataaaaatttgaaagtatcacaacttttttctgagatgtcaaattgcttagcattcgtttagaaaaagattctccttttcaaaatctttttttagataccaaatttgttcagtttagttgagaatgaagcgagttatggcagatcaaaataaaaaatacaaaaaaggcgttttccagtgtaaattttgaaatagcgcgcaaaaatttacgccaaataactgcgtcttggggccaactgcgtctgagccaagtgcgtctcgccaactgcggctggccaactgcatcttagtagtaaaagggccaactgcgtctcagtaaaaaaataagacattttcaacgaaattttaaaaaatacatccctaagaaattaattttctcaaaaattcattcgctagatttattttttattatctccgttttatccaaaatgtaataaaaaggtaaaataaaataacaaaaaattaacaatccatttgataattgctggaaattcccctaagcatttcattaaacaaattcgggttattttgattttggccgtattggtgatcattagggcagcaacttttagtgaaaaaactttttttttgctcaattgtttgaagaaaggagctcaaaaaacgcatttctgcgttaaaattttttcatttggacgtcacttttcgtcactagaaatcactattttggcgacttcgtcactaaaatagttaaaaatcactattttggcgttttgtcactattttttcactatttcgacattttttggaaaattctttaacaaaaatgcaataaaatcaaaaaatacacccctaagaatcgacctaaaaaaatttcaaaaaaatacacccctaaaaatcgagctaaaatttttcaaaatatactcctatgaaatgaaaaaaatttctcaataatttactttcttggcaaaaaatttttaattttaaaaatttttttaggtaactattttgggttttttggtcttaaaaatcccagtcctactcatttgcaactgcaatcagtgaataaaaattattttggcttattttttggctgaaaattatgtcactattcgtcactattttggactttttgtcactatttcttcactattttgggatttttactcactattttagttaaatatttcgggatttttcgtcactaaaagttgctgccctagtaattggcgtttaattcaaaaaatacactggtcaataccttttttgttattgtttgttttgatcagccataactcacttgatttcaaactaaatcgaacgaatttggtatcaaaaagtttttgaaaaggaaataatttttctaaaagaaaatttcatgatttttaatgtgttagagatgtgaaaatagtacgccaaaataagaggaaaatacatatatttttttaattacaagttttactaaaaattgggatagaaaatcattaattccttatacattcaatgcaaaattttttctctatcggtatgcaaaat

SEQ ID NO: 18276 - DNA, 973 bp, Heterodera glycines
  misc_feature (935)..(935): n is a, c, g, or t
  misc_feature (949)..(949): n is a, c, g, or t
tgtcagctctcgctttataacaaatatacaatttaacatcatcagcatataatttaattcttactcctgatggcaaagcatcaggaagatcgttaatatagaccaaaaataataaagggcccaggacagagccctgggggacgccatagcacttttttatttgaggataaagcatcctcaattttaacacgaaaagtcctattactcaaaaaatcctttatccaaattaaaagtttgccccttataccaattttttccaatttgtataaaagtaattcatggggcactgagtcaaatgctttttgaaagtcaatataaatacagtcaacatttttccatttataattgcctcataccaatcttccacaactgttattaattgacttgttgtagacctatttctaacaaaaccaaattgatattccgaaatttttttgttttttagtagaaaattgtaaatatgtctgcttgaaatctttccattaccctgcaaagtgagcaggttaatgaaattggcctatagttttcgggattatttttgtcaccctttttaaaaagcggaaaaacaattgattccttccagatgtctggaagtgaaccagtgtctaatgagatcctaaacaagtctgtaataacagttgacagagaagaatggcaatttttaaaattttatagctaatattatctggagaagtgccatttttgttcggaagttttttcataagattttgggtctcgatgatgttaaaatttatatccgatataaagcattgataaatttctataatattacccaatcatgtattgcttgggtctgtttgacaattattaaacgaattagcaaataacttggcaaatatttcacatttctcagcactattatgatagcatttatcttcataaatcagattaggtatttcaaagggatgacattnaattttggatatanttataaattgatttcttccctttg

SEQ ID NO: 18277 - DNA, 1965 bp, Heterodera glycines
  misc_feature (48)..(48): n is a, c, g, or t
  misc_feature (54)..(55): n is a, c, g, or t
  misc_feature (81)..(81): n is a, c, g, or t
  misc_feature (102)..(102): n is a, c, g, or t
tttataatccaatttctataaatttcatttattgtttatgtaatgatntaaatnntatattaaaaataatcccctatagtnaagaattaataccattctttntaaaccatcataattaaaataaaacttttattaatttataatatttgaactttgcaatcacatcgggtggcaaatccatttgaacctgttcgccccgtaaaacaattttggtcgcctttgttattatttttcttttaaatttaatttttttttgtattgttaatatcaattcagattatttcaatataatgaaataaataatacttctttttattatatcagcttcatttatttgcaaagtttgcgcaattttcattattgaaccccatttttattcattttcaatttaccatttaatttataattactttttttatataattttttagggatgatcgtagctttccgtgacctgaaacgcacgaaaaacatgtttttttttgtctattttggcattttgcccaaaataattttaaaaaatgcaaaaaatataggcctataaataaaagatttctcaaaaattgatttatttattttcttcacaagaatctgtcctttaaaatttatttaacttaaaactgatttggcctattttttttaacttttaataaattttatcattttacacacctaaaaataaggtttttagtgccaattttagggtctttacagtctagagcctatctattttggcagtttttagagccaaaaatttaatcactagtcgataaatgaattagggacggaggcggtgcttaaaagggagtgaagctgcttaataagcaacttggcgtagtcgggaatggagttgtctgtgtcgatttctttggggatttgtagttggtcaaggtcggacagaaatttttttggggcagtgttgtcagaaggaggagaaaaattcgccataaagaattgttaaaagcccagaaaaataagtgcgtaaatcatattctgtgggtgaaacgaatcgatgatgcatgtacgaacatttgagaaatttttagaaaagagcaataatgttaagcattttttttttggtttgccatcagaaaatttttttgcattattatctttgcttctttttttgttcattacatatatgttgtctaacttatttttgctgtttaaattttcattcattttgtagaatacgtgtttaaaaacgttccgttactgaatatttattatttttgcaatcagtttttattttatggtattctgctaaatggaacagacgatgactgaaaacggaacatcaaagcaaattgctgatttggaaatgcacgaagttgagcaggggtcgcgcagcttaccggaaaaccaagaggcgtacaaaaagtgagtttgtaaattggtggcggtggtggttatatttgcatgtcatgaataattattttgcctttgctttagtttcgattgttatttatattttgcttattaaacattgtaaaattaaatgtaatgtttgaattttaactacattatctctaaacagaaacatggacaaaggacataaattgatgttggctcagtcattttacgatgcgtccgttgtgcttcgtaaggcggccaaattttcgtaaggctttgcacgtcaattattttaattttgatatattagttcaaaagaggtggttttggaagcagacgatggggaggccgagcaagacggagacgaggatgacggtcaaatcgcatgggaaaacctcgaagtggcgcgaaaaatttgcgaaaagtgtcgatattttcatttttttatatttaaatgcaaattcagtcaaatgaaaagctaccacgcgaagttatggacggagcgaaaatcggatgtgttggtggctctaggcgattgtatgaccgtttcggagaactttccgcttgcgttggaagaattcacgagcgcactggagattcggaaggtcacta

SEQ ID NO: 18278 - DNA, 2089 bp, Heterodera glycines
atagaaaaaattttggcctgagcgggacatttgagtcccgggctcataactcgttaggggttggttttagccaaaaatggcctaagagcaaaattgtagagctttttaagctctatcgaacggtgtactacatgatgtaaaattttgaaaaattttcgagctaggccccctagaaattttcggaaattttttttcggacgaaaatgggggtgaaaaatattttcctggggtaaaataaggtgctgagtacgaatatgatgtctattttaagtttcagaatttttggaattttttaaaaattcgaaaatatttggcaattttttggccctcgggattttggcctaatatttgaaaattcataactcagttcagatcaggtctattttggcgaattaaagctttaaaaatagcaaaaaatcgggaaaattttatgagatttatttgaaatttatagcacaaaaacaaaaaaagttattccagaaattctggaaattttcgatttttcagaaaaaaattcagaactcggttctgtaaaggtgtttttgaaattttaaatacttaaaaaatccgcaattttttgctctattaaataaattttatttggcatttttatcacttttttgcgaattgttataaaaataaaagtgattttgagattcgggaccaaaggggggtgaccaggatttttgagtggaaaattttttttcacaaaattcttccaaaaatatgtctttaggggttatttgggccgctgatcacgaatacgtgatcagattttacttttgacatcgttaagacctcagaatccctgtgtgattggggattctgaggcatcattttttgggggggggggggtcaaagttcgagtccggacggtgtaacattatttttctatttattttttgctattttcaatttttattcatttaaaatatttttattttattaataataaataaaaaattttcatttgaattaaattattttttggtgaaaattttatttaaaaataataattttttaaattaaagaatttaatgtttttttaaattagaaattgtcaaaaaaattattttcaatacaataatacgcaatcattgtaaattcaaagtttatttttaattaataaaagaaagcattttttaataattttttaaaaaatattaatacattttttaattctatttttcataaaccatttactaattttttaatcacagttgtacctcttctaatctctgtaaggtcaacaaataattaatttgaagatttcttttaaattatttaaatttattttttttaaattaaaggatttcattatttatttttgaatttgtaaaaaaattaattaatttcaaattaaataaatattcaattaataatttccaacgttgtttttaattaataaaaagagtttttattataaaaattttttaaaattaaaatgcattgtatttttaattttaataaaacttttaccttatttatttaatttcaaaccatgttgtacctcttccccaatggtagtacctctcctaaccatggtgtacctctcctaatcactgttgtacctcttttaattacttttatacctcttttaatcacttttgtacctcctttaatcactgatatacctctttgaatcacttttctacctcttttaattatttttgtacctcttttaatcacttttgtacctcctttaatcacttttgtacgttttttaatcactgatgtacctctttgaatcacttttgtacgtttttgaatcacttttgtacctcttctaatcacttttgcacctcttctaatcacttttgtacgttttttaatcactgatatacctctttgaatcacttttgtacctcttttaatcatttttgtacctcttttaatcacttttgtacctcctttaatcacttttgcacctttttttaatcactgatgtacctctttgaatcacttttgtacgtttttgaatcacttttgtacctcttctaagcacttttgcacctcttctaatcacttttgtacgttttttaatcactgatatacctctttgaatcacttttgtaccacttttaatcac

SEQ ID NO: 18279 - DNA, 1243 bp, Heterodera glycines
atgctgcagtcgccgctgctgtacgcccacgcgttgctgagttagggtcgagagcggcatgaaaaaagacaaaaaggaggaaaatgaaacaaattcgcggctttgctctcgcgttggagaaagcaatgcgcagaataactggggagacttagggttaacgcatcaattatttttttcagaatgtgatcggggtacaaaaaatacgggtccaaaaatgggtgtaactccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaactccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaagtgggtgtaactccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaagatacgggtccaaaaatgggtgtaactccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaa

SEQ ID NO: 18280 - DNA, 1567 bp, Heterodera glycines
  misc_feature (26)..(26): n is a, c, g, or t
agactttaaaatgaaatcattctttntggttggcacaccatcagaatatttagcacacctgcgaaatgagcaaatccaatcacatttttcagagaacactcatcagttagaacaaatgaacaaataaaattgacaaaagataccaaccaaaaaggcagaacatttgggagtttggtccctacagcaaatgtaatgcatttatttactttcaaatggacaacttttttattagagctacacctgctgctgctggacctggatacaggcctggatttttcctaaatccaggtccaggttcaagccatttttcggcaacctgggttttcctgctctttgaaatgatttaatatgtatatgtatttcaaaatattttattattgtaaattaaatattttagttgttcctaaatgtttgctttgtaaagtaatttcaaaaaatccaggtccaggccaagctctattttttattaatagattcacatttcttgataaggcccgggttaacatttaaaaagcgaaaatcatcgacttttaacaatatgcaagagtggcacagtccatggccggaaaatggaccagtggataataaatacgtcagtgaatcagaatttcttgaaaaacgatatacggaagttgcgccaaatactgtatatattactgacgtattttcagcgatttaaaagattagatacggtcgtctcggtgtggacaaattcaattgaatccaaccaaaataagtataaaaaggttccgttaaaaaatcacccaaaaccaatttcaattaatctcatcatttttgttgagattcatccaagtagaataagaaccgtaaaactcaagataatcagggtttcaaaggacatcaaattgactcaaaatgggatgtcaaaatccaaggactgataggaaaactttaatttaatgattttaatttgtaagcgagggttatttgttgtctctccatcactgtcgttaattttatttaatttcttttttataatctacgccgacagaaactgggaatcagcagaggctcccaaaataaacaaatctcaaaactttcacttccactgaaaaatccaatcgatcacaagcagaaaaccgaaagcttacgaactttggtgccggaacagcttattaagagagtgagtgaaattttaacaccaaatcttagctccaatacaaaaaatgtcttgggtttactcgctgaaaaatcacatataaaacccaaaagtaaatttagcaaaaattttgttcacataaaatttgcacaagaaaatatgaaacattccttctaaatgcgagggtttaattgttttaccacatccgatgaagaaatgagggtccaataataagagatggaaaactttcgctcacccaatgccggaaaccggctttcttaaaagttaaatttatgaacttgaagctaaggaccttttaagaaagtgccatttaattttttatagaaaatttctgaaaagggcatgcgaatttcaacttttaatcgccgctaatttctctttaccagagaattcggctcgggcgagaaaatgtcgcttatgatgggt

SEQ ID NO: 18281 - DNA, 1626 bp, Heterodera glycines
caagagaaaaaaaagcattaattaagatgtttttgctcgttttttcattttcttttttctgatcagttagggaccgaggccaaaaaagagagaaatttttacattaccaaatggaaaatgttctacacgatcagttgttttactgttcgatatgttcccttgtgagagccacgaattaagaaccacgacgttgcgatcaaaacgaaccgggaaatgggccaaatctatcggtggttgaacggagcgaatgacgtcgaagtgaaaagaggtgaacaatgaaacagactttttacggcattgtaaggtcacttggctgcccggtggccgcgtgaacgaatcgatggattggactttcgaaaccattcgaatgtttcgcaacggttcgaaatgcaatggtcggagtgttcaactccattcttttcttagcaaatcgcaattttctgaacaacggcggttttccaccaaaattggtcttctccaagggttacgtggagagcagtctgagccgaaaaatggccgtaatatttaaaattattggacattatgaaaagtctgtcttttaaggagtttatgctgaacgatttggacttgacggagactgtacgtcgattggaaagcggcggcttcggcatcgacgaaattctgatcccttctctgcacgcttcagatgccattggggcaccgggcggattcactagggaatgcatcgaaagaaaggagggaatccgagtgcagcacataaccaggcaatgagaagccaaacatcgcggggcgggggagtgcctaagtttacatgaattatgccaaagtttgctttccttagggtgtcgatttggtacgacgtgaaaaagtgcggctcgggtcatatgcgacatgcaatttgtattttcggtcagcttttcgatttttaatccatttggtttatcttttgttaattgtacaaaggcttggaggatttgggggacaaattggcgacatggccccatttgtttgccaacaaattgcttcccgaattcgactttggcgctttgctttgctggtgggaggaaatgcaccgacgggcccacttcgagagtcgagaacggtccttgggccgactgaaccgcgccatttacgccgatttgccccatgtaaatgccatctgacaatggataaaatgcatttttccgttttcatttcttaaggttcgtttccaaaagtttaccattgaattgaaaaaatttatcgaagcgcagcgggggacgaaagatggcattcccttcagaaaggcactcgcatttttcaattgctccaccgacgagagaaatatgaactgaagaaaaaattggaaatgcgatggaattgaaatttagtttttattttgtatatttatcttatttattgtcacagcggcccaattttgggctccaagtacaattatgctggatttttcgtcctagtggtctgtgagttagtcaccaaaaggggggtcccaggttcaagtcctccctatgttgtgtgttaattttaatttcttcttttaaagaagaaggcagcattattttttattaataagttttcgtgtcaaaaaaaattattttcaataagagttagttacgtacagcatcgataattttcatgaaattt

SEQ ID NO: 18282 - DNA, 1371 bp, Heterodera glycines
  misc_feature (1226)..(1226): n is a, c, g, or t
agagtcggtcaaagtagaaaaaattaggcccaaagaaagaaataaatggcgacaaaagtcagcaaaagtgagtggaaaatggtaacaaattgcgatggaaattgttggaagagcagaaaaaagtcgaaaattgataaaatagcgcagagagaaacctaaaaattattttaaaaattaatttttaataaaataaatattaaaaaagtcaaagcaccaaaagggaatgggaaaaaagaagaggacggagagaaaagcgcagaacaaccgactgatattgcttatgccaagagaggagccaactaaaggacggattaaatgccaattggcggataaaacattggccgacctcgcggaaagactgtaaaagttcaaaaggcacaaaacggccgatggcacagttaaaagccaaaagggaggcgaaccaaccgaaggatggcaagctgaaagtgaggggaaatgctaattacactaattaaacttagtgcactaactgtcttttcttagtgacagcaaaaactcggagacaccgacaaaaaggggcaaaattaggccgaaggaaaagtgccgcatttgactgaacaaatttaaacaaagacaaattaaaagtgtcaaatggaaaatggcaataataattttattggttgattaattaccaagtttcgctgacattgtgcagaattaatttgcacaaatgaagagaatacaaaagtaagcaggcgaagagagcgcaaagggaagaagccaaaacggaggagagaaaaacgcacggaaactgccaaattggggagatgaaagaaagaattaattacttaattattaatttaaatttataatttattaattattccctttaaatggtttcactcactccgccgttgtcaaatgattgtgcccttctgatcagttgcaccgaaagggcattcagcgaaaaggcgacaattgccgaagaacggagcagacgaaaatggtaattatcacttaatgataaacattgggtgaataaaactatttttgccattggcccaccggcacaaaacaatggaaaaagcaacggcaagcagtgcaaaggtgaaaagtgtgcacagtgtacaaacaattgggatgatactgtcgggagtactgtaatggactcgattgtcagcggagaaagggaaaaactaaaaagtggcgattagcgtataaaacaaagtgccaatgtttgggaccattatgccagatgctttttngattggaaattgctttgaccaacaaaggcaatttccaattggcattgcccggtacaatttggcattgaatgtgcgtccgattgagtcccgccaaagcgacggtttgccaatgaccgccgccaaattttgccaaacattcgtaatg

SEQ ID NO: 18283 - DNA, 1901 bp, Heterodera glycines
  misc_feature (119)..(119): n is a, c, g, or t
tcgttggccattggacggccttttccatttgtgaagggcaccgcccgtcgattggcacgcatttcagcgaacgccgttcaagaagaagcggctgcttaattaatattaattaaatgccncaatttctctctcaaatttaattaattgccgcttccttcaaattttccgtctcacttttctcccaaatttttgttcgcatctgtcgcattggcgtccaatcgcttcaccaatgcattcgcattgccccgtcaggcgattgcaacggtccaaagtgccgggggcagtgccgtagccgcaatggcacggcacgcagcggtgatcagatgctaatattgggaaaaatgatcagaaagagagagagagagagaagaacgaaccattgtcactgatcagaaaagtgccttctcggcaaatgcattggccattggtgcgattgcattgagtggcaaagccattctcaagcggacaatggcatcgtttgcaccttaaataaaattccaatcgcgaatttgcatttaataagacattattgcctcgggaattggccaaaccatccctcggggcattccgagggaacggcgccattctcacagtttgcgcctgtccttccctcgggacaaacacaacttaaaacattaatttatatcaacatttgtaaatttgtgaaattcactcatatcccctcggcgaattgggcgaacggacgcaaatcgcattcggaaaggggccgcaaatgtcgggcagagaacacacgtcaacgcaactgtcgccgacaaagcctaattagggggggggggggggttggggtaattagcaaaggtttaaattaatttaaaaattaatttcaccaaaattgcatttgcaaatgtgtctgtcccagtcgcgcatgcatttgctgttggccgggcactgagtgggagccatttggcaaacattcggtgccaaacaactttgcctaaatgtgctggtcttttcccattcggtctcgagttgtttgtcgagagtggacaattaatttttctttttaccgtgttgccgattggttggccaggcgaagtcgttgcccgttccattcaacgttgcgtaagcatccgaagaaggcggccggatgggcacttgacggaacggtgccggaatggagtgaccggggagtgctcagtgccatcaacggaattgactggacaaatggacaattaattaattcaaatgggttttcggcacttttttgtatagtacatcgacgccaatttccaatgcttcggcagagaaacgcgcctcgacggaatgccaatttccgtcggaaagagtcgccggaaagggcagcaaatactgctcgctgttcactctgatgatgctttgaccattttcaagctgaaattgaaaattaaatcccaatcaaattaaatggaaaaaacaccgaaaaaatgaacatttgggccgaatgctcaaagtccaaagtgatcacttggccttttcgctcgcgggttcgaaattcgaaatacagcgaaaagggcagcgaaaattcgaggggtaagccccaaacggcgaaggaatcgtcggccaaagtgagggcggggggctctaaaagggagaaatttttaaaaaagtaaaattttttaataataaattttttaattttaaattgaccttgcacaattagttgcgacggacaattgagacgaggcgaatgaacgcgaaaagggcagcgacaatggtggccaagccaacggtccaaacagctcaaattgacggattgtatatggaaattgaggaaagagtgtatggaagcaaaaacaatacagtgtccaagaaacgggtactttataagtaaaataatcttttttaattatttcaatttttcatttcccattttaaactatttcatattctattaatattaa

SEQ ID NO: 18284 - DNA, 2350 bp, Heterodera glycines
  misc_feature (16)..(16): n is a, c, g, or t
  misc_feature (29)..(29): n is a, c, g, or t
  misc_feature (83)..(83): n is a, c, g, or t
gtacttcaattacctnttccttcagcctnttctctgcttttcacacattcattcctttttggctttctttcaaagcttatttnctgcatttccattattcattcgctcgaattggtgcattttcaattattcagtaaaaccaatttaggcctttaaaaacggttcaacagttaacctggtggcatcacataagcaaacagtacaaaactacacacatacggctttgtgccttcaaattcataatgcatttttggcactaagcccttgacacacaatcattttaagcacacagcgttacctgccattttcgcttgacactaggagcacacagcttcgactagtccatggcttacgctcatttcacccattaattgatctcttttctgggagcacacagcttcgaccagtctcgtggcacacagccacaacggcactcagcccagctaggagcacacagctgcgactagcttttatcttttcatgctcaaaacctttgcacttatcctttcgaaaacagccaaaatcacaaaaattaacatattatcacattaaaacacagcgcattgatcaatcaatgatcacaaaatatgccataaggtttttgtattaccgtactcagccatattagccacagaaattttgccaaatttctttcgcaagacaatgcaatttgcgttttactgaaaaatagcaatttcccattgctttagtcctttttttgttgttgccaaaatgtactttaatttactcttccaatctccaacaaggaattaaaatttaaccagactaaaactgcttttgggtctgcgtccctttttaagtctgcattgttcaaattagcctttaatggcctcagacactttttgtctggaatgctctggaattttaattctctctctttctctctgtttaacaaaaaaaaaaatttacacaacgggtcgtggcaccaaaaaggtgttgtgtccccgggtttaaggctttcagccatttcaaattaccgttttaggagagaggaatttattataaggaaaaacattgacaaataattataagttaaaaaccgggaatatgtttggctcaacaacaacctcagagcattttgggtgggtcagtgcaattggttatttgggaaaggattgccaaaggcaagaaatggcacagactgacccaccgcagacatctcgcagcccccgagggggaaattggatggacttatatactggtacaatggggatggactttggataggatgaggggtaatgacggaaaacacaaaagggaataagagaaatggatggcatatgcaacagaggtgaataggaagaaatggcacgataacattggaaatgagagggataggattggcttgggatgggatgaacagatggataagtttacgacgggattggtcgggagaaagtagggcaatgtacattatgcacaaaatatgaaattttgaatgctgcggatacagcagtcagttttaaaacgaatgaaacctaccaaatgaaacccaacaaattttatttcatttctaaaacaatttttttttaattaaaacaaagtttctttttgttatggttggtcctgtttgtttctgttttacgcgcacgtaacaaacttcaaactcgtagaaagaaaattttaaagaaaatttgtatttggcaaagaaaaataccgtaatgtaatttttggctcagatttaataaaaaatataaatcccccattcattcgcacacagaatggtgaccgaattgaggcccagcgttattacgagttgagggagaaggatgtgttgcggttcgggttcagctcgcgtgagtatgtgctgttgcatgagcattcagcggcggccggcgtcgaagaggcggaggaggacacttcggccgacgaagggaggaggacgaagtgatggacggattggtggaccggacggggggcgaagagcgaattgcggcggcggaggaggacgacctgttctgataacgatgataatgatgtgatcagtgatcagagttaaattcgaaatatacaaaataaaaaaaacaggccatattttcatacgcttccaacttgtataaagttggtctccgaaaacacaaaaattgtgagtggcgaattcgaacgattttttggtttgttagcaaagggccaactgaagcggctgttcaattttgtaattattttgacaattttttcctctgtgtttactgtgttatttatttatttatttttcttgtgccttaaagggtaattgtcgggtggaattagcgaccggcggcgcattttgttgacgacgacggcctattggagaaattgttggcatacggtagagtgttttgtttttttc

SEQ ID NO: 18285 - DNA, 2503 bp, Heterodera glycines
  misc_feature (2394)..(2394): n is a, c, g, or t
  misc_feature (2413)..(2413): n is a, c, g, or t
  misc_feature (2452)..(2452): n is a, c, g, or t
  misc_feature (2472)..(2472): n is a, c, g, or t
  misc_feature (2487)..(2488): n is a, c, g, or t
aaaaataatttctcaccttgtctgatgtgaattttgtccttgctcttgtactcgcaaagtgccatcaccggcagcggttttgaaatgggttcgccacgttgccaaagcggtgaaatttgggcacaccttgaaaaaaaataaatttaaaaaatgaaaatgccatgcaaaaaacgtgccaaaaaatgttaggcttttgctcacctgtcggtcagtgaaaggagtcgcgcatgcaattgttggatgtattcacggacagagtcaagctgtcgcaacatctgttcaccatcgtccagcgaaaaatcagtacgagaatattcacgatcaagatggtcctggaatggagtcaattgcgataatttaggggcccaatcatttaaataaattttaacggtttggattttggcactttttcatatattcagcttaaagaggattaaagcagaaaccatgtttttaaaaaaggagattttgacaaaattatggtttaatgagagaattgaattcaatcataatcatactctttatttttttaatttaaaaaatttaaatttttttcagaatcccgaaattccaaaattttctgagccggaaacccccccccccccgctgacatacatcacgcaaaactgaccaactgttgctgcatctgctgctccacctgctccgactcctccacaaatgccttggcattgtacgcgtcgcgcaggtggccctccaggcacttgctcaggttcagcatccaatcccattggttctgcatggtgcgcaggtacacctcgatcacttcgcccgccgggtggcgttggttgatcagcgcggcgccctggttgtgcacgtcgttgaactgcttctcgtgcagctcaatctcatggagcagctaaatggttcatgatcataaatcattaaatattaatagttgcatgagtgaggttctcggcatttaaatccgagtgaactttgtaattttctactttgaatttttccataatgggatttaaaccattattccttccctcaaatcattttattcctctataaaataatatcattctaaacatatttataagaattttgaaaattaatcaaaactttaggaaaacttaattttgcaattaaaaaaaattaaatttattgaaaatttatgaaattttagtaggtttgactataaaataaattttttcattttgcatccgatgataagttgttgttctccattgataatgccgacgacaaacgaaataaaacttaaatttcgaaaatttgatgactaatcgacgaaattgtcaataatttttaaaagctagatcctgaatctaacaaaaaaaacattttttaaacattttattttccggccaattaaacctaattagtcatgcgccattcgcgcctattagctgtaatttgcgcaaccacctgcttgaagtagttttgcagcatcggtatgtccaggcgctccaagtcgctccagttgcgtgtcacttccaattcctcacgctgatggatccaaagcaattcaagctgagcagcacggatgaaggcgatcagcgagtcctgtgatcagagagagagcattgggctgatcagtagtaaacaggacagaaaatatgatcaaattaagagaccatggcaaaattaaggaaatggctaacgcataatttaattgccctattaaaggacctaattaagcatggtataaagcccaacccaccaaatcgaccatgcgcccggcagacagttcgcgcaactgttggtactccgactccatcattttcaacagctcacaataatcgtatgaatcttctgctgatacttcagcctgagaaagtgaaaagtgatcagagaacgcagacattggaaggaatgaggaaatgattcttgatcatagtcatcttggtcgagattattatatgaaatatacggtagaaccaccggttcaatatcagagatttaaaatattccaatattttgactctaacaatttggaattttgtaggccagaaacaattcaaaatatttttatcacattaatttggtgtctcaccttcccccgatcaaaaaatggattgtaagatcactccaattgttttattaaattatttttggcaattttttttacttgtctggcaatgcattcgtccaccgtttgtcgaaagtcctgaatatcccggttgtccagcttgtgctgttcaaagatttgctccaacacttccagcgtctcgctgaattgcatcgagttcagcttatgctgaaataaatgggtttattaagcctgcgaccatataattaggagtcctaattcacgtaaatgattaaaacactgctatttttatgatcaattcaatatgggggatcagttaaaacccgaaggaaagaattgatcagaccattttttangtctgttaaaccctcgagntgaagtgatcacagcctttataaatacgtcagctcatangaaaaatgataatgatcagntgatatatttattgnngtaaaaatcaaaaca

SEQ ID NO: 18286 - DNA, 2177 bp, Heterodera glycines
cttggaattctgggcaatagtacttagtacgttcctacctatcttttgccctcccttgttgcgtcgtactataaatattgtgcccccttttcctcccttttcattcactcatttttcttttatgagtgttttactctgttttttgtgaatttcataaacttcactgtttcaaaaagacatatttcttatcttaaccagtaaatacccaacccgaattccaaaaattatcgacatcgacctgaaagtttatcagagtttccctggcctatactaccaaatttgaacctaaatttatcaaatttttttacaaaaactgcaatttccctatttttaaatttataattcatttcattatgtattgtttttatgttttttccttttttagaacagaactatttgcgtttatcatcatcatcccttcattgtgcaacaacaacaacacttcaaaagcgacctcatcgccgtttctcatcgttcgttcgttcgtccgtccttcacatcaattcgctcgccgttttcgcaatggcacttcgacgcatcaaacaggtggcgaaatgacaactctctgatcagccaatgctttcaatgttttgatccatttgcaggaattggcggagctgaagcaggaaccgatcacgggttgcaccgcggcaccgatggatgacggcaaagacatgttccactggaaggccaccatcaaaggaccgcccgagtcgccgtacgagggaggcaccttccatttggacatcgttttccgtcgcgactacccattcactccgccaattgtcaaattcgaaacgcccgtttaccatccgaacgtcaacaagcagggtggcatttgtctggacgtcctgaagacgacgcattgggcgccgtcgttgaccatttcgaaaggtgaaagcgacgcgggaaagagcagacaaaacgccgacaaaatattgagacgacaaaacgatccaattcgaaacgaccaccaaaaccggactttttggaaaagtgtcgatattttgtcgtgtgaataggatttttcaaattcggaaatgccgttttaattcattgtctcccctccatttcagtgctgctctccatctcttcgcttctctgcgacccgaatccggacagtgcgctggagatggacatcgcgattatctaccgcaacgaccgcgagcagtacaaccgaaatgcccgtgaatggacgcagaagcacgcgatgaaatgagacgacaaacgaccgatggatgggagaggatacagaagacaaccgccgaagagggaggaggaggaggatacattcaactgaccctattcccatatatgccaactgtatagattgtattattgtatctcactgtatgtacagtatttgtcgcccggttatcgtttaagcgaccataattgtctgttgttggttgatcaccattatcaatgtgttgtatctctgtgttatcatttcaaccaatttgtgatcaattgttgcgcctaatgtgtgtaaataatgtgaagaatccaaagatttgtttgtgtttttgctccctttttcgtgccttttcatgacttattcaattttttggtgcctattatagtgccttttttcccaggcttttccatgctctaaataagtgttcggaccccgaccccgaaccctactgattttatttatttttttaaactgaggaaattctcaagcaattagtgagttttcaagaaaatatacccttaagaatggcatttcttgggataaaaggcaaacaattatacttgtatttttttaactttttaaaccacttttgataaaattttatgtgataaatagggatgccaaaaatatgcacataaaatcgtaaaatatgcacataaaaagtgaaaaatatgcacaaaaaattttccaattgagggtgtaatttctcaaaattactccccttttaagcaaagcaaattgagagaaacaatcaattaatgtgagaaaaaaggaaaaacgacgacgaatgggtcgaataatcaaatgaaaggaatgaatgaataaaaggcaaatgagctgattgtttgttgttttgtagttggccgatgagatgaatgtatctgttgatgttgccaataaagcactttctgtttgtgggaaagtgagggacggacggcacaaaattttgggtaattaatggggggggggtaatgaaaag

SEQ ID NO: 18287 - DNA, 1701 bp, Heterodera glycines
agtttcgtaaaagttctgagcaaaaaattcggatctaagactttttgaaattttatgacaataactttttttacacttaagtaataaatttttaataatcatattctgatatagaacaattaaagctattaaatgatcgaacgaaatattaatttgttttaaattgagccaagctatgaatttatatatattacgcattttttgttttcatacccattggcggatttaggaaacgcgcatgggtggcgtttttaggaaatgcaccagcaccataatatttaaatttaattatttttcaaattttttttgctgaataataaatcataatttatctccaacttagcaaattaaataaaacattaacattttcaaataacaatcaattatttgaataaattcataaatcagttttttcgtgatatttgcgcctatgtgcttaaaatctttttcttatccctactaataaatattctctattgctgatctttttcactactaattgatccgagttcaactgatccccttgcactttttctttttatcatttctgtaattattatttttgttctccctcaattccaattccaattttattatgattttattttcatttgcctttttaataaaacataaaataatttttgttttgtaaatattatattttgaattaacatatttatcattccgttttttctgatcacgatttgatggacaaaatgaatgaatcatcacaaaaaaagaaggaaaagcgatggaaaagcagcagaaattccgatgtaaattaaatgcagaaaatgaattatcagatcagtaacagaaaataattggagagaattaatgaattttgattgattaattaattaattgatatggaaaattaaatgaaaataaataaacatcgtgaacagatatttaaggatagaaggacttcgatgaaaatattaaggcattgaattattagagcgaggcacaggataatcgccttgcggattttgcggatctcaaccaggaattcagattttttaagaatcggtgaaattgcgagaattattaagaaagttcggcaagcaatagtgtatcacatagcatcacggaatagaataagacagcagaataaaaatatgataagaggaataacgctgtgaaagaaattcaaaaaaattcatcatctgtccagcggatccgaacccatgacatatggtcattaaaatgcaagaggaaaaaaataatcaaattaacaaatttttcctgggattttcatttgatcacttttttcagatcatttttggggtcagggccaaaaaaacccgaaaattggcaatagtaaatcgaatatgctctacaagataaaagtggtcttaaagcgatctgagcagtcacagttcggaaagttttccccctgtagaaaattttcaaaaaaatttaaaaaaaaaattttgcatttaatttttttgcaacagatgtgctccaaatgcgcgccattggccgacccgtggcgcactgctcgcttcccgcactgtgagcaaattcgagcggatcaaccgggcgattgtgcgagtttgagcgcacgtcgaacgccgtgcgcgaaatgttgaaccgcgaaattcgactgaggtctgtccgtaaactgattttgttccgttaataccactgcttgcttgctgataattgatcggccttaagatgcttttttttgtttac

SEQ ID NO: 18288 - DNA, 3327 bp, Heterodera glycines
tttttagtgatataactgagtatttcgtaaatttcgaattttgacacaatttctaacactgtttttttataccattttagccctaatgatcttcgaccttttacagattggaaagacaccatttatctttttataattgctttagccccattaagactgttttcgagtgatattaaacaatcggggacgattcagtcagtccctgttgaaaacggacaattcagtatccgattttttacatgaaaaatggcaagggcgcgccctaattcgcctttttttcatcattttggacgccgttttaaattgattccaatcgtttttgagcaattttgagttgggatcacatcaaaccgataaccaaattcttcaatgaaccaattccaaattttattaaatcattgaaatataaaaggacaaatgcaatgaatactgatgaaaggggaactaaaagaattttgattcttttttaatggcgaaaatatgtcgtgccaccggtgcgtaacccatgggttcggacagtctcgggtctgagctccttcttccatttttcacatatttttctccgttttaactattctatgcttacatttaattgatgagtggcgtacaattaactataaattataaatttataaattacaaaatatgataacttatcgaatgtgtttatcggtgcgtgacgtctgaatagcgtcctctcttttaatgagtccaatgaattaatatttgaggacaattagttaatatgaactgtaaagaattcgaatcgttttattcatcacacgaattccaacacaaaaaataaactaatgaaaggagaatttctcaaattttatatcttcttaaatacccatcacggaaatcgtgagaaaattaaaaaaagaagttttatacaaaggattcatgaaacgtttaaaatgtacccaaatattttgtttacattagcaaaatcatgagaattacggttcagttcttaattttttaaagtaattacattttcaaattttaaaacagtggcggtgtttgttggcctcaacgttttttattaagttaagaggactttccattgcgttcaacacaagttgaagatgttgcgattttaatgaaccaattaaaaaaattcgaatactttattttttaatgtctaaatttttaatttcttgtaaattttaacccacacgacaattaaatgtaagcataaaatagttaaaacggagaaaaatatgtgaaaaatggaagaaggagctcagacccgagactgtccgaacccatgggcactgaaaccgtcaatgccaaaaaaacaaattaaggtttgacgacaaaatagccaaaacacccgcaaaatgaacctatcgagtcagcctgtgcatttttttgagaggacacctttttgacaaatcgcaaacttatatttaacttgtcattaattttgtaattctttctcttatttttgctgtcgagattaagcgcttgtataccattctttcggtataaaaagttcaattaattttttcgtctcttcttccctctatgaagaggtaattatttaattccgaatacaaattaaaaatatgaaaaatctattttattaagaaagaactacagtataacaatagaaataaccaatgagacaccgaatggtgaggtagcaattgaaagaggtacagaaaatttggaaattactaaattgggggacctaatttgaagaaattttgctcagttaaattgctgaggtagccaatggcacgtgagcaactttttgcttatagcctttcagcaatttattggccaaaagcagaaggatgaagccgccaatgagcaaagtcaacagaaaagcaacctaaaatacaatacataaaataacaaattaaatggcatgctaaatgatttatcacttgagcccgggcgatgatcccaatatttgagattaatcccacaaatccggtctagcaaagaattttgaattcaagtcccccccccccaaccaaatccgcaaatttgaattccggtctcttttaattatttatgcaaattttattttttttactttaattgtgtccgaaagtgttgacagcagtccattttgggcactttccaactgctcaatgtgacgttcaaaacggcttaactgttcgctttgggcttccaacacagaatcgacctaagcatgaagaaaaaattattttgaaaaaatattatataaaatgtatttatatatttattactctatcaaaatccttggaaaattgctgcccaattctttgcattagagaaattaaatcattggccgaatagtcctaaaatatgatatacaaattatatttcttatggatctatagcttaatatgttataaattcgtcagttggccaactagtgaatgtgtgaaatttatttgaataaaaaataaggtaattgtttacctttttaattgtttgtcaaattattttaatgattacaaattaaactcaacttcgatttaagaaagtcagttatcgaagccggctttgaatgtttaagaaacattttcatggcgggctttggttcctctccaggaactgcttcatttgtttgggttggcttttttcatttaattaattccacttcctataaaaacacagcaaatcaaatgaccttcaatttttaatttatattcattaaaaataaataaataaataaaacaaaggaaagaaatttcgaaggttttgttgtttatttattttcttccaatgcttttaaatggtttcaaattttcaccgaaaattgtgccggaagatttttcctcctacagtaaccgaatgcccaaatatggtcatttggtcatttataaacttatcttttttggttggaccaactcaacttggaccaactcaacaagtgaagccaacttttaaaggcgtgccatttttctgtccattttcagtgctttttcacttgcacggattattataatttaaaaatataaaagtatacatatgcgttcaacagaattaatgaattaattgtggcattgacaattttacgggggaggtaattattaaaataaaaatgaatatatataataatttcatggcttttcatgcattattttttgtttgtttttacatatattttatttataaatgtttgcaagaatatactcacatatgcatatattacatataacatgttaatatacaaaaacttaaagcgtgtctaccaccaagcaaatgaattaatggattaatgaattaattaaatgggtaatttgttttatttttttggtttgcgctgcatttccttgtgatgatcgcccacctcacttaaaataaacggaaatataataccta

SEQ ID NO: 18289 - DNA, 1824 bp, Heterodera glycines
  misc_feature (1791)..(1791): n is a, c, g, or t
  misc_feature (1804)..(1805): n is a, c, g, or t
  misc_feature (1816)..(1816): n is a, c, g, or t
gcgcccgtttctaaattttgttgaacttggacgggcgcttcgcgcccgtatttaaatgttgttgagctcataagaggtacaaaaattgttggaagatgtgttggaagaggtacaacagtgattataagaggtacaacagtgattagaagaggtacaacagtgatagaagaggtgcaaaagtgattagaagaggtgcaaaagtgattaaaagaggtacaaacagtgattagaagaggtacaaaagtgattagaagaggtacaacagtgattagatgagtccaacagtgatagaagaggtgcaaaagtgattagaagaggtgcaaaagtgattaaaagaggtacaaacagtgattagaagaggtacaaaagtgattagaagaggtacaacagtgattagatgagtccaacagtgatcagaagaggtacaacagtgattagatgagtccaacagtgatcagaagaggtacaacagtgaaaaagcgatacaaaagtgattagaagaggtccaacaatgattagaagaggtacaactgataagaagatgttcaacagtgattagaagaggtccaacagtgattagatgagtccaacagtgatcagaagaggtacaacatggtttaaaattaaataaataatgaaaagtttttataaaaatcgaatacattttaatttaaaattttttttataataaaatactctttttattcattaaatataattttgaaaattaataattgaatatttattttgaaatgaaattcatttttataaattcaaaaaataaataatgaaattaaataaattcaaacaaaaaattaatttaaaaaaatttttcacaaaaaaataatttaatttaaattaaaaaattaattaaaaaaaacaaacactcttttaaatgaattaaaaacattaaaaataacacaaaaataaatagaaaaataatttacaccgtccggatccgaacctgccccccccctcaaaatgatgcctcagaatccccaatcacacagggattctgaggtctgaacgatgtcaaaagtaaaatatgatcacgtattcgtgatcagcgtcataaaatagccctaatgacatgtttttggaagattcttggtgaaaaaaattttccactcaaaaatcatggtcacacccctttggtcccgaatcccaaaatcacttttatttttgtaacatctctcaaaaaagtgataaaaatgccaaataaaatttatctaatagagcaaaaaattgcggatttttgtattattttacttttacagaatgacttttcagaagcgagttctgaatttttttctgaaaaatcttaaatttccagaatttctggaataacttttttcatattgatgttagaaaacccaaataaatcccataaaattctcctgatttttctctatttttaaggctttattcctgtaaaattgatcaacccttcgatttgttatgaattttcaaatattaggccaaaatcccgagggccaaaaaattgccaaaaaataaagaatttttaaaatattccaaaaattatgaaacttaaaatagacatcatattcgtactcagcaccttattttaccccagaaaaatattttacacccccattttcgtccgaaaaaaaaattccgaaaatttctagggggcctagctcgaaaatttttgaaaattttacatcatgtagtacaccattcgatagagcttcaaaagctctacaattttgccctaaggcgttttttcgataaaaccaacccctaacgagttatggaccacgggactcaaantgtcccgctcagnngcccaaaaatntttttcta

SEQ ID NO: 18290 - DNA, 940 bp, Heterodera glycines
gacacgaaggccaactgaacaagcaaaaaacagtcaattaatgcattttaaaatgcccaagttatgccgcaattaattaattagcactaattagctaattagaactactcaccaatgtgactgtgctgagcacagtgagtgagaaggcaaaaattgtgttcgctctactccaaattgaatgcattttgagtggaacaaattgtatttccttttaattcaaaaattataattatattttaattgggaaatgccattgaaaatggtgggccatatttttgtgtgatgagagagaggatcacccaaatcatagaaaatagggggaaaattggaaaatataaatatacaaaatcaatattgatcgtcgtcattttcatttttcacgacagtcccttccttggcgcccgcccattttccattcaaatgaacacacagaaatatattatgtatatgtaatgcggtggcgacgcacaaaggcacaaaccattaaaaatacgtgtaaaaatttaaaaaaaaggcaaaagattttttgtatatggaaacaacaacaacaggaaaacattaacagcaacaggacagacaatgtgcaatatacaaaggcctaccaaaaagttaactttaagagggatggtcggacaaaaaatccattttttttggggggagggagggggtatttgagtgatattgtccaaaaaagcgcatttaactcgaatcccagcggtgccaatgaaaaaaaaattttttttttttaattgaatatattttgcacaaagttggtgacagttttttaaattttttttcgaatttttccctggacacggcgttggcatgaaggtaaaatatgataaaagcagagaacacccaattattatttggttgacaaaaagagcaaatcaaatgctgcgcatttttgatacaaaatcaatgccatttgtgaattttg

SEQ ID NO: 18291 - DNA, 1483 bp, Heterodera glycines
tggttcacttgcgttgggccgcccgtctgatgccctcctcgccagcgcattcatcgtccacaaaatgggggtggcttaaaaatgacagcggcgattatccatgtaaaaataacgtaaaaacttggggttttccagggtctgcggggacggggaaaggtgggggaggcctccgaaacgaaaaaaattttaaaaatttcaatgaaaaatgaaaattttaatggaaagtttattgttttcttaagattttggaaacaattccaagaaaaccatgtgcatttgtcgaattttgagcaagggcattgcgatacccaaaatcgagacttgaaaagggcattaaatttccgcacggccacgataaagagagaataaaaacagcaaaatgggagattttctgacactttttgttccaaaaaatttccactggattatgcattgatttttcgaggcaagggtaaaaaaaattttaaaaacacacaatccatctgggttaaattgttggccaatgtttacgattttcagtaccaaacctgcaacatgtgttcgtccacaggccggggaatgtgatttttgtctgcgacctctgctgcaaaatgagtcggttgtccgcatcgaacatgaacacactgaacgcgcggtggagaattgctgtaaatgaaatttttttgagggatgaaaaaaacagaaacagtaaccgttttaaaaatccgataaaattgaaaaaacgtacgttttgcatggcattccctttttgacacagtgcctgaaaacagtacagcaattaatacaatgttattgtccaagaaaaacatgatacaagggcgtaaccaatgggtagaggcggtccaattcaaccctagcacaaatgatttttttttaatttgagtctaattaaaaaaatccaagggatgccaaaaaatcagtcatccatagtttttctcgatgctgataccaattaaaaaaagcaatattcttggtatatctaacgacaaagttctacaaaaaatgacggttttgcgaatttcacaaaaatccttagttttttatgggcctcccacaatggcattgtcaaatttatgccaaatcgatggttgataattgtccaaaataaacaatggtcataccgatgggttcgtcccgttcattgaccgcaatgcatggctcctccaaatatttggcctggattgggcacatccgcgcaaccgccgacgatgccgccgacgccacagttgtgccaccagcggtggcccgccgcctttgctgtgccaacaatggacggcaaaagcggtgaatggcacgcttttgtgccaatgccaatgcggacaatggtgacgagttacggatgatgaaggaagaagtgtgcattgtcttttaccactttttacaataaatacctgaaaaaacggtaatactggagaattgatgtcccgacgaaatacaaagttaagaagtttctttacagtttttctagggtaagaaaaaacgc

SEQ ID NO: 18292 - DNA, 1063 bp, Heterodera glycines
  misc_feature (979)..(979): n is a, c, g, or t
accagcacaacagtaatcagcattcgcattgcccgctggcgatcccgaaggtggcgagagccgatctgctgatcaaaagtgggattaaattaaggcaattaatttataaatgggaatttcaatgaataagcacttggctatcggaacgaaatgtcacaaaattggggggacgaaaattggagtataataaattaattacataatttaataaatttattttttgggattaattaattaatagccgcaccaaatcattaaagactaattcgaattcattaacctatcagctggctaattgtttcacaagacaatcaaagttaattagataatgatcaattaaataatttttcattcaaatgacgactgataaacctaataactgaaagttaaaagtgccaaacactaattgctttcataattggaaaacccgtgactaattggtcccactaattgaccacctgcatggctttgttgcgcaatacaatgctcatgtgaacgcacaatgccgaaatgattgtgagcggtgccaaaaaaagtgccaacgtttggatcaactgatacttttgttggaattcgggggaccaactctctttgcaacgggtgccccactaaaaattggcattttgaatttaaaaatatttccaacaattttaccgtcgtagtcaaatttcgcgcatattcagccggataaatgcgcaaagtgaacggttcgggcaatgacagaaggccagagactgtccaaatcagcagaatcacctgaaaataggagaaatgtacaaaagtttgttgtataaaattcaaaaaaattttggcaaaatgtctcttgatttaaaaagaaaaatttgccaaattgaattcttccgctttaatcgggtcaattgcatacaaatttttagtttaatctttaagcaaattgcctatatagctcaaatcacaaaaaaataaaccaaaatgggattggctaatgaaattggttgancaaatgtccacatttgtccaaatggactaaatggtttgtcaaatgtcccacttggcacgttcgtcggaatggcatggcgcgtga

SEQ ID NO: 18293 - DNA, 1546 bp, Heterodera glycines
attttaaaacataaaaaaaattaataattaaaaaatatactctcttcatacaattaaataatcctataaattacttaattaattacttattgttaatgaacaatgattaattatgaagaattaaagattttaattttattttaaaagataaataaaataattttccttttgtaaacaatattaaaatgacaaaaaaaaagaaaataaaagtctttcaacaaataatttacatggataaatacatttttaatatttttgtaataaaataattaataaaaatggtaaaaaattattgcttaattattaaaaacaaaattagttttttaattaaaaatatattttattcaaaatgtcctacctgaatgaacaacatggccttgcaaaattctgctgatagccaaaatgttttctaaagatcaaaaaattatattttttacaaaattctcattaccgtaatgtcattaattacagtcggcggaaggcaaaaaatcttaaattaattgcttttattttaaaaaataagagaaaaaaggcattaccaacactaaaaggtcagacaaggccaaattggtgaggaaaaggttcatcgaagtccactgaaagtgatttaaataaaatatttttcaatttaaatgtttaaattaaatccaaaaaatttggtggcattaaatttatttttaaaataaaattttttttttcatattttacccattttatgccatcattcctccatttttctcaatgctcattatttttcttctttcccctattattggccaaatttgggccaccggaaaagcgggaatttaaattggcacgcataaacaaaacgccaatatccaattgcatggcaattcaattttcttggaatttatttgcccatttgtcagaaaaagtcaaagaaattaatttaaaaattaaattttttttaatatttaaaataaataaattattattttaccaaaattttaaaaaattttatgattaaattattaaatttaaaaaataaaagacgaaattcagcaaattctcaccatgtgcctatttcttgagacgacgtaaaccacgaggcctaaatttccgaaaaaatggaatttttgaaaatttcgaatccctacaatttccgcagactccgacagccattaaaatggcaaaaattgcgacgaaaacccattcaattggggtgggcttcagaaaatcggccacaaagtccacgtattcgtcgtcatttagcctaaaaaattcatttgaattgcggaaatttttagcgaaatttttaatttttcgttttaacaaaaataaaatgccgtaaatgccaaaaatggaaaaatcacaaaaaatgcgaaaaattcaaaaaataaattgagaaaatcacccacctgtccaattcctcttcgctgctgtaacctcctgccgttttgaatttgaattgttggcgaaatgtcattctccaataaaaatggtggaattgttgttgaaagaaaagtggtcgaattaattaacattttaaaaaattaaatagcgcctaaaatttattgggtaagaa

SEQ ID NO: 18294 - DNA, 1728 bp, Heterodera glycines
gcggcatcactgagttcagcgactagcgcactaatgttaagtccctctgcagatgagaagcataatcacaaatggtcgacagtttctcggcctcaacgcccaccggcagctccgtcttccgttggttgggctgtgcttgcgctttcgttcgaacagatcagcgccaacatggccccagtcatttcttcgccattcgaatctgtgcacgttgatccgatgatctccaacactaccctgtcaatctgagacaccctttcgtgccgtggcatcgttcgcccattcatcccacctccgtgtacaccaccgtgtcctcgcccaccatgcgcgctttgttcactttggccattgtgtcgcgtcggatcggtgcccacacactgtcgcgaatctgtcaacgacggaggggtcacttttctgaatgaacgcgtccaattcacttccttccacgatttgcgtgcgtattgcaccgccccttgggcaacggcttgttgccggatgaactcccataactcctgtttgttttgacgagaaatttgtgaagaaacgggggagaaaagcgactctttgtagtcgcgcaccaatttggcaatggccaaacgatgggaacacattaattaagtgattattattaattggtgggaaaagaatggaagacgagctaagaaaaggaaacatacagcgaaagtgagtgactgtttccaaaatttgacaaaatttaaattaaaatattatttttttaacaattttagttttggtaaaataaatgtgtgaaatagggtggtatttataggttttagcctattttttcctgagctcccagtggccttgaaattatttggcctaattttttttacttttttgaatagtttttgtcattttacaccaataaattttaggctttttagggcctattttccattgtttagtgcctatttttgtagttttttagagcctaaagaccagggatggagttccgaggcactaaaaattttcggaagtcggaactcggaattccgaggccccaaaaattttcggaagtcggaactcggaattccgaggccccaaaaattttcggaagtcggaactcggaattccgaggccccaaaaattttcggaagtcggaactcggaatttttgaaaaattttacagaaattttaaaatatttcataagttaactttaaagttataaatcaaaattactaaatataaatgtattaaaaaattaatattaaaaattaataatcaaattcaacaattgataaattggactgcaaaaaaatcaatttcctaacattgtctcccttaatccggtttcgcaaatccgtacaaatgagcccggctttagaaaacaatctttcgctttcaactgatccacaaggtgcgctcagaaattttcgggcaacacgacaaagaagagtccattttccatgttcttctttcaacttccagtaatagaaaatacaaacagaaattaaaaattctcaagaaaattaagtttttttgagtccggcggtgccgataggtgccgtcggaaaaaaattgaaaatttctatgcaatttattaacataaattgtacaaaaattgctaattttttgaaaaaaaaactcaaaaaaattccgaaaaattccgacttttcatcaaaaatttcggaagtcggaagtcggaattccgaggccccaaaaattttcggaagtcggaattccgaccccaaaaatgtcggaagtcggaa

SEQ ID NO: 18295 - DNA, 2289 bp, Heterodera glycines
ctattgcagttcacacgaccataaaataatttggcaattttaatgcaacataacttttttttatgagcatccaaattaaacatttagtatcattcgatagatcaaagagtcttctattagtatgaaaaatttcaaaaaaaaaaatcgttgtgtttcaaaaaagttatgaccaaaaatgtttgaaaaccagtttttgaagttttttggccgtaacttttttgattaacgaaattctttgaaatttgccgtcaaatcgaaaacacttggggccatcgaatgatacaataacgattaattcgaatgctcatagaaaaaattatgttcattaaaattgtcaaattattttatggtcgtgtgaactgaaatagagccagattgcgctttacgaaactgaaaaaagataaaagatgtaccattttcatcacaattcgctgctaaggactccttcaaaatgcgaaatcgttcctccagccaaatgaaaaggcgttgttcgttgtgtcggaatttgaagttttttgtgggcgaatccgtagaattgtctgaaaagcttattcaaacaatttgaatataattggtccaccattctcaaaattggcagcaattttcagtgtgtcgatcagtttgacactctttgccaattctttcaatgacggaaagtcgtcatcttcgagcagttcagaagcagtcaaaaaatgttcagatgcattccgctggagacattcaatggccaagaaaaaaggatggacagggaaaaactgagaggcaaaaattaagaatgtaaaaagtgaagaacgaactgacggaccgaccaaatgaacggagccattggccacgacggaatcgccgaagaaaaaagaacgctttccattgtcaagtcggagcagttcaaagagttcgccatgttcattcaacttaacaaaaaatcacacatcacacaaacaatgttaattaccagtctatttgaaattttgtttatttgtataaatttttttgccaaaatggccattccctccgcttattattcgttcgcttttctctgacttttccttgtccgttttcgctgactgaccaaatacaacgcgcgttccctcgaggcggggtgaggcaaagcaaaaaccttccccggaaaagagccctctgaaacaaaggattgttcgtttatttgttatgattttatcattttcgtcaacctttcattacgaagaattttcgctcgaattccgtgtcggattcgaccgccaatgtttcttcgtcaagcccaaagtccaacagagagccatccccggcggccgttgttgcgacacttccgcacaatgaaactgaatcatcctctttgactgtgctgtgtcttcgccgtttatttccaagtgattcgtccattttcacctcaaataaaggcttaaattcaaatagaaataggaaaagttaaagaaatttaatttttgattatctataaaatttaaattttaactaaaataaataatattggcgcaaaactagaaaataattctaataactcaaaactagcttaacaactcccctaaaaaacatgtttttcgtgcgtttcaggctatagagagctcaggaaaaaatagtgaaaaaactataaatataagccctattcataatgtacgctgtccgatcgtaatctcactgctcactttacggcttaagtttttattaggtaggtcgaggaaaataaatccgaattcaacaatattcaaaaactgggttggggtcaattccatttttcgctgatttctagacttagctcgccaatagctttcggatgataccaaatttatcaggattcgattgttttaaaaaaagttagaagtgtcaaatctctgaatttttcgaattttgaaccgagccaaaaataggtttaaacccaataccgcaacttccggggaacccaaaaccgggctcaaaatcccgaagctttagggacttcggattcttacagtacctgctggggttaaatttgaatagttaaatccgggtcttacttcctaattttcgggcccctggaagccctacaaagcgatttgaaaccaattgtaaattcgggaaaaaaaattctcgatccaatttaagaatccggggaccggataaagctggtaaaatttcgtttttttaatatttattaataacggacaacaaaatttaattttttttttcattaaatttaaattattttaactgaaaatatttttaaaaatttttacttcggcttgtaaaaaagtatgaatggtcattgttttgaagctttgtacggttcttttttgt

SEQ ID NO: 18296 - DNA, 1123 bp, Heterodera glycines
tttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaatgttttaaaaaatttttccttatattttggttatatcgttttgcttttggtggggtgcttggaacagtggaatcatgcgca

SEQ ID NO: 18297 - DNA, 2186 bp, Heterodera glycines
acaaaaagaaagtcaataaaatacaatatgtatgaaatgcaaatatttatttggcattgaaaattgggtatttggccattgctgtctcccaattcattttgcctttcaccaaatgcccgacaacttcaccaatttcactaacctataagcaataatacaaataaatgaatgactaggcaatcaattcaaaactcacagaaacacgaatttgttgcattgttggcgcatttcgcaaggtcacagtccacggctgcaactcagactcaaagtccaccgtaatgccaaatggtatgccaatttcgtcagttcgagcatagcgacgaccaatggaaccagaactgtcatcctaagtcaaacaaacaaattgaaaataaaaagcaaacaaactatttacaattttagaagagatttctcgagaggtcagttggtcccgaacagcaaagattattgggtcaagtcgctcattagaagaaatgggcaaaattgagcatttgatcggtgcaattaggggcggaagttcaagatactaaaaagttaaaccaaataagtgccgtctctgtcttcttacgcatcgcttttcgtccccctcacgttgccgaaaagaatgctccaacacagcgtaaaaaatacgaccaatcccaaaggaaggctcaatcaccgaaggagtcacttcttcaacatggacagtcttctcgaaacgcttaacttccaccattgacgagttcagctcaaaagtttttccctcgcgcaaagacaagcgatatttactgaaagggatttgattattattggttgagtcaattaaaaaatattatgttgtttaaatttgatctgatttgagtaaacaaacccattgcttttgatttcccgttccaattcctcgatctgtgcttcagttaaatcgtccaaagctgcaagaatctaagcacgaaagaagtgcctattcctttgaccttcctttaaactgaatgctaatgtgaacctgttttgaatcggatttgaattctttgcccagcaactgtttgtttggcactgcttcgaccacttcgatttgcttcggcgcgccgagtttcttctccgctacgagcttcactcccgatgccttttggtgctggtgcaagtcatagcaagctctgtccgcatttccaacacattcgatccatccgtaagaggtaaaacactccgcgtcccaacagtccttgaggaaacacggacagataaatgaaacaatatgattaacaacttgagcgtaatgggccatttcattggaaagatgttgccgaaagcgtagtttatcgggcgaaatgccaacagaaagaagaaacaaatgagttcgcgccatgtaataacccaaagtttcattgtttacgatacccaatttgactgcgtttccaattgaaatctgaaaaattagtaaaaacttaaaattggtattgtattagaaaaccttttggggattttttgattccatttgattgcaagcaggaaacaaagtaagttccaaatgtgcaattttctcgaatttgggatgtctcttgtcggtcgggtcaacaaagtgttcaatttcacacattgtaaactcccggacgcggataagtccttgtcgaggcgaaatttcgtttctaaagccagaaccgacttgggctgcagcaaaaggaagtcgtcccttaacagaaaaaataaaaaattacatcaaacaccaaaatacctggttaaattctaaaaggcgtttgaagttgataaagattccttgagccgtctcgggtctcagaaaggctcgctgatcacaggtaggtccaatttcagtgggaaacatcagattgaaagaaacgggttcggacaagtcaccgccggttaacggagatttgaaattgaatttcttaatgacttcgtgcaagtcatcacagctcatcccatcaagcataacaagcacattcataagttcggactttgctttttcatcagtttttttgtccttaaataaatttttagcaatgatggcttattttgcaatatacccgaatcaaagtttccacttgatttttaaccaagtgatcggctctaaaacaagcacccgtttgtttgtctttcacctaaataaatgaaatatcaagtcaatccagaacaacgaaccatccagtcgataaaccggtcaacatggccagaagctctgaaatctatgattt

SEQ ID NO: 18298 - DNA, 1964 bp, Heterodera glycines
  misc_feature (1876)..(1876): n is a, c, g, or t
  misc_feature (1902)..(1902): n is a, c, g, or t
aattccgactccaaaaagttgggacattgggaattccgactccaaaaatgtgggacatcggaatttcgcctccaaaaatgtcggacatcggaattccgactccaaaatgtccggaaccggaattccgtgccacccctgcgttatatcaaccaaggggaaaattcataacatgacttaattttaatgttaaaaaattctggtttggttcaagattctttgaaattttataataaaatttttttttaatatatttttctaaaaatagttttagcataaatattattaaagataaccttaaaaaaattttaattttttgttctcatatttcagaaggccttataaacaaattgtaattgaagaatgaagggttgtgcggaaaattatgctcaaaaatggccatttttcatttttgaagcacattataaattccggcttttcttgtaattttgtcaaaaaatctaggtttccggcctaaatggccacagggccctgtttccatcagaaggactgtatataatggatttcacgaaacccgtaattactgatgtaatttttgttaaaccacccgcagatgacagtccgggctttgtattgagtgcatggcgttgctcttatcacaacgatgaaacatatttatgccaaagaccagaaggtgattatagtaaatttcttctcactcaataatcaaatataatcgatgccgcaccgattagctaaaaattagaattttctaggctcggtaccaatatttgtcgcgcatccctaataagcaaatcctctcttaattctttaattttttaatttttaaaataaataaaattgggcgacaaattaagcgttggggtccaatattcacggcggtgtcgaaatttctgtttagtttcaaattttctggtgtccaaatttccaatgtccaattttcgcgcatcacctcctctaaaaacttaaaatttaatgttattctccaaaatttcaataaagtacagaaaatctatgcgtaagttgacaaaaacccaaacattttttgtgaatattggtccaatcttttttgtatatgagcgaaaatttaaattttgtaaatcatataaaaatgatccgattattgtttttatactgagaccagaattttacgaaaaaatgatcaagattaacacactttcaatgactagttgtctatcttttcaaacataaatacaattgacccatgaaccctggaaatttcctctggcggggagtcatttaggaccgtaatttatgtaattaaaaaaataaaagctttgatttgcatgcgtggtacttatgacgaagatggatacggttcgcttgaggacaaagaatgcgacaaaggccaacagttttgctacttggcaaactgtaaaaccggtaatgacattggaatgcgttatttgacctgcttaagaaccccaaatttggtactaaatacaaatgattgtcaataatttttaaaatatttttataaattttgctcaaaaaactaaactcaaaatttaagttaatgaaagattttctagaaatgactttttattcttttcaaaaaaaatttttaattaaaataattaatttattaaaatattatttaaaaaattcattaaaattaatgcatttcttgttcaaataacttgtagacatggtcagctatttgtcttgggattgtgcgaaagacacggattgtgccaaaatttcggctgattggaccatgaacagaggcggcggcaattactcgtgcgagtgcacatttggcgcccctggattaacttgagcaacgaaaagctgcacattccgatggcacgtacgattgtgttcacccaaatggaaatccccaacagcggaatttcttcatgtaatatgcaaattnggtggtgccatttctttgggtgctgngtgattaatgatgcatgagagtgtcattggggactatcatctcaaaaagccaaaaagccggc

SEQ ID NO: 18299 - DNA, 1990 bp, Heterodera glycines
gtcagttaattgtgcctaattagctaattgccttctatgtttgctcatttggcatggcttccggacggcaatgatctcaaagtgtggcacaaaacaggcattttaagcccgtgctaaatgccctcgttttagctggataaaacgggcatttctatgggtctgataaatgaatgagcccgggaaaagtcgaagaaatcagtaagcttgactcgagccttccaaaggggctttttattgggtcaagaaaattcagtagggatcaattcttgaaattttcaaaatccctcgaatatggtgacaaaaaattttccacgggtctcaaatgtgtcacacattaataccattgagattcgccgtcatccatacgctcattttcaatgtttaaacaatttttttgtgtgtgtgtcagtgaggttttgttgttgttggcgttttgtcgttgtttttttcatcgcgtctggcgcactgtctctgggcctaattttgaaaatgttgtttcttcatccgccgatttcaccgcctaaaggtggacatcgccggaggccattgctggcgggcggcaaaatgcgacgacggcaccggcaccatcggcgatgccattgtcgtcgtgcccggaggcggcagggtcattgtattgccaccgcaggatgacatgccgtccagccggatgctgatttcgccacccgcgtcattgtaacaactcggcgtacggtagcgaccgtagccgcccgtgtaactggcacggcgtgccaatacagtagctgccgctgctgttgtgcgtggtgcaccaaggcacatgcctaaaagacggatcaatttgaatacagagtattaaatggatatggatggagtcattgttgccacccgccgaatcccgaaatttttgctcgtcccatggcaacccataatatgtatactgcatatgtcgcgactattttgatttactctttgtataggcaactactgtattgttgcgccaaataatcattttccctaaagatactgtaagtattctgtagaatgagtattgtataaaatgtacaaattattttggaaatttgcaaaaaaacagaaaaaaattgagataccgtatgtatttgccccttgggtgttgtcaggcttaaaccttactgtcctggtcacagaacaggacagaactgatcactttctgaccaggaaaagcacagtaccaactgagccccgcctaccaattccggcgctgagttggccaccaccgaccggcgacgaggcggccgacgaccgattgcttccggatgagactgatccagacaccgccgaatcgctcccgctcgttaatgtccattgaccgcttgtggtggtggacgaattgttgttccggtttttaccgttcccgccgatgttgttgtgctgctggaactgctcgccaaccgcggcggatacggtaggcactacggtagctttgtgcagttgtttttgctgctgttgcattttggtgccacctgccgcactgatcagaatggaggcggccgaataggcactgatcggcgcattgtcaccgcaaccattcggcggcgctgagccgacaccgccgctctcaaatggctttttgcgactggcgccgggtgagcgccgacgagtgcgtcgggcgcgcagtcggcaacacagccacacaaaagcaacggtctgtagcagggcaattgcgagcagtaacagaacccaccagggaagtgctgtggaggggggaggggtgacggaagtattttacgatttaatgtcattcatctattggcggtattggcactaagtgaaatcctcgggctaatgaccgtaattaattggtaattacgggagacaatccctgcggttggcattatttttcaatgggtttctcgatcccttagctattagaaagggtttaaattggcactaatttttgggacatttaatcaaattgccaaaggcattgtaaatcccgtcttggctaacttcttccatcggatggcggcat

SEQ ID NO: 18300 - DNA, 2687 bp, Heterodera glycines
  misc_feature (2670)..(2671): n is a, c, g, or t
atttttaaatttgtagatttcgtcagcagtgccatcgcgaacccaaagaccatagggaagaaaaggcgaaaaacgaacattttgtggcggcgaataatcggagcaaatgttctacagaatcgtcggtcatttgtcgcttttcgaatggtcgcaaagaaacgcgcactttcgtcgacccggccgaattcttcgcgcgtcagtctctgaacgcctcgcgaatggcacggcgcacaaacacacgacaccgttttcagcagcaaaacgcactgttcgaggatttgctgttagcggaagcggaaagggacgcggtgccgacggcgcttaccattcgcgggacgacggcacccgcggggacaacggaaagatgaagcaaagcgcagggataaatgaaaataaagatattaaaacaaaaactatgacactgccgaaagcattcattggacatccaaattgaacagctgcggggaatttcaatttctgatcaaaacttaaaaaatatgaaaattttggtttttaattggtcaaaaagagaagacatccaatttatataaatcggagattgatttatccaaagctttcaagttttgttaaattttttgacttccctctcctaacatttcactcattcaaaatttaattggaattttaattattttttattttaaattaataaatctcctcaaaatctggttcagaaaataaaatgagttcggaatatgcattctttctttgatcatttttcattaatcagagtttgtacattttttcgaatatattaaatattgaatataatttttcaaatatttcacctttaataatttaaattattttccaacgaataactcccaatacttaaataatacaaaatgaatttaaactcttcaaattttaatcttaaacttagtctttttatcaaaaatatttaaacatatttttaatacataaataaataataaaaagtcattattataaataataacatattatcaagaaaaaaatcgaaaaatattggaataaaacaaataaatcagaagaaagaagtgttcaggtagaggctggcaatttgaatggcgaagctgcatttggcacaatttgggcccaaaatcctcaggccattctcatccaagaaaaattgccttttgaaggcagcaactttctgaaggattttgataaaacaaatgcacgaaaattgaaaatgtttttaattaaaaagatttaattgtaattaatgggaataaattttcaattacataatattctgccaaaaattgcgttctttacttgaatattcggaatccgaagcaaaagttcggccattcgcttgacactttccattgcatttccgtccttttttctattcaaatatctctgcaaactctccaaaagtttttgttgcttttcgtttacaatttgctgagttttttcgcccaatgaaagacaatctgaaaatgcacaaaaatattaaaaattaacaattattttaaaataaaattaacaatccttttcgacctgaatcaaacagaagcagtgactgtatgaatacgtattccacttcgttcagttggattcgtcgtattggtgccttagagtaattaagactccttttttggaaattgtccctaattgcttcccatttgttaccaaaatgtggttgatcaccgccactatgcctctgatcagtccgttttgcgggatacaaatgcctttggaaaagttcctggtcacttgaagtccgtcagggtaaaccaaacgatcagaaaaccgttcgggtgtttcaaaggcttcgcaaaagacgagcaaagcgaaggagcagtggacgattaacgactggaggtcagaaagtggaatttcctttggtgggcatacggtatgaacgagttacggtaaaagcagtggcaatttacggtacctggagttcggagaacgattttacccattgacagcgactgataaaatgcgcgcacgccaatcgtaaaagtccaattgaatgccttggcaaatggcgaaatgacttttgaattactaaggctcgaattttcaattttttaacttttttttgcagctttggctctcattaactttaattggatttttgactatttttaatacattttgcggagaaacaggtgaaatataagattttgattcaaaaaaaaaattaatcaaaaaaattatcaatattaaaaataaataaataattgtctaacggttccgcgaatttcatcttaaaactcaatttaaaacaataatattccgacgatgcctataggcggcagtgagaaaaacttgataatttttggacttattaacagattttgccttttgatttatcacttaattaatgtaataattggttcgtttgctttgcttttcggccgaagatttaaccttttctttgttggataattaaattttaaatgaaatattaccctttttgacttctcaccaggtctcaacttaaaattttcaaaaattttcatgggcccgtcaaaaacggtgcgctgctgaaacgcatggtcaattgtttcgaaaattggcgtggaggaagaggtgagcaaggtgcggaattgcctcctcttggccaacaatcggctaatcagtgggtcctcttggccccggtcgaatgggtcccccaaagatgaatgctttggcccatatttaccctgaccnntgcaggcccatgcaag

SEQ ID NO: 18301 - DNA, 1172 bp, Heterodera glycines
tttgatcgcttcccgaaggggaaggtggtcgcctgctgggcggactgaaagtagtcgagacggggcgccaggtcaatcagcgcaatggcaaccgctgaacggaggacgacaaatgaacgcgcaaataaaaaagtttttgattcagaaaacgagtctgtggtgtgttctttccgcgtaatacgttatttcccaacaccaaattccatttaaaattaattcggttaaaatttttgctttgttccatttcaattcgaggatgtttgtacctttgttcatgtcccaacagatgcaaatgagacggagcagcgtgaacacgttgaacatgttggtacgaccgccagctttacacacttccgggttttccagaaatttacacacaattgagagaatgcaactaaaaatgttaagaaatatgtaaaaactgattcgccaaagaataacagacacacatttttaggttgtcctcactttgccgatttgtccaaaggtaccggagggcggacgactgagtccgagagggttcgtcgccaacggccgcatcgttgtcctccgcggtaacactcatcgagattaaattgtacagtgcctgacaaaggggacatttttgaataaaaaaatccatgaaaattaataccgagacttaaccatttcattttcttatcaaccgtggcaatgaatcccaccttgatcagcttataccgcctgtcctgcacatcccaaaactgcacgattgggtcatcctcggaattgtcaaagcgcataactttgcgtttgcctcgcgttccaccgggcgttgcggtggcgacagccgaacgagttctatcagaaattatattcattttttgtccccctataaaatgccaattttcaaaataaatggccgcatgttcaatttgtaataaaagggattttgtaatgccaggaaaaggtgcatttttctttggttatttcaacacgaactccatctgaaccacccaatcccaccgtttgttcaagtgctgttcaaaatggttggtcaggctggataacaggtacacgtgcatcagcaaacagttgctgtatcggctgttcaacgccgtggtccgtccgttgcgccgttcgtccgcattttgtcgcgggtgtccgtcagtgtcggcggtaactgcctcctcctggcccaccatcgtcgccgt

SEQ ID NO: 18302 - DNA, 1705 bp, Heterodera glycines
  misc_feature (104)..(104): n is a, c, g, or t
agcaataaaatacgatttcgatgacaaagtttggcactttcattgccatcgctttcgtcgccagggcatttttggatttgttgctgaatgactgcgagtccgcncaacagcaaacgatcggacggaaaagagcaaaggcgacgcgaacggataaaatggtggtctaaaaagtgggtgatgcactgcacaaaggccaagtcgtcgacatccctgaaaagggggcaaaaatgaaaggaaaatgacagactaaaggaaaagacattcaaccaatgtgattagaaagtgtacggtttgcatggaattttcaaatgcccgggccaaaactcaaacaaatcaagtgtgaatttgaaaaaagtacaaaatggcaaggcaattgactgtcaaatgcaatttgacattttcaattcccctcatacattgacagaatttgctgggccaacgcttcagcgaaatgtgtgcgcgttaacgcctcgccacagccggacactgaaacggctaccgaaaggccaaagtcagagttggcagcagcagaagaagaagaagcagcgcattgttcagcccaaattgcggcaccgaattgggctgaaaatggaaataaaaagtggaacggcaacaacaaaagataaattttcatgttaatacaatttgacctgaatgccccatgcgcccttcccgcttcaaaagaatgccgccactgctaacgcacgcctcacacattccatcgggctaattaagtcaatcaatcaggcaatttactattatcaacagcatttctcacatgaattgccactcccccgacagtgtccattcgtcggatggcattgtccgtgcccaaagccattgccggtgctgccgacttgtccccattgtcaggcgcagccaatgccatcatttgtttggctctacgatgctctttgacggcactgcgtgtcctcaactgatcattcgatggcactgttccaatgccgagcgaagcgcacagtttgtcggccccgggcccagccaaaaccatcggttggaccaatccaaccgcagcagcagacgaatcaaagcaactgttgctgctggcgtacggttcggccaacgctttggatgcacaaattggattcacacagttggtgacctgcactcgcgagaaggatggacaagatgattcatcggaattgtttaaatcggcaaaccgacaatagcgacagcgccgtaggccatctgccgggaacacatgtaggccgcctcacactccaccgagccggcaacggtcagatttgagccgagaccgcagttgagcgccgggcaacgctccagaaactaggggaagaaaacttttttagcggaattgatttaatcctttggcttaaaagcagagaagcatttcatattgttgtataaaaattttgaagagagaaagcagaattatccaaggtccacttttttcacgcaaggggaagaaaatctcgaaacactgtctattacaaactatggaacatgagattctctgcgagaaggtgattataatagagaggcagcagaaaacaaaccatgaccgcagccaccaggggaccatcaccagcaagcccagagtaagtaatggcgtcaacggccaggcccatttccgattgcttccattgttcggtgggcgattggtgatgtcgacggcatgcttcagcgcttcttgagaattttttttcagcagattcggcgaaaa

SEQ ID NO: 18303 - DNA, 1852 bp, Heterodera glycines
cgattaaattctccgatcattcgtcctcctttctacactgtgtcggccatctcccgttgaatctcatcctccgtcaaaaatttcgcccatttgacgttgccctcgatccttcaaattaaaaaaggagtgaaaagctcaggcaccaaaatgccaaatgtgactcactttcctccatcatggatggtcacgccatcggcataattgaacttaaattctcccttacgcagcgcatcaatgccaaggcttcatgaaaattgggggaaaaacaatttattaattctaataaaaacgaaataaaagttttaaaaatcatttactcttttttaaagtaaaacttgaaaaaatttttttttttttctgatacttcgttaaataactttttagttttttctgatctattgtttctaaaaataagaactctgccgcggcgaaagaatgagtttctttgcagaattttgaattcaatgaattatttttgggggtttttgaaggtgaccaaatatcatccgaatggaatgcactcgacaattttatccggaattatttgaacttacatcatttggggcttaatccccgagccgctaacaccagcatcactcataaagacgtcgagtcttcaaatgaaaaaacgcgcaagcaatgaaatttgaaacaaaatgccactctcaactcactttttttgcgaaaacgaaatggacggctttcgagcagttttgctgaccctgcaaatgaaaaattttaaaaagcgcataggctccaaaatttgcagacggtttaagcccactttgctttgcatatgtccgcgcgaatgcccaaaccttcgggcaagctaaggataaagccaacaccacccagcagatccaagccgaggctttaggaaaggggaaaaaagtaattagttcgagttcggttgggtcattagtatccccctaattcgtaagtgctctgactacatatcaaaaaaccactttttcgttcaactattcaacttacagcatgtcgaacttcttcaagcagtaccttaaataatgatttcaaatccgtgaaacacaattttgaatccgttgaaaactgacaaaacgccaaacttacatggagagagacttgtcgggcatcaccgcaaaacgatgggagaaggtcagattgatttcttccatgtgcactcgaacattgtcgatcctgcaaaatccaaattattcgggccctcaaaatccattaaaagttcggcaattgtttaaaaaattcgactccaattcgggttaggggatttagaaattagcaaaaaacggaagccataaaattttttgctccacgacttttcacgtatttttcgaaacgaaatatgaacacgcaccacccgagcacttgcgcgccatcgtcaagaaaaaaactatcagagaccaccgcaacacgttgcgaaacgctcgtatcgcccattttcaccgacacatcgtcgaccctggaaaatttggggataaaaatattttgaaatcacaaaagcactccaaaattttgccaatttatttggacgggcttcgaaaagcgccatctttcacatatatgttccacttgaaacaccattacggaccatcgttccacatttttgccctcggcgaacgctttggcgttgaaagcgacgaacaatttgtcacggttggtacggtcgaccttccccaacagtttggctttgcgcgcgaacgattcggacacaaatgaagtggtacatcctaaaaattgagcaacgaatttcaacattctagtcggttttatgtgtcccatgaatgaccgaccatacccagattcttaagatataaattttttcgtacttggacaatacctatatacatggtat

SEQ ID NO: 18304 - DNA, 755 bp, Heterodera glycines
ataaattaaccgaaacatttaaattcacattaatgattacctatttaaaaaaaaaaatttttcaacaaaaatggaaattttttgaaaattttttattgaagtttttttaataataaataaaatattactgattatttgtttaatttttaataatattacggatagtaaacttaaattataatttcaatatatttaattcaaataaaaaaatatattttttaattttaggcaatctttttggagatattatccccagctacatttcaagcaaatttgctgaatccgtatatgctcgatttgcttattttgtcgccacaagcacttgttgctgatctgctatcaccacaattgattcaaccaaagattttaagtcctcaatcattctcagccggcgtgcttagtcctcgtaattattaaattaaaattttaattacaataattaaacatttataaaaaaaaacaaaatttttaagggcatcataaaattcaagaaaaacaatgcaaaagtgataccaaacattttaaattaataaaatattcaacaataattaattttatttttaaatggccaaacttacaaaaattgttttttatataaaaaaagatattaaaatttttagagcttgataattgggacttatacgttgaaaaaacaaaattaaaaaatggtacaaaaattttaaaaataaataaatgcccaaaaaaatattttagccttattagcttttattttttgcttgattaatttttaaatg

SEQ ID NO: 18305 - DNA, 1469 bp, Heterodera glycines
  misc_feature (1373)..(1373): n is a, c, g, or t
atcttcataaaatgaaatccaagccctggatgaataaaatttcctgaaaaatctatatcatggcgagagaaaatttaattttaaaaatttaatttcgtattttctttttaataaaaattttttgtttcagattttgtcacccgaaattggcggtggccacgatgaaagtgaatttgagacagagggtgaaaatgtgtttatttggcccaaaactgacgagcccgacgaggaggcttatctgggcgaaaattcggcacatccggacaccagtgcgcacattcacccgaacatccttcatcccgatgggtcatgaaaagtgcctaaaactatttgaaatttttaatttatgtgccattgtggtaattgagctttttccaagtgttgtaagctattaatttacattttataattgttaaaatgataaaaatcgtgctgagacgaagtacgaaaagtgcaaggttgggcgaagcacgaaaaagtgcaaagtgtgctaagtacgaaaagtgcaaggttggacgatgcacgaaaaagttcaaatgatcaaattaaaagcaaaataattctgttagttatatttgtataacatatttaaatttcgctacataattaaatatatttttatattaatggtgagccgaagcggggcatcgttttcgtacgggccgttttcgtacgagcacaagtttttggctataacttttttatttgtttaccaaatccaacattgttggtgtcattcgatagccctatgtatcctctattttttgaaggtttgtctaatttagaggtggctaaaaaacgcttagactttaaactttattttattgttgaaattttcaaaatttaatttccaatcgataaatagataattcaaaaatgaaccagtcaacaatgggtaatactataaattatgaacattgtaaattttctatctaaatttttgcgaaatttcaatattttttatgaaaatttatttgaaaataaatttcaaaaataaatttcctttcttcaaagaattagtccaatttgtgttcttttttagtaaaggacaataaagccaactgatagttaccgcatagaaacaaaatttgcaaattataagtcaaaaattccttatttgaggccaatatttattcaccacaattgatccaaccaaagattttaagtccttgttggatagtgaataatttgaatttatggcgaactgacttattgactttatttgttatttctatgtccatccgccccctccctcgtccataaaagtggacacctcctcccactttttgttctttcctttcatcattcatttatattttatttcccaatttgccctccgaccgaatcaataaaattatttatttatttctttntctttgtgtgttctaagtggaagaacacaacaaattgggcgcagtcagcagccattcttcatcactgaggacaaggacagctgcaaattcacaaaa

SEQ ID NO: 18306 - DNA, 2206 bp, Heterodera glycines
  misc_feature (29)..(29): n is a, c, g, or t
taatcacttattacttactgtgatcgatnacatcccctctgaatgtttcactttctctcccatcattgagcaaattgtccattttctgaaaatgcaattccgacaaaaattcgtcccttcgtgtattttttcgcaatgttttgcccacacaaatcaaaaaattgcattgacattccctagtgaattcttccaattctccatttttggccgacgaatttggaaatttttttccaaattcgtcgatcgctccattggcacaaattgcgagggcacgcaaaaggaaagtgtcggtcggaccattgtcccaccaaagaaattggtcctaaaaacaatatttattattattttttatttttattttataaaaattggtgcttattctgtaattctattactgtgagatgaattcgaattcattttttttgaccaaagtgatattaatttttattatttaataattatgaaatgaaatatttcaatttgatttattattttaattccaaattccggagcttttttagccagggttccactgtttttgagactcccgaacaccccagtgtatattttccattaatattttttcaaacaaaaaaaatctggaaataaaataaagaccatttcattgatagactgtgccaattcctccaattgcttttgatgtgccgaaagtgattcacttgcatttttcaatgcttttcctttcattgtttcttttaaaaaactctcattttttatacgaattattttttcgtttgaccaaaagttttgtgtgtataattgccaaaggtatttcagttcacttaaaaacatcgcttcgaattgtatggccacaaaattcgctgaatcatttaaataatttaaattaaaaacacaattggtacctttttgtttgcttgttcttttcctttctgtgctgaatgtttttgtggcccattcgtcataaaggaatttggccaaagtaattttatttcgccaattggtctcaattaaataattttcatataatttaaggtaaaaaccgttataaaatagagggactgaattgaaaagattaacgaattttattcctaaaaaacaaacccaaaaatgacaattggtcggagtattttttgcaaagaattgacatcctcgaaaatccaattaagttaataaatccgattctcgcacttctcaaatccccttttttcaatttaatttcactaaagatttatttatttttttattatttgttaactaatatttaataatataatttttcataattccctactcaaagtattgcaaaagttttttccgcgttggtaaaaagtgaaaaatgtcactgaagatccattccttaatgttctcttcatttgcgacaatggtctcctgaatttttttttaaatacaaataaaaataattaatttctcaaaaatggcacaaatatttgtgtctgcctttgtcacaagagtcggagcgggctgaacccttagggctcggcagcccggcatggaaacactgaattgcttcctaccttaatttcctcgtcatttttgcaattcggccactctttttggcgtgccattgtaaccctttgagtgccattggcatttattgttgtcaaaagttcggctttaagccttaacaattcgcagaacaatttgggcttttgaaaatgcgtgtcaaataattccataacattaaaatccaattgcagacggttgttgaacatcagactatttaattggttaattaattaattaataattattagcaattattaccgtaacattcgcctttgatagaatgcttttgctgtgattgtcggttttggtccctttttcatcgcttttgtcccttttttgttctgcttttcctcctcctcctcttccaaataagccaccaaaatattcgccaatttttctttgttttgctcaattttgtacgataaaaaataaatatgaatgtaaatttcaattttttgtgccgctttttttcgttcgctttcattttcagcggtaaaatattttttgtagaatctgtccagcaaaatatgctgagagccgccaatttgattataaatgaaacgcatttcggtgaaaaatggcagaatgtcggcaactgaatgccggtaaaatatgaataaaatgccggaatcgaacagaagcccaggaacacccaaacgagggctctcgagaatcgaaatttcctagacaaaccgat

SEQ ID NO: 18307 - DNA, 991 bp, Heterodera glycines
ccccccccccccccccctctgtataaataataaaggcgatgaatgattttcatacattcatttatttcctcgtcattggaaagggcaaagtgaagaagtaacacaaaaataatcaaaagcgacaatttcaacatttttatcttcaaataataatggtttttttaataaaaataaattgaattattaaagaaaatgaatttaaaaaaataaatgattaaaaatgcagcaaaaaaaaaaattgatataataatcgataacaatacaaataaaaaatcggatgagattaatagaaataaatcgcaaaatattgcccattagttgttgactaaatcagggctcccaactctactgaattatcagcatttttctgatttcatgaggtcaaatctgattttttttttttttttagaaaacatttactaatttatgctgatttttggaaaaaatcctcaaaaatggcaattttttattagttttttaaatttggaataagtttcaaaaatgctgatttttgacttcaaatgttcatttcgaaaattttcaattgggaaccctggactaaatccttaaaaattcgacaaaagtatcacaaaataagggcaaaattttcaaaatttcagcaaatacattatctattaaaagctttaaaatggctgatttaattatactaaaaaatttcattaattaaacaaattattcttgaacaattttatcctatatgagattctaataatcttcatccaattattcaatggtcttttttaaatttcttcagaaatttattatttttttccaactggtttaagcttgctgaaggctcaaatctgcttatttgttagcaaggaaaaaacgcttgcttaagcaagcgtgcatatcacaattaaataactgtctaattatagtcgtatcgcggcttctaatcacctctatgaaattttccaacaggatgacttacttaatcaagaaagattgaaaatatattagaatgaaa

SEQ ID NO: 18308 - DNA, 2754 bp, Heterodera glycines
tcaagcggagaagacgacagaaagtgaaaacaatctccgaaaagtaaccggagaagaagcattggaaaatgcctaaaaaagaatgaaattgttgggaataatccaccgctttgagctgttcaatcgttgacgactattgtgcaacggaaaagtcatggaaatgcaacacggcgctatatgaaaagtgttgctttgtttggggttatgtcgcgattgttactgtgccatttttttatcaataatagatagggctgggatttttatgtgctaaaaatcctgaaatatgtaataaaatatgtgctaaaaaacccaaaatatgtgctaaaaacaaaaaaaaaaggcctaaatatgtgctaaaaaatgcaaaaatatgtgctaaaaattggaaaacccaagtgtatttacgcataaaaaaatcatatttaatatcagtctttatcaattttcgcccgacctccaatcaaaattttggcgatatcaatcaatttgtaaagtcccggattaatttttccatcaattgaataagttccttccgggaactttgaaattcagtgttaacacagcgtttgatttggctgctttaggcatttaaatatataaagaaattttctaaatgcttaagaaacgtaaagtagtcaatttttagggtgcattttcagattttcttgtattttttttacgatttttctcaaaaatgccaaaatatgtgcaaaatatgtgccaaaaccccgaaatatgtgccatatgtttttatgtgccaaaacgccaaaatatgtgtttttatgtttttataactcgctctaaatcaaaaattgttcggagaaaatgctatttttgggcttctctcgccataactaagccgcaaaaaaaatatgttaaaacataaaaatcccagccctactcattagtgttaattaaatttggcataatgtcttttttcgcgtttttctcacttaaaattgtattctttgtttttttccacctttcattccaattttattatctggtaatttttattgttttgtgccgtccaatttcttttgactttaaaattgatattcgtcaaattgtttctcatcgatatttgtcttttggaattaaagtgtttggatttgacattggcctactctgtgtttggtataattgcgtccctgtcttaagtcagtagcaaaagtacaatttggcgctcccgaggaaacaggtacaaaagcggcgatttttaaagagtttgagggtgagatcgggaataaaaaaattttcggacgggttttaatttggagtgtattaagtatcagtccggaccggacgatatttaagttctcaagtggaaattgactattccggatcggaaagttaaaaaaagcgacaaaaaactccagcgcaccgaaaaatttattgtttatcagaaaatttgagttcgggccgaaccttttttgctgtctacatcgccgtataaactattgacaccgggtcggtgcttagtttttctccgtcttctcgccgaatttttacatttgaccttgttggatggtcatcacacgcagtccaattttgacacggcaacgagcgttgaatttggagattgccgttgacagaagtggacatcagattaatgtcggtggaaatcagcagaactcgctgcaacgccaaaatcacagtgctggagaaagttttccccaaaatcagcaaattgaaaactcgccaatctcacccactgaactcgcgggctttaatggggaaaatggtgatgacagttctcttgttttagaaccaaatatgaccgaagaggaattgcgcaggcgcttgttggtggtcagcattgaacgtagccagccgccatccaacggaaatgccggaaatggagaaaacgccgaaggtttgcgaaacgcaatcagggaaaatgatggacgaccgaattttggagtaaatggtcaaacatttgcccaccaaaggaggccgcatgacactttcttatcaaatttgatgaataatggaataggaaactttcctcaaaatttggtccatgtaccgcgtacttcaaccccaactcgaaatgttgaatttgaacagcaaataggaccattcccgtttgttgttgaccgcaacaacagagcaccaaccccacctttaaacatacggcaacaaattttccaccccatcccactgaatgcacaccgcattaaccaagtgtcggttaacgcgcaacgcaacattgacgttcagtacgtaccaaataattgcgttaatgtcccgccaaacgtacagcgtcattgcgacattcagtacaccgctcctaaccttgtcgccgcgccaattcctgtttcatctatcatgaacgtatttttattaaattaaataaaaatgatatcaaaattcatttattcagctggctgttacaattagttgaataacaataactgctaaaattgtttgattttttttttgcaaaatttaagaatttttttaaaatagggttgggttttatttatgagattcgttattatacatctatttatatatatatggttttgtttaatttcattttatatgtgaatttataaaattaaaatattaaaaagtataccgaaaataaaaaaatttatatgaaacaaatctttttttaaattttatttcactaacaaaaaatttattaaacataataaaaaatttcatttttgtttaatattttcttgagttaacctaattgtcaaaatagataaaattaaaaaaaataacaatttttttgataaaatt

SEQ ID NO: 18309 - DNA, 2551 bp, Heterodera glycines
  misc_feature (2422)..(2422): n is a, c, g, or t
  misc_feature (2467)..(2467): n is a, c, g, or t
  misc_feature (2470)..(2470): n is a, c, g, or t
  misc_feature (2508)..(2508): n is a, c, g, or t
aaaaaggggtgttccggagggcattgtaaaattttgataaaatctgtttcaaaaagtcgttttaactactgtatttctcgtaaaaaattattagcttttcaattttcagaagaatttaaattccagcgaaaaatgattgattataaaataggaatatacgccataaaaaaagaaatatatataaatcgacaaaaaaaagaaaatctactctactgtccaaatgcccactgtccaattgtccttggggcggtgttaggcatttcataaaatcccccattttagcgaatttttcgataaaaaaatttgtatgaaaacaagtgctatttctgcataacttgtgttaaattttataattttatttgaagttttccaggctaatagagaaaaagctgggctatcgaatagtactaaggatgtaaaattatattgtctttagcaaagttacgccatgttttgtcgaaaaattcgctaaattggcggcggattttatgaaacgcccaaggtggcggattttacgaagcgacctagcaccgttccgctggagggcatgaagatttctgaagcgagaagatcagaaaaactccaaaacccgaaattcatactcaagtcaattttaaaaaattaatattcagaaattttcattaaaaaacgaattccaaacctacaaaaatctccggagtccaaccaaccccgccctggttcaaatgtggtatatctaaatgtaagttaaataaatatccacaaatgtaaattttgataaaatctgtttcaaaaagtttcgttttaactaatgtatttctcataaaaaattataactattcaattttcagaagaattaaaattccagcgataaatgattgattataaaataggaatatacaccataaaaaaagaaatatataaatcgacaaaaaaaaagaaaatctactctactgtccaaatgcctttttcaaatttcacttccttcaatttcgcccattttttaaatttctttcgcaactttttcgaaatttctatttgaattgttaaatgatacttcaaattctgtcttccattccttgtataagttttcaatttctttccattttttgccttctccaattttcaccagttgtcgccaaagcgactgagaaaatggaagaaaattgaggaagagaaatttaattgatttaaattggataattttaaatattgtgattaattttattatttaatttgtgatctttgaaattgtgattttgtccctccattgaacattttgtacatttttagcattagtcactctttttgttgttgatcgctctgtccaaattgctccacctacgctttttctttctatttaaacacgcacatttctcactcctcacatcttatacagacatcttattcatctttattttatatttatcaaataaacttctttcttatttgggaattattttcccccttattccaccccgccctctctccctcgcgccttcccatttttgcccccattttgccgtccgagccaacaagtggtgccgctagcaaacaaagatgtcttcagctcgatgccggatggctttggggcccgcgctgttccgacttcggcaacatgtcactacggccgaaaatttgctggacgagcccgtgatcaatgccgagacgaccgaaaaccttgaacaggaacgggggcacatcacccgtatcctgtcaaggatggaggtcgagctggacgcgtggggtgccatcatgaacggactgcaaggcccagcgagagaggcggaggaagcgcttttcactgcctttattcgagatgaccggcacttgacggagtggttggaagatgcgcgagaaatgctggctcacatagcagcagaactcgcagatgagcacaaccagccaatcgcggcgggaggacagcaaccagctgttgctgtgaatccacccgtgccagccgtgccattcgtcaacaatgccgtatttccaggcggtgccaatgctcaacagccagctgctgttgccaatgttgcaaatcaaccaccaccgatgccaatcaatgccggtggtgtccattatcaacagccatttgctgttgccaaccctgccaatctggcactaccagtgccaatcaatgccgcacctgtgccattagctactgcacgccttccacagctcagtcttcccattttttcgggcgaaccaatggaatggccagcattttggcagagtttcgagagtgccgtcgaccgtgccgcccttgagcccgtcgacaaactcaactatcttcacggttgcctacgcggtaaggctgctcgtgccgtaaccgcctaccgtggaggggacaattatgcccatgccgttgccgcactcaggcgactcttcggagatccacggaaaattgccgaagcacttcagtccgaactgatcaatctccggnctgtggacgatagcgttggatcactgcaacacttcctcgagactntgnagcgtgtgtgccgccaacttttgaaccctcacatgccngatgacagcccattcatgtaccaaatcatccgcagcaaattgc

SEQ ID NO: 18310 - DNA, 2042 bp, Heterodera glycines
gattaaatttcatcattaacaaaatattttatcagacagaattatgaaatttaattgtttgttcatctgctgattctcaaatctcaaaacctaccatttaattaaacaatgcgcttggcaaagccatgtgtcgaaattggttttatgataatttaacaaaaaaatcggcaatggtgaaacatcacgaggacggaagtgaattttaacttttaattccatcgggaagttgattttggtttagaggaatttaaaaccgaaataatttaaaagtttattgtgcaaaaagaacagcagtagaatgagttgatatcaattttacaagaattcaagaatatttaattttttccataattgcacataaccaaatgatcaataaataattcccagtctcgattaaatgccaaatgctaaatttcaagttaaaattaaattttaccattaatttacataggttatataatatatctcatatcaaataggcagaaaatttgaattctttttttggaaaaaattcgtttgtttttttttgcggggcggggggatttatttcagaggggggatctaattcaggaggactttatttttcaagcttttcaaatttttaaatccctaaaacgcagaacatacttgaattggaataatataaaatttattcattaacctttaaaatttcaaatcaaccatattacagtatcgcgttttcaagaaatactgtctcaatgacacattttccacttacgctttttcacattactatttttttaatattttcgggcaaaacatatttaatgattagtaaatttgagttgaaaatttttaacagatttaacttttgcttttttaaaattaaaaaacaaaagaaaagttaaatcttataagttttcaattaaataaaaattctttttaaaaatcttcaaatcccgcttcgtaaacccggatgaaaactgatgctgatccgctttttaattccagccaagttccccctggtttaggttttccataaattctcagtccagactaacttttttttctcctaatgctatgtacaaataagtcagccaagagttaaaaaattaacaataaaaagcataaaatttcctcattcaattcaaataaatgttgaaactcagccacgtatttgtgttgacgttggttgcttttccatgtccacgtcattcattggcactgcttcactcattcgaatatttaattttgaattaaatcaataaataattcccagtctcgattaaatgctcagcagatttctcttctttcctcggccagattgagataaacatgttggatttctcagcaaaagactgcaaactcagccacgtatttgttttgacgttgattgcttttccatgtccacgtcattttcattggcgctgcttcacatcattcgaatatttaattttggattaaatcatttataatttttaccaaaatgcttctttttcttgcttttccacttctttttacgttggctttgcattgctatgctttcaatggggcgaatttggcaagcggagacattgagccactgctcaatgaattgcgagaaaacagcaggtcgaatatttaaatttgtatttttatgctgttcgataattagtgtatttaattgttttgttttggtgttgaataataaattttagggacaatacaaataataaaatgcccgacttttcggcatgaataatttggtgccgggtcgttcgttactcaaaaaaaccatcaaatgagaatattttttgatatgacttatgctaaaaagcaaccaaatttttaattcttaattgcacatcgaagccctaagtgttttctatggtcatgcaaaatttcaaaaaatttcgttaagttaatttgaaagaaagttatgacaaaaaatgttcaaaaaagaaattttgcaggataatagaaagcattaagaactatcgaaaatatatcaaaattttaaaatttgattcatttttggcaaacttatgaataattttctgtcaaaaattttccatttgaagtaacgtcatagtaacctgtgc

SEQ ID NO: 18311 - DNA, 2864 bp, Heterodera glycines
cttttttgcattgtttattttgatcagccataactcgctttatctccaactaaaaggaataaagtttcccgttgttttttttcagcgtcctccaaaactaaacaattgtttaatcattccatgttaataaataatgacatgtcatgccatatttctccagctgctgttcttcctcccccaccgtttgcctttcccttccggcgtctcttcctcctttctgttcctagacggagtttaaccctaccactgtagaaaaagttggaaattttgactgttttaatagattttcagcgaagctttctttaagtcaaatttcaaaatttcacggtatccaagactaaaagcccgaaaatttcccgagtcgagaatctcgcacatcccttataacaactaaatttattttgagcgcaccatatttatttttatttgttcttatcgttaatgaattggcatctattgcattgagcattttgaacacttttgaacttgggatttattcactataatatttactcaaaattaatcatttcatttcaccaaataaattaaatttatgcaaaaatatgacaaacattgcctttgctattaattaatttggagataacagcgacggaactcaacatcaaaaaagtgtccatttatgaacgaaaaaggagaattaatggttcagcggtgtcgagaaacatcgtctgggagaaaatatcttgaaatcatagcgaatttgctaagaaattgctcctaagttttaaaattcgtgactgtttctttttaaaattttatttttccgtttttggagtgggtcaattacccccccccccccccctcctgtttatgggcctgtattttccaccctaatgaatgttttttattctccatcggttggattgcgaaagtgttccattcgcatttcattcccccgcttttccttctttgcttccgccgtcctttctcttcactttgaacagcgattggcgtagcgatgtccgtgcgtatttgaagaacattgcgaacagaatggaccagccgaggatgagcatgaacgcactgaaacaatttggacaaataaattcggaattagtcagttgatttcttacggcaaaactgaggggaaatgaatggccacgggcacgtgttcacgagggtcaatgccaagtcggttctgcgcgtcctcaacgccctgcagaaaatgggagcccgaagcggcgtaagagtccaaacggatgagaacagcggacccatggtactgaaaacgaacaaaaatgaaaatgtggtatttaagtggtcatttgccaaccgaccggttgtccccggatgacagcgccggggtggagaacggccacggcgacggacttactcgggtagaagtaaatcatgcgaacctaaagtcaaaatcacattattatttgaaaattcggcccaaattgagccgccccattctttttgacctccccagccgccaagaaatgctgcacaaattcatcgtaagaaacggccgaatgttgctgagcgacaatggcgcggtgttcgggcaaaatggcatttcgagagagcaaacggtaggcaatgaacgcaccgagaaaggccaatccgatgccacccaaaaatatgttgggcataaagcgaacggattccgcagctgaaaaaaagtgaaaatgaaagagaaaattatgaagggggccggaatatttttgcaaaatgaaggttcttgaaaaatcagagctcgtgatcagcgcattttttccacggtaaaacgttttttggcaattttaccattttttccgatcgtgccgaaaatttttgcatttcctttgtttttcggagaaactcgtgttttgttcactttctgtttatgatgatttttctttgaatatcattaaaaaataaaccgcagccaagcggataattaaatttaaaaaatcgaaaaaaattaattaaaacgcactcctttcaacttcgaattcgggcggcattttcttgttgaagtcgcggatgaatgctttcattcgctcgtcgaattcgcccggctttttgtcacgggacataacgaattggcgcataaatccgctgaattctttgttgaattcgcgtaggatttgctcggagtcggaagagcggccgaaattggcggatgaaaatgaactttggtgtcggtgttcgtccccttcttccttttgcttcgtctcctttccgtcctcatattctgccgattgtcgacgtgtgccgcccccgcgacggaccgtacgaaattctgaacaaaaaaacgttccggattaaagcgatggaatttaggaaattgaacatcccatccgctttttgaatgcgttcaatagaaaactttataaacaagcccctcccgctgatcccattgcaaaacgcacgtgtcaatgccgtcccccccattcggtggaacggagaggagtgccatcgattcaaaaaaatgccaaaattgtttattgtggcaaaacggtgggcggcagtgacgcacatcggatggaccattttgactttttgttttgcttcacttttaaaacaattggttagacaaggttgaattgtttcatacaaatagaattctaatgcaaaaaaagcaaataatacgaatacaaaaaataatgcttcattctgaatgcatttgcaaatttacaaaataataaaacttatgacagaattaaatagggaggtcggcaatcaaagggccaaaataaaaaaagagaattaaatgccaaatggaaaaatgccaattccgtcgtattatccgtgtccattcgttcttcgtcccttttgtcccccgtttttttcattggtttcgtacgccgagcgtcgcttccactcaaaacggcgttgttggacctttgcataactga

SEQ ID NO: 18312 - DNA, 2543 bp, Heterodera glycines
aagacttaaaaaaaatttattgggcggtaaaccacataagtaccagaaattttttttaatcaaaaattttcgaaattattgtgttcgaatgagcaaaatttaaatttggttatagatgctaattgtttgtcctaaagatttccctccctttttgtgtactaattcgtttcttaaattggttccgaattttttggcattttgaaataaattgtaaaaattcgaaacaaaatactctgaagatttgtaatttcacgtcaccatgcttttaagtcccaccgcgaggtgggacagttccaaaattttgtaccacattttaatgcggaaattccaagtaccttaattggacaacttcttgtcaacgacaacagtcgcctttggccccttatggaacagaaaaggtggaatatcagatggggtgcgtcccttcctaaaaagttctcttttcgtctacccctcccatccttgtgcactatttcttttcaaaattggtccaaatttttttgctttttttgaaatttaattgtaaaaaaatatacaaaaattcttttctatttaaagttgtgcttctcattgcttttaagtcccaccatttccagactcaaaattgcataagatgactaaattgatcagaattttcattgccaaaatgtccttttttggtgaaaatctgttaataaatcaggacgaagttacaaaatttttccggcgtcggattctcttccctcgcccattcaataaaagtcttttttttgtaaaaatgcgccgtaaaaatattggtaaaaatctgattttttcatcccgaacagtgatgccaacccgaacccgaaacccgaggtttttctcaaccagaaacccgaacccaaaattttttgagtgaattggacggagaaaacgcaatggcagtgctttacgcaggtaaaaattttcttttagggtttttgtggtaactaatgaaattttatttcgaactagggtctggctggccccgaccccgaacccctacatttttctgggttaacacgacgcttccgacccttaaccccgactcgtggtcggggttaaatatacactcataagaatggcattttcgaaaaggcaaaagaatttataaaaattttgaatttttttaaactattttgccaaaattttattaaataaagtaaatttactatgtttagtcatatgtagagcccggacatgcacgaaaaatgtgaaaaaaggcataaaaaaataacaataacatcaaaaaaggcacgaaaaattgaaaaaggcagcaaaaatcaacatttttctagcaaaaaatctttcaagaaacctttttttttgctcttcgggcctaatttttttttctccatgttatatcaacaatttcagcaccggagcgaaaaaaaaaagaattttttataaatggggtccggcggtgccgataggcgccgctgggaatttttttttggaaattgtaagaaatgtgataaaaaaaatagcaaaaaatttaagaaaaaggcatatgtttcaaaatccaggcttagtcatatggattgtggtgtagtggttagtgcatcaacacttacattcctttctgtcattagttcgataccgtttgacgtttgctttttaattaatttttttttgaatagctaataggattttttaaacaaaaatgcccataaaaacgatcatccttggaataatttgttgacaaattgaatttcaaaaaattttcttttcgttttcctcgacgaaattatgaaatgtttagacaggccaccttttttgcgggcgtcgcgctttcacctaaaaatatcgaagaaatttttttatcggaattcataaatattgaaaaaaatactccaaattttcaaaaaaattttcccggcggtgcctatcggcacccaccgccggaccccgtattcctaaaaaactcgagaccgagaccaaaaaaacccgagacttttctcgagtcgagactcgagaccaagactctcgagcatcactactacttaccctgaaatattcgtttgaacgccccaaagtcacttgggtaacctatcctttgttaggaacaccttttcggtgactttgaaaattaaaatttttcagaaaccatctgcagaattacccaaaaaaaaatttcatttcaattgcggtgagtgccaattcaaataaataatggccaattaaataaaagaatcataattaagcaattgatggacccgagcaaaaaagctttctacaacaaaaatgaggacaaagtgacgttggccatcgatttcactgtaaatgaagtaaaaacggacccaatatgatcttgtaaagacctcatcgttgaattaccatcacatggacctgtattttttgtaatattttttattgtttacatttttaaaaaactcatagtcaagagaccaaatcaaattttacatgctaacaattcgtgttaggtcgtttcctaaaaaccgccaagtggtaggaaaacaaaaaaaaatgtaagacatagattcataacttggtccattttcaaccaaattaataattcttggtat

SEQ ID NO: 18313 - DNA, 2178 bp, Heterodera glycines
tttttttcctttttcttttttgtccattgtctttaacttttatttttcaatatttcgtgacaatacaattaattattatttgaatttttcataaaaaatttaaatatacagtacaatatcaaattaactttttaatgtgcttaaaatagtaaaatacgtttctcagcaaaataaattcggctttttcacaattttcacaacaaatgaaattgaataagctcattaaagtattttagttaatgcattttctgttccaattcagacaaataaatgaagcttttcgttctcattgcttaagccttttatgcaaaaatttattttaccattttcatttttataggaattatttattcttaattataatatatctgtgtaatgagtagggctgcaaaaaatatgtacaaaaagtggtccaaatatgtacataaatatgtaagaaaaatcccaaaatatatatgtacaaaaaaaccccaaatatgtaaataaaattttttttatggtatttttgggaaagaaaatcccggtaaagtatgaaatagccacaaaatgacataaaaattactttttatggtatttttaggcaacattttcaaactattttttctttataaattttcaaaatatgtaaaaaaaaaatgaaaatatgtacaaaaatatttgccgaaattttgaatttttttttttgaatatttccaaaaatttccgtaaaaaatcctcaaaatatgtaaaaaaatgaaattatgtaagaaaaagtccaaaatatgtaccaaatatgtaagaaaatcccgaaatatgtaaatatgtataaaaaccccgaaatatgaaaaaatatgtaaataaaagtcccggtttttgttcgcaaacacaaaaaagaaagtgtttttcctgctatttagagcaaggagaagccaggaaaaaaatatgtatttacataaaatttgcagccctaatgataagaagctttttctaaacaaatattaagcaattataagcatttgaaaaaagatataagcgattgaaaatttgttttttgaatctgggcttcaaatatttctcatatacccaaaaaagatatttgttttttctctgcactctctctttattgacacatgtctcgttttttgagtcggtgtaggctaaaatacgaacataggcttagatgagcactatgggtacgccccagtgtcagacaaaattactcataacgccaaatagcgtaattggcgtaattttttgcgcgctaattcaaaatttatactggtaaatgccttttttgcactgtttattttgatcagccataactcgcttcatacccaatcaaattgaacaaatttggtatctaaaaaaagattttgaaaaggagaatctttttctaagcgaatgttaagtaatttgtcatctcaaaaaaaagttgtgggagtttcaaacttttatcatgttataactcaggtcctaggcagctctttctaaccaaaatgctaaatttatttttttctattgattctaaatgctcaaagtgattttgtacccttataatcaaaattattagaatttgcgaatttatgtttttcatgtgttagacatgaaaatagtacgccaaaacgagagaaaaagaaatgcatttgtatgttttattttgttacttttgaactaacagataaaattaaaaaataaacatagaaatcgatgcagaatttttttctctatcggtatgcaaaatttgaagaaaatctgtaaggcgaaaaaaaagttgtatagagcgaagtaaatgttgtttttcacataaaatgagtaactttggatgagaaattgaaagagattatgaataatagaattgggagccggaaaatgcgacaccggcggaaaatccgacaccgagagaaagtttttcatttcaagaaaatgcgaggcagtactgctcttttgggaaaagcagactgaaacaatttaaccaaaagggtccgaagcgatagatttttataaatttattgccgagaagagaagacaaaatataaaatcatttttaaaagatcaaagacgaagttgtagaaaattgtgtgacaaatgaaaaatgcaaaacaaaataaaaagataaaattggcgaaatgtaaaatataatttaaatttaaaataaatgatgaaaataatgtcaaaagggtctccgcactcgtatgacgt

SEQ ID NO: 18314 - DNA, 1781 bp, Heterodera glycines
gatttggttgacaagagaaatatattatagtaaaaacattaaatgggatagaactgtgcggggccgaactgaggtatagcagccccacccgtttgccggacggaaatggcattagctcaggcagtggcaccgacggcgccggatgcgtagcgggtgagaatacctcataaaaattagacatttagtcaaacgaccgtgtattatcctatttttaggacaaacttctatgtccattaaaattcattctcattttttaaaagaaatctttaaaaaaatacctttttcaattaaaaatatcaaaataaacatagaaaataataatatgttaaattttatgaaatcatttgcttattttatgaaaattggtaatgcaatgaaaaataataacaaagcgttaaaaattaatccaatttatttacactccactaattttaggatgcttacaaaaattgactttttctctcactttaaaaataatttttacggaatttttaataatttaaaaaataaggaccaaatacctaataaaacaactaaatttattgatattcaacaaaatttagcacttgttttcaattatgtgccaactgatgaaggcgtgtccagcggtaatgagcaactattcttgccacttcatcaacaggtagcaaattgagacatttctttttgtctctattcaatttttactgatcactgatcactagtgatcagaaaaatctcggaattttttttttgcaaatatccatttaaaaaattgttaaaaatcccaattctggcataatgtttttaaatcaaccgaaatgttcctctctcactaattgtactgatttctactgctgttcgagaatctcgatttaaaattctaaatttatcaggtttttgggtcgctcagggtaactcctccgtcttgagtctttctggttcaattctcgacggagcctaggaaaatttgggttctagaacagcccactaattaaccttattagttaactaccacccttttcacgcgtattatcaacgcagattgattatgtgccacttttgcgactcgctgccgatgctcgacttcggcagcaacaaaacggcaccactctttggtggaccgacagatgtggcggtggtgccgatttggtcattgatccgacactttgggagaataattcgacgaattggggacgtatttttctgatggacagaagcaacaacgaaggacttttcaatgaacaaattttttcgttgtttggaaacagtgagtaaatgattgactgaatgactctgacagactaataatggcataattaacattttaatcggctaaaattgtcattttcattgagaataatttccattaatccggtcaaatagcactaattaattaattaattaattctggccaataattaaattttagacaataaaattatttatttgtcgcagactccgtgtgggccgcacgcttgtctctgctgatcaccgccgcactgatcactctcattctgatcgctttgctcctctacggcgttgaggtgatcaaacgtcaccgtcagtaccgtgatggttccttcacaatttgtcagtttatcactacacatccatttgaaccgcgctacctcatttcggccgctccccggttcggccccagccaattttttgactataacttttttctttgtcaaccaaatctaacaatcttggtatcattcgaaagcttaatgtgtttagaattgattatgtgccacttttgcgactcgctgccgatgctcgacttcggcagcaacaaa

SEQ ID NO: 18315 - DNA, 2989 bp, Heterodera glycines
  misc_feature (41)..(41): n is a, c, g, or t
cccctaagaatcgacccgaaaaattttcaaaaacacacccntgatgagaaatgaaaaatttctcaaaaattcatcttcaaaatttatttatttattttcttgttagaatttttgatatatctcattaatcatttggcataatatctttgctttttgaaggaaattttcaattttacacccctaattttggaactttttggcacctattttcccatttttagcacctattttgggggtttttagaacctaaaacctacctattttggcagtttttagcacctaaaaatatcatccctacttataatagaggaggacacctaaagctatcgctcaagatctttaatttgacaaagtttaagctaagttatgatttattattcagcaaataaaattaaaatattaattaatttaattattattatcattgatacttttttaggctcgacctaacaccgaccctttttcaaaaatttctttgctagaaagtcgtatgagcgtcatcagacgggcgtttcgcgcccgttttttagcttgttaggccgcttcacggcctcagtcgggcgcttcgcgccggtttttcaatttttgttggccttggacgggcgcttcgcgcccgttttttaaattcgttgaactcatacgggcgcttcgcgcccgttttttagcttgttaggccgcttcgcggccttggacgggcgcttagcgcccgttatttaaattttgaggtacaaaagtgattaaaagaggtacaacagtgattagaagagtgatcagaagaggtacaactgtgattagaagaggtacaaccacggaagggaaaggcacaacagtgattaggagaggtacaacagtgattaaaagaggtacaacagtgattagaagaggtacaactgtgattagaagaggtacaacaatggttagacgaggtaaaacagtgattagaagaggtacaaaagtgattagaagaggtacaaaagtgattaaaagaggtacaaacagtgattagaagaggtacaaagtgattagaagagtttagtgattaaaaaaaagattcggacttatttaaaaataaatttgtaacatttttaaattaaaaaaaatttactgcattccacattgaaatttcttcacggatttgcaattcgtcgcgttccaaaatttcgcacaacattttttggtcaatttgcaaaaatccatccgatttgatcaaagtgtcggcattttcgtcaatgtaaaataaacaatggcaggcaaaattctaaatttgaatgaaaataaagtattaaaaaaaattggctcttgattgagaataaaaataagtgaaaaaaggaacattatggaaaaaatagatgcgataatttccgcttttaaacacaatttagaaatatcaagttaaattgagagaagtttttctctcaaatttccttactatttttctcttctctgcccgccgctaaaaatggtagcagcgacgagtcagagaagagaaaatagtaaggaaattgaagtgaaaattttattttttttattcaaaacaatttagtgattaaaagaggtacaaaagtgattaaaagaggtacaacagtgattaaatttgaacaaaagttgaggccgagttgggatgggcaaaatgggaaaatgtccattcaaaatttcattacatacaatgatgaaatgtaaaaaaaaattactaaaaaagccaaaaaatgattatggatatttttaaataaaaacattttttgcaaaagaaaaaaacaaaggcattgatgaatttaatagatacttgtctcagcaaaaaaaaatttgcggcttcagaattataaacagaaataggaaaaatggttgatttatgaaaaagatttaatatgaattcaagcaccggactcttctttgcactcgacataacaatgtcctggccctttaaaagggtacttgagtgcgtatttaatatttgctttgttaccatatgcaaacagtacattatggtgtactcggtaacgtagcagaatataaggattatacggcacgacatgtgagttgtcgtatattaggccgtttacctctaattgggcaccaccatcagttggtgaaggccggaaatacatcgcgggcctgtccgggcgcaaaatcgtacattttgagtaaggggctgggaaccccttcttgcaccgcccgtaaattgggtcgctaggaccacaccaactgtcactgcatctgtgcagttgcatatgcattgtttcgcggatttcgcgatgcatttttgcaatgggcgtgtcgtcatctttatcaggcaaagatggaatgtgcgcccatatgtattcctgaatgacatatggaactgcgtccaggtctgtttgcgccacaatgtgggcatgtgggcctcctcggccttggaactccattgattcaccgtaaccaaggattgttccgaagaactttttgtcataaagttcttctcggaactcagcgattttgctgctccagacacgcatccacatgtcaaaacggtcagtaaatacttgaccgtttttgtgtaaattctctttgaactcaggccattccctgttgttcgtgaatgtaatgaagagacgcgctttcttcgcgtcatggcaccgtgcaaaaacggtgttgcaatcttcatacattttcttccaatattggagagaatttacgttgtgttcggaaagccgaacaacactgccaatgtcatcaacagttttctgttgggcattggggttttgccgtgcttgctgcctgttgtattggttgaccaaatactgcagcagattttttggagtgctgatccgcagatccatgtcaggtctacgcaaaaatgttgctatttgccaatcaatttttgcagcctggtcaaggatccagcgctgaccaagtcctccaccacatgaaagaatgtggtggtattgcaactccacattttcatcccttattgcgagataatacttgcaataatctcgcagggagataaatt

SEQ ID NO: 18316 - DNA, 1917 bp, Heterodera glycines
  misc_feature (150)..(150): n is a, c, g, or t
ggaggaggacgcgttggcgcttcgcatggagcatccatgatggcggaggaggaggagcacaaccgagcgcagggcggcgcggaaagggacggcggcgaggcggacgaacgcgtttcatttgcggcgagtggacacaaatgagtggcacanatttaaactggagaaggcagccgacggacgaagtcgataatattgcgaggagctcgggaacgcgtttatttagacgtacgacgtaagttgcaacatatctgtagccagaaacatgcagcttagtgcgagctcacttgaccacaattgctggcggggttggacacttacggacgaaagagccgccatcggaatgcacggtgtggtggggggcgaggaacggtggggggcgggcgggtggcattttgaaacgaaggcatggaaatggcattttttggaattaattcttattgtattgtacactttcttggctgttatttgcggatggactttttacggcgttcagatttcttgcccgatggtgatcatacgcttttgcgcgagttgatcaagcgttcaaacacaacaggtgagaagcaaattaagaaaaaaaatcctcgttttgcttcagccgcaccgccggtgattccgcctttggtcgaattggccgcgcgaagggtcgcctcggcactttcctttgagctgatcgaggccacctacgcggggttgcccagcgaacagcgggcacatcggggcgagcatttgcctgagcatttggtgctgcccatccttcgccaatgctttcccaactcggcagacaacattaggctttacaggcaaatggaggcgaattccaacgaatttcaccattttctcccttttaagctgtctaacaaattgcagtgaagggccatttgtgatcggagaacaggtgaaaaaaatgagaaaatcggggtattgtctaattaattaaatgcattttcagcttttccaaaatggcgctgtttccgaactcttccaaatcggttcgtttttagaccaaattttgcaaaagaaaatgccaacaattgaaggctatcacttgtcggccgtcgtcaatgaccaccaacggtttggcgatgtttgtgggagcaccggcggagcagcggcggcggggcgacgaaggacggcacttttcgatgtgagcattcgagtggacaggtaaagcggcttattgttagaattttgtttagctgttgactggtgaatccctattgtccgttgtgctttttcatcgtgtttttctttgcaggtgtcgggtcgtctcctgttcctgttcctgctccaactcttcctattggtgtcaacatgtcgtcgccgcgtgcctccaacgcattcaccggcccgactccgttcagtaccgcgtggccatttgggactcgatcaccgcactgaaggacagggacctgaagaagttggcccagtatttgatcaacgaattgccgcgagaagtctgtgaccgcaagaagacttttcgcatgatcagtgaattggatgcccattttcagtacattccggtcgcgcagaaactgatcgacgctttgcgagaccccacttcagcgatcaattgcacacatggagcaccaggtgatcaaagggaggggggagcagcttattttgattatacaaataaaaattcaattccactgggaaacacccggttaaaaaccgataaattttataaaaaagccattcgtttttgaattttcgaattaagattcaaaaagtttgtctaaaaatgttcggtatcgccccttacaattagccccatccgccggtctttcgcatgcgcagcccgccgtttggtacatggacgagaccgcgttgcgcgacgaagtgcacaaaattctgctggactttctgcgcaagtcgtgctcactgagcgtggtctgcgagttccaatcgctgctc

SEQ ID NO: 18317 - DNA, 2794 bp, Heterodera glycines
gggggcgacggcggtcatcccctccccctgaagggatttgaatggatcagcagataaaatctaaaagctgggcgaaaaagcgctgaattattggagagccaatttgttactttggaacagctaattcaaaaagtctgctaaaccggactatagcaccaaatcaaatctaattctgttgatcaacagccaacggactgctgatgagagtgaatgggtttaaaaatttaatgctttttaaatgattaaatgaaaaaaatagcacagactaaggatgacattcctaggcctcaaattttttggaaatcggattccgaggcctaaaaatttttcggaagtcggaaatcggaattctgacactaaaaatgtcggaaatcggaattccggccccaaaagaaatcggaattccgacccaaaaatgtcggaaatcggaagtcggaattccgttccatccctggcacaggtccaagcaaatggcacaatttaaatgtaaatttaatcaattaagggattttagttaaattcaacacaaaaaattatgcagcagccagcatttggagtgatttgcataaatttttgtttttcttctaagaaatgctcccccataacctataaaaatgtccgtccgattttggggctcgcacttttgcgcatcagccgaagcaaatttaagaaaacgcgttcaattggcggtgcttttgaacgagtgatgagcaatgcaaagaaatgggaaatttgagtaaatggcgaaatttggtaaaacgcgcggcggtgaaacggacgaaattttggggaggggaggaaaaagggggacagctgagagcggatgtttgcgcaagagaattattataggaaagaacagagaaccaatttagcagaaaaacaaatttaattaaatttttaaaaatatgcaaaaaaacaaagaaaaaatttagtcgaatttgcaaaatctttagcatgttttaaaaattcattaataaaagttttaattttgttcttcgttttaaagcagccaaaaaccaaaaaattagagactattttttacaaaatttttaataatgcattttgaaagttttaaattcggcatcacaaaatataaatttttcttttttttttggggggtggggactgtgccatatttttttttctttgccaatttcacactaatttgaatagtcacactgttggacattggtggggcattaaaattcaatttcaaaatttaaattctatttcgaaagtcggctaatttaataaatgcgcactgctttattatccgcaccaattttgagtgtatggataaataaataaacgaataaattgcgaattttgggcagcaaaatgcgacagagcgtgaccaaaaccacaacaaaacggcaggcgggagaaggagcttatgcgggcgaaaaagtggtcggttatgtgcagcagcaaagagtttactgcaaaagcaaagggcgaaaaaaggggggaaaagtccgtcccaaaaagggaaggacggtgcggctcccggtaaattggacactattggataaaaaataaataagttaaaaataaataaacaaaaattttaattgaataaataatgttattattatttgtagcatcagctgcagaaagtcatcatacattcataaagaaaaaagttattttttttgcgcattttttggcacattgaacaatcatcgcctaatttcgtacattttttttgccacatttgatcaatcattgtgcatattgaatgtttaagttcctgggtttatattttaaaagagtaatttgatgtccaattttcctttggtgtccaaaattccgacggtgtccaatttaccggtccccggacggggacggtgctgggacgttagtcaaaaaccatcaaatggatggaaaatttttgaccagaaaattcttcataacttcgctaaaaagctaccaaattttatgatcttgatatcattcgatagccctatgggttttatattatcctgcaaaatttcaaaaaaattcattaacttttaagaaaattatgagcttagaaactaaaaaaaaaacaagttttttgaacatttttggtcataactttctcgaaacttgataaaactttttgaaattttgcagcatgataaaaaaacacttattttttgagggaatttttaaatttatactctatcccagaaaaatggctatctctttttttgataaattttatacacatacaaatgctctcgagcatgatagggagggcggtgcgcaatcgaccttttatttttgagggaatttttaaatttatactctatcccagaaaaatggctatctctttttttgataaattttatacacatacaaatgctctcgagcatgatagggagggcggtgcgcaatcgaccttttatttttgagggattttttaaatttatactctatcccagaaaaatggctatctctttttttgataaattttatacacatacaaatgctctcgagcatgatagggagggcggtgcgcaatcgatcttttatttgagggaatttttaaatttatactctatcccagaaaaatggctatctctttttttgataaattttatacacaacaaatgctctcgagcatgatagggagggcggtgcgcaatcgatcttttatttgagggaatttttaaatttatactctatcccagaaaaatggctatctctttttttgataaattttatacacaacaaatgctctcgagcatgatagggagggcggtgcgcaatcgatcttttatttgagggaatttttaaatttatactctat

SEQ ID NO: 18318 - DNA, 2292 bp, Heterodera glycines
tgaaaaatatttgaaaataaaaagtgaatttatgaaaaatgagaaacattcactgaaggaatggaaagaatttagagcaaaaattaaacaaaagtttggtgtgagtttcggtggcgcaaggagttggaaacagaattacaactgccaataagtaagtgagtagtataaggccacaaatgtggtggtaaattttacccccaccattgtgcccttcgcagcgcgcgccggcgttcgccccctccctccccattgtgggagagtgttgtgcccttcgcggcgcgcttaaccccttttttttgcacgagttgcgcgcaaatattacacaaaaccgtgcgagctataatttaattagtcgcgattatttggttttgtaagattgattttttattaaatatacttagatatagaataaaatatttctctatttctttctattctaaaagggctaaaaaatatttctttttcaggtttaaacaaatgctttactgcagttattctaattttattgtataacattctcatgttaaaccgataattttgcacttgtttttcgaattcatttatctttgaaaaacaaaggtccgatatattctctgcttcttgacatttaaatatatctgtttctttgatgccaatttctagtttctgcatagctaaggcctgttttctatattcactcataataagaccgggtaatttttgaattttttcgagcatttctaagaatgaaaagtataaattttcgattccaggtgcactaaatgctgctatgtagaaagttttcacacctttaaaaagtttatttgcaaagatttcaagattatttgatcgtttaagtatattcccggctattttccaattttttgttacattattcttaataaaatcaatttcttgaattactgtagacatctgggattatagttacttctagcgttataacaccatccaaaggataaaaaagcgaatattgttcttcttttaataagacgtgttggaacaaagcctcggccgtgttttcgttagggtatcgaagagggcaataaaatgattcaaaaccaaaagaaagcttcaaaatgcttctgaatttcccttgctcatttttataattttcttcaattaacgatgtgaggatatctttaaaattttcctcagcattaattatgaaaggatttttaaaataaaatttagttttatattttgtaaaaccaaattttaagtcttcatgacgaaatgactcaattaaagaacacccttccattttgagtgttgcccttttagtttttatgttcttatatacccatatgctcccaaacaattgtttggagcctattttcataatttaacatttggctttgcacccttcgggactcgaaatgtaatcttcgggcttctgttaaagaattttgagattgttcctcaagctttgttgcctggtcaaaagttttgcatctttcgaactcacgccacgcagattcagctttttctgactccaaattgatttggtccaggattttaaaaatttcccaaattgaatcggacattttaaggtacaattcccgaacaccattagcgtaaggagctttttctcttgattttattgcacgattaagagtttctcgagaagacttggcaaaatcgcttacatcatccgatagcacaacgacatctcgccatgctctctctgtctctcttttagcagcttccaacaaaatggaattagctttttctaatttttccaaattcattttttattttttatttttctgtttttcttttatatatttttattatattttatattcaatgaattcgtctctaaattctgctgagggtcttggcttttcaaattttatttgattttcttgcattatttcttttattttattggccatatctccaattcctaaatctggctgtgaataagagttacgataagtctgtccaatttcatgcctatattttttagctatttctattgattgtttggcatcttcggctaattcttggcacatcactgggtcctttctgtctagacatttttccatgccttttttaatattttttatattcttttcctcattttttattttatcaaattgtgaatgtatttttcttactccatttaatagtttttcatgccaaaatatgatttcagattttcccgaattcctatcattaataatttgagcttcaaccatggtattatgagcagaaaatgaaaagtctttggcctcattagttaacctaattatatctttaattacttcttcacaacccttcgggggcatc

SEQ ID NO: 18319 - DNA, 2211 bp, Heterodera glycines
atatttaaatttgaccatttcacaccaaatatttgctctttcaattgcatagcaaaatgaacaaaaaaccgttcatttagtgacaaaattaagcaaataaatcaaaaattaattaatgtccaaatgaatggcaaatggacaaaaggcattccgccggaggaaaatttgcaaattaattaattaattaatggaaaaatctttctcatatcatttcctgttttgttgtctggccaaacaacaaacgcttcttctcccttatcactttttctgtttggcataataaattaaccaattgtcactttttggtttatcagtgagtgattaaaatttgttatatttttttgattgctttctcacattttttcccattatttttcagcttttccttttttttttatttctccattagcttccaattgaatgatgttttttttctttttttttgtcggcgaaaatgggaaatcaatggaaaaaagtgaggtgacggagaattatttttgtgtattgtacccatggaaagtgagcacaaaagaagagaattatggtggtgtaaatttttccaattgtgaatgaaatttaaattaatttaaatttaaattcattccagctttgatcggttgttttaattgtttgatcgaatttcggccgatttattccgtgctgtgttttaattttaatgattagccatccctttaaaatgtccgccgatcaaaggaacaaaaattcaaaaaaaagagatttgcttcatttgcccattgacatctttcgcattttatttttccgattttacccccgccaaatttggccaaagaaagcgaacagcaaaaaaaggccaaaggattttgtgtttttatcgcccgttgaaatggcctaataaaaaatatttgtgagttttgcgattgtttcgcctttcctttgccttttgcgcttttcctccatcgctttttgcttctcccccaattttcactttttattcgtcatccttttttcttataaagaaaaaatttctattttttaatcaaaaagtgttattcaatcgaatttctttaacactttttgaccattaaaataatttatttattagatttatggtttttattttattttattccgatttatgtcaaaaaacgagaaaaacaacagaagaaagacaaagaaagaggacaaaagggtttgatcatttgataaacgaattattattacagtatctgaatttaattttttcaagaaaaccaagaattcaaacagtccatcaagtccgagcagtccaccgacttcgcctgcactttcactgcctttgcccgcccatccgttgcaaattgcgcacttttcgctaacgacggagacaaattggaaggaggagaaaaagcgaagaaaagcagcagaatcacttaaataaaaaaattattatttaatattggctaaatatatttcttctattttaaattcaaaaatcatcaaatatattgggcgagaatgagggtcccgttctctcgcttttgcttgaatgtacagttttgttcggaaacgaataatgcgggatttccgcaggggattcccttaccgcgatttcttaattccattttccgcttctgcatacgtttttaatttattccagcttcttttcttgaaaagtagtcaatgaatttgcgcaagaagactaaggtttaaggatgttctttttatttaaatagcttacaatttgttatccaatttttaggtcgaaccaatagaagatgagattcctgagaatgagcagcaaataaacatctctacccgttcacataactcttcttataacgcaagttacatctttttaactttacgatttaatatttacagtctgatcgtgtcaatgaaaatgatttggttaaatcgctgtctcaatgtcttctggcaaagtatgagttgcttaaacgcacttcatttaaaaaagaattcagcgtttctaaacgagggtttgttcgtgatgccgacattggagaaatgttctcagaccgaagagaacgcgagttgcgagcgaatgttctgaagaagagtgagaaattgctgatggatgttcttggataccgagtcagaggaggaatttctgaccgttttttattcttttttagttagatcgagatgaggaagggaagcgtttttacctctcgacaaatttatgtaaaggaattgcaatggctatggtgagtgattcttttataatcatgt

SEQ ID NO: 18320 - DNA, 1994 bp, Heterodera glycines
  misc_feature (113)..(113): n is a, c, g, or t
  misc_feature (381)..(381): n is a, c, g, or t
  misc_feature (1922)..(1922): n is a, c, g, or t
gtgtgcaatttatttaagcatttcggttttattttattttgatttttcccattttgtatttatttaataatatatgtataaaaagcgcgttaaaattgctataattaatcttncgaccaataaaaaattagtcataaacagaattcacaaaaaccgggaatatttcaaatatcacattaattttgacattttttcagtaaaatattttaaataattgatcaactaaacgatgatgtgcgatcaatgaagaacttcctaaaaaagtagggctggtcgggaccggcaattttgacaaaaaccgggactgggacttgccgggaccagaaaagtcgggatcgggaccgggaccaagtttttcgaccgggaccgggaccgcgaganaagcctggaccgggaccaaccgggaattttcccaaaagaaaattttttggaaaaattttgaaaatagcattataagatggaaaaaacagttttgtgaagaaacttcgtcgaaaaaagaatgatccaggctatttaacgcgataaagaaataaaaattccgatcaaatttgttttcccatataaatccaacaagaaattgttttattaattttggttttttgaggcaatatgtccggcggtgtatgttcggtacataattttatgagatttattataagattatacaacaatatttggtcatattttcccaatgtggcattttttcattttgtaatttttgacggtgtcgtaaatggcaaagattgacttgaatttgtaaatacctaacaccatttttcatgttcttatgagcaaatgtgatagcaaaatctagtctaattcgaactgaagctgaataatctccaaactgtacaataattctggttgatcagataaagtgccacagagtcaacaggtatgagtcctccttaatcgccttgatactgtgattgggttattgtaagttgtttgcttttcaagtcatgtttttatttgagatcattaattaccgtcagtttttcatgaaatttcaattttttgaactgaagctgattaaagaattttaattatttttaatcctttaaaaatttctccaacaaaatgtttctaccaattttcagcagtttacaattgccaattcattcatttttgctttttttatttgccaatattttttccattttttcttttgtcgttattctttcactgctaatgccaaattgtttaatccggtacttttcggttttgtgacccccccccctggagttttcaaataaaaagtcatttctatggtaatttggggcgctgatcacgaatatgacatttatttttcaaaattccgaatcccgaacccgaattcgaacacaaattcgaaattaataaattacacggaaatttttaaatcttttcgccataaaatcattaaggcatattatttcttttaaccacttttattaaatattaaaaaaatttatttatcaaatacaaatacaatctttttgaaaatttatataacaaatctattttttagagcgcagataattttttaaataaatttatccaaattttcataaatttttccgttttttcaatccttcaaaatttcttccccaaattgtttcttccaattatgaatattcgtttgggaaattttcacaatttttgcaatttccttttcattcatttttggattttcttttttaatttcccaataaattttcattttttccattttttcttcctccattagtcttttcttgctaattccaaattgtttcttccatttcctaattgtgtcataaccaactccaattttcttacaaatttccgcataattttggttccattcttttcgtgaatgttttcttttttgcttatattcttctgtcatttcaatgaatttttgcacaatttctaatttttcttcatcagtttttgatttnatagcatttctttttttggagaccaaattctttaatccatttttgaatattttttgcgatttgtccccaatt

SEQ ID NO: 18321 - DNA, 1479 bp, Heterodera glycines
catttcaatcactgggcactcaattctcctgcatttctatcactgaaactcaacccaccagcatttcaatctctgggactcaaatctccggcatttcaatcactgggactctattctcctgcgtttcaatcactgggacaacccaccaacatttcaatcactgggactcaacccaccagcatttcaatcactgggactcaacccaccaacattccaatcactggcactcaacccaccaacatttcaatcactgggactcaacccaccaacatttcaatcaccgggactcaacccaccaacatttcaatcactgggactcaacccaacagcatttcaatcaatgggactcaacccaccaacatttcaatcactgggactcaacccaccagcattccaatcactgggactcaaccctactgcatttcaatcactgggactcaacccaacagcatttcaatcaatgggactcaacccaccagcatttcaatcactgggactcaacccaccagcattccaatcactgggactcaattctcctgcatttcaatcactgggactcaacccaacagcatttcaatcactgggactcaacccaccagcatttcaatcactgggactcaattctactgcatttcaatcactgggactcaacccaacagcatttcaatcaatgggactccccaccaacgggtcaatcacttcgaccccactcaccaaatttttgcgtcaaaggtactcactcggccgcttcgcggcctcgtaactggggccttcggctccattccagtcactcaaaattcaatctcaccaattcttcaaaacccaataaccggaaatgaatgataaaaccgacagcggctcgaccgcttagcggcctcgcattcttcttttggcattttcttatggcataacagttcttccttgtttcttgactttttcttacgcacaacatttttcttctatacaaatttttcaaacaaattctcattcattcatttaaaatttcattaccatttacataagcaaaacaatatctttcatatcaaaaccaaatcaatttataacacaaacaacaaagaaagaaaaagaaacatttttaagactgttttttacacaaaatgacaaaagaaaaaaatgtaaaacaaaaacatttcatttttcaaagcatttatacaacacaacacaatgttaatattataggattttcttagtgaacaaactaaggagtgtcctctttcttttgttaaatattttatacaataaaaaatgggttataaataaggaagggatgcgagagaaatttcccattatctctccctttcctttcttttactctcttttcttttccattgcaatttactctctttttttcccactccctccttctcccacacacacgcacgcgtccaacagactactgctgcacagcaacacgcgtatggtcactgtctgcccctcccatctgccgctgcccgcata

SEQ ID NO: 18322 - DNA, 2975 bp, Heterodera glycines
attttacctgtaaattaccaattttcagtgaaaatctgtttaaaaattgtcaaattttccaatttgcccccggcggcgcctagcggcaccgccgggcccccgaaacttatttttcataaaaaatggctctaacgcaaaatttatcatttttagtgaaaatcttttagcaaattgcactcaaattttcaaaaattttcccgacggcgcctaccggcaccgccgaccttgttctgaaaaaaattttttttggaaaaaatgcgcctttttattgatttttttcttcatttgtaagaaattttcaaaaatgctgattcttgaccccaaataatgattttttgtttgaaaaatgatgattttgaaaattttcatttggcaaccctgatttaaatagttgttttccgttttattagattacttaaattacctttttaacattttattgcatatattatttcatatataaactttacatttttcttcgcttatctttttgctgtatataaataattgttatataaaaacatgataattctcacgatattttctaactattttaaattatcttttataatatttgttagtttattaaacttattttaataattatttaatttattcttttatattggtttttttaattaagtaaaagtgttaatattctttagctataattttatttatattttgaatcgatttatttttgacgaagtttgaaaattcttattcttcttttttttcataggtgccagaatatttgaatttcggtttggttttcttggtacaacgattaatatggacattttaacaaatgaacatatgataattttatttctattctttttttaatattttaaaatgattaatgttatctgattttttatgttcctcaatttatttttattgtcacatttatgaattaaaatatgttagtttcaatcaagtgaggaagtttataatttgatttcatctctttttcacaaaaatttgaaaaatttgttattgaattcatatatatataagaggtcttaatagttggtttaagtatttcattaatttcagatccttaaatggttagataaacttttgtacaaattaaatatttatattttgacaaataaagctattactaaaagaggttataggttaatctgagtaaaacaatttttattatcaatcttgggttttatttcaacctgaggatttgcaattacacttgttttaatttattttttcttagtcatttatttttataatcaggtcttttttatatttaaatattatttattttatgtgttgcatatttttggaatatttttcattatatactataagttttcaaaataattcaagccttttatggatgatttgttttttttcgagccagtctttttataagacggtttatccgttgacccaaatctattaagtgtcctattcaaataaaatgataattaataaatgttttaatatattgctagtgtttaacgataaataataatatttaaaactttattatcattacggtgctaatttcatatctttttaaaacttttttagttatttagttttaaaataggaattatataatataataaattattaattatgagaaaagctaattcgcacaattattcaaagagtatcattttaaatttcatccccaatttttatttaaaagtttgaattattcttttgttttattgacatttttgataaagctttaagaatatttggttacattttaataatactatttaaaattattttgcaaattaataaccttgatcaggatggttgtttactgagaagtgatttttgcaaattaacataaaatgtttgtttgatattttcaattatattacatattaatttattattttttaatgagtttaattcaattttttttaatttgtatattatttaaaaaattgctgagcactttttattgcttaaatttcaaccgcccaaaacttacattgagcaccacgcgccgactaggcgtcaaccaaggacgggcattgcacgccctcttgtgacttgaaaatgattttaattaattatttagaattttaagttaatttattaaggttatgggataatatgtttaaatggtagttcataattaaattttttaatttgatttattcttatgtcgaaatttattattaaatccctaaaatttatgttaaatttatttattaaaaatcagttgtagtccgaaaactcaataaaatttttatttttatttctgcaattgatattgattgaatggtcaaatttgttttagtaatttaaatttttacattaatcttaatatattttttaaaaaatggctgttccgtgacaagataaaaacagattaactataagtttttttagcatatctacattgaatttgattacctttttcaaatattatttaaatgttttaaattagaattcatttaataatctaatttaaattgatcgtttatatccacacttcgttttcgcatgcaacttttttgaaaaaaattttttgattaaaaattcataaattatattccgctgccgatagtatatttttatttatacttcttattattatttgcactttttaatttttgtcagattcttattcaatttgcgttgatgaatattaagaatagtaaatccgtattatttagtctttaattgtatattcattgcttgtctcaggagattcgatcttaagaaggatttttacagaaaatgaatatgaatcagattttaataaattttgtattttaaaatgacttcaactgttatttttccagagctttttattataattgatatggcatttaatcattttttattttaataattgtcatataatcaaaatttaaattaatccgcttttatttttatactttactttaatactttaaacaaataaattttaataaaaatttttatatgtaaattatttataatatattttaataatcctatct

SEQ ID NO: 18323 - DNA, 2974 bp, Heterodera glycines
cctattttataaaagcataatgtgccctatttgttaccgcgccgaatcctactattatttcactatttaattggaaatctatatttttggcactcatttgcaatttaaatttgaacattggcgttccgacaaatcttgaagaatgggaaacaaaagttcaggaaccgatcacaattattgagccggaaggcaagcttttttctatacaaatctcaattattaattctgaaattcataaaataaataatccacaaaaatccacgtctaattaggaaccaaaatattgaggtttttgaatttttaaaatcggataaaatcccaacgtctataatcagccggttctattttatcccatttttttccaatagtttatttcagcagatctgcacgttttggaaggccatttacagaaattgatgtcaaccgtgcatgagttcccaattgatgagcacggagaaattgcgacaaaaattttcaaaatattagggaaacggcttgtaactcaaatactccgcgcaatggactactgtgaacaggcatgtgatgaaagtaaagccaaagaatttttgtataatttttagataaaaatattcgaaaatatcgggtcagtctcgctctcgagaaaaaagcgtcgttcgactggacatacatataaataatataaagtctaaaaatgaaaataagctctccaaaatttgcagggaatacttttcagtacaggacaaattcgttttaatttgaatccttaaattattctaaaaaattaaaaaaaaaattaaatcgatatttttcattaattttcctatttttttaagtttagtcccccataaacattcgaaaagtgataaaccacacaaaagggaataatgctgagaacagttcgaatttaaagaaaatttatgtatgagtgggtgataaaattttacaaaacaactaactaattaatggggaagaattattattctaaaataattaattttaaaaacacaaaaaaagcaatgggatttcctatatttttaatttaataaataaaattgacttggaattgtaaaaaaaatcattataattaaatttaatttttggacagttgcggcaaagtgttgacaattttggacgagttgcaaatgagcaatatttggccactttaattgccaaaaagcgaactatcattttgggattaagcacagaatttaatacatttcttgtcgaagttgaacatgaaaagttcgcaaacaatggatggacaacagaaaaattgacacttttaattgaaaaaatggacaaattttttcacaaaaataaaatttattgtgccaatgccggctttgaacatgccaaaaatgaacacaatagactggttcgtggtaaaaaagcgatggaaaaccatcaccaagatggacaaataatggatgaaaatggtaaagattatagatgcacatacaaatttgctaagattttaagttcattcaagaaaagcttgggttaggttttaaataaaatttttttcaaggactagtgattaattaaatcgtcgctgatctgacggactaatataggcgttattttaaaaatataactttgctcaaaacaaccaaattttaaatacttggtacaaatcgataggcctaaatgttcactattatcctgaactatttaaaaaaaaattatttaacattcaaaaaagttattaccaaaaatgctcgaataacaagggtttcttgagttcttttgattacataacttttttgaaacttacgaagttttttgaaattttgcagactgatagagaactcttattgttagggctatccaacagatacgttttaatgatttttgttccactaattaatgaaaaattcactcattagtaaagtgccaagaaattgctgtccgcataaagctgagcattatggaaggtgaaatggaagccaaaattcacgtttattcaacacagccaattgatggcgacggatttatggcatttgcacgcgattttctcaatgaatccaaggaacttcttaaaatcattgaaaatttgtcgaacccaattcaagaaaatgttcgtaaaaatttgaaaaatttggccagtgttgcgcaacaaaagtccaaacagttgcgccagagcattgcgcaacaattggaacaattggtggcaaatgccgcaaacgaacttgccaatttgcagagccagacaggcaagttcggggacaacacggcatccgaatatttacgcatttttaggtgtaagtttggggaatattatgaatatttttgctaattaattaacaagggcttagattaatgtaagataaataaaatctcaaaaaaaatgtttgacataggaaactggaaaattaaagttttaaaaggtcttataaaaatagaaaaatgactgtatttttccaaaaaatcattaatttgcttgataatttcgtaaatttatcagtatttttatgaattttaatcaatttttttgattgattattagatgcaaatcaacggcagaaaattgaaaaattttgaaatttaaaaattctgttttttatattttatgttttacattcatttaataaaatatttttaataataattttagtcacctgttttggaaaaactctttaatttacgttatttaattttaattctaaattttttcataaaaataaaaatgctcgaccagttctattaattataaattcaaacccctaaaaaacaaacaatcaaaaataatgaattgcatttaattaggcaaaattacaattcataaaacaaaaagggcaaaaatatggccatattctctcattgcctctgacgaagaaaagatggtcaagtgagaatagtgcacccaactgtctgtcttacctcgcccattttacaccccatccaaaaagcattccaaatgctttccattaatataaaaataagataacaatacgcgaaaatatgcgatttgcttgctaggcctgttcggcca

SEQ ID NO: 18324 - DNA, 2202 bp, Heterodera glycines
tttaaaatttttgattggtcttcttaagtctgttctacttacgggtttctcttcgcatttccgatgcttctcttttcgatgctttcttagaaagaattggtactcaactgaaagctcttttattggaaacagtcgatggaaaggtgccgtttaacttttgtctgtgtcgtttcacaatttttaggtttcagattctcaaaattattgccaaacattgtccaaatttagaacatatttcctttgacttcttcccgtgctctaattcatttcgagttggtgatttactacgatttatgggttgaaactatgggccttctcccttctaatttaagcatttctccactttgcaactcgttctccaattgccacggcttcgctccgtttccattggctttattcgtgaaattagcagcaaaaagtcagctgcgctatgtgcccacattctgtcaatgtttcgagaattggtttcccgaggagaattggaagtccgtgcgttgtcgccgctgtcattttaaccttttcttttagtatttgcaaatttcgcgcgaatttcccttgccaatgtcatttgttgctgaattgtgtcgaaggaattccgtttgtctcgttttgttcatttttttattgttaaccaaaataaacaattttagaaaatctccaaaatttcgtgtcgaattagcagggaatacactcaaatcgatctgggtgagtttaacactgttttgagcaaattagcagacagcacacatcggttgatcacattgaatttctttggcttttgcccggctttaattgagcgaaataatctcaaagttcgtttggtcaaatttcgcgaggacattgaccagtcgttgcttcatcacttttgcgcacattctatgaattcatttccgtatgtttagtattataaatttccggagcaggggggggggtcaggcggtgctctcgggaaaaaacttgaatgtagtttgttaacagattgtccaaaaattacaaaatcaagttttctctttttccccgatggaatatttgagttttagatcaatttggaatatggacgaatgaaaaacgaagaagaaaatttaattttattctatttgttaatatttcttagaattaaataatgaaaggagcctggattaaaaaaattccactacagtttaggtcctatttttagttgcattccaaaaaaattatcttttaagaatttgcattttctggacaaatccgggaaggaaattttaggtcaaaaaaccagcttctttttgcacgttaaatctccttcaaatttatgtactttttcaattcattttttacttttgttatatgtatttttcaaaggaataattaaataaatgtttttttcttttcacttttgtttataaaacacgaaacagtttagtgtttttgcacgctgttattttataaaaatacctaatatcattcattcactaacacagagagtcaattttcggctcccaatgcaaaatgaattgaaatttatttacacacaacataaggaggctttgaaccttggaccctctttttggtgactaactcagaccactgaaacgaaaaatccagcttatttgcatgggagcccaaaattgactcgctttgtgttaaattggttatttgcactttaagcatttttttggcggtgaataaactgagtcacatttgaaagtgcggtgggggtcggtttagtctggcaagctgtttttgtccaaaatagattctactcagatttttttttcgaaaaatgtttaaaattaacaccataacatatttatcagtgtgttttcaacgaaaaaataacaaaacattgaagaatgactacgggcgtatttcataatttttgagaaattcaacgagaaaattgaagatattatcaggattaacattgtatggtaattttgatcattttggtaagcagggttgatgttgttgatggtattgtaaccctgtaagagtcgagaattctcgcatcgacggcacgatatttgcgcgttttttgaggagggacttcaccagcgacgcatcgtgcaatgtctgcatcgattgacttatctcatatcaaattgtgttgatgaagcggaagacagttggatatgaacaagcataagcccgttgaagctttatatgggaaaaaaacgtgaaaaattagggttttactttgccttaagaatataaatttgactg

SEQ ID NO: 18325 - DNA, 2088 bp, Heterodera glycines
cattgttcgcattcagttcaccaatttcctgtgagtctcgcttttatttacccaaaacaaatgccggatttgagatccctcccccatttgcttttttggcattgaatgtaattattgaaaatagttttttagaacctatgaccacgtgactgtgaagccgggaccgcacattaatgttgtaattggcccgaacggaacaggtcggaagaggaaaagcccccgacttttcctacattttcacttggatttagagactttggaattttactgaatttagtataaattctccgcaattctttgcttcttcattgcccattcattcaggcaaaagttcaatcatttgcggcatttgtttggccgtcggcggctccccgaaattgttgggccgttcggatttgatcggcgattttgtaaagcacggcaaatgcgagggaagcgtcgacctttttctgtatgtgttaaattcattattacttttactatctgacagacggtcgaattagatttatttatttttagctttttcttttgggaaattccatgtaatttggttttaaatttcccccttttttcatcaattcaatatatttatctgttgtttttcattctgcaattgtgtttagtgcatcttccgttggtttccaataagtgagcattttcagttgggacagtcgacgaagacgcgaacgctgtttcagcgtgcacataaaattgccaaactcggcctccttttttgtggacaatcagtcgatgaagctgacccaattgcgcgagctggtcaaggagtacaacatccaggtgacttcgtttttttttgagtgttccaatttttagaaatatcaaaacgacaaaaaaagtcggacttgggtaaaaagtgcgatactaaaaaaaaagtaaaatataaaacgataatttattttcattgaaatttgcttcgctcgtcgtttaattttgctccttttgtcaggtggacaatccttgcacctttttggctcaggacaaagtgaagagttttgcagaacaaggcccgcaaatactgctgaagaacactgagaaggttcaataaaatggaatttaggaatttctgttcaattagaaaaatataaaaacgctcatttttcaatggaaatcaatttttgtgactcggaatttcgtttctttatttttgggttttaaaatttctttgcttaattcccattttaattgtttaggctgggcccactgaactggtccaacttcacgaatcgctgcttgaaaagtccgaagagggcaatgaattgcaggcacaatttgaccggggcaaaaaacgcatggaccaattggagttggagctgaagacgaagaaggcccgggtggacagctacaaagaatggtccaatgtctgttttaaatattaccgacgaaaaaataggaattttttgggccctaaaacaaaattaataaatctaaattcctccccctccgacagaattttccgtcggatttttttccaccccattaattttttaacccatttagcgacacaaagtgatcgttctgttacggctcaagaaagcattattggttggaacatttattacttttttcgttagaaaacttagaaaattttaggaatacgaaagcgaattggacgtgcagcgacagcaactggtcgaattggacgaaatcagcacgcagctgaaaaatgtggagaaggtggagaaaaagcgcaaaaaagcggtggaaaacattgggagaacagccgctgaactcactgaagagttggaacaaatggtgggcagtttagaaagttgtacagttacaaattaccaagcaaattatgaataaaggtcggaattatttaaattgaaagacatccggggccggcaaattaaaaaaaacatttgcctggcatccccctgcctaacatttttcgaaaggcaaaagccatcatgtggcgcccgagtcctccgatttcccatttaaattatgattattaattttactttttgtcattaatgagttatgattagcaacaagcgaatgggtatttaaaagaacggctaaataaaacattgtattaaatcgaacaaatatttacaatttaaa

SEQ ID NO: 18326 - DNA, 1963 bp, Heterodera glycines
aataagcaaatttgtgttaggtgaactttacctttgatgaaattcattctcttatagacaagaaaagaacatccgaaatatgtcggtcattgcccacgttgaccatggcaaatcgacacttaccgactcgctggtgtccaaagttggcattatcgctggtgcaaagtctggtgagacgcgcttcactgacactcgcaaggacgagcagaaacgttgcatcaccatcaaatctacgtttgtttttagagtgataattgtttaaaaacttgtaaatatatattaaatgggttagtgcggttgttcaacatcgacacaattcaataaccacaaacaatctgggatgtggggtccttttgttggtatttggaattggttgcaacaattagcgactcaggaaaatccccgtgtacaagttttcatgacatgacaaaatttgaaaaacaaaatagtctcccctttggaatttttggcggtggaccaaccgttttacaatgcttttacttctcttaaaatttagtgtcatttcgatgttctttgaactcgagcgcaaggacttggagtttgtcaaaggtgaaagctttgcgtatcactgaccgtgcattggtggtggtcgattgcgtgtcaggtttgtcatgaaatcgtatgctttttttttggttggcacaaaccaacaaattcgcggttgcatttctatatcaatttggcttttagtttcaatttctatttctacatccgctctttagggtgtttgtgtgcaaactgagacggtgttgcgtcaagcaattgctgagcgtatcaagccggtgttgttcatgaacaagatggaccgtgcgctgctcgaacttcagcttggccaggagaagttgttccagactttccagcgcattgtggagaacatcaacgtgatcatcgccacctacgaagatgatgatggaccgatgggtccgatccaagtggacccgtccattggcaatgtcggctttggctctggacttcatggctgggctttcacaaagcagtttgcggagatgtacgctgacaaatttaaagtacatgtttgccacatcgtgctattttgttgtctcttttcgggttcatacacttacacctttttagattgacaaattgatgaaaaatctgtggggcgatcgcttcttcaacatgaaaaccaagaaatgaaccaagagcccgagaccaagcgaggcttctgccaatttgtgttggacccgatcttcaaaatgttcgacgtttcggttttgacttttgtcaccagtgaacaaattaatttttataaattcaggtcgtgtgtttgctggcagagtcgccactgggatgaaagcgcgtatccaagggccgaattatgtggtcggcaagaaggaggacctctacgagaagaccatccaacggtatacaacaatacatttccgacttagttcaatccctgtttctagcacaatttgataaaaatcaggtagcgctatacgcgcgacggatagttttgctatggccggaattaagagagcccacatgccacgacaacattccagaaatacatttgcactgcgaactcaacttgatcacacacaactgcaattcggtgacgaccacatgcttgtagtcatagtcaatcatcgacctgcatgctaatatattataaaatgatggccggagatttgcgtgcctcgcacgatcaaaccggtcacacagcgaaaaaagcgacctaacgtccgcactgaggtctgaagccttcacgatgaggaagtcctataagtaattaatttcatcggccaagaatgacagagacaaaccgcgctctccagaatgtcaagtctatcaggtctgttatcttcaaacaccactctcactagattcttgtaagactcaattttcatcgcacaaatttgtgactgctcttccgccaaactattcattagcaataaatttatgaagacaactgactcat

SEQ ID NO: 18327 - DNA, 1145 bp, Heterodera glycines
  misc_feature (50)..(53): n is a, c, g, or t
  misc_feature (55)..(55): n is a, c, g, or t
  misc_feature (60)..(60): n is a, c, g, or t
  misc_feature (66)..(66): n is a, c, g, or t
  misc_feature (68)..(69): n is a, c, g, or t
  misc_feature (73)..(74): n is a, c, g, or t
  misc_feature (78)..(78): n is a, c, g, or t
tatcaaatcattacacacacacacactcacccgagggtcgtttatggttnnnnanttggnttttgntnnatgnnattnccctatcatccaagggttccatactgcccatttggcttttcctccccatttggcttttcctccccacttggcttttgctccatgccattccctgatcatccaagggttccatactgcccatttggcttttcctccccatttggcttttcctccccacttggcttttgctccatgccattccctgatcatccaagggttccatactgcccatttggcttttcctccccatttggcttttcctccccatttggcttttcttccccatttggcttttcccccatgcccttttctgctcctccgtcaatactccccccccgcccctcccttcagcacttcgttgttcatttgcaatttggcacttgccgacctgctgttcctggccttctgcgttccgttgaccgccttctcttacgtgtccaactcgtggcccttccctgatcagttgtgtttcgtcactgtcactttgcaatacgtcacttgttacgtcagcgtgtggactttggttctgctggcacacgaccgatttgttgtctgtttttgctttcttttccataattttcctccctattagtgcgtcttttgcaaattgttttttcttttgcaaattgcgccttaataatctttgctaatccctttagtccatcacttcgcccctggcaaatcgcagtttgaagcgttcgcgtgccgtcttttggatttgtttggccgtttggtgcgctgtgttggcgctgaattcgcttcagctgcgccacgtgggcgtgctgcgctttgagtataatgtgagcagagagagggaaagtgcgcaagtcgcaaaaagccattgataaaaatggcatttttaattgaaaagggatttttgtgaatttctatgtatttctttagcaattaagaatcagatttatgtattcttggtaatttgtgggacatattaattagatgtttggcattaattaatttttatttctttttttagttcggttttttagaaaagtcaattcagggtcggagaacttgattctgatatcaattaccgaaaccctgacccgaattctaaaattcagaaaatt

SEQ ID NO: 18328 - DNA, 1815 bp, Heterodera glycines
  misc_feature (21)..(21): n is a, c, g, or t
tattgtataatttaaaattantcggaaatttattttcgacttttggttcgaatccgggtcaggaattcgaaatgggccgaaattaatattatattcgcgatcagagccccccaaaaaccccccaaagcaccacaaaacagctcaaaacgcgtcttttgcctctttttatgggaccagtaaaagcgatgattccgtttaaagtttatgtcttcatagtgttgttatccttatattacattccctcgagtcattttcattaagtagcacctcttaattaccccccccccccctctttccccagggcactctcggctctgcttgtgtcgattcgcttgaagttgcattgatgcgcgcttcactgtctcagactcgcctcttctactggggcttcaacttcggcgcgtatttggtcaattggcatcgctttttcttttcctttcccctttaatttatttgtggttttcagctgcccttggccacttcatgtgctttttactttttgctcgtcaaggaaatatggcgtcaaaagcttgtccaaacaaaatcatcgcaaaagtgaggaaaaaagaagggacagaggaaaagcctttctaacaaatagggattaagccatcaaaatgattaaatgagtcattgaaaaataaacattaaataaacactttcatcaatttgtccatcagaatgaagcgacatgccactcgaatggttttcgttgtcattctcaccttcggcgcttgttggctcccgcagaatttgcgtttctttttgcaaggccttaattacccggaggcgagcttttgggagcgcgacgagaaaacgtaaagccaaatttgaccgggggcgggggaaattcgtacaaagtggcattttggggggttatccagctgccgttcagcagcaattcccaatgtttcagcctcctcttcgtccagtccattgctcaaacgttggcctacgctaacagttgtgtcaatcccatcctttacggtacggtaccatccctttttttaccgtataatttgtcattccttccccattcacaggtttactgtcagaacgcttccgcatggcattccgtcgcactttgggccgtttctgctgctgtgaagcgattcctctttccgcgtctctcccgcaacaattgatctccgggattcaaacgccaaacggcgaagggccaaaaaggcgatcagcatcggggattacggtgtacagctggcgggaatacggtaaaccgcaccactcggaacacattgctgggacgacgaaggcgaaactcagtggcagaggcagtgacacagtggtgacagagtggaggagcacagcaacgagacggtaggaagtgggacgggtgggctacggtagatactgtaacattagcaaaagcgaattgtaaattcaattttgtagtgcatttaggtcgaccatctgtcaccctttggatgctcaaattcattttgatcagcagagcgattacgttcaacaacaaaatgccaacaacagtgatttgggagacaacaaaaatggcaatgccaatgccattctcgtgatgagaatgccaaggacgagaagccaacaacggagggtttggctggagaccctcggcgaagagaataaaatgagcggggaagaggaagaagaggaggaggaagaagaggacgtcattctgttgtgattggctgtgattttgatgccgaggggaaagcgccgatttccgatgattacgggacggaattattcgaattcattttttaattttatttatttatttattttacatcggttacaatattaacaatgaaagcattccatttt

SEQ ID NO: 18329 - DNA, 1648 bp, Heterodera glycines
  misc_feature (1631)..(1631): n is a, c, g, or t
  misc_feature (1641)..(1641): n is a, c, g, or t
tatcacttgttgtaccatcttatcaaatttgtacctcttcaatctctgttgtacctcttctaatcactgttgcacctcttctaatcacttttgtacctcttttatcacttttgtacctcttatcaaatttgtacctcttcaatctctgttgtacctcttctaatcactgttgcacctcttctaatcatttttgtacctcttttatcacttttgtacctcttcatcaaatttgtacctcttctaatctctggtgtacctcttctgatcactgttgtacctcttctaatcactgtttcgatcaatttgaatcgcttcacagtctaggtagcgaagctcccaaagcgcgaagcgctttatcccagctaaatagccgacggttcacgcacccgctagtttatatactactaaagaaacagatgaactcattgctaaaactaaaatctcgggaaccgctggcgggaggggctcgggagtgtggcattgcttaagcaactttttgaggcgcatccaggaaaactataggcattttggtccgagggccaactgagcgccagcggcgctgaaatggctttttgggggaaaatgcatgcagtttttgggccataacttttttctggtaacccggagccaaaaatgtctgctgaaagggccctaagttggaatgtttgggaaatttttttcttcttggtcgagaccctaggatcaaagcccgagcctgcaaaaattcgcaaaaatttttttccattttttcggtttttcggttttttgggaataactcgctgggtgttgcgctgagcgtgtttgcgccgctgaactttttgtacagctcgacgagctctatcttgtcaattttttaaatttctgaaattttcagaaattttcgagctaggccccctcatcacttttgaggtttttgaattttagtattttttacagatttttctcgggaaaaccaagaccactttcaagcaaccgtttttcacgctctatcgattggtgtcattttcagaaaaaatttttaaaatttttttggaaatagaaaattttggttgctaggcttcaatttcagttctggcgcaataactcgtcaggagttgattttatcaaaaaatcgtctaagagcttttttgtagagaattttaagcccaatctaatgtgctttatcacatgtttttaccatgagtttaaaaaaagttatgaaattaattgtgattttgaaattcaaaaccataggggggaccccatggttttgcatttcatgaaagatttttttgctcctaaattagccaaaatgcatttttatggcctaatttaaggtgctgaactcgaaaatatactttatttttggtttcagactttttggtaagtgtttaaaattttttgaaaaatcttcaaaatttgagccccggaaaatccagtgaaattttgaaaattcataactctcttcgtttttggtcaaatttagtggaataaaatttgaaaaatagcaaaaaattaggagaattttatgagatttatttggaatttctatcttccaaaataaaaaagttattccagaatttctggaaaaattcgatttttcagaaaaaaattcttaactcccttctgaaaaagtattttataaaaaaaantatactcaanaaaatcc

SEQ ID NO: 18330 - DNA, 971 bp, Heterodera glycines
tttgaatagcatgtaatcggctcggctcctccgccctcctcccacatttgctggctcttcactaatgatgatgattatgatgatgattgctgtgctgtttggaactggttccttccccgcccgccccctcggggtacacaacggcgccgcctgtaactaccacaccgctagtgctgctgatcagcacagcacgaagcgcgcgagttggccaccgaatgaatatgtgtgcgcgacatattgcacttgtccccctatccccgcacaactttcccccgctctttgctgggcattctccgtattttgctgctgatgtggtgatctgctgatcagttaccatttttctatatgcttttatatgttccggtattatgttaattttggtcagtaatgatcaatcatttgacagtgtcactacattaaatgatcagactaacaatcttttttgtcttttgtatagaattctgattccttctcaagccgtttcccccttaaaaagaaattttatttcaatttttttgcgatttaaaattatattttaataattctgacggaatacgttaggtattttattttgcatacctaataatttttttccgccaattcaattcaatgcaaaaaagtacaacataaaaatattttttcactgaatagcgcctgaaaataaaaaatacaaaaaaagaaacataaaaaatatgactttttgttgtacaacgatgacagaaatggaggggacgggacggatgaatgaatgaatgaattggatggaagagtgttgggaagaaaaatgatgggaaaataatgaaaatggggggggggggggagaaaatataaatcgattggcgctggaggaaaaatgacgaggcgcaagccgacggacgacacccatttgatcactgcgcgcgctttttgctgaaatatttgcgacttgcgcaacaatttttctttgcgcctattttaacggaaaacttttt

SEQ ID NO: 18331 - DNA, 2568 bp, Heterodera glycines
ttttcaatggggtaaattttggggaatttcaaaaattttttgaaaaaattaaaaaaaaatttatttgttaaaacaaattcacaaaaatcattttcatttatttttaattgattttaataaaggaaaattgtcgagcaaaaacatttttaatgacatattcacttaaactcaattgaattaaagcgacacttatttttattatttcaaaaaatatgtaaatggaaatgaagaaattcccatcagttgagaaattaaataatgaaaagaaaaatgaaatgattcagttaatctgtgcagaggataaaaataaacgataaaatgagcttaaatgaaatcgctaaaatttaaatggctattaagttttaaatgggataaagaaatgattgttttgttgttcggttaaccttgaagattcaatttgatttttaataaaataaaaaagaaatcctttttaaatttttgatcattgatcatttatttggactgttttttcccattttctcaatttcaataaatcactcactcctccgttcaaatgctactttttctgctgatcatctccatttttttgttccccatctttgtcatgtcctgtcattgtctttctataagttctgtacatttccctcttgtatttttcgtcatttcatagagccatcgattgcccttcatgcgaattatgccccccccccccccattttttgaacagcgaataaattgtgcaaaattgcatcagttccccaaattgatttggtgtaatgtgtagcagatgagttctgctgactttgtatgtgtggaatgatgaaatggtttatttattttactgttcgggagcggcggaaaaaggtattctcgacgatttgtctatgtcgagagtgaattttattaggcatgagaggacaattaaattaattgcattactcactcacttcccccccccccccccagcaaatgcatcgacggacgtccttgggggccggtgggacgtcattatcaaacgctcgtcctgcttaactggcttggctattgttatttctgccgctgtcccattctctccaaaaaatttcccccccccccctccattacataattgggcaatttaatcggctttcatgctttatgtttaaaaatgggacaggtagaaatttggcagcttaatccgtttaaatgcatacgctgcgcagaattttttcatgcgtgagtgatcggtcacagtgatcggactaatgcgaagagactgatcagacccatgattaaattaattcggaaaactgattagaaaagcaaaattaatgaggaaacattgatcaaataagcaaaaacagattagacaaaccacgaatatggagagactgatcagaacacaactgatctatcacgccactcatggtttaatcactgcgaatgagtatattttggaattttgcttgtaattgtttgccagatcacgagagctactgagaatgaatgatctaagcctgatcaagtgaccaatgcatatcaaacaagttttgcataattttcaagtgatggttacttgatcaggcactgatcaagtgatgcccgcaaatattgccgatttgtgtttgcagaattgcaggcattaatctaacacaatttacaaaatatttctagcattaatcaacacatttattatagatcaacaagtcatttagctgaataattttttgttttgcaaacccagttttttgtaattatgttcatttccaataaccgcatttcttagggttgtcaaaatcacaaaattttcacaaaaaaataaaaatttttattatgacttcaaacatttttcttgcaataaaattagatttaaaattattaattgataaatatttcttagtaaaagaccaaaaatgttttatcgacgaatattcgctttattcttgtgcattttcgtcattctcttcacattacaagtaaacaaactatttcattttttaatttaaaaaagaattaagtttatcaattgaatgatttttgagtaggaattaaaattcacaatttattaaatttaattttacattttttgccagtttctccccgtcatcgatggcatgcaatttgatgtggtccaatgtggccattcaaaacggtgcgaattcggcggttgtgcaccaggcaaagcgcaaaacgcggcatcatgtgcctatttgttctcaatggagccggaggggccggacagtgttcgaatgggtcagacaaaaatcaaaaattcgtacaaagaaaatttttcgttaacctgatttttatacaaaaaaaaagcgggagttaaaaataaaaacccaaaaataataaactaaagtaaaaaaatatttcttgaaataattaaaaatttaataaaaattgtttttctttttttttggattactaaaatttttgtgtacaactttgcctatgcatagattgccgctattgactctgactctgaggaatctgaatttttaaaaatcagaaaacctgtatgagaatgccacaaaactccctgcaaaattagtcgggttgggtagcgaattgcgaaacattgtctgggacccagattttttatag

SEQ ID NO: 18332 - DNA, 2059 bp, Heterodera glycines
  misc_feature (1974)..(1974): n is a, c, g, or t
  misc_feature (1995)..(1995): n is a, c, g, or t
  misc_feature (2014)..(2014): n is a, c, g, or t
  misc_feature (2049)..(2049): n is a, c, g, or t
aaaatccccccttttcaggaaatgcctttgccaattcccccccccccctccctcccattttggcacacattttacggaacgaaatgcaaaaatgaatttttgagagggtcacacaaacacaacgaaaaagtatttataaagaatgtgtggtggtagtggtttgaccccgtcattttgcggagtgacaatgggccaaactgacgaacaattggtggtggatgcttaagggggcgagcgggagagaggtgttaaaggatttgccaccccagcgaagcattgtttaaactccttgaaaattgtttttctgaaaattgtttaatatttgtttttttaaattattttctaatggaattagcctggtcttagttttctttttttataatttttgtcaatttataatttatactatgaattattttgaggggtcgggggagagttggtaaaaaagatcgtgctggcgcgtttcttaaaactgccaatgggtttgaaaacaaaaaatggttaacacataaaaattcatatctttgcttaatttcaatcaaattaaaattctttggtagcattcaatagccttaattgtattctatcagaatatgattttccaaaaatgtttacttaagtataaaaaaagttattgtcacaaaattgcaaaaaatcttaagtcagcattttttgttcagaacttttttgaaactcaatgaaattttctaaaattttaaatataaatagagaattcttagggctatcgaaatataaattaattttggttcaatttcattttaaagactttaaaattttaaatgttttattattatatatgcattaccattgcaaaaaacatagcctgttcaatgctttataacttcttttatacttaagtaaaaatttttgaaaaatcatattctaatagagtacaattaaggctattgaatgatattgaatgataccacgaaatattaatttggttgaatttgagccaagctattaatttaattattttacccattttttgttttcaaacccattggcagtttttaagaaacgcactagcaccgattcaatgatgctttcgctttcgtcactcctccaactttccgattttgctcaattttttccgttcgttgctttgtttgaccacaaggacgaaattacggccaattttggttcggaggaattcaaattcaatcataaactctgaattgagaaacattgactgaagcattgattggttattgattggattgcttgatcagatcattgtttttttctgatgattttctgttttttcttttatgttttctttctatgctttttcttttatacatagaaaaggaaattgctttagcacagaaattctgggaatatcatagaatactgtgcgcttttgggccatataatttggctgtcctttttctgctttgtccttatttttgctatcttttttgtttgtcctattacttttaattttacgatatcatttattatgttcaataaataaaattcaatcgttttcttaaaaatttataaaagtcaatggaaaattaacaaaaaccacaaatgagagtgatctataaacgtgatcagattttgtgaatatttcaccatttagagagcatccaaatcaaatttaaaattggccccgaaatttgcctcaattttgtcaccaaatgagcgcaaagaaacgaatggatgaaaagaatcgtcagcaaaaaatggcgaaacgaaaagaccggaggaatctgtggaaaagagaaaggagttaaatctgcataaattaggcaattaaataaattataattttaaaaaacatttaataatttgtttgttaacccaattgttttccatttttggtgaaaacgatctgccgaataacagaattgacgccgattcctacggtatcgccaacaccgtaggaatatttggcatttgttcttttttcttttccgttaatccaaatcttcccatcactatcanatgcataagtgccattgcgcngtcgaattgtcccatcatntgttctgctgttgactgcaaatccgagctcatccnactgaaaaat

SEQ ID NO: 18333 - DNA, 1031 bp, Heterodera glycines
agtgattagaagaggttcacagtgattagaagaggtcctacagagattagaagagtgattagaagaggttcaacagtgattagaataggtacaacagagattagaagagtgattagaagaggttcaacagtgattagaagaggtacaacagagattagaagagtgattagaagaggttcaacagtgattagaagaggtacaacagagattagaagaggtacaacagagattagaagaggtacaagagtgattagaagaggtacaacagtgattagaaagtgggcattcaaatagagcatttatggtaattaaggaattgtttttactcaaaatagataaaaaatcaatgtgttatatttttcattttttaaaatataatacactttttattaatgaaaaacaaattatgaaatgtataataattgaatagttatttaaattgaaatgaaaaaaattttacaatttaattttaaaataatagctgaaattctttaattaaatataataaataatttaatgaaaatcattattcatcaaaaaatttaattaaactaaaaaaatttattattaataaaaccaaacatttaaatttattaaaagtaatgaaaattaacccaaaaaatacaaagaaaaataatgtacaccgcccggcttcgaacttcgcccccccccccaaaaaaatgatgcctcagaatccccaatcacacagggattctgaggtcttgacgatgtcaaaagtaaaatctgatcacgtattcgtgatcagcgtcataaaataccctaattacatgtttttgaaagatttttggtgaaaaaattttttcaatcaaaaatcatgtgctcacccctttggtcccgaatcccaaaatcacttttatttttgtatctttttttaaaaatgtgatagaaatgctaaataaaatttatataatagagcaaaaaattgcggatttttgtagtattttactcttccctaatgacttttcagaaccgagatataaatttttttctgaaaaatagaaaatttccag

SEQ ID NO: 18334 - DNA, 1570 bp, Heterodera glycines
caaaaaaagtaaaaatattttcaatttttaaaaaattccaaaaaatctgaaacttaaaataacaatcatatttgtgctcaggaccctaatttaccccagaaaaaattttttcaccctatttttcaaccaaaaaaaaatttccgaaaatttctagggggcctagctcgaaaatttttgaaaatttccggccatataatacactattcgatagcattttaaaagctctacaattttgcactaaggcgttttttcgataaaaccaacccctaacgagttatggacccgggactcaaatgtcccgctcaggccgaaaattttttctatttccgggaaaaaatcgaaattttttcaaaaatatcaccaatcgatagagctcgaaaaacggttgcttgaaagtggtctccgtttttctgggaaaattcgttaaaaaatcctaaaattcaaaaacccgaaaaccgttttttaggcctaactcgaaaatttttgaaaattttcgaaatttttaaatttggaaaaatcgagcttttaaaactctacaatagtcccgctggcacccccttgatcaattcaaaccctgacgtgttattcacccgggactgaactggtcaaagttggtactgaatttctccatttttctgcagccctttctattataggtagaggcctggaattttttttgttttttagaaaacacttcaacttagtttcctaccagcggacatttttcgattagagtttcagaaaaaaagttacgggccctgaactgtgagcaaaaacgggaaatcggcccctggtactcagttggccctcggagaaaaaaacctatagttttcccagatgcgccgtcccgagttgcctatgtgtgcaaaatttcagccccctagctattcccggtcttgagatatcctttttgaggatgagttgccttgtcaatataacatatatataactagcgggtgcgtgaaccgtcggatctggcatagggataaagcgcttcgcgctttgggagcttcgctacctagataagctatgggttgtggagtaattgttggtccagaagatatttgagattaatcaaaaaattttatagggtcattcggccgctttgtgccttcagacgggcggttattagttttttttgaaaaaggggcccacaatctacagtataatcgaaatgtgtgttttgtaatggtatttttgtgttgctttgtgaatatcccgcttttttgtgggtgtaaaaactcatcagaaatcaaacccatttaatcactagtcatttttaacagtgcattttacacttgcacatcagatacaatggaagtggacgaattttgcagcaaggaaaggtctaataaatacatacaaacaaattgtattgaacataatattgaaatggcatagtgccaaaatcatttcgatcatataatcgcatcaattaataattaattcatttctgctggtgttgctgattagtgatcactcggaccgagccaagcggaggagagaaaactgtaaaacgattgctttgttgaactcataaagtctaattgacaccgaaaaatgaattttt

SEQ ID NO: 18335 - DNA, 1885 bp, Heterodera glycines
cataatctgccttttgttcgcatgttattgtttctacctgattagcataaaccaccctatatttccatgaaccatctcaattcactctctttgtcagatctctgcacatgattcaagtgccgtcccatctttactatcgcctttttcgctgtttcctttgccaatttcttgtcgaacactggacggaatggcttcccttattcgaagaatggactgcgtaaatcaaaatcaattaatcgatgattccacatgttttttgatcttttttcagtccactcgctccataattggcagtcgtattcgacgtttccgcttggctccggggtctacggccattccatacctttactcggaaggtttagtcccagcagaaggtttaagtcccatttcctttttactatgtatattcttttttcaggtcccaccactagtgaatgtggccaatttttaatcttcgatatttccatgacagacgcacaacttgcgcggtttaaatccgttatgggagcaagaataaaattgaaaaaacttgatgatgacgcaccagcttgatcttttgttttgtgtggcgttcccgttagccgaacaaataccagggttcagaaagcatgattttcaatttagcgataatacatcagcaaatgcgagaaatatattatgggaaataaacgagtgggaatggtttggagaaatttcgcctgaatttgagtggtttaaaacatcagttgacaaccgactgtgacagtgatgagcagtctgtatgattgcaacagaagtgacaaaagcaataaataaacagaggagagcaattgcaatcgatctagccaaaaaatccaatgaatatcagtgactcccaataatttgtcgcgccttacgtcaagaatggttgccccaaacacgcttatgatattcagccggcgccaacatataatcctggaaatgcaattgtgtttcgcttcccgttttccctgaattttcaccttttcaacatcgtagaaatcggcatggtttttactgaggaacatcacgaagtcttgcgcatgacgaataatcgcctccaaagaacgttcgctccattcggtataagccaacttaatttgcgtaaaagtttatcgtgtagagcatagtcgattaactgttgccaattttcggcttttttggccccggtgccaaaaatgctcagaaaaaatcgatcaaatgaaaactccagccaaaatttgttatattttatgcagttatttaaatttgttttatgatgatatttgcttgaaattcaatctattggattttcttgcataaaatatgtacataacatactttattcaatcgtacacatagtcccaatataaatagtgcctcatatttccgattcattgctcgtaattggtcaggatcaatgtcattatgatcagagattcatttctagggcatgtacaaattagtcattgttttagtatcttttttctgtgttcccccattcctttctaaaaatcagaaccactcaaatgctcacacagatatttattcaaagcagagttattgatgaaagttcagatatttgtcaaattggttttggttggctattttgttcagcagaataaacaggaggaggcggagagaataagcaggtgacaaaaaatatttaattaagtccaaagtgtgggtacaagtggaggggacaacacatttggtgacaaaaaaaaggagcggagaattgagagaaaaataatgaaatgggaagaggaggaactgatcatgacagaaaaatgaatgatgaggagacgttaattcacaaacgcttcctttcaccaccaaattctgtcggcaaactgaagtcggtgatcagcgttttattgtcgtatttatgtttcaaaatgcggcacaa

SEQ ID NO: 18336 - DNA, 1437 bp, Heterodera glycines
ctcgctttcattttccgcctcctccgacttttgcttcttcaattcctcgaccaaatcgtgaaaggctgtccgttcgaatttgtacagtaagatggtgcctacggccgtttcaaaatagtccaaaagaccgagcgcggagtgctccaaattctctgaagtagggttcagcagcacgttgtcgcgatccgcgtactcaatgtaaaactcacgcggcgacagtccgccatttccgctttcgcccacaccgaccaccgactcacggtactgaaaagcaaaagttattcgaaaacattattagagaccttttgaactatttcgaagacggtgatccgtgcaggcaatttcggcaacatgaactgtttgttgaccaggttttcgtcgtctatcagaatgcgtcgcaaagggtcggtcaatgtgacttggggcatgtcctttttggccactgcgcttgtttcaattgtcgtccgacgggcgatcttacgttttgctaaattcctacttgtgtatattaaatgacaacttaatcctaacttaatttaaacgcaatggtcatatccaatttgttagagtccaatacttttaaacgtacaacgcaccggtaattgcactgacaaataaatgacttacatgcgttgtcggcgcttcctggtgtgctggagcgactactttcatcatgcgcttgcgagcggttcttcagttccgattgctttctttttttggcatttagcatctgctgagcccttttcacgtcttcctaaaatttgtttttcttaacactcatcgtaaaatactcgaaaaataacctttgccttggttgcctcttcatcggagtaattcttgaagcgaattagtgcttcatgttgtggtacaacttcgtcgtgacggttgctccaaccctaaaatcttcaatgcgataaaatgaattaaattaaaatgaccggataatgaatgccatagccgacatctccgccagacaagtctttcagaaacatcactttagcctcataataaatgtgctccgagttcagataacggcataacactttctccccaatggtccattttttgtccgtcggatgtccgtgcggattggtagacattgaagagctgagatcctttctaaccattagctgtattttctcaaaaaacaaaagaagtcgtactcgacacttccactgctaatcgtggacagttctgatgaattctgcttcttctgaagtttctgttggctactgctgctgttactcgctttcgacaccgatttgggcgttctgctgggtgaagaggtcgactcatcccgaactaacgaattctgttgctttttctttgctgacaaatttcgcgacggcatttctcagatttaaataaaagaaagtaaggcgtttttctaaaaaaaattgattgtgaagaaagtgtgcttaagaaaattacgcataa

SEQ ID NO: 18337 - DNA, 2084 bp, Heterodera glycines
  misc_feature (1996)..(1996): n is a, c, g, or t
tttcaactcgtttttgccaattttttggccccttttatttggtggcgccaaaatgtcggctacaaagtatcccgaccctctctgggttttcatgcctcctcccccaaccgtaaattgtcattatcttttattaaccaatttttccctattttaggcttttgccaatgcttcatctccagtcaatctcattgccatcattcgctttccgccgatttttggtttctacgttgtgccatttgatctgatcaacgaattgacccgggagcaattgacgatgaagaagatgaacgatatcaaccgtgttcttctgatccgttgtccgattgtgcgcgacgaaagcaaatgggccaaatgggtggaggaagcgattggatggaactttatggaccagtggaatcggatcgacatttgagatgggttagtgaatgaataatggttattcaaatacccaaatttattgcttttcgatttttaggctcttgacgcaatgatcgatccaagtgatcagaagcagaaatgattgaacgatttgttgagaaatgatcatctatttaattgatgtggagttggataatgaatttgagcccatctgatatatataaaattgttgttttgttgcgatgatcactaattgtattatatgtatatatgcccttaggataaattgactgaaattccaggcgcattcttttgacctaatgataaagtcggtggtcactttccctccaataaacgggttttaattaccattaagaaaagatgatgcacagaattcggtaatacgaccgatggtacgtacctccccccccccgtttttctgaaatcataattggctttaatagtgtttaagacaagatttgagaggtcttacatgccaagtattaaaaagtcaaataaaaatgcatgtttaaaccagggttattccgggtcacccgaatcccgacatttttctcgtcccgaatcccgacccgatatttttctcgtcccggaacaacactggtttaaaccttcaaacaacgggtagaacactttttaagtcatttaaaatattttcttttattttaaatgagcacgaatataaacctttattttatgtttcagaaaatttgaatatttaaaaaaaatttttcatttattgagcccaggaaatttaggctaatttttgaaaattcataactcacttcagggttggccaaggctccctgtcatttcgtcactgatcgtttcgtcactattcagttcgtcaccaagaaaaattttttaaaaatttgtttggcagattgtcaaaaattaaaaaaataagctttactttatttaatacaaaatctgtcatatgtataaaattcgaaaataaatgaatacagcataaaaattgcaattaattgaagcaaaaaagttacataggtatctaatttttataaagttatttttggcaaagtttgtgatacaaatctcttaaaaatccgagaaaataagttaaagcagcggaatatcactcttgactcaccgccccttcccctctcggccaatcgtacgtcgtacggggaccctgctggcgaccccttatatgtacacttgtgatcataatcagtagtgctgttcgagcccgaaaatttcccgagactcgagacaacaaaacccgagacttttctcgagtcgagaccgagactctcaaacagcactactaatcagggctccggactaaaattttcaaaatcagcatttgaccgacaaaaaatcagtaattgtggtcaaaaatcagctgtgtccccttgaaatcagcagagttgggagccctctgatcataatgaattatagcgaaaaaagaaatttagaaataagcacatttggagcttaaaattaaaaatgagaagctaaattaatctcttttatttcagagaagagatcccttccaaatctcagaatcaaggcaatttaaaacttttatttattaaatttctttctttctttttttgctagcccttttgtttattanagaatgtttttgctgttcttaaggcaatgtgccaaacaaaatttaaaaatttttgctcagtgacgaaacgatcagtgacgaaatgatc

SEQ ID NO: 18338 - DNA, 823 bp, Heterodera glycines
tgcaaaacttatttcgggcaaaccgaaaacatattagattccctttgaagttgccgccaccataaatccgatttccccaaatccatgcggttgctttttttgcacatccctccccgcgccgcgcagcgacgcggacggtcatcaatcatccgtctgtcaccaaagtgacaggtggaggaaattcaattcttgcaaattaattccaaatcttcaagattttttatcctgaaattaaactatttttgaaaatttgctaaaaccgtgcggttttttgcatatcttcccttcgccgcgcagcgccgtcatcaatcatgcacctgtcactaaagtgaccagtaattttcaaaaattcaatttttattttgcaaatttaatttcaattcttatttatttattttggattttaatcaattatttgatcccccttttccaattctcaattatttttccccctcccccaagcccctaaacctcgcgggtttctcgcgggtgttttcccgcacaatcccaagcctatgggaggggcacacaaacttttgaagatgccgccctaaaattccatttccccgaatccgagcgggcgtttaccgcacaaaccggtgcctatgtgaggcgtcaaacttttgaagatgccaccaagatgcaaaacttattggggcaaaccgaaaacatattagattccctttgaagttgccgccaccataaatccgatttccccaaatccatgcggttgctttttttgcacatccctccccgcgccgcgcagcgacgcggacggtcatcaatcatccgtctgtcaccaaagtgacaggtggaagaaatt

SEQ ID NO: 18339 - DNA, 1491 bp, Heterodera glycines
ggggcaaacgaaaaccatattgaattcccttggaagttccggcaccataaatccgatttccccaaaatccatgcgggttgctttttttgcacatccctccccgcgccgcgcagcgacgcggacggtcatcaatcatccgtctgtcaccaaagtgacaggtggaagaaattcaattcttgcaaattaattccaaatcttcaagattttttatcctgaaattaaactatttttgaaaatttgctaaaaccgtgcggttttttgcatatcttcccttcgccgcgcagcgccgtcatcaatcatgcacctgtcactaaagtgaccagtaattttcaaaaattcaatttttattttgcaaatttaatttcaattcttatttatttattttggattttaatcaattatttgatcccccttttccaattctcaattatttttgccacctcccccgagcccctagaaaattaaagcagtcatgcttttaccccgcttgaaatttaaaccgcaaaatatttccggttcataaaatgcacgacgattttttcgaaactcgttcagttcaatttcacgtccgaatttaaaggtcgaaacaatattttcaaccgtgtgtccggtgtaagaagccccggacaccccgagcccttaattatttctatgaaaatttttatcgcattttcacagtctatcagacttttcgtccccagacatataattttcccggattcccataataatgccgttgctttgatggggtttgtacatttgataaccgcggcattgaatttactagggttatacttaaattcgcattcggtgatcgtcagagagtttagtttaattccggtaccgagattagcgagagcaattatatttacgattatcgtttttgcatttttgatacaatgtaccaatcaaatggtcctttcactccctttatataccccttctataaatagcaaccaaaaataaaattaaattgaaaaaatgaactgtccacataaaattaagtgttgtcattactgcccctgtcattacgagatgtgtaacagatgtaaaaaacacagtcttttgcatttcggtacatcattttttgataatttctggctatgccccaaatgcgcgaaacatgttccctatgaaaatataaataggtcaaataaataagatacattaaaaatgtttcgcggtccgttcactctaattctctcgggggctactgggagtggtaagacccgttggctattacggtttttaaagcatcataagaatctaattgaaccatcgcctgaaaaaattctttattgttatggtgagatgaatgatagtattttaggattaatcggggagggcgttgagacttttaacgggattccggacatgaataagattaaagaacaggaaaaaccccttttactgatacttgacgatttaatgcttaatatgcagaatactttcctcgatctactctttaccaggggctcccataattggaac

SEQ ID NO: 18340 - DNA, 1532 bp, Heterodera glycines
accaggtcatttaaccatggtcatttgacctggtcaaataacgaccaacccatgtgaaaaacggcagtaaaagagggtcggggtcggttcgccgcggccacttcgccgcggccggttcgccgcgggattatttttgaagctagtgagaatgtcggccatacttgtgcattagagattgatagaatttttgcttataagttcttttacgcccagaactcaacccctcctttatattcggtaacattttgaccaaatttttatttaagcccaaaataaagagaaacttatttttaattaatttttttcgttttgtattatagtttcagccttagttataacaaatttttgaaaaataaaaaaaatttaaaaaatttttgaacaataattatggcggcgaaaaggacatttttctatgggcggcgaaccggctgcggcgaaccggccgcggcgaactggccgcggcgaaaaaaccccgcggcgaaaaaaccccgcggcgaaaaaaccccgcggcgaaaaaaccccgcggcgaaaaacttaaaagaagatggtaaattttctgcgggtccactcgcgtttcggcgctcccgtttcggcgctggcgtttcggcgctcgcgtttcggcgccagcgcgtttcggcgctcgcgtttcggcgccaaaaaaaattacaaaaatacaaatacttggttaaaatcaacaaacaaaatatgaaattcaaaacttagttaaaataaacaaatcaaaaacctaacgctttatcaatatataaaaaaacaaaaagaaatgggagcaaaatttggccacgcagcacgcaaaagtgtaaacattctttcgtacgatgtttgcgatttggaagtcattaaggcatggcacaccgggaaaatccatttttcacgcctaaatatttaatttacaattttgaaaaactgaattaaaacaaacagactttgccaagatcgtataaatctgagaaaattgggctggtgccaatgagaaagttccgtcgccaaaacactcattcattctgtccgcaaaacgcccgaatgaatcgcgaccaaacaataaaattctaagaaaaaaagaatttcgcattttttttctaaattaccgttgcgggttttcgtttccattttcaaaataaacaccggagtcgcccaacagaaacagctcctcaacgccttccgtcgacgtgtaggtcctgtatgcttggttgatctcaaaattcagattggttgggactcctggtggtgcatttatttcgtggcgcgcccttttgattaactaaaattagtttgcttgttagtttttaatttgttaaaaaaattctcgtacgtcattcgcagccctttttgtcaccaaaattgcggcgggtgatggcacgttctgcaatgcttctgaacgaatgacagatggcggttccaaggtagtgatggcacggagtttgattgtagttttgacttgttgagcctcaacattcgaagcatttgcgggacaagtgtgtggcgttgaaagacgaatgaagtgattgtttagg

SEQ ID NO: 18341 - DNA, 1858 bp, Heterodera glycines
  misc_feature (1831)..(1831): n is a, c, g, or t
agggttgaacattaaagccccaccctcgagtataaccccattttgaagggggttttattcgaggaaatacggtataattatgaaaagcccttaatccagacttggaaccattacaggtccaggtccaacaaggaatccaagccaggttcaagcattttcaagatagcaaactctctaatcatcaaaatattatttattaccaacgctttttgtaaaatcctcttttggtatgagtggaaaacgaatgttggacaatattgggtcaagaattttgcctcgattttcagcggaacatacgatgcctttttgacggcactgttcgtcggaccaacggagtgccttaattttagaaaataaataattgtaatttataatatttaatttaccgcattccaaatttcgatttcactgcttctcagctcatctcttttgagaatttcacacaacaaattttgatcaatttgcaaaaaggattctgatttgaccaaagcactgatatttcgatcaatgtagcgcaaacagcggagagaaaaatcccaaaaataaaaatattataaaaaattatataattattactagggattgttcttttatgtaaatacatattttttttctggtttctccatgctttgaatagtaggaaaatcactttctttcttttttgtgtttgcgaacaaaagttgtgacttttatttacatattttcggatttttctacatattacatatgtacatattttggactttttcgttatatttcgcaatttttcgtacatattttcattattcttgaatattttgaggatttttgagaatttatagaaaattttttgtgaaaattaaaaatttttttgaaaatgtattcctaaaaaaacttttttttttcaaaaaatgagatattaaaaataattttaaaataataaaaactgattttaagccaatttagatattttaaggcaatttgtgcctggttctccctttactaggaatttttttccaaaaataaccatttaaaaaaatttatttacatatttggtacatattttgggttttttgtacatttttcttacatattttaacattttttatacatattttattacaaacatatttcgcgatttttcttacaaaaaaaacaatccctaattattactttaactcgtcggggatcgtaccatagaattttaccaatgttttcggttgagaatttatccttaggttatttataggacccggatttatattggcaaaaaaaacacacaccaaaaatatagattataatatagcgaaaaaacgaaaaatatagacaaaaagctgaaatgccaggtcccggtcgcgtatggacaataaatttttatgaaaattgtcttgaatttttgaaaaaactcgaacacccgtaaattttttgtcatttttcagcaatgaataattttatatacatgaattataggatattagagtttattatttgcaaaattagatatttttactcgaatttcggtcataaatttttgtttttcacaattatggtatttttccaattttttcggttttaatggcatgttttcaaaaatttttctttctttaggggtatatttttcgaatcaaatttttcatgagaatctgtgggtctctgtacttgatctttcctgtccgggctcttattattaatcacatttttttgttttctcaccccaaactttcaagtcccattaattagtgttaatgagattaataattaaaattctttcctcacctccatcatcagcaacaaagcctgttcaaaagccataaaaacatttggcaacttttgaattgaaactttggcacanaaagttggcacattcttttaccaggcc

SEQ ID NO: 18342 - DNA, 932 bp, Heterodera glycines
actttgtcatcttttatgtaaccttgcgcctcatccaaaatgtcctgtaaagcatttgtataaagatataaatcaagagaaaagtgagcaactcaccgcccatgtcatgaaacacgaataaccccaatcattctccttcgcagtgtagacatgattagtcttccgtgtaaaatttggaaccccatgtttttgggaaataagtcttaattccgccgaggcttgacaggaccaagatctgtgaagaaaaatttatggaataaaaaaacacaagcatactcagagtacgcgtcaggacaacattgaaggaaaaagccaaggcacttttgggttccctttttctggacaacatgttgtcgtggcataaccattatacgcctgaaattggatgagtaaaaaaccaagatttgtttgtcttaccaaggcacgccttgaatatatttgcaaggtcctctgacggtgtcggacatatgtcgaaagttttggatgacgagttgcagcatcccgtcagacgacgctgagcttgtcgcatcaactgcgttggcagcattcattgcagcggaagcggccgttgcagggacagaggcagacaaattgggcattgaaagttgatgggcttgttgctgagacgaaggcacttcggaaattgcaccgcttgcgttaaaaaagaacggaggatgacccatcatggtcggatcttcgccaagtgcgcgcaagaatttcagtggcggaaactcttcgttgtaatccgtctgcactccgaccgaagacctttgtctaaacctaaaacaattttttaagtttggcgctcaaaggcattttgtaacggatttaatgttaagtcaaaacaaacaattcggaatgtagcatcagctgagaaagagcatcttcgtcgcactgatcactctcatcatctgaacaatgcttgtcagtgc

SEQ ID NO: 18343 - DNA, 1587 bp, Heterodera glycines
  misc_feature (1578)..(1578): n is a, c, g, or t
tgttatggtaacatttgactccgtccaaaatgatgggtaaatatttttggagtaaattttgattgtcaattcgccaaagggcgcagttggggttgaaaatgtcatcctttggcaacaaaaaagttcccctccttggtcgatctgttggccgttcaaacaaattaagccgagtaagtaattccgaattttctggattcatccacggagaatcagaggtcgtaccctgaagctcactgttataaaacatcgaccatagcaagaacagaaactcttcccgcccaaacaatcccaaaatctctgataaaccgaattaacttaaaaaaatggaatgtgaattttgaaacacctcattcgaaatgtcaccacaactgtttggctggtcaactgtagcgctgctgcagggcaatacaaaagcactgaaatgaatgaaccacaaaaaataaagaaaatcactggattgtaaaaaaacaagataatttaaaactcacctttggtccgcttctgtcgagtatttccgttttttgtgatggccttttctgtgtcctttctctctgtgatgtttgtctttggtccgtgccccatgccattgtttcgtttccgtccaatcgacgtctttgtcccgcttcttccgcttattccccttatgagtggcgtgtttttgtgccgtttgctcatcatttgaagaactttctttttttgggaatcggatgatcaatttgggcagtaagggagtgctggagaatgaatttgaacttaattacaaaaggtatttctttaccattcattttcatttgaactgcaacttctcattgtgcaagttgggattggaatgtccgtgagcacggaatgatcgtcatttgcgatttccgatgaagcaaaaagtgaccgcgctttccttttcattctctcagttaaaattgaatttactgaaaatagtttccgtttttattttattttatgaataaactcaccagaatttgttctctctgtaatttttgcatttgccatttctatggaggatgagttttgtcgcgtgtatttgcgttttggctgaagaattctttttaactttttttaaatcaaccataaaactgactgttttgctgtgttggtcttcttcttttcctattctgttgaatccttccgttgagcgttttgcgctttgcaacacttccgacactgaatatgaagacacagccaacaattcatcgtcctcaaacgaataagcatcgttattccgtttccgacctgcaccaaaaggaggaagcatttgtttttgttttgttatattcggtttgtactctgatggccattatccgaccgagattgactggttttgttctgcaatgaattggaattctgcttgtaaattggcaatttgttcgcttttcttcttgtcatcaatatttctggttttatatccttgggaatcaataccaaattttcatcagcagtcgaagggtatcctaaacatttttaataatttagtatttttttaactgtaatttaggttatccctaattattgctggagtatttcgcactccaaaaggctggtctttaactcccccttgtgcantatatgcag

SEQ ID NO: 18344 - DNA, 2842 bp, Heterodera glycines
attatgctctacaaatcaatgaatcaatgtgccaactatttgctaagcttataatggtgaagaaaaccaaacaaaaaaggcattggggtgtaaaataagctttacataatggctaaaaattttatttaataaatcataaaattccactaaatattaaattttaatcaaacctggccagaatattcctttatattagcctcagcttttcagcaattttttagggttttctttttaacttcacaaaattatggcctcatggatgtttcaactatacaaaaattttaaaattcttcaacacagaggatagaaattctgaaaaacccttttctcaaaaacatttctgtggccaatccaataaagattgacaaataaaaataaaagattgtttattaaattaatttaatttctctataaattacttttatatttgcttttcaggaaatattttagacaaataaaaattaggggctcattagtgtgtcctgaaatttgagtggatttagcaaaaacttggacaatttacggggccatattttttgaagtcaagagaaaaacactaatcaattgatgtctggagttaatataaaaaaataatctggcaaagtttgattacaaaataaatttattatttgaattttcatgttttttaagtaacatataagccactatctaagacttacgttacagctcaatattcaaaagaattttgttttgattttgatcatatttttcattccgtctgttaaactttaatttagcaagctcattaaattactaattatattctcattattctctttttatgttcttctttgcaatatttttattttttacattttttcccattgctggccaaaatttactgaaaaacgaaaacaaatacaaatttatacccagaggccaatatgaaattatcattgctaaaggacaatatggtgagaacctttctgtaacgatcgacagactttcgagactgtaaatatttgtgcctaatatttcaaaatcattgaatttttagcctgctaaatttcatattaggcaaaaactgcagaaaactattagtgactaattctgatgttgtaggatcaactgactggatctaattccttaattttataatttttcagacggtccaaagcaatttggctttttgacaaatcgagatgggaccatcgaatggaattttttggacaattttcacagaaacaaacttatcaataatcaatttaaagatttaaagtcgcaagaaaaatttacaattcttgtgcaaaaagagaatgataagcgaattattagaacattcaaaaattatgcagaaatgcaccgaacaatgaatcaaaaagaaggaacattttatgctcgcaaccaaattttcttcaacaatcttccggtcactttttctgaataaaatttcgcaaacaaaaatttcaaaaaatcattccgttaatggattattaaaatgcttaaataaaattttgttgtttcagaaagcgcccccggatttgccggtcgattggatcggaaacagcagttacacttttttgcctcctagaaaatatcgtatcattgtcgccagtggaccatatggtaagaagcaattgaaaaaagcatttcataaaaattaatggaaacattaatttttgtttatttatagatggtcaaaaacagaccgaatttttaactgataatgatggtaaaattgagcaaaatttcttggggaatttcctcgacaaacgtttaaacgatggatggaatataaatccaccagaatcagcagaaaaaattacaattttggtggagaagggaaatgataaacgtattattagcgaatatacgaattatgccgaattaaagaaaacaatggatgaaaatgacggcaaacttttcaactccaactacatcgatttcgaagcccttacggtttagcgttttgtttacccaaataattcaaatgtttttaaatcataggtagcgtttccggatttgcccgatttggaggatgatttagaattaaataaaacaaacgctaatagtggcaatgaggtgtattatatgttaaaatttttttaattatccatttaatttaaaatatgtattttagaatgtgaaaaataaagatttctttaggtaattaatcaaattcaacaaaatttaatggatgcagcaaataacacaaaaaaggtcaatagcaatgcaaaaagcagtaaaaaaagatactgtttgaaagttttatcaataatttggtgaataaaaatttaacaaaaaattttgtaaaattgttagagaaattatttgaaaatagtttttaaaaacctaaaactcattaaaagataaatagatgaaaataatttcaaattttattggtttaggtgacgaacaatgatacgacagttaatttggaaagctataaaaatgctacgtacactattatacctaatggacaatacagaatatttgtagctgttgggccaaacggtaattcgaaattgaaattttttatatataatatttactatttacttttccattatgcaactcatttttagcgctatgaagaatttggcgtttttttgcatgattttaccaaaaagaaatttttgaaaaattcagaaaaatttctataacttttgaaatccagaaaaaccccctaagattggtggatcccttaaaatttgttgatgaaaattatgggaggcggtataactgaaatatggcataagcagtaactgaatattttgataatgttaaagaatgtgacttgaaaactttaagttttttttaagatggcccaaaacaatttggattttcaactgacaaatatgccaaattaaatcgaaatttt

SEQ ID NO: 18345 - DNA, 2007 bp, Heterodera glycines
  misc_feature (12)..(12): n is a, c, g, or t
tctagaagtccntgaaattgggccatcaaatacgaacagaaaacggtccctctcttgggttggcatttgttcgaatgtttgtaaccaagccaagcccattctttcagttcgttgctcacccccattgccaacaactgctcacttccatttggtacaacatcaattaatccgacaataattaccccacatttcggcactttcgccctttttaaggtacgaaggctttcccctgaagcgtcaccgttcctcctcccttcgcactttgctcatcgctcttttgctggtgctcgggtggcctttgatggccctttgttacattgcctttcccaaaagtcgcgtgggcgaaatcgtccggtcgcccttcatgaaattcctttactacaggtcagtggggcaaaaacattgacaaatgaatgagagaaagacccatttggaagacaatttggagaaaagcaattaattaattagctaattaattaattataacctttcagcacttcctttggctgttttcttgctcttcttacgatggtataccaaagggggggggggggggggaggtgtggagggaattcatcggagaaacgcacaattcaaattccatttgaatttaatttaatttcgaccgtttgcttcggcaccactcaattccgatgcactgttttgttccttccccgcaggtcacttttgaggcgcaccgtgaacaaaccggcgaagtgaaaggcggcacggcgacgcgtgccgctgaccgtggcccaacgcccacactgatcgaatggttggtgttcatttgggtaattggtaagtcaaatggacgggaattcgtacggtttggaacccgctgctgttgagggatgttgtggtccgaaatcaaacaaatgtggtggaggtaaggaagaagggggcgggagggaaattccccaaattttgttcccccgcagggcttcaccaaatacatccaccagtggtggaattggctcgacttcgtcatggtctgtctgtacttgtgcaccatttccattcggtctgtccttcttccctttggcatttcgttcgtctcctctctcttccttttctgttctgtcgccgttcatttctcctccctttcttttgcacagattttctgcctattcgatttacgtgatgcacaacgttggcgagcagttcacaccccgccacgtcatccgcacgcattggaatgcgtttgagcccgtgttggtcagtgaggcgctgttcgctgtcggcaacgtgttcaggttgggtccgggacggctgcagctgcgccattggcactgctggccaagtcctgcacatttcagcttcgcccgcatcatctacttgttccagaccaatccctacttgggacccttgcagatctccttgggctgcatgctggtcgatgtggccaagttctgcttcattttcgtgctgatcatctccagcttctcgatcggattggctcagctttattggtattacgactcgcagacggtgacaaatcacattccccaattgaactttaatttccccaacaattgtcatttccagccggtctgtttgagttccgatcggtgtaaaatcgtgccgaatgccttttcgtccattgcctcctcctacatgacccttctgtggtctttgttttccatcacaaaagtggaggacaccgaggtcagtcaacgactctttccagcaaatcgacaaatcgaagtgatcagacttacaaatcagtcaaaattaggtggtcgaagcgcatcacttcaccgtttgggtgggcagagggtcagttaaagaaggagggggagaaggggggatgggattataaatgccggatcatccccattcagtctgttcatcctttatcacatggtcagtggccaattcccattgataattatgattaattaattgctaattgcccctctcccctcgaagacgtcaatcattgttctgctcaacatgttaatcggtaaaaccgtcccaagcttgtaacgagaaaagattctctgg

SEQ ID NO: 18346 - DNA, 2770 bp, Heterodera glycines
  misc_feature (2730)..(2730): n is a, c, g, or t
atttgagtcggactttctgatcgcttcttcggtgggcagtgaagaggactttgttgctgcgttgggcccctcccttgacgaatgttctgttttgggaataatctcaagagcggatgcgctaaggtatatgaccgcaaaggttcgaattgaacaaacggttaatgcatggagaaacatttgctgtgattaggtgagacggaaaacctttggcggtgcttccgcaactgtccgaacttcacaagagcatgacgtcctcgatttcctcgccaattcgatgatttgtcacattcaatcgtccggtggaaatatgaaaatgaaggcggtcttcctgggcttgatgatcagacggtatttttcatataccggcaatttaaaaccaaattaaggctaatcgaagcggagaagggcgtttgcgaggcggacgatcgcgatttttacggaaacaaacgcattgagttggctggatctttgctttctctgttattcgaggaccttttcaaaaggttcccaacactttccagcttgtttctatatgtttcattgttaggttcaactccgaattgaaacgaattgccgacagtcacctcaaccgaaatatggccgctccgctggacatcgtacgacacatgcgccaagtgggaaagcaataaatcccgacaaaaaaaacaaattttgtgtccttggttttaaggatttgataacaaatggtcttgtcaatgctcttgccactgggaattggacaattaggcgttttaagtgagcgatgaatgccggaaattactgaaaaattaaccgttttgttgttcagaatggaacggcatggcgtcacgcaagttttgtcacggctgtcttacatcagtgtgttgggaatgatgacgaggatcaattcgacgttcgaaaagacacgcaaagtgtcagggccacgttccctgcagtcttcgcaatgggtctgtttcatgccttgcccatttttgtaaatagtccctttctactccttttagggaatgatttgtcccgccgatacgcccgagggcgaatcttgcggtttggtcaagaatttatcgttgctcagtcacataaccacggacagcgacgaagcggtccattgtttttaaatgactttttggaaccaatatcatttttagcccattttgcaacttctctacaatttcggtgtccaagacgttcgtccgttgaaatttagcgtcgttcatgaaaggtaaatttgattgttaatgcctttaaaagggaattgattaaagacgttatcacatcgttttcctcaatggttccattgtcggaattactgatgacgttgaaaaaatcattggcacggtgcgactgatgcgccgaagagggcatttgggtgcctttgtctcggtcagtttcaacacgtccacaaatgcgctgtatttggccagcgacgggggccgactctgtcgtccgtatgtcatcgttgaaaatggtcgtccatgtctcacgcagtcccaaattcaggtaaaaatgggtgtcactttttgttcatctacaattatttcggttgcaggaagtccgagacggtcagaaaacctttgaccatcttttggcggagggatgcatcgagtttttggacgtgaacgagttgaacagtacgcgcatcgctgtctatgagcaccaaattttgccgcagaccacccacttggagatcgaacccttttcgttgctcggcgtcgtctcgggactgatcccttacccacaccacaatcagagtccccgcaacacttaccaatgcgcaatgggcaaacaggcgatgggcaccatcggatacaatcagcagaagcgaattgattcggtccatctttagcgatggcaaatgttttaacggtttggaaatggtttagctgatgtatctgctcgtttaccctcaaaagcctttggtgaaaaccaaaacaattgaattgtcaaacttcgaaaagctccccgctggtcaaaatgcgattgtggcggtgatgtctttcagcggctacgacatcgaagacgcattggtactgaacaaagcgtcgttggaccggggtcagtcgtatgtttggcttccaacattttaattccgagaataataaatcaaggttttggacgctgtttggtctaccgatttgccaagggcaccgcgcgaaagtacgccaatcaaacgtacgacaaaatcatgggaccgtcgctggacgcgacgacgcgcaagccgattgcgaaacatgccgttttggaccaggacggcattgtttttgttggggcgaagattatgccgagacatgtaaattgtacttttggaatttactttctgccttctttccaggtgctcatcaacaaatccatgcccataatgcaatccgaaatgcttcccgctggcaatgtcgccgggttcaaccacaattttgagacaaaggacgtgtcaattccctaccgcggctcaatgaatgccgtggcggagcgcgtgctattgacctgcaacgacgaggagcaatacttggccaaagtgttgatagcgcaatgccgaagacccgagttgggtgacaaattcagcagtcgacacggccagaaaggcgtttgcggactgatctcgccccaggaggacatgccatttgatcacaacggcactgtgcccgatttgatcatgaacccacacgggtcgaccaaattttgaattgtttgaatgatagtttttttctttttagttatccgagcagaatgacagtngggaaactgatggaattttgtgagtgcaaaatgcgctgat

SEQ ID NO: 18347 - DNA, 1698 bp, Heterodera glycines
  misc_feature (1683)..(1683): n is a, c, g, or t
ggcagggggaaagcgtggggggaagggtggggagccacgcatgttgtggtacacgcatcgattatggaagccgcgcatgcactagcaacgaagtcctttgcgcgaagcgctcatgtcagcgcccgcccatatataccaaaagtatactgtctacaccgagcattagaagcgcaaagcgcccgtctgaggccgcgaagcggccgaatgcacttgctcatcacttaacaaacgcgcatgcactagcaacgaagtcctttgcgcgaagcgctcatgtcggcagcaacaccacccaacaacaccaagccaactgtctacaccgagcaattactgtgcaaagcatactgtctacaccgagcaactactgcgccacacgctagtttatatactttagaataacagtgcaactcatttccaaaaacaaaatctccttacggtttgccgggtggggttcgaaattccgaccttgggggtaacttttgacggcgcattcaggaaaactatagattttccgatccgagggccaactgagcgccaggcgccgaaaagtcactttttaaaatttttttttgccgtttttgggattcaaaaattttttaaaggcctaaatgaaaaatcggcctcgtaaaggcactcagttggaaagttttgcacattttttggttcttcaccgaacccctagggcttaccagtttttctggaaaactgtggaaaaattgtatacttttttgggccatttcagcgccggccgaataactcgccggggtttgaccggaggaggtcggtgtaagcggcttttttgtacagctcgacgagctctatccaaccatgtttttggatttctgaaattttcagaaattttcgagctaggccccctcgaaaattttccgtttttgaattttatgattttttacagatttttctggggaaaacggagaccactttcaagcaaccgtttttcatgctctatcgattggtgtcattttcagaaaaatttttcaaaaattttttggaaatagaaaatttttggttgctaggcctcaatttcagttctggcgcaataactcgtcaggagtttattttatcaaaaaatcgtctaagagcttttttgtagagaattttaagcccaatctaatgtgctttatctcatgtttttaccatgagtttaaaaaaagttataaaattaattgtgattttgaaactcaaaaccataggggggaccccatgattttgcatttcatgaaaaatttttttactcctaaattagctaaaatgcatttttatggcataatttgaggtgctgaatacgtatatacgctttattttgcgtttcagattttttggaaggtgtttaaattttttgaaaaatcgtcaaaatttgagccccggaaaatccagtgaaaatttgaaaattcataacgctcttcgtttttggtcaaatttagtggaataaagtttgaaaaatagcaaaaaattaggagaattttataagatttatttggaatttctatcttccaaaataaaaaagttattccagaatttctggaaaaattagatttttcagaaaaaaattcctaagtccattctgaaaaagtattttataaaaataatatactcaaaaaatccgcaattttttgctctattttataaattttatttaagcttattatcacttttttgaaaaanagttatagaaataaa

SEQ ID NO: 18348 - DNA, 866 bp, Heterodera glycines
tttatgattgcttgaattcatttttaattgtagagcttttaagtatttttataatttacttcccccaaaaatactccttaatcttttgtaatttataagtaaatttagcaaataggtcttactgaataacaattaattatgtttattttcttcttttattattttttattaatgcttgtatttaattttcttttaaataaatatttaaaaaaggtttacttgtaatcttagataatacagtttttaatttaattttaatttataattattaagtctcataaaattactaatgcatttattggcagttcgatttttatgccttaaaagtattgctgtgaaaaacgtacaaaatagtccagaattgttaaaattatagttaaaatttatttacgtttaaaaaaattctaattttaataatttatattaattctttttaactatgcaaatttttattttttattataaatgtaataaatatttataaccgagactaccgcacttccataaaaataactttatttaattagaaattatttgattttatttttaattttggattttagcttttttatattcttattttgtgtttttatttctatctttatcatttctatatgaaaacaaaacttaatttttttattaaaatgttgttatattaataatttttgtttgttattatcatgtcagattgtgtatttaactttatgaaatgaagaaaattccggaaaagatccgggttccgggttggtaaaaattttaattttcacatatatttcaactccaaaattggccaaaaagcgggtcatgtgttaaatttctgctctatttcacttcaggcgtaaataaatgacatcttccattataaa

SEQ ID NO: 18349 - DNA, 1069 bp, Heterodera glycines
  misc_feature (1001)..(1001): n is a, c, g, or t
gcgccaataggcgccgccgggaaaaatttgtaattattaatgcgatttgttaacagattttgcccaaaaaatgactaaatttagcgatttttagcaaatttttaaagattaaggatttttaaggtccgctttaattatttttcttactttttaaagaaatgtcaaaaacttataaagtagaattctttgaatggaaaaaattaaccagaaaattgaaaaaaaacaaattttcagccatctctgtttaatatacaaagtatctccttgcggctaataattttggtttttggcagaatcagaattttttattttcattttttaattactaattcttagaaaaagaaaaagcaataattttattttacaattttattttaattttcatttgtgttaaatttattggtttaactttagagatcactttttgttaaattattattttttgttttatatttaaatttttaatgattttttgatttccgcaatttattaattaatctatgctatttaatttattttatgttaagtttctcgccgatttcctggattggctaactttaaaaaaagttatgaccaaaaatgtctgaaaacctggttccttttgtacttttggccgtaaccttgtttaaacttgacgaaattatttgaaatgagatgagctaatagagaactcttagaaactcgtttatatcaaaaattataattttttgtagtcgaaatataattatttaattttatcaaatatattttttaattagtatttctatatcttcacacttcattttattataaaaaattattaaattgttttatcgttgttgtaatgggtgataaaatatgggtccttttcaactattattatttttatatatgaattgttaatatttatttaaaatattattttattttattttcatgtccagttcttgtgttcggtggcggcgcgttaggtagtggcgtcttttcttattaataaaggcatttatattaggtgggtcttncttttttcttttcttgctttttccccataaaagaattattatattattaaaatgttgaacaaccaatt

SEQ ID NO: 18350 - DNA, 2784 bp, Heterodera glycines
  misc_feature (933)..(933): n is a, c, g, or t
  misc_feature (949)..(950): n is a, c, g, or t
  misc_feature (972)..(972): n is a, c, g, or t
atgcaacctttatttttcctcgcctctcttttcgaactgcccagctattagcaagcgtgtttggaccaattctaaaacaaatcggggtaattaatttaatctgactttataagataaatgggaatttaagcgaaggattcatgcaaaataataatctatagaaattctcaaaaaagtagttcctcgcagattcgggaaccgtttctataaagctagagacatatgcgctaaccataaaaaagatgaatcattttttgaaaaatttatatagttcgactaaatttgctaatcgatttatggtgtacaggatgtttgtcgaaacataactcgtcaggcctttaagatagacctgccattgctattcctgcaaatatggagtctagtcagcccaatcgattgctattcgaatggtttggggtcattggcccaaacaaaagttgtgctgcttcttgcaaataagacgtagccaactgtaaacagcaagccatccaaatgcttcaatgtaaaaaatttacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataataatctatagaaattctcaaaaaagtaaatcctaaaaaatataaaaccattactataaagctagagacatatgcactaaccataaaaaaaataatcattttttgaaaatattatatagttcgactaaaaatgctaatcgattataaaataaacatttctgtcgaaacataactcgtcaggcctttaagatagacctgccattgctattcctgcaaatatggagtctagtcagcccaatcgattgctattcgaatggtttgnggtcattggcccaaanncaaagtgtgctgcttcttaaanaccgaaaaaatataaaactattaataaaaacaaaccttaattaaaataataagaattttacatgaaaatacaaaatattaataaaaataaatccaaaataaaataaacatttcataaaatttttatttttaaaattaaattaaataaataaattaatataaaataaaagtaaaataaaataaataaataaaataaaatgaattcataaaaacgaagcaaatgcttctcgcaataaaaactaaaaataatctaataaaacgccccaaataataaataaatttattccacaataaaacggttgaacgtaaaagcaattaaaattgtttatgaaaagttttcctttcttaaataaaagggaagaaaaaactaaaacgataaaaaataatttaaaaatgaaaaaaccataaaatgataatgtggaaattttgaatgctattaaataaccaaaaaattttggtataaaaaggggaagggttttcagtttaggtatgcttcaaccaattcactctgctagcccatcggttctcttcactcatcaagccggacaacaactcgctctgaatacatcacaactcgggcattcgaagcatcgcggatattgatcaattgtgatcagaaatctaccaaattttccactttgtgtcctttgtcgccccatcccaaataaaatattaaattaattgattggatcaaccagtgcatcccatcaattttggtgccacgacccgggaaggcaaacgacaacaccaccaacaacaacaaaagctgatcgctgatctgagaactggaaaaagccggtcatctgttcaaatagaaaattgttgtgcactgttaaagaaaactgcaagactgttcatcatctaaaactgttcttcgtcaatcaaaagtctgatttagacgtttagttctaatcaagaccaaaatcacaaacaaacaaataaataaacaaaaaattcagtgaaacgaaaggctgagtcaaagcccgatacggagctaaaacacacaaagaaggacgaaaacaaaaccgacgagttcaaaatactctaggtgtattcaaaggcgatcagataacaatttttcaattaatcattgtgatcatactgttaataaaaaaatttgtgttgagaaaaatcacaattaataataaggctggataataaaataaacagtaaaaagccaaaaattatacaaattaaactcgaaagtccttccagcagaaattcaaattgctctaaattaaaaaatttgaaaagaaaagaaaagaaattttgaaaaaatacgaataaacggtcagaaatctagggagcaataaaattaaaacatccaataccaaattttcaatcactttagttaatctttgtgatcgtattgttaataaaaaaaaaattccaaataaacgtcaaactgtgtcggccaaagaaactaatttctgaactggaaaaggaagaagaaaattttgaaaattttgatcaattggaagaaattattgaagaagttgaagaatttgtacctattgtagaaattccggttttaacacccgaagaaattgttaccgagcttgaaagaagggcaaactttccctttccaatagtgcatatttacccaggaatttccaaagtaacaaaccaaattttaaaaactgaacccttcccataccaaaacaaaaccgtatataaattcactttgacaataactatttttccatactgcattttaaataacctagataaagccgattctttggaaagaatatcacaggaagtaattttagaagctgacttaaaagtaagagaaacactcaactctaaccct

SEQ ID NO: 18351 - DNA, 1096 bp, Heterodera glycines
atatgatacgctttcaagctttccctttcactttgtctgtagcaactctttttgcttttctggtctccactctccggcacacatttgaacatttaggaaaaaatccttaattttgtcccgaccttccgttccgtataggttcgggatttctcggagcgtatttgcgtattggtttgacagagtaactttatgtaattccattacaatatcaggaatttgattttgtaggaaattttgctgagggacaaactcgaaattttgagtattcggaaattggtcgggcaaaaacggttggaattgattgggctgtggttcaaaattcgggttcggttgctgctgataattttgttgattcatattccgaaccggattataatttgggaaatttggaccgtttccaaaatctcgtacattttgaatggggtaattcatcccaatttctcgaccataatttggattatgaacatttcggttttgctcaccaattaattctccatacccgggattatgagcattccgaaccggttgtgcccttattccctgatttggtacaaaattttgggaatttcgtgcagaaaactgatggttgttcgccatttgcgagttaacgaaaattcggggattttggcggcggtgatttccatatcggttcgcatccggattccgattttggttttgctcgaaattttcttgttggccattgtacgaaatatgcggtgagacattttgaggggttgaatgagcccggggatttccgaaactttgggcaacattttggttgggaggtcggaacactgcgagctgcatttgttcttcgacattttgttgcactcccacttgctgggggatactgttttcgaaatttcgcggaaatggatttgggtcttgcacattgtccaaaatgttttgaggggccaaattcaaaccattgttttgttcagtgccatttcgtcggctgtggcgagaatgcgacgattcctcttgttccatgtaattaatcggccggcgcactcgaaaattatatctttgctgaaaaccggttgactccatacatttctaaactttgaaatgaaaaggagaaagaaaaaattcaaaa

SEQ ID NO: 18352 - DNA, 1369 bp, Heterodera glycines
acgaaaatttaaatatattaatattttcttagataatattgacattttaaattaaaaattttgtcaatagaaaaaaataaataaattttgggagaaatttttgagaaatttttccaattcttagggtgcatttttgaaaatttttttggtcgattcttatgggtatattttttgattttaatgcatttttgttaagaattttttgaaaatccttaaaataggtaacaaaaatgccgaaataggtataaaagtaggtacctaggtaataggtagaaaaaatcagatatctcgaatggattataataaaaatgaataaatagtagaacaaatagtaaaaatatatagaacaatacgtggataatatataaagttaattatatttaaatacgacctcattaataaaacaaaattaaaagatgaaaaacaaaagtcagttaatgaataaaattcaaattatattttgaaataagtcataacacatactgcttaatgaaagttaaaaattttattttattctttaatcaaaaaaattattttttaattccttctatataaatggaatatttaagtaaaaaagaaaaaaaaaaataaaaaattaccaaatttaccataatttcaaaaagtaaaaccttttgtataatatgctaacatatgcgaatcaaaaacaatttgataaataaatttgactatggagcctatgggaggtaaaattataacatcaaaaaaattttcaaacatattatttataagttatatgtaaatcgaatttgtaaaatttttctgaaacaaatatacattagaaaggaaataatcaataaacattttctagcatataatatagacatttaatgagaataatcaaaaatttatttaacgaaaaatgcaaataataataaaaagcatttaaagtcgatcataatcgactacgcccgtgagaaaaattaacatttaaaaacataaaataaataatttgcatgacttacgacgtataaaacaattgccattacattacaaacataaataatctaaaatttaaagatataaattagactaatacgtaaaataatttttactcactcatgcgaaatgggtaccaagccttagagatgacagtcaattttgagtaaggatgcgatgattataaaaagaaaaatttaatttttccaatacattccattccctgcgtaattaaaaatattttcataatcagtgaataaacttatatccaaccataaatactcacgaaatataatgtcttaatacaagatataagctaagataaacattttatagtagaaatgaaaaaaagaacaaggaattattcgaggttaaaggaacattaaaaaaataacaaaaataaatatattga

SEQ ID NO: 18353 - DNA, 2429 bp, Heterodera glycines
gcattttccgattgaattttacctataattgtaacttcatttccggaaaatgcatattttcagatagaattttacaattgtaacttcattccggaaaatgctataattgtatttcatttccggtaaatgcgtattttccagtagaattttacaattgtagcctcattccggaaaatgctataattgtaacttcatttccggaaaatgcatattttcagatagaattttacaattgtaacttcattccggaaaatgctataattgtatttcatttccggtaaatgcgtattttccagtagaattttacaattgtagcctcattccggaaaatgctataattgtaacttcatttccggaaaatgcgcattttccaatagaattttacaattgtaacctcattccgggaaatgcgcattttccgattgatttttacaaatgtattgtaaaattcatttcatgaaaatgctataattgtaacttcatttcaggaaaatgcatattttccgtccgatagaattttacaattgtaacttcatttccggtaaatgcgcattttccgatagaattttacaattgtatttcatttccggtaaatgcgcatttccgatagaattttacaattgtacttgtttaccatttctgatcaacattgaagctgacgagctgatccgaggcctcatttcactgattaaatttggttgcattttgtcattctctccatttggcattttgtcaatttgtggggacacttaacaaattattgcatgatttcaaataataaatgaagaattttttataatatttttgaaaataaaaattttaatttttaaaaattgcctgattcttcgtcatcattgtcttcttctgccgcctcaatgccaattaagctaaaacaatattttataatcgtctaaatttaagacagcatttcaatttattatttggattttactaaataattaattttaactaattaataaatatttataaccgttgaaaagttgatggagcagcatcagctaatggaccaagcgcagctccgtgcgggttgcgggaacgaagcgcaaaatcagaccaaagcgctaaatacagaaattaatcaaacagtaataagaccacataattagagaccgaatatggacagacccgtatacgggtttttaccggtcagtcgccgataatccgcattttttgatcgatacagatttttagtgattcgggttttacggtttttttagtctgtaagtccgtaacccgtgtatgtgactgtatgtgacatgcccagcccgttttgagaactaatatgttcccagttcaaattaatttatatagtttatagaattgaattaattattcatttaaattttttcgccaaaatttgtttaaaaatgcaaaaaaatatatataaaaaataatggaaaatctcaatttttctagcgtgacgcaaaattaaaattctcatttttaataaattatttttaaaatttattattgtaattaacgaacaacaatccatcagttgtagttgcattgcgttgcgccagccgagcagtgccgaacgggtggaacaaatgcacaaaagatttgccaaaattggctgttcatgcataatgctggcaatgagccgaaatgcggtcggaaaagcagtcttttcaagccgagtggactaaatttaaaaaattaaataaataaactaattttaattaagttttaaatatttcttcattttatttatgagaaaaagcatgaaaaaataaaagctttatttttttatttcaattaataaattttcaaaaatattttgcggttttcattcttttaattttaaattctttaaatgaaatgtaatctttaaattaaaattcgtttattatttattatctttaattataattaaatatttttatgtaaaaaaattttaaattataaaaacaataaataaaattaaatataatttgcatttgtatgatttatatgagggaaaaatgtaaaatatatgactttttgaaaatattttaatgaatataattttaccaaaataaataaaacccaatttaaatttaatttcatcatatatccacataaattagataaaattgaatgggaaaaaaaagcaaatcgaactttgttaaattcacaaaataatttcttggagaaagaaatacaaaaatttgcaccacctcattaattaacagcgttaaaatgggcactttgccgccggtactcaaagtgttcagcgaccaattggacgtcctgctgctgagatttgagctgtccaaagagttggcctccaaattccaacacttcagcagcccgccttgcaacgagcagcgaagtcgttgatgcaaaattccctgaaaaatttgcaaaaaatggaaagaaaaaaattaatatattttaagtattaatactttttgattataacccga

SEQ ID NO: 18354 - DNA, 1213 bp, Heterodera glycines
  misc_feature (67)..(67): n is a, c, g, or t
ataaaaccgaaaaatgccagaatatattttaaatattttttgaataattactaacagtgattttttntatttatctaaaatgttttaaaatttcaatgttttggttttaaaaattttattttattccaaacatttaaaataattaaaataaattaaaaaacaaatgtaaattctctgaattaaaaaatgatgcctttgtctggcataaaaatatccaacgatccttgggccaaggggctaaccaaggaagtgggctggacctgaaaaattataaaaaatagaatttcattaaaaaatttgcaaccaaaatttgggcacaaatactgccataaattggcaataattcctggcgcccaagtgctggtaatttgtccatggcataattgtgaagtcggccggccaaagatgcattttgaagtcggaaatgggcattctgccaaaataaaaatggtttaaatttgtattcaaattaattttagaaaaattataattggacgagaaatgattaaatatgtacaagacataaattaaggtgtttgctttcatatttatttttcaagtgatgccaattcaacaagatagaaattttaaattgtcattctgtctgataaatagggcttcgatttttaggtaaatacctaaaatttttgcgcacttgtaacgttgagataagcataaaaaacgagtttttagcttggtttggagcttctacacccacttttataatacctatttttacctatttcgggatttttctacctattacctaggtacctatttttatacctatttcggcattttggttacctattttaaggattttcaaaaaattcttaacaaaaatgcaataaaatcaaaaaatatacccataagaatcgaccaaaaaaattttcaaaaatgcaccctaagaattggaaaaatttctcaaaaatttatcccaaaatttatttattttttctattgacaaaatttttaatttaaaatgtcaatattatctaagaaaatattaatatatttaaattttcgtttacaaagagatatgtagaaccaaaattttccctctttgtttgcttttttccactaaaaaatcgttaataaaaatttttttttacctattttggtacctattttggaatttttatacctatttaatacctattttgagatttttttttacctatttaagtacctattctgagatttttcttaccta

SEQ ID NO: 18355 - DNA, 1294 bp, Heterodera glycines
aaggggaaaagatggacagacaaaggggggacggggatacgaaacggggatagattgggaaacgatttggaaattatttttgccattttgcgcagattcacacattcgccaccgatgcgggcattcaccgaacggaggccgaaattgacagagacgtggcagagatcatccaatttgagaaggaattcgctcgcattttgatcccggacgaggagaggcgcaacttttccaaaatgttcgttcattttccgataactttgctaattgatcagctgatcccccctcccccttcaggtacaacattcgccatctgtccgaaatggaacgtcacgtgttccccgatgtgagtgactttctgttgcttttcaatttatcccaaaaaataaaaataaattcccgcgtccgataattacaattattacatcatcaattaatgaattaattgacgaattaatacttaattgaatttcgatggggaaagggcagtgtccgtcgttttcccgtgcattcgcacctttcccttccatcggtcgcaaattttcaattaatcaaacggcgaaggacgaaaaagcgtcgaacattcttttaaatttaacaagaaaaaagaaggcatcaaagaataaatttgggaggaaaagaaatttaaaaaacaaataaaaaatagtaaaaaaggaaaatgaaaaaacagctgatcggccgatcaaaaaccaattggtcttatcagccgatcactgatcaatcagtgtttgatcgttgtcagatgaattggtccacttacttcggctggttggtccccgacgaaatgcgtccctacgtggcctccgacccggaagttgtgctggccgagccggcgtatttcgtccgattggcccatttgctgcgccggacggacaaacgaattatcgccaattacgtcctttggcgttatgcctccgcgtggtctttccaggcgagtggcgcaaaatttaaatttaatttaaaaatgcaaatggaattaaattatccaattttatttgaacttatttcgttttattaaataaatttttggtcattttcagatggacgaacgctatgacgacattcagcaggtaaagcaattattattctcgtggaaaaactaattgacgacatttcaggactttctgaaggcctttttgggcaaacagagcaaaagcccgcgatggaaagactgcagcagttcggtgtcccagagaatgagctatgctagcggggcgatgtacgtgcggaagcatttaacaagaagagcaaaacggccgcatggaaatggtgggga

SEQ ID NO: 18356 - DNA, 1160 bp, Heterodera glycines
agtgattggccatgagatcacccacggcttcgatgaccaggggcacaatcgacggcattgcaacctcaaagattggtggacccgaacacgcagcagcacttgtggagcgaaaggtgtgaattggcaaatttgaattgaatgagcaaatggaatttggtaattgcagcggtgcatcatcgaccaatattcttcctttgaagtgcccgacataaatttgcacgtcaatggcattttgacgcagggcgaaaacattgcggacaatgggggcattaagcaagcttaccaagtaaaagggaggggaagggaacagcaaaatgagggaaaatggtaattaaggcttacaaaacatatctgaacaaattgggacgggaggagaagcggttgcccggctttgagcggtacaacaacgagcagatcttcttcatcagttttgctcagacgtggtgcggacatacgaagccggagacggtaagcggaaggcaggcaggcattccggacaaacattcattggcattggcacgctcagctgatccgacaaattctgaccgacccccactcgccctaccgctaccgcgtcaacggcgtcgtggccaatcagcccgaattcacccgcgcctttggctgccccgccggcgcccggatgaacccggcacggcggtgttcggtgtggtgacaaaggacgaacggagggtgacaaagtgcaaaaacagtcaaacgagcagcaacaaagcccaccgattagcaagcacatcccatttttgtacatatttatgcaatgccgcgcaattcgttgcaatattagaacaaaagagagagaaaaagagaaaaaaaatcaaaaataaaaacaattgccaaatgagtcgaaagtttggcaaatttggcacattgattatgccattcatcgttttgctttgctggtcgattaagcctttgccgctctttccttttctcataccaatggcttttccgattctttgggcgattcgctccacgcaaatttgagaaagaaaaggagggagaaaaggttgagcaattggaacacggccaagcagacgtaatcgaacttcatgaacacacggccccactcgcgttcgatctgaaaaagacaccaatcagcagagaagcagagaatgccattcaccttttcccgcgtttgttct

SEQ ID NO: 18357 - DNA, 705 bp, Heterodera glycines
aattttatgagatttatttgaaatttataccacaaaaacataaaagttattccagaaattctggaaattttctatttttcagaaaaaaatttatatctcggttctgaaaagtcattagagaatagtaaaatactataaaaatccgcaattttttgctctattatataaattttatttgacctttttatcatcttttaaaataaagatacaaaaataaaagtgattttggcattcgagaccaaagggggtggtggacaggatttttgagtaaaaaatttttttcaacaaaaatcttccaaaaacatgtgtttatgggttatttgggccgttgatcacgaatacgtaatcagattttacttttgacattgttaagacctcagaatccctgtgtgattggggattctgaggcatcattttgagggggcggggggcaagttcgaatccgggcggtaacacattatttttctaagtatttttttttgcttatttttagatgtttttaatttatttaaaatagttttgatttaatatttaataataaataaatttttaatttacatttttttatcaataattgttttaaattttaaaattcacattgtacctcttctaaaaaaatatgaaaaaaattaacttaaagaaattctcaacaaaattaaaaaacgggcgcgaagcgcccgtcctgaagtcgggcgtgggggggga

SEQ ID NO: 18358 - DNA, 1583 bp, Heterodera glycines
aaaaataataatttcaaaagatttcaaaaatttaaaaagaaattaaaggaaaaaggataaaaaattaaaaatataatcacttttttttaacttttaaagtcatttttccattttttaggtaaattttgtcctttttggtcataatttggaaaatttagttaatttagaagaatcttaatcagttatttatctgtgttaaatttaaaactttcatacatttctcaccgtacggggacactgattcccctatttccgggtcacagtttccggtgtgattaccagttatccgattccgtacttcttgctgttgtgaacaacaaaatggcaaatatccctacagtgtttttgaatttattatttttttttgaataatttaaactaaatgatgagacgagcgagcgacaaaacaaatggagaagaatttttttatcgatttttaaaaataattaaattttgggaagggtggggagccccgcatgttgtggtacacgcatcgattatggaagccgcgcatgcactagcaacgaagtcctttgcgcgaagcgctcatgtaatgcatttcttttcatctctcacaagtaaactgtctacaccgagcaattactgtgcaaagcatactgtctacaccgagcaattactgtgcaaagcatactgtctacaccgagcaattactgcgccgccacacgctagttaatatatacgttatattgacaaggagtttcgtttcaaaaaacaaaatctcccggccgaaggccgggagggccctgaaagtagtggaagggtcttacaactttttgaggagaatccgggaaaactatagaaaaaaatttagcgcggacgactgagccccagggacggatttctcattttttcgtgcatttgggggcccgtaactttttttctaaaacccaaatcaaaaaatgcctgctgtgagggggctaagttgaagtgttttctaaaaaacaaaaaaaattccaagcctctatctgcaataggaaaggctgtaggttcgtggactttttcagtaccaactttgtccagttcagtcccggttgaataactcattagggtttgatctgggcggggagttaccagcagacttattgtagagttcaatgagctggatttttccagtttttaaaatttcgaaaattttcaaaatttttcgagctaggcctaaaaaacggttttcgggtttttgaattttaggaatttttaacgaattttcccagagaaacggagaccacttccaaaacatagtttttcgagctctatcgactggtatttttttcggaaaaatttcgattttttcccggaaatagaaaaaatttttggcctgagcgggacatttgagtcccgggcccataactcgtcaggggttggttttatcaaaaaaacgccttaagtggttgaggtggtggaggcaacgctcgaaaagtaccagagagaaccgaagacaatgcgtgccatagccacatcaacaccgtcttcggcaaattgtgctgcgccatcaacagcagtttccaacaccgatcagcaaccgaaagcgccttcagcggtggtggcaaatggtgggacggcac

SEQ ID NO: 18359 - DNA, 2462 bp, Heterodera glycines
actttattttaaaataaccctttcacaaatttagatctattattaatttaaattattttctttccttgacaatcggaactgaataatttcatgaggtttgattgggttttttaagtaaattttctgatttatattttcttgaaattttaacttaactttttcaattttattaattcaaaaaatgtaaaatgttttttagcttataaagaagttcttttttttaaatattatttgtttaataaagttatatgatcgcgaagatcgcgacgaatttatttaatggaatttaatagttacggtatttatttatttaaaattattcacattttaaatttattgagtttcattttttataattttattacaatgtttactttttaagatcggtattttggtactgttacttatttgcatttctttcattttgataaagataaatgtgaaattttaaagcaaaattgaacatttaaagttcgttaataatggtataattttcatttttctgttatttaataaagcttttatttgtattacaaaattatagagatttattaaatattttgaaataatctcgcagtctccacttaaatagtctgctttttttgttttaattgtgaactaatttaaatataaattaattaaagggctattgctttctttacaattgcttattttgttataacctatttatttgtttattttattttttggtttaaaaatgacaatttatgcggccggccttgttgaagacccattcgcattctttcacagttcctctctggtggcgaagtggttgttttgcctccctgaggtacgctggttgaacgcctaattgagcaatggtatttactagagatcggatacgggccggacccgtatacgggtttttacggacccgtagcagtcaattcgccaaaactttgaaattgggcggtcaatttcgtaaaattttcggtgaaaatcgaaaaagcattggtaaatattggaaaatttatgtaatttgaaaagaaatcaattatttctgtaccaaaaattttttaagttattgaatagctttcgtttaaattttttatgtaattcttttttattttttaagaaattcttttttttacgaattggatttgtaaattcttcaaaattataaatcattttaatgaaaaactgtcagcaaaattcatgaaatcagttaaaaatcgcaaatttggtcaatttttctattaaatctattaacaaattgcaatcaaattttaaaaaatttccgggaggcgcccaacggccaccgccggatgccaattgttgtatttttaaattttgttgcttaaaatttataacaaaagttattataatgtcttgtatttataaaccgatttttatcaaaaagaaaaaacccttacccgtatacggacccgtattatttttgaatacggggtttttacgggttaagggttttacgggtttttagcccttttcgaataacgaaaatttttagacctaaaattttttatcaagaaaaaaaattttggcaatcaatttttgagaaaatttttcaattcacagtggtgtattttctcaaaaattttcaagtcctttcttagggggtgtattttcccgattttattgcatttttgatgtaatttttgtgaaaaacgccaaaaaaggcatcaaaacggcaaaatgccaaaaaggcatttaaggcacgaaaatcccgaaaaagtcaaaaaaggcataataaaagtcaacgtagaagcctcaaaccaagtggaaattacgttttttatgcttaatgtcgtccgaatcgagagcaggtggtcgtccggagcggggttcatcttcgagctgctcattgccttcacgaaattttgtgaaccatcgcttaactgtagaaagagagagtgcatcattgccctcactttcacaaatatttcgaagagcttgggttggggtagaattttttcggaattcgtaaagtaacagttgtcttaggcgaattttgtccattttttgaaaatcgttcgattttgcaaaagtaatggctatacaacaaatgcaaatggcaaaaagatggccaaccgtccgctgattaatccaattgcttgcctccctttttcaatctctttagaattaaatatcattttttgcataatttgttttttcagagggtcagaactttttcaaacccaatatatcgaaacaggtgcgcagaaaaaaaaagcaatgcctcaaaatgcgagctctatattttatatatatcattatgtaaatatcagactttctgagtatatttcttactatttttaggtggtatattttatattgaaatgataaagtgaattaataaattatttcttgtccacaatctggtgtgcgtactacactgggcagtctgtattcagtttttattgcgtaaaaataatttcatgtaaatcaaaaataaaatagttttgcatcacacattcatttta

SEQ ID NO: 18360 - DNA, 1637 bp, Heterodera glycines
tgtataaaatgtgattttttttttgtttcctttattttgacttatttgttcgaatccgggttcggggttctaattgggtcaaaacaggtgccagaatcggttttcccaaccccgaaaacccctaaaacaaatttattcatgaaaaaaaaatttgtgaaaatctgcccacagataaccgacaagtacccgaaattcttttgaaattttgcaagctaatttataagagctatcgaatgatactaagaatgtttaatttggatgtttctagaaaaagttatggtgaattagttgtaaaataattttatggtcgtgttgtgactgaaagaacatttggccttcacaacagagataaattagtgaaataccgaaaatgaaaatagctttcagtttctgaataattttggtcacttcattctcatttaatttgcaattcttttaatcgttttctttatagggattaacacaattaccaaccaataaattaccaaattcggtttattatttgcatttggcgttgcgccggacactttcgatttgtcggtggaattggcattgaaatgtgagaagtccaccggataaagattggtgattgtcttgagaaaagaatttgtttgtagagaatcagaataatgaaatattcataataattgatcattgatcaatccctttctgggaaatttctaactcaaaaaaagtattcccatttctgtcagaatttgacatataatcaaaatgcgttttctcaaatgtccctttaaaatgtgctttcatttataatttaaaacttccttaaaacattgtcaaaagaagaaagtgttggtaaattcgttgccgagatatctgcggattcgcaatggctaatttggccggactcgcagtcgaagggcgaccgtgccgcactgtcgtcccaatccatcggtggcaaaagggcgagtggacggacggcggcggagggaatttccaattcattggccaaacagcgccttaaaagcaaacgctgagcagtagtaaattccccattcattcacttgctctttctcttttttatcggtcgtcgaatggcttctcgggatttttcccaagacggcgattgttcaatcgaattgaaagccgattctgaatactttgaagccatgaagaaaagggtttaaaccgagtgctaaaatacataagtatgtatacacttttataaaaacaagcaaaagtcttcatttagtcccttgtccatttttaggatggaagaggaaaattcaaatttaaaaattgaggttattgtcattttgttataaacaaataaaaatcgggccaggacgttttcgcgtgttgtttcactcttttttctaacgaatatttattttataattaagtgagtttataaactaaattaaagttgtttcgggtgaatgtagtgacgccccgtgaaaaaatgggtcaaattatataccaatcgattcgtctcgaggagctaagcacggaaaaatatgtctcgagttgaggaaatgccaaaaaccggtttttgaaccggtttaaaactcgaaaatttgagtgaaaaggggggttcctgaccttttaaaacgctcaaattcggacaaatttggtatcattcgaaagctcttgatgagctaagtctaaaaaac

SEQ ID NO: 18361 - DNA, 2821 bp, Heterodera glycines
gtcccttctccaattgcgcgcactttctgctcaattcttccacttttgaactgagtgaattgtcaactaattctgtaaaagtgttcagctcattaactaattgattactaattatgttggatttataattatcaattaattaattttattgcctttggcatttggcgtcgcttcggtgccctccgttatcatttttcgtcgtgccaattccgctgcaatttttgcgtcaattgcttttcgctgggcctccaatcgttccaattcatttccatcgtcggacattgcaaaagaaggccaaatgtggtctaaaaaggggacagaggtttttgtggcgtattttatcacacgaataattcattatttgttagcgaaattcattaaaaattcaaaaatttttatccggcggcgcctaaaaatccttacttttcttaaaaatacgttcaaacattgcaaaatttgctaaatgatttgatttgaatggttttgaatagagctcggcattttgtaaaaaaatttggacttgaatttccataatgatctttcgaccaatttcgtactccggacttgaattcgaacaaaagtcgaaaactcatttttcatcaaaattcacattttgcacaaaaactaatcaaatatactgtatggaatagaaaatagtgattcataacgattccattaataaggttgatttttgtgaaaaattaatttcgacttttgttcgaattcaggtccgggattcgaaattagtcgaaatggatgtcagatttgtgatcagcgaccctgaaaacccttagaaacatgttttcaggggcttttaaaacaaaaaattttctccaaaggtgggggggggggcatcggcagtattaccgacgaaaatggccttgacccggatcctcgaataatccaggcctgaatcccggtccaagtcgagaaatatcattgccaacttttataggcattctttgagtgtgatgcctttttccgttactttggtctgaagtgatgtcgccgagtgatgtgtttgatgtgcttgtgctcattgtttgtgtttttgaggcaataaaataataaatcattgacgtaaaaaacaaaacgccaatgcattcaaatgaaaaataaagtgtatttatgttgggacccacccgtttgggcgcgcgcgtttgggcgcgcgcgtttgggcgccagcatgtttttccacgaaagcttttttctttggcatccaaatccaacaatcttggtatcattcgaaagctcttaacatgctctattagccttaccaaatcgaaaggattttcaagcctagaaaaaattttattaagaaaaaacttcaaaattttcgactttttcgcaattttcagtgtataactttttctgtattgtctagtctttgaatttcggcctccgggacccaaatccccctatattatcgggatcatggtctccgtcccttttttagccgggatcacggggaaccgtcgggatcccgaccttgtgcgggttctagttcattatcaggaaaaagggggaaaagatgctttgcattgcgcttgccagagaagcgcaaagtgagagagagactgtataagtgagagacgaaagaataggcgagagatcgcatagacagacactgaagggaaagcggatggaagcagagacatcctccatggattaaaagcgaacgaccactttttcttctctttctgataatgctgggataaactcagcatattccaaattacctgcagcagtggctttcttttcataactttgaatcaattagctaattaattactcttattccaagacccaaattgcgccatacaatggcccctaattgcctgccgcccgaacttttgttcgaaattgtgcctttcatctctcccaaatgcgctattccaaatgtgttctcgtcctgccgactgcttcacatccttttacattctcgtgttgtcaaatggaaagagtggatggaaaaggtatgcttttcaaaaatgcgggcccaagttttagcggacgacgcccaactcgtaatgctacgacgactcgaaaaaaaattgccacgaaatggttaattatgatcattttttggagagttgggcagttcgtacaataaaaaaatattaattaaataagcctaagcttaggcctaggaccaagcaagcctaaacttggcccaagcctaggctaagcttaagcctaatgcttaaggcttagtctaagccctggtacgaactgccaattgtacgaactgcattcaaaaaaggaaaagtacaagtttgttcggggcagtacgagattggtttgaccgttataactttgttagagtcggaaagtattatattttttaaatacataaaaatttacattttttaaaattttatgtggttctaagcgggattcgctctgactttaaatggtatttgggaattgctaatgcatccacaaaatttatttacattttaaattaataaccatatgattggcaaattccgacaaaacttaccaccccagaatttggtcgagttcttgtcccacgacatcgttcaacgcagtaattgcagcagttaaatgctgaattggcacaaatgcgagcgcggtgatcatatgagacgtttctgcgaaagcggggtcacttcgatagcgctaaacgggagattatttcttctttttgagaactgaaacttacattttgaagtccttcggaaatcaggcgcttgtctgaaattcgcatcgccagaatttcatgctgatgtctacattagatttgtcgaaaatgtacaggaaaccctcgttcatcatcttttccttttgtctaatagtt

SEQ ID NO: 18362 - DNA, 2757 bp, Heterodera glycines
tatatggtataaggcaaaaattgaaaaaccccgaccccgaacgattagtcaaccccgaccccgaaccccgacgcttccaaccccgaaccccgaatttcccaaccccgacgtcagggttgcaaccctaattaaaacggacgaataaattggttttgtgtgtcctgatttttcacgtttgtcctgtgaatatgaattttttttttataattactttttgttattgtaaattaatgtagaagtaatttcatggataatttccctggtttttataatcaatcgaaagcagaaaattctcattatattcatttcataaataatttattgctaaaaaatttttcctaatttcatttgtataattattaatatctattgccaattggaaaaatgaaattatgtattttattatttttacttttgatcaatttaattgatcaaattggatcagaaaagaaaaagttgaaacaaaagtcatttgatgaaatatttggagaaaaatgggaagaaaatgaacaaaaactgaaaaatgaatagaagaaacggtaaataataagaaaatattttcaaataaaagataaaattaaacaaaaagaaagaaaatattcaacaaatgaatggaaaaaattaatacgaaaattgcaaaaagtttgggcacaaatcaaacatatattcaaaaattgatcagagaatttggtctccaaaaaattaaaagtcataaatcaaacgtgatgaacaaaaaaatgacattctgaaaaaattcatttcattgaccaaaaaatttaaacaaaaaggaaaatattcaaaaaaacaatggcgccaaaattatgccgaaattttttaagaaatcggagtaagttatgcattaattaaaagatggaaaaacaatttggcattagccataaaattttatttgaattaatttattgtatattttttgttttaaatagcgaaagattttaggaaatgacatctcattcttcttggatttattgatgattttttgttatgaccaaaaaaaattcatattttttaattaacgactccgtccctttatgaaagtcaaattttcaataaatttattcaacaattttcttgatgcaacttcaacaaatcgacttgttgctccttctcacgcatttagccggccggccttctcaaacaaatggagtgccaaagttaacgccttcagactcaattttgctttcgtccgtcccacgacgccatttgaacagtccctcctctccccaactaaataggcattttttggtgaacacaaactgctaaatccatcatggcaattactcggttccccatgagttgacgccaagccaatatttgacaatctcaccgtcctctcgcgtttcatggccccatccaatcaatttgaatgcgtggcttttaaagaaaatgcgctaatcaagttgaaaatatcaataaaatattttgagaaaatcgtaaagaatcctctcaatacttacgtcataaatgggaccattgacgagggtgtcctaagtaaaatttatcaaggaattacagtgtttttgccttaccacgtaaatattgatccgtccattgcttttgccatagtagagcaaagccctattggctgtaacaccaacttggattggtccgttctcgtaaatctccatcatcatgtccgcttcgcggtttttttctaatccattccagcgcgacggctgacttgacagatctatcattttaatttatttaaaatattcaaccgcctttcccagccatagctgattgggatgtccaggggtattggattaacttttgacactcactgaaaattcggccctccctgtaaccgaatggcgattgaccgtcacattcttttttgcagaataacgattcgtcaggttcgctgctgttgatcaaatagggcttgcaacccaaacccgttgtgaaattcgtgccgctgactgcgccttttgtataataccattgccatatatttgttgcagatgcaccatcggcacagcttgtgataaaacaattgtaaatataaattagcattgttttgaattatgcgccctctttgtcgctactttaaaaagtaataaattttttaattacgctttattaatgttaacttttgctactttgaagtacttgcaattttgcgattccaacgtgtcttgggcagatacgtacgaagatgggtaattggaataggtgcgtatgccttttttgaggcgttcaatgcaaaaacggtcggtgagtaccgatgcagcggaaacggacgcgcatgaattacaagcacctttaaatggtagactaatgtctgaatattttaacccaaaattttgataactctgtgaagcatccgatttttttttgtattcttatggcgatattttttttttaaatgatgaaatttctgaaactaggaagccttattgagaagccttgggctatcgatgtttaccaatctttatcgaagttggttgactatgaaaaacaagcttattgtaaacattttttaggttgaagtcttaaaattagacaattaaataaagcccaaacaaaacttttcgcggaaatttattattttttctgcgttcaccaagaatttatataaaaatatgatagaaatttttgtcaatttatatagtcaatagatttcttttccttaccttggtcagttaccattccgatgaaatccgcacattccggccactttttgcgcgcgtcaaattcttttggcaatttgaccccattaggaatgggacgctaaaa

SEQ ID NO: 18363 - DNA, 3366 bp, Heterodera glycines
agtggcggatttataatacgcgtcgacccaattttgatcgctccttataaaatgcgtcagaacgtaaaagcggaatactcaagttggtgataaatgtgagataaagaaaataataatgcaataaatgtcctttgttcgcccgataaggctctttttctcaaaattcccacttttaccccctcttatcaaaaaattcattgatttaaaattgaaaaaaacaatttaaaaaagctgacgcagttatgtaaaatggatatttatttattattcaaatgaaaaattgcaaaaacaaaaattacaatctattattctacaactgcaaccactgggacaagaatggaaccgataaagttaaagtaaaattaaagataaagaaaaatatttctaaaaattggctacaaaaataaaacaaattagtaattcaatgattagaaaaaaaatttaatattcaataaagcttaaaactgttggaaatcatgaaagaggaaaataaaaaaaataaaaaagtaaatatcataaacaatatgaacaagtcattgaaaagataaaatataaaatgactttaaaaaactttaatttcatataaaagtaagttgtactaaaattaaattatctcctaacgatttcctttgatcaagaccatttctaccatcaagaattattattatgataattgaatttgtcaatgggtgcaatttataaattaaaatgaccaaaacaccaaaactaaaattaatttgtagatttagacaacaaaaattttgtaaaaaattattacgcaaaaacaaaatttttttaatatggatgggcgtatagacgaacaaaattcttagatgtgacaaggagcttctattggattaaacaattgtcttgaaaaaaataccgaagtgcattaaataattattttaaattatagaattacaaatttttatatagtaactaaataactattggattacgtaataaaatcccatgaaaagatatataatactacaaaaccaaaaagtataaaagaaggataaaactatttttaaatcatcttcttgtctgcgctcatcttgcatattctcttcgtccacagggctatttgtcactttgttgtccagcgattccgctaaaaggaggtttccgagtacattgattgcggttttggccttcttcaaacgcgcgccgtcctgcatggagtaggccattagtccggtttccactaatgctttgcgtttcaggtccttatcggtttgcgtttcttgttttgataaggtggtagtagtagtagtgatgcacgtgtcagagggcaggtcactgtagggaacagtgaacactagggccttccaatcgaattatccaggcataaaaattataattaattgataataaaattttaataatccatttgaaaatctattgataataaatgaaattataaataataaatttcattaaaacgaattcggcgcaggcaatgccgtaaactagaaattctaaataagtaaacttacttcaatacataaccgggtggcaattaatgaaacggaattcatttaaataaagtgattatttcacaaatcatacataaattatttattgaacaaaaaaaacagatttaaaaataaaatgacgacgactattaaaaatgaagggagttgattgaacatttatttatttgacaaattaattcttctcacacacaaaacttataagtaagtttttttaaactgtaatttttcaaaaattttttcttaagtcgcgtatttcgtctataactgaaaatattatataattttatatgtatatacaattttacattactaaattgtgtaaatatatatatatatatatatataataaaaaagtccaataaaaaagtccgtgaaaataaattaaatccagacattatatatgaatgcacataacatttcgaataaatgaattttttcaaaattttttaaataaaaatatggtttaaatgtttatcttgaaattgctaggtttataagcagaaaacctaataatattcattgtttcaattttgttattttcatcataatatatttaattagcctatgagagtggctaattagacatcgcatttacagctgaaaggaattttttatttataccaaaattcttacataatggtttaccatcaatatctaaaattaaaaaaaacctatctttctttgaaatatatttgatttttaccaaaatatttctttataatttttcaccacttttattcactaatttctcttcagatatttaattcattttttagttgaatgacataaagaaaaagaaatctgcaatttatattatgtttattttagtcagaaaatctttttcttgactcttgatcgagaagcctgctttctttttttaaatttttcctttgaactacatgcgaaactttgcatgtttacttttttatttgtttcaaaacttttatttaaataattagtaaaaagctaaacggtccttttttctctttaaaaaaggtgtatttatatttttctgcatattaattggtgacgatttttaacatttttgacacaaatattttaattaatttatgttttaaattttcattttaaatttaaatatcgcttaatgttcgttctattaacttaattttatttttattttcaatgtttcattgcttgcattcattctttactgattaaatgattgccggaaagaaaaattattaaagagataacacgtaaattttcaaaatattttaatcagtttctgatttggtaatttgtaggcatttttaagctgggtacatttatttatttcatttggctttgaattcttccctccgatttcatgtcctcttttacaatgagttttagtatggcaaattgaaaatgtaccttctttactatattagatctacaaaattacaattattttccaacaagtaaaaaaaggtaataagaaaaaaaattcaaaatttcaaatttttttaaaatttattttttcgtaattgtctaatcaccaggcaatatcttagaaaaagcttctaaaaatgctaacaagggaacctcgtgaactgtaagtcgaaagtgggtataaatttggtaccattggatagaattcatttaaatattaatttccttcctttatattctttgtaataattgatccagtccacgggtgttggggaaggaattcaaattcttctactccccttttaattttcttttgtattcgtgtagcatatcgctcactcttacagatcaggggccttatacccgttttggcagttaaaataggtaaaccacggttaagaatttaaatcaattctcgtcttcatgtttttagcacatggttaggcttaacaacggtacctcgcttaaaggg

SEQ ID NO: 18364 - DNA, 2032 bp, Heterodera glycines
aaaattttattttagccatttgtaagtaccgtacttcctttcttgcctttttttaaaacttttctattaacgagggttgaggtacgattttaactttattgttgaaattgcctttttcgacgaccaattttctgagctgttccaccctatcgggcgccatttcctccacccatcgcgtcaaaaagcccgtctcggcgtaggaaaagcgccgacgctggtccttttgcagttcgtccaccaccgtattcaaaatgtaccgtactccggcattgctaattttgccatttgctgttgaagggacaaaaatgacgttttataaatttaaatgatttagtggggtttcaaaaatatgaagccttatttattcgcaacagtttgtggttttttgagaggccaatgacgaatattttcaaaataaggatatagactttaactatttttttagactttttgtagtttttgggaaagttttcaaaaattgttttattttatcgttaccaaactgaattaaaatccaaaatccctatgcgccgactattggtccggcgggccctcccccccccccccccaaaaaaaccccgttctttaattgactcaaatggatttttttataatgatgcttttaaaatttcatgtctctagtgtagtgttattttttaatacctccggtgtaataatcatcaactgttttcttccagcccatgtcattgtgccttaaatattaaaaattcaaaaatgtataaaataaaacccaaaggagacttttaaaaaaatctttacccactgagcaattccaatttttatgtcattccaatttttgtataattattagtcattttatttttagccataaaagctttattatatattttcattttttaatgtttacgtgtggcaaatcaaatggacattgatggaattgttatcggtcaaccattggggacaattctaaaatttatatttaaaatataaaaaaaataaattaaacaaattatcaaatgcaaaaaaaaacgaacattccaagcacagaattgctccgccccaccattggtgcgtgaattgtcgtcctttctcggcacaaaaatcaacacaatcacagcaactccgataaacagcagaaaaagcaaagtgccaatgccaaaagccaacaattttttgttccgggattccatttcctgggacaatttgtattttttcttctgtgagaatttcatcagaaaatgggaaaatattaaaaataaacggctcttaaatattgcgagtcgggcaaacttttttcggtgtaaccaaagggagcaaattaaattattaaaggaactaattaattatcatcctgagcaattaagcaatctaattgatcaatagtgccaaatcggtttttttgatggggaaccaaaatctcccagtttaaaagtatccgattcacaaaatccgagcaatttcaaaaggcaacttcaacacaataaaaacgagaatgctttagcatcagttgtgaaatgctctttaattgcgtaaatttgcgatggtttgaccccaaaagcgccaaaactgttacccaaataataaaaaataaataaataaaaattttttgtttggccataaaatttttatttcgacacatccaataaatgtgaaaatgtttgtgcttttcctccaccattccctcccttaacatttattttattgccgtgtttcttttgatgtcgcgggaaatgggcgacaaaagcgaacggacttttattacaatttttcgatattttcgcttggattatggccatttgtcagtttgtcggcaggtggtggttaacttgtgaacaccgcggctcttatcagacagagtttgggcaattatcattgttatcagtgaagtgtctcaccttctctctctttgttcctatctcttctctctctctctctcactcctctccatctttttctctctcgctcgctcactatctcatcaatattatattatcatcgctttggcttaggttttgggccgaatggaaattggcgggcgcggaaaacaaaa

SEQ ID NO: 18365 - DNA, 2049 bp, Heterodera glycines
aataacaaaacaaagaaatgaatttaggccataaaataaacataaattttaacgacggagagtcacaaagagaaaaacacacacaaataagaaaacaaaaataattaaattatttgcatatttcgcagagaataattaatgaatgagtcgttgctttttttgttggatttgcgctataaatttgggtatcacaaaacgaacagtgagagaaagagagggagaaaagtgaaaaagtgccacggaatcagtcaattatttcattgaaacgaaacgaaagataagtaagtgtttggccatcagtgatttggcattggcactaaatttggcggtatgacagaaactgaaagttcattaggcaattcatcatcttttattgtttgtcgtcaatcgaacactgctcccgtcatcatcgccataatggtgccatcggttgaagtccacgttgaacaccttcaagcacaaatgatgattggttattaagcgagatcaaagaatgccgcccctcattaggccccccccttaattaccacaattgccccggagtccaagccgccgaatatgagccgctggtttgtgctgagtgccaacgaacggataggactgtcgcattgctgaaatgaaaaaaatgaacaaattttcactaaagttggcatttgtgacacacgccaccacaatgttagctaatactcacggcaaaagtgtagagcaattgcaacgtgaaaagccgaaggatggaaatgcggccattgtcagtgccgaaaacaacgaattctccgtcacgggacaaaatggcacagagaatcttctcggcacatttgtacccgcgctgtttcagcagctgaccattggtcgaaaaggtggcgagggaatcgttgccaatgaaagcctttgagggggcattcaaacaattttaattaaaatgaattttgccaaagaaattaatgggttggcattttgtaggtggatagggcgtggcacttcgccagaaatgtaaatcaacccccatttaaataattaccgcaatgtaacagtctctgctgaacagaatgttgttgattggtgccaatgtgtccgttccgttgccgtttgagcagatgatgctgcgcagcaggtccccctgcgtggaatgcatcagaagggcaccatccgtggagccggagaggacaatgccatgctcagccgaaacgcaaattgctaaagcacaaaaaaaccaaattaattaagtgcctttaaatttaaacgattatgcacccggggccaagccgcagcaaaactgtttgcatttctcacccacccaccactgatttccgagtcgtgtccagtcaaaatggcacgaggcgacggctcttccccaggcatattgtaatccccgacgagtaggcccaagtgttggctgaagtgccaaagcaccacggtacaatcggcactgcccgaagcgacgtaacagtcggcgaagagactaaacggggcggaacgatgttgggagggggtttaagaaaatgagtggtggccggccactctcgatgaaagtctcgaattttgaatccaataatgggtctatctttagcaaatgctgtctcaatccctccccaatgagcgcacctcgtctcggaacgtgccaaacatgtgaccacgttgccatgaccgaacacaacttgccggacttgtgctgaaaaggcgtcgatacaatttgattattgctatattatgcccaatgtccgtcctcaccattgcccgtctcaatcagtcggaaactgtagtcaggataaccgcacacgatgatgaagcggctgtcaacagtgcaaatgaaattgctccatgacactgtcagccgttggtccaattggtcgccaaggtgtcgtttcggcactttctgtgacggattgccaaccgcgagcagcgggtcgacagtgatcggcaattcggaggtggaaatttgtgacgttgctgttgatgaagcagacgaatccgctgcggccgatttgtccgtcgctgaggcggcggcagcgttcaaaacgttggtgccggacgactgagtctgggcctgca

SEQ ID NO: 18366 - DNA, 1789 bp, Heterodera glycines
catatttctgggggttttccggaataaatccatatatatccttaaataaggtcttattgaaattttaaaaatatatcacaaaaaaattcgaaaatcaattttgtatatttacacaacttttggcattttttcacccattttaatcctttttttcaattcatatttgaccatttctcggatttatagttcatacaatggatagccctatttatcaggaaatatttgatgaaatttcagttgaaaaatccaggtccaggcctggatccaggtctcgaggagcctggattttttctggacctggatttttgcccaggaaatccaggtccaagtccaacatggaatcccggaccaggccctgcttttttcaaaatgtcgagtctaataaaaaccaattttttttaatattctcattaataattttatttgaaaggaattaaaagtgcttctgcccactgattgatgaataatcaaaacattcattcattccgacgagtaacggataaaccatccgacgaccaccaccaacgccagcccatttttacataaaccaaattaacaattttattcatcattttcatttttgcacataagcgttatcattttcataaaataataaatgaatttaattaaataattaataataataaatatataagtgcttgacaaatacatattatcccccgaatgggtcggtgtcttcaaccccacggctttccgtttccgtgtcagtttcccttcaaaacagtgcttttcttcttttttccgccggcattggcatccctcctagcttcttttgaacaattttaattccttttataaattaagttaaaaatgcgagtaattattcatctcacttttcttctgttcgcattgtccgttgttctgttggcggatgatttccctgaggctacaaattccgggccgtaagcatttttagcgtaaaaaagttattaaaattttaaattgcatcaaatttgaggctttatctatgcgaagagcgttcgcgggaagcgcatttcgagaccgaatacgtggcattggaccaatgcacgcgctggggcacggcgcagttgcggcacaattcgttcgcccttcgatttcaactgaccgggaaatgtgaaaatgggtcagcattaaaatctgggctccaagatctgaggattatcctcattttgtggttttttgataggtcaatgagggtttttttgaaatgaggatttttgtggctttttgagaaattttgaggcttttggagaaaagcgtaagaatctattaaattttatatttacttttaataaattggcataatgtttgacaatcatttaataatttgggtttttaatatatcttctaatattttgaaaaagtctgcatctgtattttttttactacataggttcaatatcagcaaaacgaaaatttagaattaaatgtgccacaaaacacaaaatgcttattgctaaaaaactgctcaaattgatcatggacaatcaaaaatataacatttgaacaatttaagagtgttttgaatgaattttgtaaaaatgcggctttttgacctaaaatgaggcttttgaaaattttaatctgggagccctgattaaaatgcttaacgattgaaaaatcccgggtcatatttcagcattttaatttgttatctcgggagtttggacccgagcggatcaaattgggcttatggcatgagtcctgaaattcaattccaagtgccgaaccaccaggaagtaagtaaacgctaatcaaatgccgggtacgaatatcgataatgtga

SEQ ID NO: 18367 - DNA, 1030 bp, Heterodera glycines
  misc_feature (106)..(106): n is a, c, g, or t
  misc_feature (110)..(110): n is a, c, g, or t
atgttcgacaatcatttaatattgggtttttaatatatctctaatatttgaaaaagtctgcatctgtattttttttactacataggttcaatatcagcaaaacganaatntagaattaaatgtgccacaaatcacaaaatgcttattgctaaaaaactgctcaaattgatcatggacaatcaaaaatataacatttgaacattttaagcgtgttttgaatgaattttgtaaaaatgcggctttttgaccaaaaatgaggcttttgaaaattttaatctgggagccctgattaaaatgcttaacgattgaaaaatcccgggtcatacatatttcagcattttaatttgttacctcgggagtttggacccgagcggagcaaattgggcttatggcatgagtcctgaaattcaattccaagtgccgaaccaccaggaagtaagtaatcactaatcaaatgccgggtacgaatatcgataatgtgaaaaattaattaaaattttaataaaataattatttactttcctttctcccactataattgaaaaattttgtttcattatcattttttaattttaatgatggttttctgtggtctttgtttggtggcggaaattcccaaggatcataaaatccgttttatggccgagtaaattggcacgaaaattgggagaaaaagtgggtggatttattataaacccacaaatggaaaagcagtaaattatgaaatgatttatcaactcatttgcaaatatttagagcaaagtggctgaagagtgtttggaatatcagaaaaaattcgacaaaaagataaaccaaatcgcaagtcattggcacggcgtccgcgtgagcgcgccgaaagcatttggcggcataatgatcgaattgtcaattgcaaaagaaaagtggaaattaaaaatggagttggaatgggacggagtcgctatttaaaaaccatcaatatgaaaatttttcatgaaaaaatatttataattttgctaaaaccaaccagattttaattcttgatgttatt

SEQ ID NO: 18368 - DNA, 749 bp, Heterodera glycines
tttgagtttcagattctagcaattggagtcaggatattgtgttagcttatggtcaaccgccagatgatatcgaacaatcatacggtaaaaaagattcttgatttgaaaatattaatatttaaaacattgattaataaataatgataattttttatatttaaatgtttcattaaatatgaagataagaagaaattaattagaataaaaaacttgcttaacatttaaatattttttcttcttttttttttagtttatattttaatttttagtattaaaaatgagaaaaaaagtttagtaaaatttgttgattaatgtttagatcataattggtacatgcatcctaagcaagcagttgaatcatcaaaaagttattttttttgttttttttgtgttttttgaactttaaaattaatttatttttaagagaaaaaatctaagacaaaatcggagagcaaacattcagtagtgaaaattacgaaaggcgataaagcaaatgcttgttacgtttgtggggattttttcaagaaagagcgcaaagaaacgttatttaaacttggaggaaaaccagttaccgtatttgctcttttgatccccccccccctaaagaaattttgtctcgccccccggggctatcatgtctctgctgctgctgatgagagggcaccactccccccgccgctcaatcaatttgcggaaaagcacactatccctgctacatcgccgcagggtctatcttcaatcgctcgtcc

SEQ ID NO: 18369 - DNA, 1796 bp, Heterodera glycines
cccctctttaatctctctttctttctctgactctctgtcaattctctctgaattcttagtagcgaatcgactcaaagcgacgcgcacccatcgtaccattcattggcttggcattattaccttcacagcacaccatttggcattgctccattccatctgccgatgagacctccacacccctttttatcgacttcttttcctatttacttctcataccaatttttctcaaattgttttatttttctgaacaaaaagtttttttctttttttgaatttattttcttatgcattttatttccttgcaaaaactaaaaaatttaaccatctgaaaaaaaattatgaacgaaaaaacatacgcttaaaaacacttttgcatatagtgccttttttgtatgtaaagcagtattttggcatttttctaatttatacgtcacctaattatctgtaatttttggacccaatgaaaataattagaatgtgtagaagttcaataattttgcaaacttagaacaatattactaggagatatttatatcgttctaagcagttcctcagtagaaaaaactgaaaaatcaaaaataagataaaataaataaacatcgaaaaagaatgatggtccatggtgaacgtatttttattggttcatttaaaatcaaataaaaaataaacaaaattaaactctttattaaaaattttattaaaaatgatagtctttaatatttttttgttaaaataaatgtgactaatgttaaaattggcaatttccttatttattaaaatgaaaaaataattttttttattattttagaaaattattaaaaaatttctctgcctttttggatatgaattgaaattaataaaaatattaaaacataataactttttataaaatgaataaaatggtctactttggattaaacatttacaacaaaaaaggtatatcgttgaaagaacagatttaaatcttatcgaaagtttaattccttttaataattacgcagtcatccaatagacgaattttttatttgacaaaataaaaatatgtaaaaataaaaaataaatttaaatttaaaatgactaatccgaatgataatttataaatagtcattcctcccaaaatgaataagtcaacaaacattaaatgaggatgaaaaataaatattaatataaaaaattggagcatccataatatttataatacaacagtaaaactaaattttaggcgtactttttcaaaaataatttggaacaagaaaggagggacccatccatgcctataggctctgacggaaaaatttaacaaaaaaagttggctgtagtaaaaaaaatgtccctggattttaaaatctcaaaaaattataaaacaaaaaagaaatcgcaagtagaaaaataaattaaaataatatttatgcatttatcagttattatgttacttgaaactataattttataaacataaaaaaatgaaattaagaaagatttttatttaaatgattattatttaaaaaatataaattttattttttcgaaactgaaatgatgaatgtaatatgaaatttaataagcaaaaatatattataaagaaaggcttattccatattttgtaattgataattaaatatttataaagcaagtcataagactgaaataatatcatatgccaagtcgaaatcgttaacaggtcctattatgaaaattagctaaactttaaaaactctcacgtggatgaaaaaccgattagaatcaattttttattaaagatactaaaagtcttgaaaagtggtactttaaagaat

SEQ ID NO: 18370 - DNA, 3572 bp, Heterodera glycines
  misc_feature (1097)..(1097): n is a, c, g, or t
tttagcacattcttttattacatatttaagattttagccccttttaattccagctcttacatcctacatattacccatggatggtaaaaaaaccgtcaaaactcattttatttttttgtcgttttgttattttccttttttctcaattttatgttagttctttgtttaactataaaaagaacaagaactttgaaaaagcaggtatcgcttcttcctcttccaaactaagcaatatcggtatcattcgaaagctttgagagcgtgactgtacaattggacagttgacaatccgacagtggaatcctacagtggtggacaatcggacaatggacaacccgacaataaattacactcaaagatatgaaaatgccgtcccgaaggcgatcgattgtgccgatctcaagaaaataggcaataaattatgagtttttggaataaccctaaaaatcaaacgaaagaaaaattgagagaaatacattataaaaactttgtttgaattaaaatataaatttaaacctcaaataaaaaaatattaaaattaatccatataaaaggtttttgaggttacgcacctacttcctcccctttatacacttttgcttgtgttttatcggccttctaacaatgccttttttacattgctgccgtggcggccttgtggaattatgaatactcagtcacaacagtttgattttttgatgaaattttgtaatattggccaaatttaattgcttttccattacggaatataaaagaaatcttcattttctgctgtttcccaaccttcacaataaacaaacacaaaagaagacaaacattggaagctcttggccagcagctgctaattatttcttaaccacaaacgagtcaacaaaaatcacgaatcgatgtcgcaaagttgaaattacatttcagcgtcttaaagcgacgaaaagcaaagacaataattttagtaagaattggcccactaatacgaattgtatatcaaaattaaaaaatttcttctatacataccgtatattctctaatttatccccaatctaatccttttatcttaatcccccagtctccaattatcccgccccttttgaggaggntgaaaaaataatcccaatcccaatggggggataaaagagcatatatttttctgttatttttattttagaattttacttatgaatgaaaaattatattattttaaaaaatttcgaattttttctactagtctgctaaatttcaaaaaaattggctaagtttcaaaaaagttatggccaaaatgttaggaaacctacctgtttcctggcgcacttttggccataaatttgttcaaacttgatgaaatttttttgaattttgcaggccaatagagaactgatagggctatcgaatgatgttaagattaaatttttaattaggcttgagcaaagttatggttagttttttgttgaaaatttccatttgatggtttcttttttataacgccctttttggatgacttttttataacgatatattagagtgccacgggaccgggaattttgggcaaaaccgggaccgggactttccgggacctgagaagccggtcccggtcccgtggcactctacgatatttcgccactaggatctcctggtacttatatggttcgtacgtaaagtcgaaatccctaaaaagtcgagaattcaaacgtgcggcagtgaaattattcaatttgtccatgatttaagtaagaataagtgcttaggaaaattatatatgtcagttgcggtattatatgaattcgaaaattgattccccattattgttgtttctttgcatttggttatattgttgaaaaattttgaattttcgacttattggggatttcaattttaggtcgaatcctttccggggttcgaaattggtctaaatagatgtcataatcgtgttcagcacccctgaaaaccatataagtgactttctaagtaaaaaaaataataatttgtggcgtacgaaccatataagtaccgatctccttccctcagcagtttgggggtataattacaatttactatgacaatttggaaagttacatttttttttttgcaatttacgcaaaattaataatttttataaaataattctcaaattgttaacaaaaaattattatttttggttaatttttcatgacttttctgcactttttcgttactttttgagctttttatgactttttcgtccaaaatttaaaaaaattagtagattcaatttgaatgggtagcgggagagatatgagcgctgagattaaaaatcaaataatttttgaagttttaactaaatgccaaaattttgccgattctttagttataaataaatggctgattcttctgctcctgttgataaagaggagccttgggtcaggcgctttccaccatacaggtgttcgatagaggttgaagagctcaatgaattctatgttcttcatcaacaagtcgtgcccaatcgtgttgtgccatgctgcgtggattgtgtcgaaattacggtaaaattcactcattaaaataaaaaaagacaaataatttttaaatttgtttgatagacatttataacaattttttaaaggacatattcgaataattttgaaaaaaatcaccttaaaataactaaaaacaaaactctcatttatgggattttaaattagattcgatcaaattcatttcattcataggaaattgctgcaattgcggttgagaaaataaacagcgatcggatcagtgaaggaatgaagcctttgaatcttgtcaggatcatccatgcaaccacacaatacgtttcgggcagaagcttttgtcttcaaatactttttaaacagacaaaggtaaatggtgagtgattgaaaatttttataattttcaacaattatttggcttctgaaaattgaagatttaaaaaagatttaagttttacgtaaaaaatatttttatctctaccaaagattttcgggaagaaatcattttcgactaattaactctttttgtttggtctcatttttgactcaacttttgggtttaggttttaacaatcaaagtgtggcctaaataattaatgccttagcataaaaaagccacttttgtacagcattttaattggtgttattcatttaagaattaaaaactaattttcggttcggtcctatttcgctactcaaatgaaatttttctcggtgttgaaaaaaactatttttgaaccaattctcggctacttggaaaattctttttatatttttcgttttctcatgcgtccaatgaagttagcattttcttagaaaaatgttcttctcattgagagcttccgaatgataccaatatttgaaatttgttgctaaaacccacagaattgtaccgtggaaatcactcattttttcgatttctggaaaaaaactaaatattcataaggtccttcagacctgtacctgtatctgtattcccgaatgacctgtaactgtatttcctgtacaaaaacaaaggactgaaaatacaggctctttaacccagtttttgatcaggttcaaagtgcgcaaaaatgaccagaatag

SEQ ID NO: 18371 - DNA, 1040 bp, Heterodera glycines
tgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagcaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcggggggggggcgggggggggttttttttttttcccttttttttttgttttttttttttaaaaa

SEQ ID NO: 18372 - DNA, 1849 bp, Heterodera glycines
tctagagtctagtctatggctattatttacggataactttgagctgatattttctgctctgtcttctgtcgcttaattatcaatattaatggaacgtcagagacttagaaattttttgtcttgagggttcaagtcacggaccccgacttaggagagataatcttattattcgctaggatgctctgcaaaaatatttgtgtatattgtcattggaaacattttagacgatatcttcgggatcggtgatttttgaagggtttgggcaaaaggaaagaaatacatagttttttaaagaaaaaatagggtcgattaaaggcattcgaaaattaaacccattaagctaattgggtaaataattttaatgctcgcgagtttcgatctcaatctcgactcgataaaagtctcctatcggcgtgccggacctcaaaaatctttttttaaacacttaaagccaattatgatttcaataattcactaaatttatcctaaaggcatacataaaatacaatttgtgatcaccgcaacaaaatgaacaattttataacgttaaatggactcaaattcattatccaattccatctttcatttttgtttgatcacttctcagcaattcattctgtcacttttggtgctgatcacttgggccaggagtttcgtcaagaagcctaaaaatcaaaaaattatatacctaaattgaatgttagaaaaaaaacatacactgatccgtcctctatttcgccatcatcaattcgaatgtcaatttgattccactggtaaaaacaatcccatccaatcgcttcctcctcccatttggcccatttgctttcgtctcgctcaattggacaacggatcagcagaacacggttgctaaagttaatccttttcaatgccaattgttcccgtgtcaattcgttggtcaaataaaatggcacaacggagtcatcgaaagaataaacgataacaataaaattgacgggagatgaagcattgaaaaatgcctaaaattaaaaaatacattaattaattagttaattaataatggtaagcaccgtttttaaggcttcaatactcggcgacaaaaccccatcacccatgtccataagcaacgagcatttgagcacctttggcacattgtccggacggggagtgaaaagccatttggccaccgcttgtctatccgatgccgtggcattgtcatcggccggaaattcagtgaagaaatcgtcgaagccatataatttgacaatgcgaagtgatggacattcattgagaagtgacggggtgaattgacgcaaacgatgaaaaattccgacgggcaattcaaagccatgaatgtttttttcgatcattggccaaatgttgcgcaaaatgaactccaaagtgcggcgactgttcgtgcgcatggccaaattaatttgacatttagcgaaaagtgggcgaaaatggcgaagaaaagcgatggcactgttgttgatatgtctgaaaatgaaataatggcagacagaaaacacaataaatcattcatttcaccttattaaaatgtcttcgaatccgacgactttctttggcaacggcttttgcggaatttgcatcgatttccaacggcaattggtaatttccattttcttttggccattttctccaattttgttgttaattcgaatatttccaaatgtccatttgcgcgtcttgaaatgttcgtcgacgtaaaagtcaaatccgtggctaatcatcgcaattccgaggccaagttgagaaggcgtaatcaaatcgaacacacaaagccaacaatcggcggagatgaagctgaaaaaagggaaaagcaaaatttaaaaatgaaatttcaaat

SEQ ID NO: 18373 - DNA, 2099 bp, Heterodera glycines
gaggaattttttaattgaagattaatcatttaattaatgttttcacgcatttcagttggatttgccacgatgtttggatggacattttgccattttttcgtcgtcgtaaactcggcctcaatttggcactgatttcgccacgtttcgatgctttggtcgacacgcatttcaatggccaatcagaattggcgatttggaaagttatcagcaggattcactaagacgctttcacagaggtgccgaaattacgtgtgttaatcgattatgacaatatttgggacaaaggcagcaatttgtatttgcatttgcatacatacaaaatcggaagcaatgcccagccaatttgggatgtttttgtccgtcaaatttggccaatttttacgacaataaatgcccattgtttggactttgaccatgctgataatttggacactttgcttcgtctcacatcgccgacaattctctccaatctgaacattaattcaatccagtcttatcgtggtctgttccccgacgcgcttggtgatgaatttgttgggccaaatgcaactccaactgctggacaagcgttgtccaaatggttacacacgccgagaactgatggccaaccgaagcgattgcattgcgttaatcctcctcgaaatcttgaatggatcaccaatttcaaagaggtggtggtgactaaattttcgttaaacggctactctactgctacagtttatgcgtccaaccaatccacccgatgacattgctcagtttcttaggccataactttttgttttcttggtcaatcaatacctacttaattaggtaattacgtacacataaaatacaatggaaatggacgaatttgcggaggaaacaaaagtcaaatacaaacaaacaattagccaatattgaaagggcaaagtgccaacatcatttcactcatataatcgcatcaatcaaccattaaattaattcattcatttcttctgctgatcactcgtccgggagaagcggcgtcgagaagaagactgaaaaaacgatgattccattacactttaagtcaattcaatttttatgaattcaatggcactttatgagtccaatcaactaagcatccgtgttatttttttttatcataattctgtccatttcaaaacaaaccgtacatttttggatacgaattgaaagcacaaagtctaagcaattggtgattggactcaaaaaatcatttaagcattttaaattttgttcacccgtcgtcgaatccgccatctctgatcacaatgtcaattgggttcgttcgagcattcactatttcccacgcatttctccaatttttctaatttcaggcaattggagaacggctgacaataagctaacttttgatgctgatcaaaaaagttcttttcaccactcatggtatcttgaacattccaaaatacactgaaaatcctacaaattgtcaatacttttgtttgccacccccttttttcgaaattttttgttttcataagtcatgaaaacatgtcaccatgggtttttggggggtcgctgagcacgaatccggcatccatttcgaccaattcaggaccccggacccaaattcgaaaaaagtcgaaaattcaaatgttttaattttccatttttagcctaaaaatggttcacaatgagactttttattgaagcacttatgatttttagatcttttccatgtgtttaaagtttaatgaaattcaaaaatttgaattttcgacttttggttcgaatttgtgtccggggttcgaaatggatgtcatatttgtgaccagcgacccaaaaaccatgtgagacatgttggttagcctagactaatacccgctgaggggtgtactatagtcaaccccccggaaaaaatggcacaaatgatataccaattgattcgtctcgaggatctaagcacggaaaaatatgtctcgagctgcggaaattccaaaaaacggtttttgaaccggttcaaaactcgaaaaattgagagatttcgcactataacttttttttaaacgatcgaatcctgacaatttggtaccatttgaaagctcttgacgagcttaatctaaaaatcaggaactaaa

SEQ ID NO: 18374 - DNA, 1333 bp, Heterodera glycines
ggggcgctttcagcagaaaaggcgagaaaaatgagaaaaagaaaaagctgagaaaacattttggaataaaataataaaaatgaaaattattttttgtgtgattaatttgggaatgaatttgaaacttttatgtaaaaaaattccaatgatggaaatgacagaaagaaaaagaatttttgtttggcagaaacaatgcataaaatgacaaatgtatgaatgaatgatgattaacggaaaacaaaacgagcttttgattcagaataaattaattaaaaaattaccaaaaataaaattaaattattttaaatttaacttgtactgctgcaactcaatgcatgaagttggagctgtacaggctcagtgagaacgaagattcaaatctaaggacatatttcgactcagcgtgcctgaattactcaaaattatgaaaattaagttttttttcagatcgcattacaaaaatttgttagcggtggttccgaaaaattccatttttggagaccattttcaaactcggctctccaataattccatcattacaaattaaaaaaatttttttagtatattcttaaagtattagctttgctctatttaatcactttttctctttctctgggtcccttttcgttgccttagaatatgccatcaaaatacctacctaaaaaatgaccaattttactttatcaactctaactccttaatgacttttccattgggattgatcttttgcctgaaaaatggcaacaattatcgataataatggtaattattaggaataatgattgtgtttgttgaaatttgaaaaataaattttcttcaaaaaatgaaggccgacagaacttatgtttcaccctaagtacatacataaattgtcattgcttttttaacaaattttggtgcttttactaagtaggaaatttttcaaaaaataataataagtttacttttttcatttgatatccacttaaaattcttaaaatttatcaatttttaattaaaattgcatattttccttaatttaatttgtgtaattttttggattaattggaacaaaaacaaaaatcggtttaacataagcctgcaacgagtgaatttatttgcttaattctttaccggactaattaaaaagtctgataaaataaaacaaaatatttttttctccctatttaaatggtggaaaattaaaatttattcatttgaacttttggaaaaacgaagtgggaaaatccgacaggaaatgtcattgtcatttggcacacagctctattttgaaattgccattcttttgttcatcgccttcaaaatattcgcctactttcaaaaacccaaagtc

SEQ ID NO: 18375 - DNA, 661 bp, Heterodera glycines
cgcaatcattgaaagatgtagaaaaataagcagcgaaatatgtgaccggaaatccgtcatcacagattatcgcatttgttactattttttattaaaaaaggttggcaaaattcaaaaaacaatggcacgccccaaaatgcgcgaaatgggcttttttaaacgcgccaaagtatagccaaatgcctctcactccatcaaatgagctgttttttctccccattggcgttgtattggtcgctgctgctgctctttccaggcaacgcttttgccaatttgaaatgccaaaatgcgatgacaaacgaagcatacgaagtgccgaatgacaatgtgctggtgaaactgttccaggatggcaaattgagcatcggcgaggagatgaagcagttcgtgtgtgatctaagcaagcagagcatggcgttggaagctgctgacacagacacatcagcacaattgacagagtgccaacaaccaatggcagcgcaacttatcccgaatttgcgcagtgccattcgaaaattgaccactgcgataaatgggggtaaaaatggcaccgtttacaataaaactgttaatccaaatttattttgaaggaattgaagtttcaaattccgaactcgaggcagtgaaaaatcttttgcagcattcactttttttgttggcc

SEQ ID NO: 18376 - DNA, 2312 bp, Heterodera glycines
aataaaatgaaatcgaacaaaaactgagtgccgtcttaactttggcactgcagtgaaacaaacattcaggcgagcatttccacccgtggtgacttaaacccggcaaatgggacgtaccaactgccgggcatgggccatcgcaaccacggggcattggactacaaggggaccaacttcgaactgttcaagcaactgcgtctggaggtgctcacaagcaaatacgacttttgttggcaaaatattcatttttaaggtctttggtgggccgacgtacggaggccccggaaaattgccaccatttaagtaaatgggaaaagggaaggaaagagggaaaaaataattaacattcagttgggaaacgacggacatcgaagcaccgcacgagggacaaccaaaagtttggcaatttgaaccatttgtgacgcaatgggtcacaaaagtgaaggcggaagggatggaggaggaggaggaagagacggatgaatgaatgcggtagagagggaggatagagagagaagagcgatagagagagagagagggagagagagagagagggagagagagagagagagggaggatagagagagagaagagtgggagagatagagagagagagagagagggagagagagagagagggaggatagagagagagaaagagagagagagagaaagagagagagagggagaaagagagagaagagtgggagagatagagagagagaaagagagagagagagaaagagagagagagggagaaagagagagaagagtgggagagagagagagagagagaaagagagggagaaagagagagagagagagagagagaaagagagggagaaagagagagggagagagagagagagagggagagagagagagacagagagagagagagaggacaacgcgaaaacggatgaacgaagagttggttaagatgagagaaaagcaaatttgttttattaaataaaattgtaaaattgccatttttgaattttaataaaaatgaaagagaaatgagaagccaatggtcaaacggcgaaagatggcgattcgcaaaaggcacttttgtccattgcttccattgtaacatttgacgcggcgggagtcacagcgaaaatccaaagtggcaaagcacagcaaatgaaacctgggcatttcttactgtaatccgatcggtacggtagtcgttcggtcctaccgtaaaagaaaaggcacgccctgtccagggacctgtcatttaaggggtctttcttctgcccattctgtcattccctcacattgccatgaatcgccagtcggccttcgcctcctcctcctcctcttcctcctccattatctgttgcgacaaaagcaaaaagtcactgagttctctgaatgaatttgatttgctcaattgtcggtgtttttgcttttaattgcctaagtgtgccgcgcaacaattcgacggtgccaatgtcaaggaaagcgtcgaaaggttccgctgaaaaatttgctcattcattttgtaatcaaaaaatccaacatgctccgatcactactcgttgtttgatcattatccctctctctatctccttaattaccctacttaatctcctctccctccctccctaattttcctttccgtccaatcactccctttcaccccttcgccctcccatttcattacttgtttctgcatggagtaacatgtgtttttcggctgctacagaacgcgtgccaaccagggtcgatcggctggtggtggattcgctggtgcaaagttggaccgggaacacgcgctgatggcattgggcgggcgcagtgcgcaacggaacgcgagcgacgagggcacggcgccgttttcgctttggttttttgaattgtttaccgggacggttcatcaacaaaagccacggaagccattcgagaaaaatagtacggaccttaacagagaaagagagaaaaaaagataatagccaaaggcaaagcatcgttttttgaatgtttggccaaatgtgcaaagggtgcgctccgtggtgggcttgtccaatgaataaacgttcttatgttgagaatggcacaccctttgctcacacttctctgctgatgatcagaacaatacccaaggggacattttgtgggttcgtggagagcgaaagtgcacatttatgatcagcaaagtgaagatgatcgaagagccgagaatgaccatggaaatggaaaagaaggcggcaatgatcggcacggaggtggaggtgggcggagtgatgtcagccacatgaaaaggcagcaaaacagtggccaagcgggagggggtacgataccat

SEQ ID NO: 18377 - DNA, 898 bp, Heterodera glycines
agtaaatggttttgcgacggatgtgaatgaactgatgaaatggaaatgattaaaattttaaaaaattcgctacgaaatgcaattcgacgaagaagtcattggaatcgccatacggaggaagcacttttttgacgggcgttgcttcgtttgttttgaatttgaatggtcaaaaagagaaaaaaccgaccgatcacttcccattctccgttatgcacataataacccaaatctgatcagtaccaaatgtttacaattttattttcacgtgcttttcccattttcccaccgatgctgtctttgaccatgtccaacgaagtgccattgacgcataagtccaacgaatttcgcgtgtgcgaccacgagccgaactgaaaatggcatgccaaggatggaatgatcaagggatgggattgccacgaatttgcatggcaaatgtatggaatggccaagaattggcttgggttagccatccgattgcatttcattggttgcttattgaactgtaccttcagcagacacatttgttcgtcgaatgggaacctaaacaacggcatcaaatggcgtcggcacgtgcacttttaagtttcagcttaaaccataccaagtgatgtcgatttggcacgacgacttgataattgccggcggcgtctgcagaatgcttccgtcgtggtcaaccacaaaatttaccgcaaagcgagcatcgaagttttcatcggcactgtcatcaatttgatgggctttggagtccgaatctgcttgatctgactgtctgtctgtcacctgttgaacaggatgacgtcaggcttccacaaagtgctggagggcaaacggatacggtcgatgccaccgtactcccgcgggtcccaaaccattttgtagtcggaccatctctgcccat

SEQ ID NO: 18378 - DNA, 1793 bp, Heterodera glycines
tgttttttcttgtcccgttaaaatctgtgatgttgctctagattatcttgtataaaagccccttattgaagctttctgcctttagagcttttccaacaatttcgataatgtttttttattcattgagacataataacatttctataaattttcttaatttaattatttatttctaatttttaaattgtcaaatgtaaaaattaataatatgaatcaattaactcttttattcatttatttgcttttattaataattagatctatggttatttatgtcttcaagagccatttgacagttacaaaataatctggattttttgtacaataataataattatattaaataatttctttatatgcttcaatcatatttttttacaattttattttgctcaaaaagcgattagtttttgaattttggttcaaaattttataattgcttaatggaaacgacttatttacattactacacttttttcttttatttaaataaaagatacgattatgttttatttttgcgattttaatggattaaaatgtccaaagacctctatttcaaatgcccattggaaggaaaaaatttatcaaaaataatttcctgtatttttaatgagattaatatcgtttatttttcgtaactacacttacgttctaaaatcttattatgattagcgcctatacaatatcaaaaatattatttcatgattcagatcgcctcgcccgttgagaatatgtgaaattaacactttaatatacaaatttatttttattgggcaaattaaattgacttttagtatttttaattaaaaaagattaaatttgctatattcttatctaattatgtaattttaatatatatttcatctctttaactgaaattgcctgaaaccttccaaatccgcattattattatatgtgaatttttgattttttgcctgtcatcttaagaattttttttttttaatatgtaaccattctatttttaatattttatttaggattttttaattcggcaaatttctcaagcaaaatgagcggttgaaatataattcttgatatattttgatttgaataaattgtaaaataacaaaattttgactctttaaattttgttttaaaaatacaaaataaaattataagttttttattatcaaatcaattttatacaaaaaaaaattaatttagatttgctaatattaaattcacggtatggcccgtaacattttttggattaggcctccaatcaacttttagacgttcaatattcgtttatttggcaataacttttttcttacttggtcattattacctacatttttaatatcaattcataatgtaagaaaagaacagataatgactagggacgtgaattttagtgaagaaaaatcccgaaatatttaactaaaatagtgagtaaaaatgccaaaatagtgaccaaatagtgacaaaaagtccgaaatagtgacgaatagtgacataattttcagccaaaaattgagcaaaaataatttttattcactgattgcagttgcaaatgagtagggctgggatttttaagggcaaaaaaacaaaataggtacataaaaaaataatttttaaaattaaaattcttgccacaaaaatacctttttgagaaattttttttcatttcttaggagtgctttttgaaattttttttgtcgattcttaggggtgtattttttgaaaaaaatttttaggtcgattcttaggggtgtattttttggttttattgcaggaaagttaaggaattttgcccaaaaatgtcaaaatag

SEQ ID NO: 18379 - DNA, 885 bp, Heterodera glycines
aaaaaaattagatttgctcatattgatttacggtatggccgtaaatagaataagcagagacaaaaagccgatgaggaaaatgccgcgtaggaaaagccgataaaaaaggcagagacaaaaagccgatgaggaaaatgccgcgtaggaaaagccgatagaataagcagagacaaaaagccgatgaggaaaatgccgcggaggaaaagccgataaaaaagtcagagacaaaaagccgatgaggaaaatgccgcggaggaaaagccgataaaaaaggcagatgttccgttgcctagacatcagctaaagctttcgttttctttgagtttaaaatgccaactgaataaatttcccagtgccaataacgttttttagataatatcttttttaattatagaaatgaattttttaactttaatcattcttctactgataataccatgtgtatttggtcattatcaatgggttcaagtgttgttacgcctgtttcgttggattgtaccaagaacactaacgctatccgcgagtgtcgcatctgtcagaactgcagcttcatacagaactgcattatcaacgatcggccgtgcggcatctcacggcaaactaaaaattctggcatcaggatcagcgggacttggtggaggagcaggcggtacgatgctcttgatggagcttctcgagaaaaatcgcaacgacatcaaaggcagtcctgaattggacaaatcgagtaaacattaacccgattaatcgaaaattatgaaaattccacaaattaccactttcaagctttcttatccattctcgttcatagtactggtgaaattctttaagatttccatttatatttccttcaacttcaaatgcttttatagtggccatatacgaatt

SEQ ID NO: 18380 - DNA, 2102 bp, Heterodera glycines
  misc_feature (9)..(9): n is a, c, g, or t
tgataaganatttttgatttaaaatcttatttaggatcctttattggtctggcttaattttcttgctttttgaataaaaattgtcattttacagccctaaatttgaggcttttagtgcctgtttttttttggtttttttaagaacctaaagcctaccttttggccgatttttagagcctataaatattagccctactctagaaaaaccaaaaaattttttaaattcattcctgtgagactccaattctccagtattaccactaaatcattggaattttcatgtgaatttcagatgtcgtttcttaatgttccagagattctaaagcaaaaattaatcgaagttgaagggactttgaaagcaatatcgcctcaatcttcgcatggagagagtttgccagcaccagcgcaatatgctgaacctttgtcctttaaaaagggacgtttcttattatggaaaggtgtttgcattgtgttgttttagtataaaccaaacatttgcaggtgtcgagactggctttctttatctcactgggcatcccaaccccggttcattgactgtctacgactataaaaacggaacggctaacgccgtactttgcttcagccatcaatttggccccacagctctcatcatcgacgccatttactttccgcttagcactgaccacccgggcattttggttgcggttacggaccgctctatggaccaacacggcgactatttggcctatttttcgctcctttcacatacccttttgaatgctttttatgtgccacaaccaataacgtccatctgttcaattctcgatggaagtgcacaaagggatcaatttttgaggctgtctaattcattccacaaagtgtttttggaattattggattatgcaataatctgttaaggattggccacacattttgctcgttggttgccgttacggcgatgtcattttagtttatttggacttgcaaacgcaaaagttgtctactgaagcagttcaaaaatccaattcaccatctacagcattgtcgactaaaactgaagagattcggccgattcgttgtaaaaagaatgtgcacttaacgagttgagttactttcctgaatttgatttattttcaaatttagaaattttttacgaagacaaaatgtttgttttccgagccgacgatggaacgaccaaatgtttagcaaagggtaaatgctgataaatggaaaaagccaatgtttaatccagaaaaggtgatggtctccgcattgcattgggaggaaaagtgcggtttggttttggtcggtttcaatttcggcggagtgatggccgtgtcgctgcgcacttcgaaagtctattcgctgctttacatcgatggctctgtgcttaattttgcgttccaagagcccgaagaagacccaaggcccatcctttttctgtggatagctttttcttcccctcggttattttgccattttctaaaccatttttattaattcgtcgttccttatcgtttagcagtggaacttctttgcttttatgcaatgttaactttccaaaagatgaagaaagaaataaactttctctgcaagtggaggagtacacttatttggagccccaattcgcgccatatatgaaggtaattggccttgttttttgttagtaatgctctccatatcgaaattttgatcacaaattgttataattgggtccatttttttgtgataacaaattacaaaatccagcatttttttttaaattttctcagtgccgcctattagcaccgccgggcaacataataaaaataacgcattattttttttttgacaccaaatctttttgttttgagcttcatgttttggttttgaaattcctctgatatgattgctggtgtaccacaaacgggaaatagttgcttttggcatttttttttgtttgtttgaaatgggtacaccccaaaatctcgccgggacaaaacctcgccgcagaaatttcaaaatttttttttcaaacttagaaatttttcaaggaaaaaattcttagaaaattttttataagaaaaattcaaaaaaaattgtttgttaagttttttttgaaaatttttcgataaaacagt

SEQ ID NO: 18381 - DNA, 896 bp, Heterodera glycines
ttaacagataaacaataatatgggtgaaaaatactaaaacttttactagatttggtagatttgatctaaaaatgcacaattttttttgactacatttaaaaaaggattcgattcggaggcgttgaaatttagaaaatttcctcaagtttaaaaaagccatgcccaaaatgtccaaaagcttggttcgatttggaaacattccaaaaactggcccagagccctgttatccgatattagtctagttgcctctctctttcttgtaatgaaaatattatgtgcctttagcaaatggctttggaagaagcgcgagccgagcgtgccaaacaacaacgggtggcggccaaagccgaagcagcggctgccaaagcggtgacaacagtgcaccagcggatcgacaggttcaaacgacttcaatccaaaaagtgcacagggattaatggattttggccccgggaagggtattttatgattgttggtcggtcaattttggggtttgtatttttcttaaaaaataatccgggatgtacatttacctcgttctccaccccctccttgctgcgagttctttcaagggacaaaagttgataccaatgctagatttatgttcaatgttactttcccattttctctccatttagccatggtttgactaccaacaataatgctgctactccccagtcgcaatggcaacagcaaatgcagcagtccatggcggccatgaacaacgccgccgcgtccaacagcttcagtttctcgcagccggcacagcagccgcgtgccaccgcctggcagaccattccgacaccgacggtgctccccatcggacagcatttacagcagcagtcgccacccgtccagcaattcgtccctcctcctccccctcacagcataatttg

SEQ ID NO: 18382 - DNA, 1623 bp, Heterodera glycines
tcggttcgcgattcccgagtcgagaaatttctcgggttatttggttctcggttctcgtatcgtttcccggggtcatttctcagtctcggtttccggtaaaaatcacttctcgcacagccctagtaattgaacaaattaaccaccaagaatttgttggttttggatttattcctcctccgttgtctaactaaaaatttcaatgtttattgaagtgctttcatatccttttttgttttgcttatttgtatttcaaaattgtcattatttatagtatgacgatgaacgaattgaaatgttgactgaaagaatgtataagtcattaaaatgaaacatttttgatttttttaaattatttttttgtgcaggtgccacttgtcgaagacaaatttacggtatggatcattaaacgggtgaaagcgctgaacccatcggtggacgcggaagtgtttgccacattcatttcggacatagactcgccgaacgaggtacaacagcaacaccattttaggcgatggttgcacattacaacaacaaacaaacatttccaacaaaatttaggccgaagactacatcattggctatttgggcgagaaaaaggaagtgaaggagttccatcgtgactttttgcagaagcgcatcgaattgcgcccgcgggcacacccccaggcaccgaaagacgtaagtgctggcgccgttgtgaaaaatgagaaattgctcaaaattttttttaaaaaatgtgcccttccgatttataatttgtttaaaatggatgggttttccagtttgttatttgcatgccttcctattaatagatgtaacatttgttttgcacatttaggacttgtccagaccagccgcagcgctttcggaccagcaccacaaaggcaccggcgggtgggcgtcgtcggccagcggcgtgccattgtcggcaccaaacagcggcgcggcgacgacagcggcggcgaacagtgcggcacagaatgccaacaacaacaacaaaaaaaagaaaggagggctgaaagggcaaaaggtggtgtcctcctcccatcagctttccaccaacaagttcacggttagcgagcgcccgctggagctgaacaaataaaacattcagactcagtggttgtttgttgttggtgtattgtgttgtgaacaggctcgtatccatcggggggagcagtttgacacaatttaattaattttttttgttcataacaagtttggggccaacattgaattgatttaccaatatgcctcggcggcattttggaattcgttgtttttttggatacgggcctggttatgaatgtggaaaagtcgaccctccgagtggggtggtatatctcagaccaggccgcccgtatttaatggacaggaggggggtcaatccccaaccaattcttgtccaaatagacggcaaatgacttgaagttagaaaagaacggttttattttaaaaaatagatgaatttacccgagggaattttcgaaattttttgcctttatctctactgataattattgtttattgactatttaatatactgataaggtagagattgagatgtccctttttgtgtgctgttttgtcgattcttctaacatatatcccacaactttttta

SEQ ID NO: 18383 - DNA, 1735 bp, Heterodera glycines
  misc_feature (21)..(21): n is a, c, g, or t
tcattagtggttgccaaatcnttgtcaatatctaggtcattttaaacaaatttataacgaaaatcctcgttttgaaaaatccagggaaaatccggttcggcttacgaacgatttcgtttcagtaccagaaaattcggtcgcgggctctagaacgtggcaccatcggatagagcaaaacggtgatttgtattatcgaatttttaagtgccctaagcgaaaactcaccgagttatgaggcctcaaaaatcggaaatttggttgcccgccgagggcccatcatttccacaaaaggcacggagagggaacggatccaaaaatgggtggctaaattggtaatttcggatttttgaggcctcgtaaatcgttgggttttcacttagggaatgaaaatttaaaaattcacaaaaatagacccatgctctaaccaaagaaactttcatacccaccctccccccccccccctattttcgactgacagtttgagatttgcccttgtgagacgaagaaatgccaagaaaaggccgagaaaagactcaaaaaagccaagaaaattaataaaagaatttaataaaaatttatcgcgatttttacaacacatttttgttaattggtcttaaaggattggttgtcgcattgaaatattttgccatcaaaaataatgaaaatgtttcgcactcttttatataacacctcgagagtctcgggatcagtctcaaaggaaaagggattatccacttcaattagcgatactaaaaacaacaattctgtgccaaaatttctgaaagtgtgacagatttttgtattcttttatttaattaataatttaaaaatgcctgcccaattagcaaaactaattattattattattattattattattattagtatagttcacaaattctcgtccgagcattcagcccctggacggatgggtttggttgttttttaaaaataagaaaaatggaatgataaacatttttccacaaaataaatttgataaaaatagatttttaaaaatcagtgaaaaatgactgatgtttgacagcccttcgtcacaaaatcggtgaataatttgccccctcgacgacctttccgcccttaaaaagtgtttcttttgcccctcgctttctcgtgtgtgtggtgggtggttaaatgggtgattagccagttcgagatcagtacaaaaaaaagtgtatggagaggggagagatgtttgggcagagaaagagaagggagagaaaaagagagaggggaatgataatgatgttgaagggaaagaaaagaaagaaaaagagggaaagagagagagagagagaaggggagcaaagaaagagaatggagacaagagagaccaaaacagagagacaagaaagagagcaaagctatagaagagaaacaaatgaggagagaaagagagagtaaaagcgagagaagaaaagaaagaaatagaaagaaagaaagaaagagagagagaaggagagtaaaaagtgagagtgattggattaagcgagggattagcataaattaagctttaatcatcaaataggtcactcgaatttcactaatggctggaaacgcggggtcaaatcagcaaaaaaaagtcttaaagactaatcaaatcaataagggcgcttttcagtctctgctcgaattatgtttgtggaaaatgtgaagtgggcgtgcccatcagtgatcaacgatcagagagagagagagtacgcttctgatcagcagt

SEQ ID NO: 18384 - DNA, 1684 bp, Heterodera glycines
  misc_feature (38)..(38): n is a, c, g, or t
  misc_feature (75)..(75): n is a, c, g, or t
  misc_feature (126)..(126): n is a, c, g, or t
aaaaaaaacaatcttggtacagatttcagttacgggtntagttgaaaaattctgtaaaacctaagaaaaaaagancctataatcttgttaaagagctaatgcacattagtcccggatttatgagtntaaaatggattaccaaacattgtattcggagtttgttaagtgcccatgataaagtcccgttctcggcccttttgcgaaatcacgaccctaaccccgttcccggggctcatgatgggatggtcccgagacttccaaatcccacttttgtcgaatgttaatgcggaatcttgaatttttaaaaattccaatgctatatataagtagaacaaattcgttgcaagtgcgaaaacagaaacaaacaattagtctggattggtgatggatggataaaaaaatgatttgaatttaaagagcaatttgcgttttaaaaaaaaagacaaacaaaatgccaaatgcaaaaaacaaaacaacatttgaatcagagaaatgtactccttcctcaccacctcccatcaaagaatgaattgaatgaatgaataacgacgacaacgacaaaacgtagaaaaaattgttaattgtttgtgcaccccaacccaatcaaacgccccccgggggacgacgagaagtgaaaattggtgaagcaaaataaatcaaatcatcactgatgaggaggaaggaggagggacgagtggtggatgagtgataaatgtgaatgaatgaaatgacatttttatgcaatggaaagtgaacgaagaaataatgaatcagtggtgctgagttggtcggcaggtggcccatttgagcgctgccaaatgggtgtcaatgccaatttgtaagccaacggcatcgcaaatatgggaattgaatggttgcaaaaaagtgacaatggcgtaaaagaaatgagtaagtggcgttgaaatggccatgtggcaactgagcgccgccaatgagtgccaatttatatgtcaaaggtcgcaaatatgggtattgaatagttgcaaagctgcgctaaatgagtgccactctgtaagacccaaaggtcacacatagacagaaggtattgagggactgtcataaaaaaatatttggcgcggaaatggtcaggtgctatttgagcaccgccaaatttgggtgccaaatttgttggccaaaggtcgcaaaaggatagttagtggatagttctaaaaaaaggtgaaggaatggcgtaagaaaaacgagtaaaattgtcatgtggcaactgagcgctgccatttgggcgccaagggtcaaagagaataatgactagaagaaatgcacaagggtaaaaaattttaaaccaatttatggaaattatagttttggatcatttaaaatacaaaaatttgagaagcagtgcggtgaaatgggttgcattttttgtgcgccgacaaatcagtaccaagagatgggcgagaggagggggagagggggcgggggattaaattgtgaaggataaatatatcaaaaaaaagcgtgacgcagaaatgggcgagtggacgattttagaattagcattttagcggacgaagcgcgaacggatgggttgagcgggtgctatgacgttagtcgaaaaccgtcgtaatgggcgttagtcgaaaaaccgtcgaatgaaaatattttttgatataattttgctcaaaagcatctaaatttttaattc

SEQ ID NO: 18385 - DNA, 2089 bp, Heterodera glycines
aaataaaaaaaatacatacacataaacaacaacattcctttttcccattcaaaataaaatcacaaaaaatttattaaaattttaatttataattattaatcaaaaataataaaattttttataatataatatttctatattcttataaaataaaacaaaattattttacttttctcacttattctcccacactcaatcatcataaattctaatattttttttcacttcctcagcgatttcatgaaattctgctgtgaaacagttaaaaattacgtagtaatgatgaaaaagcatgaaaacccatctaccaagtcataaaaaagcgattttagtaagaaattggatttttagaaaacatcaaaatttgaccaaaacaagcccaaaacacatttcttggcaaaatttgtatcattcaaagatctcgactagtcaaattctatctacaccaattttaacccttaccattctttttaatgtgcatttgctatattgaaacttcactaaagggattagtgtctattcaaaaactttttgttgatttattggcaattttttttttactttttgatatttctcgtccctgggttcgaaatatcgcaaattaagctcttcttgaggtaatgaatcaaaatttcgccggtaatgcttttttattcacaaaatcgcttcactataccacgaagacaactcgtataagcaaaaatgcacaaaatgtccaagccacgaaatgtccaaaagaataaaaacccacgaagtgtccaaaactcgaaaaagctattaaaaagccggaaaatgggtctaaattaaggtattcggggtcgctgaatacgaatacgacatttatataacccatttcctaaccttcgacccacccgaataagaaaaatctcaaattcggttaaaatatatgctgttttttgtcttcagattttgttattcattgatcgaacaaaatgattcgtaataaacttgaaaatctacaaaatatcgcccttagcagggagggcacggcttaaaaatgtgtgaattatttatttgaacattttcatttttttgttcatatttacaagggacaaatggcccacccaaaaaaagctgtgattaaattattccgtatgtatttgtaatttgtcttccactatttcccgttttttcttcgcttggaccaatttccttaaccaactaacccctgaccgccagcacccgaggcccaatcgtctctcgattcatgtctgacgggtgagtggctaacatttgaaacataatttgctccattatctcgtctacctgaattaatataacacttagagttacagatccgggactcaagtggccaaatgcctgtgggactgaaccgtccattacgaatgataccacaatggtaggacaaagaaaatagctatagtacatgctggggcccaaccgttccggcccaactgagcgagtccgatattttcctctcgacatttaaataacgaatccaaaagcatttttggacaaaaaagaaataatattttgacgcaattccatgcgtttttaccctttgaccgaattcgtgcattgtttcttcccctctcttcccacccacctcctcgacaacactgcacaacaaactaatttaaatagaactaaataattatttgttttatatttaaaaatgaacttacaatttttggttttccgattagccccgggcaattgtcggccatcaaaatttcaaaaaaatcattggccaaaacttttcggccgtccacgccgacgaatgcctcgtagtggccatgggtgagtaccgccacaattgcgctaaagaaatttgtcaaaatctttcaggagcgccagatgttgggactcggaatgggccgggtggggtatctcaaactcaaacttgggtaattaaacctttatacttatttgataaaaatacaattaaaatatgaaaataaaatgggaggggaggagggacaataaaaggggggttggcggtttggcgggtaaatcacaaatgaattgggggtgttcatcgcggtaatacaagatgcgagggaggggcggggggcgatggtgttttgggcaataagcacttttaggg

SEQ ID NO: 18386 - DNA, 2253 bp, Heterodera glycines
acagacgaagcggtttttttttttgccccaggggatgcctttacttggtcaatcgcctggctgatcagtgaaagcgcaacgttgaaagaaaaaacagttagttttttttttgaattactcgggttcttttttttaaacataacggataaattacaaagtgtcggttttttacttaatccttaacttatccgtttttaaatttatttattttttttttgctaagacggtttgttttttttttcacacacccttcaactcagcgccatattaatgtttatattttccaaaataaaaatgattcatcagtaaaagatgatgcttcttttggcaaattttctcacccttggccctcccaatggttccgcctttttcatttttgaaaattgattctttaggctgcttcttttcctcataattttgctctttcattatttataatatttttttatgtgttaaaaatttagtgcaatgtcaaacctttcgggctcggatcagcagcatgccactccaaatcaaccggggggccaacaatttggtgccatccaacagcctttgtggtctcaactggcaccacaaaatcaattttttggagccattccgccgccatcacatcaattcactgcgccaccaccatcagtacagcatgttgctgctggcgggggcgtgcaaccgccacagcaatttcccgggcccattgctggtggtggtgctggtagtgtgcaaccacagcaaccgcagcagcattcgcaattttttggaggcattccgccacagcaattcactgggcccgttgctggtagtgttcaaccacagcaaccgcagcagcattcgcaattttttggaggcattccgccacagcaatccaccgggcccgttgctggtagtgtgcaaccacagcaaccgcagcagcattcgcaattttttggaggcattccaccacagcaattcaccgggccacaaccgttgccgcatgttgctgggggtgttcagcagcaacaacaattttttggcgggtttcagccgaggcaatttggcgttcacccggttcgcccgtatccccaatttggcactgcacagcaatttggtaattgttgtgaactgaaattcaaagttattcggcaatttcagttggacagcacaacccaaaattggatcatcaattttttgcgcattcaaatgcctcgggtgtgccgcaacgcccttttatgccaccaccaccgcaataccaccacccgcaatatcaaagcggagtaaatacacaatttttttttgcaaaaaaaataaataaattttttagggatatttgccaaacattgcacaattttgtgttgatggaacaacgagcactgcgtttctcaacggttgcgtcgacactttcaaccgggttcttccgtaatttactcctttttttggtttaaattatgctttttatattacagccctgttcgtctgtcggttattgttgttgattttcgagagcgacagtcaacccccgctggagaattgccggttgcaaatgttttgcttggaaacgcggagggggcccggattgaggcgtcagcgtggcgccaacaggccgaattgtttgccatgctgcgcataggagacacgtactctttcttcaactgccgaacattgccaccgagaatgattgcaaatggcgtgtggtttcgtttgggactcaacctggcttcatacattgaccagcaacatgtaatgttttttcaaatttttttttaccgtttaaaggacctgacgaaaaaataagtggagtataaaaaagaaattgtttttagtttgtaggggtaaaactgatcaccggcatttattttcgatttattattataagattacaaaaaaaaagggtccattaatctgcaaatgtcaattttttttacatttacaaaaaaaaaaatagtttttgtcgttgcccccaccgccgccgccgcaacaacaacagggaaatgagtcggcagcggagagtcgccctgtggtgaacaataaatcatatttattatgttttgctaattttttattttctctacagccatcccagccggaaattgtacaagtggagcagagtcgtggtggtgttaatgttcagcttggtggggcggctgctctgcaagaggtgtttacgaattgttacacataaacaaaaaaaaatttttcatgcatgtttaagaacagcgaaccagtcacagacgcctcaaaagctgttgagcgcgccgctgaaagacatgtgtgattttt

SEQ ID NO: 18387 - DNA, 1947 bp, Heterodera glycines
acatagggagaggggagggagggatcgagcgatggatatcgaatgatgtatactctctgttgatagtgtcgatcaatgtaagatgatgatgatgatttggtactgagtgagaacagacagtggtactcaccggcctcacaatcaacgggccaaagcgggggagaaggcggggagtggcccccggccaatttcgcttccttttccttttcatttgaatggatggactaagaatttgttttcgtaggcgttctcggcagatgaacaaacaacaaaaatgaaacaaataagtgcgaatggcaaatgaatcaaattggcaatatttacatgaaccatttaaatttttaatggccaaaagaatgatggaaaggcttatatttttgtgacagtgtccgaaggaagaaaaagcaaactgtgaatgatgagagaaaagaagaagcatcagcaaaacaacaaatgcgaaaagtatttgcggacggggggagggacagctgctgtctgctggaagaaagcgcgggggtggcaaaaaagggaggggggggggagatgaccaatgggtgggagaggagggagagggagaaaaacaattggccatgacacaaagttattttgatcagcaaagaatggggcgagggttgagatagacagacggacagacaggcagctgccagcaaaggcaggcagaagaattaatattaaaaagagagaaagagagtgatggctgcgatcggactgattaatgactggacgaaagcagtgccaagttgggccataggcttttcagcgccagccattcattcgtccggaagtgcccattggctggcattctctctttctctatgactgatccgtatcaccctctcgcccactctgccaacccttccccaataagtttcataagtttactctcccccccccatccctttggctaattccctcatccgttctttctcgcttttcttcttttccattcattttcctcgttttttgtcgttgacaaacaaaaagtggattgggaagaattggatggatgggcaaacggaggagggagaaagaattccatcccccccgccaatgacaaaactttcgtctgttagcagggctttcagttgcacattctctaattattgaagaagggcaataacagatgcaagaaattgccaatttcggcaaggaaaaatgaatccgggcaaagggaggggggggaagggcatgggacggccttttggtccgtctctccaaggcaaaaagtgccctccaaactgaatgaacatttcatttcatttatttccttcaccaaccaatccaatttgtttcccaaaaagttcccagacgatcacatttttttagagcgacggggaaaacgcagcggagagttaccgacgcccaacagcagaattgaaatgaaaaatgaaatgggagtgagcggagtggcacaataaatcatccttcccatccgttcgatgacggatcgaagtgtccgtcaccgacccccgcccgatgagaacgaaaatgaaccgaacgcaacactttgtaagaacggtgaaaaccggtggatggagggagggggggggggagggacaaatttggagattggggagaggggacgagttggacatttgggaattcagtcctatccatctccatttggcgagagaggtcgaatgaatgggtaagaggatgaattgggaaggatattttctcctaaattggcggattgccggagatggatgagcaattagggccgtaaaattgccagagggaaaagcccgcccggagggccttttattctcaggggagcctttgttgtgtttgccgagttgtcccccgaattgcttactcggaaaagagaaaaacaaaagttggggtgggacattttgggtgaaaaaacggagcatttcgaagaaagaaattggaaggggaaggatcagtgatcggaatgtacagcag

SEQ ID NO: 18388 - DNA, 1255 bp, Heterodera glycines
  misc_feature (1192)..(1192): n is a, c, g, or t
gagattcaaaaagtggtgttaaacatatgcaccactgaaaatggggtatggtacataaaagtcaactgtaactcgggtttgaaccgatattttgcttaatgattgatatcattcgaaagccctttaaaaatgctacaaaaaatgtcaaaacattttggtcatcaccaaccatttactttttataaagccaaatttctcgaaaaggctagtggtgttaaacttatgcacctgaccgtaacaaaaaaaatcatttttattatttttttgttttttcattccctaatcaatacacatggagcatcatcaatacccttaattttctcagaactaaaagtcagttttagaaaagacgaaatttgtttattagacaattattcatttcgtattatgactaatttaattggagaagaggaagcgccgacggaaatgcaacggtcgtccagtgaaacatgtaaaaatcacaaaaaataacatccaattttcaattttattttgttttgttttcaaaggctccgaatcgtttcacagcaaatttatgcaaaagcggcgcttcgttgagtaaaaaagactttgtcaagaaggaaatcgttggtttggttgttttggtggccatttccgtcctcctcttcctttttttgctgtttgggcgtcaatttgcggtgagttttgtgattttattttaattttcaacaattttaatggaaatttctcttttttcagtccgaagagacgaaaacatttgatcatcagaaagcatttgacgagttggagaagaacattttggcaaagctggaacaaatggacatgaaactgggctcaaatgcgcaaggatggtcctcgtttttgatgaaaagcgttggcattggcatcggcgcagtgattttcctgcaaattgccaaacggatcattcactcgcacaccaaaaagggcgtccgacgtcatggccaatttctgtttcggatgaccgacttcaaagcgttttcgcagggcaacgggccgaaggaagtgaaaagtgacacgattgggtacatcaacggaatgccatggcaaattgcgattcaaaacaacggagcaagcatcggcctgtttctgaactgttcctccctgaagattcgtaagtgcgatccaattggaagctgattatgaatttggtttttgtgtcttttcagtcattccgttcgtttgccgttgngctgcctttcggctgagcatcgtttcgtgccaaactgcaacgaaatgcgtaaacagaagggca

SEQ ID NO: 18389 - DNA, 1758 bp, Heterodera glycines
atttgacaaaagccttcgtatgcctctgtgaatgggcaattgcaccgattcctcctccgtgttggcataacgtgccaccaacgttttgcgtttctctttctgcactggccaaaacccgatgacctgcaaatggtcgaagttggtattcatctatttgttgttttccaaagggcactgactgattccgccggcaccacaatccaatccgtcgtgtgcggctcgcgcacttcgatgtcaactttgctgtcattttggagcaaaaagaagggcgaaatggtcaccactttagtgaggcctgactgacccaattggacatcgacagtcatctgaacggagaaaggcattaaaacaaacaaatgttttcagattgtgcctcaaattcaaattcgcgctgtccttcggcgatgcctttgcaaataactcgcccactgctgccagccatgtccaaagggaattcggcagaccaatcggactcgtccacgattttcaccttcgcctttttcttagactcaaatttacttttgttcaaaagcaaaatcatctaaaatataattgttggttctagtcggttttacgcgtcccatcacattttacgcgtcccaacaacagtttacgcgtcccatgacatttttttgtgtccatggcggggatggcattccggccacaaattttcggaattccgtgcggcaatctttcggaattgtggtcccgaaaattttttaatttgtatggcactttttctaggcttaaaaacgataaactctcgtaacaattcaatgtccattgctctccaaccctctgctcatgctgcagagaatatgtgcaatgcaaaatttctctcatacaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttatctcaaaaaagaggagccacttttctggcctaatcgtgaaatttaaaaattctcggaacaataaaatggccattgctctccgcccctctgctcatgctgcagagcatttgttcgatgcaaaatttctctcaaaaaagaggagccacttttctggcctaatcgtgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgcccctctgctcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttga

SEQ ID NO: 18390 - DNA, 1273 bp, Heterodera glycines
  misc_feature (1089)..(1089): n is a, c, g, or t
  misc_feature (1171)..(1171): n is a, c, g, or t
  misc_feature (1217)..(1217): n is a, c, g, or t
  misc_feature (1221)..(1221): n is a, c, g, or t
  misc_feature (1237)..(1237): n is a, c, g, or t
atcaacaatgatgggattcactagcctttccatatattgtgactcttaaggggacaataaatgaggactttggtgaatgaatttcctttcgagttcggggttcgaaatttgtcgacatgaaggtattgctgatcagcgaccccgaaaatcaagcgttttcctttttgcgtgtgtgcatttttgtagttcattctgaagcatgctgaaatggacctttaaaaaggcatatatctagtcacatcatttttatgtgcgctggaatttataaattctgagaatctcgtaaatttgctaaacttttcacttttatcattggcaacactgctgaattgtgcattaatcagttgccataattctttgagctataacagcaatgggtgcattttaaatagatctgaaccttttaattaatgcctaatatggtgaaagtttgtaaggattaaaggcagattttcggaacatataagcgccccgcatcgtcttatcaagggctttcgagcagtttttcaaactcttttcattgtttgagtgtttttattattgtctagcaattcacgaaagtgagcgcttttggtttacctttagaaattcttcagtacattacaaaatgatttttaaaaaggcatttatatacacgagcattttacgggggctggaatttataaattctgagaatctcgtaaatttgctaaattttcacttttatcaatggcaacactgctgaattgtgcattaatcagttgccataattctttgagctataacagcaatgggtgcattttaaatagatctgaaccttttaattaatgccgaatatggtgaaagtttgtaaggattaaaggcagattttcggaacatataagcgcccctcatcgtcttatcaagggctttcgagcagtttttcaaactcttttcattgtttgagtgtttttattattgtctagcaattcacgaaagtgagcgcttttggtttacctttagaaattcttcagtacattacaaaatgatttttaaaaaggcatttatattacagtgccacgggaccgggaccggaatttataaattctgagaatctcgtaaatttgctanattttcacttttatcattggcaacactgctgaattgtgcattaatcagttgccataattctttgagctataacagcaatggngtgcattttaatagatctgaacgttttaattaatgccctatatggntganagtttgtaaggattanaggcagattttcggaacatataagcgccccgcatcg

SEQ ID NO: 18391 - DNA, 845 bp, Heterodera glycines
attttaaatttcccccggcggcgcctatcggcaccgccggaccccttctttcccaaaagttttttgaaaaagcgctccgaaaaaaagtgatgtgaaaatcaaatctgaatttctattaatattcgatgatttagtccaaaaaatgatttttgaaataattgaagaaaatttgtttgaaaattttcattaatttaatttgctttattttgggttttattaaataaaaaaccaaataattttgtattattttcacttgaaataaattaaaatttgaatttttttttaaatttttaaaatttttttgaatttttaaaatttcccggttggtcccggttcccggtttttcttgcggtcccggtcccggtcccgaagaaaaatcgaggtcccggtcccggtcccggcttctcaggtcccggcaagtcccggtcccggttttggcaaaaattcccggtcccgtggcactctaatttatatacacgagcattttacgggggctggaatttataaattctgagaatctcgtaaatttgctaaattttcacttttatcattggcaacactgctgaattgtgcattaatcagttgccataattctttgagctataacagcaatgggtgcattttaaatagatctgaaccttttaattaatgccaaatatgggcaaagtatgtaaggattaaaggcagattttcggaacatataagcgcccctcatcgtcttatcaagggctttcgagcagtttttcaaactctttttattgtttgagtgtttttattattgtctagcaattcacgaaagtgagcacgtttggtttaccttttgaaattctttagtacattacaaa

SEQ ID NO: 18392 - DNA, 2688 bp, Heterodera glycines
acaaaaaaagagcgaaccgaaggcacgtgtccgtttctgtctgaatttaattttccaattcattgggctgagcaataaaatttcccgatcggatttttcaccagatcagttggtgtcatgacaactcgtacaatttctgagttaggcctaggctttaagctaggcctaggcttaggcttgcttgggtctaggcttaagcttaggccttattttgtaaaatatgagttgccttttgtccgagttgccattgagccgatcattccccgctccccctcaaatcccacctcattctccagcatctgaaaaagcatttgcaatttcgtttactcatccgttaatcaatggttaagacctacaaattcgacaaccaatggcaataatttgtccaccgctcgtggccccgcctccctttgtccgtcttcgccctcgtcaaatccctggaaaatccccgccggcgttgtcatcggacactccttcaaatgtgtggtcggtcggtcacccgtctctttctccattcctttttctattaccgccattttctcaacctttgggcacatttccgacccttcgaattccaagtgtttctgcagcggacaagttggacaaatcgcgtcttggccagctggctaagtgcgcagtttcgttttttggcattaggcttttcccttggcttaccccttgtggcccagttggcccctggggccccggttggcctggctaaaatattggcactttacatgatcaatgccaggcgagtaatgagtgcccacttcgcccgtctgtccccgcggtccctctgggcctgtttttccgacgtcgcccgtggcacccgctgggcccggttcgcctctctcgggcccctcactgtccgtacaaaagctgtgcatttggagacacttctcgagcagttcatccatctgaaagaccacgcctcacctcaaacacaaaagcaaccgatgcggcaaaatgccagaacgcggcaattgtttgtttattttccgactgggtttacaattccaatactttgccgaaacacaattcaaaactttttccggacactttttgatttcacatttaattgcctgaattcgtgaaactgagtgcatccaaatgtccgtcaattggtccgtgccgttctcggccttcaaatttcttctcaatcggcgacggagaaaagtgccgtgggtggatggaaaagagggcaaaattggcgcaaaagtttcggcaagaaaatggcacttattttggaaaagagaaaggcgccaatgaatgtgaagggaggagaaaagcgtgagcagaagcagaaccaattggaagaggagaagacgaaaacggacggacgaagaagaaaagggaaaagaaaaaggaagggggaaaggggggacagaaaaaggggacaattggggggacgaaattttcatagggaaaaacaaatggagggagggggcttaatgaaacattgatcaatttgacgtaataaatgtgaaatttgattaataggactaaaaaaaaattaatactacgaaaacgatggacaaaaaattggccaaataatacgaagggaaaaaagggagggggggggggggagaaaattggggctaatggccaatgtttatgggggaaataaagcgaaagtttattccatcaaaacggaaaacaaaactgataaaaaagagatatttatataataaaagtataattgctaagagagagcagcagcaaaattatgggccaaaaggcaaaggccaaagtgaaaagtgtccgcgcaattttcggaggtggcacagccacgacggcaccacctgaaaaagatatagagaagatttacggagagagaaaggaaaatagttagaaaaggtaagaaaaaaaaagttttagagagtaagaatttggtaaaaaatctaattagatcattttgtggagaggagtattgccgtggcactccgttacctctcaatgggtccaattgttcagtgaattgtgccggcgccaaaccccgcgaaacactccgcctgatttctaaaaaaattcaaaaaaagtgaaaataccaaaatgttgtgccgaatttgtgtgcctaatgtggaagtgccaatggcagtgccaatatttgtgccgcattttgtgcgacctttctcggccaattggttgcgcagccaaacggacggcggcgacgaggagggcggcagccaatgccacccgtccagggacgacgccacgccggggtcgccttgaggatcatcgcccgcctcgtcgtccggactgacgcccgaacctgggggaggagagcaacggaacaatggcaagtgcacgggaaaagtgagggggggagggaagtgggagagggggaaagtgtgttgaatggatgggctttatttgatgctatattttttgagtgatcagtgatcgattgatcaaattgtggaaagtgtcaaataaaaaagaggtccaaatgccaaagtgtcctgttaagtgtttttgtgatttgtgcctttgtgcgaaaacttctcaatttattcaattgtgttaagcactgaccttcattgagagaagcgaccggcgaatggtcggccaattgctggcgcggaacttctgaagggatttggacaaataatcgaacgaattaagtccaattaacaaaatgaatgcatttgaatggaagagttaattaatttgaatgatatactcaaa

SEQ ID NO: 18393 - DNA, 1318 bp, Heterodera glycines
tccctcaaaaacgcacatccaaatcgaatcatccgaccctcctttttctttaggaaaatgctcccctcgccctctcccccatttcttcgccctctctttccctccccccggaggctcttcccaactcactcttcttcctcttcttcctcctttgcctcctcctcctcctcttctgcctctttctcatctccctaaaagcaatgatttcacgtagtcccttttcgacatcggggatcccttcgacaatcatcagcttcgttcttcttttgcgttcattgggtaattaatgttttaattatctttgatacttacttttgaatgatggtcccacgattggggcgggggtcagtccaattttttgatttttgtgccaataaataagacgacatatttcagcatttttgaccgttctttcacttcccaatttcttttcaggtgccgtcgcttcctttccaaagtcgcccttcaccgattggctcccccaacactcacagaacgaagggggtcagtacaaaagggatggccccgtcccgaacctctcgtcttcctctgaattccatttttatctgtcccttccccttttttaatttgtaccgtatccctttccatatttttgaaacggtcaacagttttctctcgcttttgtctttgtttttgccttcccttttccgcttttgttcacttttattgccattcactccttttaatgtcatttcccccaagggcttcttctcctcgaccgtcgctccctcgccgaaggcgaagttttattatttcggaccaaaaagagccgccacagggcgattgctgtgatgactgcgcatcagcagcacaaaattggccaaatgtcctcccgttttgccgatgcgctcactttcaaagaatggctgagaagggtttaccgagaggaaaaaggtaattaattggaagagattaacaacacaacaaatggtgggaatgaatgatcaacagttttgggactcatttggctgctgatctttcgttttcttttctttggccatgcttttgggaggggaagtgtccaacagttcgaaaaggatactctttcacttcaaaattcgcagcatcgtccgtgctgacgagagtgaattcattcgccacccctcggggaatgccattgccgcccccccccctctcctcccccgccgccctttgcccctctctcctccaattcattgtcatcgcattgtttcctgatttgattcacagaaacaattgactctgaatgggcaaattggggtgcaatttgctgctgctgatttgcgtgcagagaatgaatgtggcgactaatgttttg

SEQ ID NO: 18394 - DNA, 846 bp, Heterodera glycines
tttctttgtggacaatctcagaaagggccatttggggcattgggctgccaattattctgaaattggagagttttctttgggggggggggaaggcaaattgggcgaatggggtgccaaaatcgtcggattatctttcctccgctgtcccatgctttctctttctcacccgctctctttctcccacttttctctttttgctctctctctctcccctctcttcgctttgcactctctctctctcctttctctctctctctcacccctttccctctccctaattattttgatgcttttcccttttcttcagctctcaaagtgtccgttcgtaccaccgaagtgagtgctgttcagaatgttcgttcacccaaccttcgcccatttcttctcaggtcgtccgtcccgtgctccaacatttgtacgccacccgcgcccatttccgcgctccgattattatccacgcggtcagtgggccaatcaatgaccaattcgaataagccaattgtcaatcgctgctttcccctccctttggcagaacactttcgaaagtgcctcgtccgcttctcctaagtttccctccgtccctttctcgcgcctttcgtccgtcagcagagaacggcccgtcgatgcgcttctctttgttcaaagtgttcgtgcgctgctccccgacgctgtcatttcgctcggatggaccaaatcggaggatttatcagcagtcaatcggttggattggacgcacagccttccaactgatcgaactgctcaacgaattgggtgatcagccggccatgctgaacatgcgcctcaacgccgccaatcagtcgtccgaagcgacttcctccgcccctt

SEQ ID NO: 18395 - DNA, 2573 bp, Heterodera glycines
ggatgtgcaggcaggcaggtggtgatgaaaggtgagaggggttgggggtggcaggtgggagatgggaagacagggcacaatttggcgtaaaaatgcccatcatcagagaggggggaggggtaaaagtgcccccgccacactttgaccaatttgattgtttaccgaccaaccaataaattataaataacggaaattgaaacaaaacaaggctcaaaccaaaaaaaaaaaacaatgatttttaaacgcttttcaggcggtgctcattaacaatttgctgaagcagctcagactgaaagtgggacaggcgaacaaaacacatggaaataatgacagacacaattgaagaacaaaacaaaacaaaatataaaataaaataaaaaatattatttatcattggagatgggattttaggttttttcgtgtttcttgctgaatagatttccatttatatggaaatggatccattgttttccatatttgcacattctggcatttttaccatatcttaacattttgcaaaactatcagaatgtcagctaaactgaaaccctgccaatcgcctcgctaactgccaatcgaatcattgtggaagaaattaaaaaactggaaaaacatccaaacctataatacctgctatacttattacgataagtgtagtaagcagattcagacgagtacgtaactttttatttaaatttgggtccggggttcggaattggccgaaagggcgtctaactcgcgatcagcgatctcaaaaaccctccgaaaaacatgtaaaacattggctagcatcttctcttatcagaggctttttacaaacccaaataaattttaataaattgaatttcaaaaaaatttatcatttaaaagaaataaaatagcatatgatacaaccatttatttttctaatcaagaaaaaaaaattctaagtcacataactaaattattgaattggaaataataaatatcttttaaatttgaagctctgaacatttttaaattataaatgacctgctgaatccaggtactggttgaactctagtataaataatcttcatcatcttaatgcgttgaacggatcgtttcgacagctgcgattgatggcaacggattggccgagggaacggcagacggaggcccttgtgattgttggtggagcgatgaagtgggaatcacggcagagccgccggaagaaccaaaattggcacggacgcggccgaacagagcgcgaaaaaactttgtgcaccgactgaatgttaaggacggaccaagcacaaggccaagctgattgtgtgtctcgacaaaggaggtggtcagcggagagacgtaaattgggtagccttgaaactcggaatttacacagtgaaagcaaatggaagaaaaaccgaccaattggctgatcggcagaactgttgattatggtacggagcacttgacgagcattttgaatggagcctctctcgggatttttgtttcttaggaagatcagttcctgctgttgaccggcccaaaaggccctcacacactaaaataaacaaaatgcgaaacattgacaaaacagcagcacctcccggttcaatttgatcacgcgcatgtccaaatgtcttttgttcagcattattatctgaaaaagccaacaaaagtgacctctgttgttgaactcgctcaatgtttcgcaccttatagtcgccctgctgtccatcgtcacaaatgtgtctcaaagccaacagcgacggtttgttcgcaaggattgcacgtcgcctaagtgtttattctgtgcaatgaatgggcacgcaaaagccaaaaaccgctttcattgtttaccattccggatcgtgttcatgggagatgaaaagccgttttctgtagtcatcgattagttcaaagagttcggctggctcatccaaatccaccacagcagcaaagtgatcttggtgaagtttaagcgccattcgaattgccggagaaacgacactgttgagaatgtccaagtcggcaaaaacccattcatccgctggatgagctatacgcatatcgccctaaaagcaattataactattatgaatgatgtgttcgttcgtcccatctgcatattggtgccagagtcggctgaccttaaagagtgtgtgcattccgaacaaaaacgattcggctgcgctcgagtggcgattgtacgcggcggtgcccaacgcccttcggccgagcatagacaaagcgaagcaaaacgaagtgacgagagacgcattttgaacggaattgtagccattctcattctcagtgtcagcagacttcctcttcaaacaaaattcaacccatccggcgtaaataagcgtgaaactctgacgagacttaaaatgatctgcagtgtttatgtgctgtaaatgtcagcgctgaccaatccaccaagattaatgtcgaagtcttcatcatttgcagcgcaaaacaccgggtcaaagtcgacaaagcgcggattcctatggattttatccaacgcagttaaaacaatgtcatcggcaagccaaacagagagttgaggcgagtcaatggcgtaaaaaatcatacattgacataga

SEQ ID NO: 18396 - DNA, 2893 bp, Heterodera glycines
  misc_feature (183)..(183): n is a, c, g, or t
  misc_feature (416)..(416): n is a, c, g, or t
aaaaaaaaaaaacaaacccaccaaaagaggggggggcggcccccccgggggggggggcggaggaaaaaaaaaaaaaaaaaaagggggggggggggggggggggggggggggggtgggttttttaataaaaaaaaaaaaaaaaaaaaacccacccccttctttttaaaaaaaaaaaaaaaaaanaaaaaaaaaaaaaaaaaagagggaggggcccctccccccccacaaaaagaaagggggcggcgcccccccccccccccccgcggggggggggggggggggaaaaaaaaaaaaaacaaaaacccccccccccccccccccccccctttttttttaaaaaaaaaaaaaaaaagaaaaaaaaaaaaattctttctccctcccctctccccctcccgcccccacaaaaaaaaaaaaanaaaaaaaaaaaaaaaaaacaaccccccccccccccccccccccccccccccccccgccgcaaaaaaaaaaaaaaccccccccccccccacccaggagagagtgtatataaaaaaaaaaaaaaaaaaacaaaaaaaaaaaaaaaaaaaaaaaaaaaaaaaagagaggggggggggggggggggggggggggggggggggggggggggggggttttttttttttttttttttttttttttttttttttttttttttttttctctcccccccgcgcggggggggaaaaagaaggaggaggggggaggggggggagaatttttttttttttcttttctttctcccccctcccacccccccaaaaaaacaaaaaaaaaaaaaaaagataaataatattttattttcttcttttcttctcccctctcccccccccgggggggggtgggggggggggggggggggggggggggggagagaccgcccccaccccccccaccaccccccccccccgccccccacacgaaaaagaagagagggagtgaattattttatatatttattttatttcttttgtttgttggcgggcgggcgggggggggggggggtgggtgcggccccccccacaacaaccctactttttgttttttttttttttttttttttgttggggggaaaaaaaaaaaaaaaaaaaaaaaaaaaaaaaagaaattttttttttttttttttttattaatagttttttttaaaaaaaaaaaaaaaaaaaaaaaaatttcatattttttttttttttataaaaaaaagaaaaaataataaaaaaaaaaaaaaaaaaatttttggggggggttttttattaatagaacactttataaaaaaaaattttgggggttatttttttttttttttttttttaaaaaaaagaaaaaaaaaaaaaaaattttttgttttttttttttgggaaataaaaggaaaaaagggcttccccctccccaaaaagggtttaaaaaagtcccctttattttttccccgggaaaaaaggggggccccccgggggggtgggaaaaaaaaattaatttattttgccattaaaaaaaaaaattaaaaaaaaaccccaaaatttgggcagggctttgggaaaatcgggtggtttcagtcaaaaaatgttaaaatttgaaattattggtccaaaatggactaaattgggggggggggggggaggagacgatttaccaattttaatttaggcaaatttacggatgaagaaaaaggcgacctcatttttgaacttactctttttcttttaaaataaatttttttaaaattttgttattatataattcaaatcatattatgagaaacatatattataatataatcatatttatttgcatgaaaaaataaatcttttctaatagtgatcaactgggcttcattttctactctactgctcatcatatatttgccatgaataattgctgtcaaattaagtaaacatttattttaatgcttttaatataatttgtttttagaaatatttcatcattaaaatgaaataacacctaatattttctttacttttatttttgatcgtcttaataaaaattaattatgttgaagcaaaaaaggaaaagttgcaacaaaaatcatttgatgaaatatttggagaaaaatggaaagaaaaagaagaaaaacagcgaaatgagcagaaaaagagagaaattattgaaaaatattataaaataaaagaaaaaataaagcaaaaaggaagaaaatattcggcaaaagaatggggaaaaattgaaagaaaaatagcaaaaaaatttgggacaaatggtaattatatttaaaaatggagcaaagaattggggcttaaccaaaagaaatgctataaatcaaaaactgatgaagaaaagttagaaattgtacaaaaattcattgaaatgacaaatgaatataagcaaaaaataaaatattcagcaaaagaatggcatcaaaattatgccgaaatttgtaagaaaattggcgtaagctatggaacaattatgcaatggaagaaacaatctggattaagcaataaaagaataacggaagaagaaaaaattgaaaaactgaaaatttattggcaaacaaaaagagaaaatccaaaaaagagtgaacgggcatttgctaaaatgctgaaaattgatagaaagaacatttaaaattggaaacaacagtttggggaagagattttagaggatttcaatggatgattataagaaaaattgaatagatttgccaaaaaatcatcagaaaaactgtaacccaaatcataggctttatcaaatcttattgtagttaaaaaaaaacttatttttgaaacggtgcttctttttcaattatcttgaattttttattcaattaaattatcttctgtgacccagtgttaatttttataagaaaaattggatgtatttgcctaaaaaaattatcttaaaacattaa

SEQ ID NO: 18397 - DNA, 1055 bp, Heterodera glycines
tctgccaaacaacgctgaattgaatgaatgatgggtcaaagaaggatgactgcttaaagtggaccttgaatggaaccgatagaacaccaccaaaggcgagacgccgacaataagcgaagcgtagggacgggcacgacgagtggaaattgtagaaccgaacactacggcaaaaatgaagaggaaacaaggcaaaagcggagggggggggggggtcttgtcagcccggaaataagaatcgcgggctgctctattggtcccataattctgtaaaagctttcatctctctctttttccatctctctcgctctcttgtctttctcttactttcccttctctctcctaaactcttcttctctttctctctctctcgccctcttctctctctctctctcttcatctctctcgctatgttttccttctctctcctaaactcttcttctctctctctcgctattttgtttctctcttactttcccttctctctcctaaactcttcttctctctctctctttctctctcgcgctctctttttgtctctatttctcttcatctcttccctttgtgacaatctttgatcaaacttttagctgctgatcactcacccgacttcatgccctcaagcgtgtggaaaaagaacagagaaacgttggcaatcagaaggaatgtgacgaactgcttgcccggcttgtctctccgggcccgctcactcaacgcgcacaatctgcgcgactttgccagaaaaatttatttttatgcgtacctccgggccaacagaatgaaaacggcctgaacaacgacttggacaatgcgagtgatgaagacgaagagcatgtaaagctaatggagggaaggaaatgagagaatacggaaaattgggacggagaaatgccaacgaacggctcacctccattttgacagggacgtgctccgacagagtggcgacccaacacatcacaccggctgaaaaagagcattcattccgaaaagaccgagcgatatgactcactcgaactgtggatcaattcgccgaccaagccgatgatcagcaaaatctc

SEQ ID NO: 18398 - DNA, 1245 bp, Heterodera glycines
cggtgtcatctatgttactagatcggggatcgatccccgggcggccgctcgagcaggacctgcggaagctagcttgatggggatcagattgtcgtttcccgccttcagtttaaactatcaagagagggaggggaggggagcggcgcgtaccggcggaggtgggtggcggaagaagaaaagggtggggggagtatgagtatgatgggcgctctggggaatccgagagatgagttaccaatgtttgtttgcctcgggatgcaaatggccgatcagatattatagacctgcgagaataccgccttgggacgggctgccatttgacagcggcaggggtgcgacgcccctgtggcgacaacgaacgcccgaaggaatgaacgacctgcaatcgatgcgcacactcttcccgcttttgtgctccttttgaggctttgtctcgtcacagctcttcccttcactttctgtcctatgttcgccaattgatcgccacaaacacaccatcacagcagcgccgatcacagaatattccttgaacatttacagagaaatgccatggcatggtgtggcactcaccacaatgcaagtggtcaacagagtggcaaagtctccgaagtagttgaaggagtacactttggaagggagcggcgcatttgctgggccgtacgccaactcggccatccgttggggctgaaactgttccatctcttcgctgctcacgccatttgtcaaatcacgcttcagtcgaaatatttgtagcaactgataccaaaaacattaataaatagtcaaattccgctttttctgactcttcggtccaacggtttgtcaagcgccgcattttttgcaattacaaatcgaagccatgtccaaatgttgaccgccaataagtgcatggttccgagttttgcagaattttttgaatcgacaataatcaactgtaaaattgctcaaaaattgattccacttttagaggacctttgaattgcagaaaatgaaatgcatttggatgaaagtgaaagtgccggcgaaaagccaattgatcagctgataattgaagcaggctttatctgagaagcagatgaacacttccaagcagaacagcacaatgccactgctgccaaagcctaaaaaggaaaagcagaaaatagggagaagaagcgacgaaatcggacagagagtgccaagtcggaggtaaagtgagccggtgccccttctgctgggcacttggccaagactctagaggtcccc

SEQ ID NO: 18399 - DNA, 1570 bp, Heterodera glycines
gcataaaagatttggagagatggacactcgctgaccatagacggtgccaattgacgcattcggcgaaatgtgaaggcgctcaaacacatcacacgaacggagttgtggagcaatggccaaatggtggacaaaatgaactccgaaatgcaagcattttcattgaaaatcaccaaagatcctgtagatgaagcaaaaaagcggtgaaatcggagaagaaaagtgagcacattctgatcgatgtaactggaataagaaacaacaattaggtacacaaaagcaattggaaatgtcattttttacgtgatcaaaatgcgtctgaataggatgacttgttgggcaatggaatttgtgggattggcaatgcttttcctccgttggcattgacaattttcatttcagtagtgccattccatccttttctcttatgaatccacaatttgttgtccaatttccatttgcgtgttttgaaatgttcgtccacgcggcggtcaaatcggcgactaatcagtgcgattccgaggccaagttgagagcgtggaagcaaatcgaacactttgagccaacagtcggcggagataaagctgaaaaaaggaatttttatgatttttctgattttttttacatttcttttttgttttggcgtcgtcgttttttgacgtagtcccaaaagaaccaaagaatggagccacagccgacaaccagaagagacacaacgtacgaactgaaaaaagatgaaatgaatgaataaaaaatggaatggaaaagcaacgaaagtgcctaagcaaaaggaggaaatggtaaagaattgtggtccctaatttatttaaaaattttatttttattttgtactcaaaagtagagtgtcacgggaccgggaccgggaccgggccgggaattcccggtcatccgaggtcccggtcccggttcccggtcccgggttttgaaaagctcaggtcccggtcccggtagggcaaccgggaaccgggaaaaacaagcactggtaagaatgggggtctgagtgaaaaattagtgaagaaaattggagtcagggaaaaataaaaaataataattaatatattctttaaaagtaacactgcccgagtgtgcaaatggcctaatggctagtctccttgactttcccttcttctttcccctggttcaatccctctacagaaattagattattttcaattttttttattgtataatcgttggtttcctataaagaaaatatgattcctcatagtttttttttaaattgatacatattttatcattttttaaatgaaaatcctaccaattgagcttaataatcgcaaaaaccaacctttttttgttgaaaatctgttaacaaattgcacccaaatttttaaaatttctccccaggcggcgcctatctgcaccgccggaccccttctttcccaaaagttttttgaaaaagcactccgaaaaaagtgatgtgaaaatcaaatctgaatttctattaatattcgatgatttagtccaaaaatgattaattgtttgaaataattcgaagaaaatttgtttgaaaattttcattaatttaatt

SEQ ID NO: 18400 - DNA, 1022 bp, Heterodera glycines
  misc_feature (959)..(959): n is a, c, g, or t
cagggggggggctttattgttcacccccccccccctcattattcaggggggctatattataggaaatcggtaattcatccagttcatattatgcttaattttaggccattgtcgccaccagcggataaagaagaagcggcgatctcatctcattttaaacggatttgatgctctaattttctctgatcagaaatgctctctcactttcatttgttaatatgttcgaatataaatatgattatttatacggttttatatgccttatttgcaacactacaaccagtgagtaaattttttggcatgttaatgagctatatttacatatttaatcgttttttcaatttctttaatacatattttgtgattttttttggctccctatcatttcgttaccgatcatttcgtcattgttcagttagttaccgagaaaaaattttaaaaaatttgtttggcatattatcaaaacataataaatttcaattacctataggagcaatttttaaattatctccttcaaaaaattttggctataacttttatttgtcatccaaatcaataatcttgttatcatttgaaagcttagatgtttagaagctatttctaagatattgctttgcgattagacaattgattaaagatataccattaaaattgcagaaaagttaaaaatttctgaaattttctaaacttttttatatgctagacaatctttttgttgttttttttgtaaccgtgttggtccaactgacgggtttcgggactgagatgtctaaaaaaccgtatttgtttgttatttgatgatttcatcatttcttgtttttcctataatttttgtttttgtgttcttttgctctttcgtttttcaaatttttgtctctattttattttaagttaacacagtttttttagtatggtgtctctttttgaaaattgaaggaatatggccaatttcacacgtngtgaatgatgttcacattgatttagaaatatccgagttcagtttcgtgatctgcgtctttttt

SEQ ID NO: 18401 - DNA, 1971 bp, Heterodera glycines
tttaattattagagctgtcaaaaatatgtacaaaaagtggtcataatatgtacataaatatgtaaaacaatccagaaatatgtaagaaaaaccccaaaatatgtagcaaatatgtaaataaaatttttaaaatgttatttttttagaaaaaaaattccggaaagggtgaaataggcataaaatgccataaaaatgacctaattaggcctataatcacattttagtattttaaaaattagtttggttaatttttatttttcacaaaaaattttaataaattttctaaaattctcacgatatgtaataaaaatatgtacgaaaaatgtgccgatattttggatttttttttgagaatttccgaaaatttctgtaaaaaatcctaaaaatatgtaaaaaaaaatgtatggaaaaatccgaaaaagtccaaaatatgtataaaactccaacatatgtaaaatatgtataaaagcccgaaatatgtaaaaattagagaccggacaagagggtcggtcggtcggtttcggttaaaaaccgaaaaaaaccgaaaccgaaaaactcaaaaatttgtcggtcggtcggtttcggttaaaaaaccgaaccgaaaaaaaccgaagaaaaattttctgtataccgtttcggtttttttgaatttttttatcttttcccaaaaaaaacaaaccatttttatcaatagaaaaagcgaaagatcacctctgagtaaaattgtagagctattgaagctctatcaatggtgtaaaataattggttttttataattaattatttttattccttttttaattttcattaattaatgttattattttgtttatcgtaaatatcatctttaaataaaattaattagtttttacaattttaatttaacaaaaagttggtttcggtttttcatttcagtttacattgtaatgggtgatatttttttaaaaattgaaaagataacatttaatatatgaagtatttttagtatagttatgaattttctcacgcgaactaaaagaagaaagttgaattttaatttcttaaatttatggaaaatgttatgatatttttttctttaaccaaatttattttcataatgcctgttttcatttcttttaaacttaggttttgtttaaatgtttaaatttatttttttgctaattttatggttttaattttaacgatgaaattaattagataatattaaaataataagattcatatattattgtacttttaaaattaattgtctttcacaaagtaattaattttcactttattaaaatctaaatattattaattttaaactcatgcaccttctctatctcatcgggctctttctccgcttgccagtttaatatgttttttttaattgttaaatatatttatagatttatacataagcagtatttgttttttctgtaattatatgaacatttaaagaataaaatatattttgttttatttgttgttttttgtctttttgtattcatttttttctcctcggtcaatgaattaacttacgtttttctttgtcctgccaaattaattatataaataatttgtatttaaatttttaccattggtgtcagaggacacagtaagttaccggaaatattaggggagggggtatcagaaaaggggatggaggactaaaaataaattcattgattaccagggcttttttttatataaatacatgtttttctggcttctccatagcataatttaagaaaaacacttatttttttgtgtttgctaacaaagttgggacttttatttacatattttgaactttttcgtacatattttcattctttttacatattttgagaatttttgaaattaaaaaaaacatcttgtagaaaaattaaaaaattttaaaaagtacccttaaaacatcagtgtttttcaaaaaaagagataataaaaattaatttttaaatactaaaaggtgattcgaaggctatt

SEQ ID NO: 18402 - DNA, 2497 bp, Heterodera glycines
  misc_feature (30)..(31): n is a, c, g, or t
  misc_feature (42)..(43): n is a, c, g, or t
  misc_feature (99)..(99): n is a, c, g, or t
ggtataaattactattaaaagatgaattcnnaccagtcaacnncaagttcaataatttgccttgtcttttcctttatctgtccctttttgcttatcatntgggcttggatccatcccaataatcagttgcaatcaacctctgtgctgatcaccctaatggctgttcaaatccatctgatcagtcccttttttcatctatttgcttcagtggtacttctgatgctaatcattattgacattgagtctgttctgatcaatgatcaattattatgtttgttcctttttcgatcactgattttccattagcccccaatcagctgatcaatgcctttgtctgtttgttgtcccccattttttccctctttccccccactcactcgctgatgtcattgtgtgtgcctcgcgtgtgcttacgcgtgccgtctgattgccttggtccgtttgtgtggcaccatccgtttgttgttccgcgtccgtccgcttcaacttcggcattgactgtgataagtccgcttgcacttccatttcgtccacttcaacgccaaccgtttggtcatttttgtcgtctctttaattgtgccaatttcaatttgcctttcctttcgcttttttgttctttcattttgccatgccttccgattatttccgtttgcgtatgattttcgcgttggtggaagctgaccgatcgttcccttaagctcgtctcgagtgatcgctgttcagtgttccagagaatttcgtcaatgattgccgactgagcatcttcatcctttgctatgtcctgacagaaaaagttgtcataaattttacataaaaatttttaggtggcaatagagcccagaaacactttgagtcccgagtttatttattagaaattaagaagcatcaaaaattccacacttttagagtatcaaaagttttcagcaaatgaccactaattgtttttttcgtttccaattaaatattatttagcaacgatttacccctcctccctcctgtcccactaataattaattatctctgatttctcactttgtttgcaagtatttcgtcgattgtttcgaattcaaaaatgggcggaatttcaatgcccgactctttcgcctcatcttgcacttgttgcagcacggcacgtttcgtttgctcacttttaaattttttttttaaattttaatgacaaaaaaaatatttttattataaattcttttagatattattaatttattgttatttgatactttttcttatgaaactataaatatattgttgagaaattaaatttagacataaaaaacaaattactataattaaaaatgcaaaaagtgtactggagctggtgggaattgaacccacgacttcttgcatgctaagcaagcactctaccactgagttacagcccctatggggcaataaaaattcggaaataataagtaattttcgatttctttgagtatttatggcgctttgctacactaattgagcaaaaagacaatcgaattaaattgattactcaattagtgttaatcaagcaaagggtaataaaattttttaattatttggtacttttagcatgtctttagcagtccaaatctattacctatatggtattttaggtggaataaatttttaaaattttccttgttttaatttataataaaatcagtaaaatttttatttaaaaaaataaaaaccaccaaaaaatttggtcaaaaaaatgtaaaaaatgtaaaaaatgtactggagctggtgggaattgaacccacgacttcttgcatgctaagcaagcactctaccactgagttacagcccctgtgttagagtggttttatatatttcttatgatagggaaatattaaaaaataaaaaaggagcaataccaaaattaggtaattaattaagaaaaaatatataaaatactcttcttcaattttcttactgatttttttttacctataaatccttttaattacctaattaaattattattatttccaaaattatttcaaataattcccttctgtcccttcctttcccatttgttcttctcacttcgtccaatgcctcctcaatgtttcgtcccaatttcgcctgtctttcgttttcgcctccgttttctctgttttgggcgcattggacaaaaaacgattggacatttgaagaggcattttgttgatggaaaaccaactgaaaacagttcaaatttatgtgacgcaaaacaaacaaaatgaccacaatttgcagatggaattgttccattggcgtggagaatcggttctgttgcgggtttcgaatgccacattcggaaaagggaaacctttccgggggggggggggggggaattgggaaaagaaaatgggacaaaataggaatttacaataattaattaaataaattaaattaaaattcggacaaaattcactgacgatatgttaatgttcggttcgttggtcattgagaagaaacagcttaacttgattaattcgttcgaatttaatcc

SEQ ID NO: 18403 - DNA, 1003 bp, Heterodera glycines
tttttataataaacaaaaataataatttcttgtaaaataatgaaaatggattttcatacgaatgtttaacccaagttaaatttaaaaaatgatgaaagaaaggattttgtgtcaatctaaaaaaactaaggatttatcggttactgatttatttaaaaaaattaaatttaaattaaaccaattattctctattatcctgcgaaattttaaaacaatttcgtcccattaaataagttaagggcaaaattttaaaaaaatcccttttcggcgccgcatgccatgcctttctcaccacctgtatgaatcgttttttctacggtaaatatttcatatagagctttcaaataatgccagttataataaaggtgatggcaaacaattatatttttatagtgtttttcaattttggcggctcaaaagtcagtgccgaactgtccttactcaatattgttaatatgtgctcaatgtcagcaccacacaaacctttgaactttccactttggggtgataaaaacattccgcacaatccgccaccattttgcacacactcactctgatggatgtgttcagaaacgcgaaaagcgaggcgctaaactctaactgcttttatttttcgaaattttgcattattttttttgaaaattccaaaaaaaaatttccaatttaatggattgacacagcattttttagccaaaattttgcatgcctcataggtggcattgccggtcagccgtgcaagctccctgaactcaagttgaatggaagcaatctctgcaagagtcgagtcgacgctccatgttggttgacggaaagagccgctgtgcaaattcacgtcactaaattataaaaaaaaattggggcctattttttttgtagattttgagagggtctgccgataaatagaaaatgctcaaaaaaatttgctggaattttgtcataatccatgcaagaaacggattaaagaaaaatgaattgaaattttttaaagaaaaacttaaattta

SEQ ID NO: 18404 - DNA, 1411 bp, Heterodera glycines
  misc_feature (89)..(89): n is a, c, g, or t
aacattcgatgagaaaattttttatttatataagtctcatttaagcccgattttccatttgcctgtagggcactgcggttggcgactgnctaatggcgggaaacagacgttgtccaatatcctcggctttggtgagaaaaatttgttcgccagacaaatggtaggcactgagaaggcctccgagaacctgaaatttttgttgccactatttaatatccgaaaaaaaaatttttttttaattttttttcggtgagtggcgggtagtagcaaaatttcagaaaattttgccaccataaacaatgactaatttttctaatatttacccttatggtggtttcaaacaggctgacaaaacggttacgatcaaagcgcaattccgtctccacccattgtttggcgtccgcaaattcgtcccgcaaatccatgatcaacagggtatccagtgagtcgacgattgtaagacctagtccaaaaaacccagataaaacctgtgtgctgtgacctagaggctggaattttatatagaaaaaaacaggagcagaattgggaattatgccgggtagaattaccgagaattcaattgcggattttgtcagaactctgattccaagtttttttttaaagtcggaataccaaggtcgcgggaaaatcccgacgagattgcgatcccgtcagagcaaaacggagaaaaatgtatggaatttttttcgggcggggggtggacccagttaaaaaaaattcccaccatcattgcccgttcttcccagttggcttaaccgatgaaataagaccataatatttaccgcattccatccattcatgaaagctgtgcgaaatgggcattagttggtcatggccccaggcatattttttgtaggcattccacgcgtagcgaaatgcttcacgaatggcacgttgatgcgcattcgttggccctgaaaaattttgcgtaaagcattaaatattctaataacaatataagcagccttgggaaaatgcgatttaaaaaaatcagaaaattatctgactaattaaaaaaaattttaatcggctttttctaaattttaggattaattatgcttattttaattttttataaaattattttcgaagacttttttgaaaaaaatactattttttatatgaaatggcgaggggaaacgagttgctcccaatgttcgtatacctccgaacattggcgtttgtttcggcctggcaacagtttcattgtcaatgttttgctgctgttgatggtgtacatttagagtttgtacaccctttccagcaaaaactgctgcttctcgctgtccatctttgacaatgtgaaagcgctaaagaacgaagaaaataaattttgaaaatttggaaacaaacagactttctttttaaattcggcatttcttgcctaggt

SEQ ID NO: 18405 - DNA, 1376 bp, Heterodera glycines
cccgctttatccctctgttctgtctacttcccttttaccccaatcccccgcccgcccaattcatcttttttcatccattttaacccatccatcccttttctttgtcttccctaaaaacaactgtctctgccctatctctttctttcactgtctctgccctctctctttctctcactgtctctatctctctctttctttcactctctcttttcccctctattcctcgccaatcacttccaatcattcgtcttcgctgaccttctgccgttcccccgaagaaaggtctttccccaaccacaaaaagtgagggcaacagagtgacatttctcatttcaaatctcttctcccatgggaaaatgtcaccaccgaaggaaagggcaaagggatgccgtgtcctttttttttttgcttttcgcatcgattgccttttgctcggttttttcgacctgcaccgaaggcgtagccaatgagccgcgaaaactatcaacgcggaggaagtccaagttgcgaattgtttgtccgctctgaacagcgcgaccgcacggaatgtgaggctgatgagccgattcagttgaagaggaatcgccgaaggcggaatcggtgtcgggactggcacagaattcggtggcatcgccgtgggggaagcgaatggcagttgaatttgaagaggatgaagaagcggaggagtcggttttgtcgaaagactgaaaggggccgccgattgagtcggacattaaaacggagccatttcagagagacaatcacctgaaattgaacccttttggccaagtgttcaatcggagctgaacaaagaactaagttttgctgcttatggacggggtgacaattaggggagaagacggactgttgcgatttgcccgaggggagcgaagggaggccgagaagaagccgatcgcccgcctcgccacacagctgcgtttccaattcgagcagttcagagagaattgtgtcgagatcaacttcatctgaatcgaattgtgtcaaaacaaaccgaaccaaacttttgtttatgccaaccttttgcctgtgccatgctgaatcggacgacgtccaactgcggtttgggcggaatggcggggggccgttgtcgaaggatcactccgttggaggacgacggagggggagggaatgtggttgaagaagggggggaagacgaagacgagggaacagcagcggcagaaggggcggacggggaaacggcggcggaagggcgcgcgtcgattcgaccgccggtctctcccgctgctgccgtccgtccttcgcccgccttcgcttcgtccggcgattgaggcggggccatcggccgctgggaaacgatggaagacacaacggacataccctcgggggaagggggg

SEQ ID NO: 18406 - DNA, 1419 bp, Heterodera glycines
aacccgcgtcattttcaagtcgcgttccgcgtgtcgcatttaatttttgtccgcatttctctctgggcttgaggacaaagtaatcacctaataagccaatttgtgaaagaacacttgtaaattaaaacaaattttttatcaaaatttttccttattaagagacgaatatttttttaattttttaattaattttattattttactctttgattttgacaattttggtaaaaatgtttttagtccaatcatttcgcttactaaaaattcaaatcttttgctttttatgtgtatagagcagtagaaaaatagggggggggggggaggaaagaatagacggatgtacaaaactaatgagggccagatgtttttttttgtttgtttgtttggtaaggaatgggcgtcaaaattgggcaaataaatcggaggaaaaattggagggatgaaagagacgaattactaatgacgagggatttgggaggaaaggaatgaattaaaagggccaaatgacaaatgtcttccgaaaatctgttccctgtggcgggcaaaggccatcggttgaccaacgacagattaatgagattaattagcgatgcgcacgaaaacgaaggaaaacggacagaaaagaacggacgatgttttagctaataattcacaacgggatggactcgcacttctttaaaatgcataaaacgagcagtgaaatggaagtgaaggtggaaaggaagtgccgaaaaagaaagtgccattaaattggggccttcgacggcatcgttttgctgccgttgcgtgacatatccccgggccattttttgaattcatttgaatgccgcggcagaaaaaagcgggccaaaacttaaacgggagaggacttgcaatgttatacataaaagcttgttttgggcgttggttttttcttttttgtttgttgtcccatccatcacaaaacccattggagagagaagagaaaaggaggagattagtgtccaaactcacaaacgattagtaaatgtaatccctctgaaaacatttgccctgaaaaagttgcacttcacttttatgtataaaaaaattaagaaaaactcggtttacctcagttcggccccagtcaattttttgactataactttttttctttgccaaccaaatccaacatagttggcttcttagaagctttttcttagccactgtttcgcgattatcaaaaaagttatacatgaaaattgcgaaaagtcgaaatttttgaagttttttctaataatttttttccaggcttgaaaatctttttgcttttttgtaaggctaatagagtttgtgtaaagagctttcgaaagatatcaagatggttggatttggttgacaaagaaaaaagttatagatcgaaaactaagctgggccgaaccgtgcggggccgaactgagc

SEQ ID NO: 18407 - DNA, 2096 bp, Heterodera glycines
aatcatcaaatgtttctatgtgttaaatatcgtttattaataaataatttccgcatataaatatttattttttaaatattaaaaaaagtttgctcatgactttgtccttgaatgccatggatgtccttgaaaatttggtaattttttgaagaaaaagctgtttatatatgcaattaattttataagttttctcattcacttttttaaaacgaaaacaatttggccttgaatagttaaaaaaaaaacaaattttgcttcctttttcaattatttgcagttttttaattaccatttatgcccttgaacagtaattagctgtcctttttgttggatatgatggattttaattattatttgaattagcgccaatacagtaacgatgatgttcatgttatttgtgacgccatattctccagtcattattttctcccgctgttctgtctcattcattattattttattatcattttcagttctaaattatttctgttttgctccttccatttttgccttcctctgactccgtcgtcatcattattttatttgttttgttttattatttatttgtttgttatcatttgtcttttctaaaataaatttaattctgttgttccttgcggacacaacattggcgacgcccgtaagtgaaatgccttattttcatcacaggtttgagcgacgcgcacaaagaacttcgacaagagtgtctccgccaaatggaaaaagctcgaaagtcaacgccgccgaggtccatgactttggaagcacttctggaagagtgccgttccattcaatcgcttaaaaattcggctgccgctttgtctggtcccggacaagttcattcagtgcaggtccgaccgcaacgagtaagcgatggaagtaagaagtctaaccgaggtaaaatggtcaaccaaaagggcaatgtttcggttccaatttcgaaagagaataattttcctttcaattcaaatagaaccgatcaagatcaaaatgtgcagcaaaagtgcaagcgatgtggtcaattccatgtcaacgactgtccttatgcagccgatgtgaattgctaccgctgtggaaaacgtggacacatcagacccgtttgtcctgaacgtacgcagtcaaacgctgtcactgtggcctcaactttttgtgtaactcaaaagtgccacgattggatttggacacatcctctgatcaatggacatcctgtcaaacttgcggctgactcgtgctcgcatctgacaattattcaggagccactttggataagtttggggagtccaaaattgagaaaacaaggtaaaaaagttggtagtttttccgggcataaattaaatttgttgggcgaattcgattgtttggtgaaatttaaaggtgttgaatttaagctcaaatgttcagtagctaacaccggagctccaaacatcatgggacttgattggattgtgccgtttgagaaggctacgcagtctcccatcgcgacaacattggatttgtcaagcgccccaacaaaagtcaacacaattgatgaacgtccccgtcatttcaaaatcggtgacactgttcgtgtgttgaactatggaaaatctggcaagtcaaattggtttgaaggcaaagtcgtcgctggtaaaggtctgatttggaaagtcaaaattccacttttaaatattactgtcaacagacatgtaaaccaaatgcgttcttttgtcccttatcaatcagaaacgacgtttccgaatgatacagttgaccaagttccgcaacaaaagagtccttgccacagcactgtcacgactactccgccgaccaacttgccagttcaaccaacgcaacgtcctcagagacaacgccgtccgccgatacgttactcgccgtgacgacagcattatttaagaagggagatgttgaacttttaatttaagaagggagatgttggatatgatggattttaattattatttgaattagcgccaatacagtaacgatgatgttcatgttatttgtgacgccatattctccagtcattattttctcccgctgttctgtctcattcattattattttattatcattttcagttctaaattatttctgtt

SEQ ID NO: 18408 - DNA, 710 bp, Heterodera glycines
  misc_feature (31)..(31): n is a, c, g, or t
aaattgattaaacgaataaggttaaaatttntgaaaatcatatattggaaattaaatattaatttaattgtagaaataaataaatatggaaaatggaaattaaaaattggaaacaattaagaatagcggattaattagaattttaaatataaaataaaatttaaaaaaggttgggtttggttttgaaaatttaaaataaaaataaaaattaaataagttaagaaaaaatggaaattaaaattggaaataaattaataataataaataaaattggaatggaatgaaaaagaattaaattgatattttgaattaaaaataaaatttaaaaaaggttgcgttagaattgaaaataaattggaaatataaaaattgaatatggaaaaaataaaaacaatgaaataatatgggatggaaaaaacggcaattaaattgggtaaataagtttgaaaaatgagaaacgaaaatgtaaatgaaagggaaaaataaattggaaaataaaaatttaataaattttaaaatggaaattgaacattaacaatttattttgtgcagacagtcaattaacgacatgcggggggggggggggtgttcagcgcatgagttgggggcgtggtcccttcgctctcccccgccgatggggaggaaaaagtgggaagcgacgccgatcctgagcggtgctcaacactgccacaatggggaggagggggggg

SEQ ID NO: 18409 - DNA, 1619 bp, Heterodera glycines
  misc_feature (69)..(69): n is a, c, g, or t
agcagatccagaaaataaataacataccaccataaacctgaaatatttctgtaaaataaagtattactntcaaatgaatgtttcataaattgggcgtgatttttaaaaaattatataaaaagcattattttataaactgtatttatttatgaaaaagaaagttattttgaaatttaggctaattgattcaaaaaatataatatttaataaaacaaaaataaaaactttaacaacgaaaaaaaatgaaaaataatttgaaaggaaacatgttttttagactcaattataataattatgtgaaactctaaacatctaaaaatacagcaaaaagtaaaaaataaatgtacgtgccaaagcttatttgctgaataaatgacattaaactttttatttttagtcgattgttgctcgtctttctttttaaatttatttttaaaaaatttaatattaattgattcggaaattcatttattggtaatttttaaaactttatttttaatgggtaaaatttttttctcactttaaagtcatgtctcgtccaaatagcccaaccttggcttgtattctctgtcatttgttaacgcgtagtttcatttcttaaattaattttctattttttatagtagcgaaagcttttatttaggatatcgaccgcaggaaaattcttgttcttataagtagccaaatttaatttataattaagtagattctttgtcttggaaatatatttgctaacaattacttatcatttataaattcaaaaactcgaatactttaattataaaagtattccagatttatttaaactaaaaagatgttgattatttattattatttattttgttatataattaaggtaattgctcttattgtgtaatttttattctcatcgagaccttaaataagtcatgcaattaaggaattattgtaaatacaaaaaataaagggttttctttttacttattatttatttttgtttctttttgttatttcacttagatagttgcacataaagtgttattttttattatcctctagatcataaataagtgatgcatttaatgaatttataaaagggtttacttttatactcgcgctcgtaccaagatatgtgtttgaaagatgtagcgttttaacattttaaatgctaattgctattttggtaattaacactagtatatatgtttttactatttattttcttttgataatttcaaataattttattcagtatattattttggcaatagactcattaaataatatttgaagtttaatttgggtgagcttttgtcattgtttttatatttaaattttagtaattatgaattttatttattatttctttagggataaaattttggaaatagttttttttttaaatttttataagattttgtgtgattttaatttatgtttgtatttctgacataatttattttatatttatagcggattgttcggttcatgatgtggagctgcaaaactgacaagttttgagtcggaaagatcgccgcaccaggcacaattaaacattgtgcctttagggatcggataaaaaaggcctaacaaatttcatttttccaatgttttggttattttggttttataattatttt

SEQ ID NO: 18410 - DNA, 2170 bp, Heterodera glycines
cgaattgctcgctcatatttcaacaatatttttgtttcctttcgcagggacattgtgcaccaatcgttcagcgactttggcttcctggtgcctggccgtgtcgcccgttacatcggcgttcagggcgacttggacccgttgttgaccggcaccgccgtgctcgagatggtgctgcagtttttggaggctcaatttcttcaacagcaacaacaggaggaggacgaggatgatgaagaagaagacgagtcggaggaggaagaaaaggaagaggaaggagagaaggagtcaaacgagagagaaggaggggaagagaacggacagaaaggaggagagcaaagggacgtgcggaacgagaagggggagcaggacgaagtggcgaaaaggtaaacaaaaagagtgcaaaacacggcccaatcccaaatttgaagttcactacatttcctctacccccctccccccacccccgaactggggatcctcctcgtttcggcgccagcccagtttttggactataacttttttctttttccaccaaatctaacattgttggtatcattcgagagcccttctgatgctctattattttgcataattccaaaaaatttgatcaattaagaacaaagttatggccaaaagtacacatgtggcctggttttttgaattcttctagtcataatttttttgagcattaacgaaattttttgaaacttagcaggctaatagagaacacttagagctttcgaatgataccaataatgttagatttggttgacaaagaaaaaaatcacgagagttggcgagaagatgagaggcgagaatttttcaatttttctgtagtcttttttttacttcaaaaaacttcaaaatcgtatattaaattagggttacgggtccgggtatttgggcaaataccgggtccaaccgggttctggaaaatccaaaaaaatcttcgaaattttttcatgaaaataaaagcttatagtttaaaaaattatataaatattttcatgaaatatatttacgagaccgggaccgcaagaaaagctgggaccggaccaaccaggaattttcgaagaaaaaattttttttgaaaaaatccaaaaattttcattaaaatgcatagattaatgataatttaaacacttttaaatatttctctatgtaaatgattgagtatttttttatttaatggtatttttctattgttttaataattgaaatatcttaaatttttgaaaatataaaaaaatttttgttcagttggggaattgaacccaatcgaaaaagaataaaaggcagaaggtttagtcaacagaccacatttgaatttgagttatccaaaaataatgttctttgattttaagacattaaggaagcagagaaagagatttatgatgtttttttttgcaaatttgaatatttttcactgctagaaagttcaatctttaggggtgtattttcacctccctcctttcgtccctaaaaacgagaggcgagagtccaaaaaatggcgagagttggcaagagacgagaagcgagagttgtcccacccctgttatgtacatatttttatacattttttggagtctttcgtacatattttcattttttacatattttgagatgatacatatttctggatttttgtacatattccatatatatttgtgggttttttttatatatttatactctgcaattttttttacataaaattcccatcccgataataatgctacataaatgttttcttttatatttttaatcagtttatttaattatccttttcaatttgatattttagtctcaaagcgaaactttgtcacttgaacatttcgccatgctcaccatgtacatcagtgagaatacgtttaaatttgtcaatttcattcaaaatacacgcggggcagcgacgcgcgtcaaaaaactaattggagcagcgaaaattaaatcaaattttatggaaacatttcagaagaaacttcgaaatccattatgtaagcagcacaaaatgtcattatatttaatggaaactgcaaagaaaaagctaaaagattctcgagggattattttgaaatttaataatttttttgaattaatttataaaatacaatcaaagcctctttaattactaagcgcactgatatataaatttcataatggtgtctca

SEQ ID NO: 18411 - DNA, 2107 bp, Heterodera glycines
ccccgatactataataaatatgttattttcttaaaaaaaatggaaatttatggcaaaaacaattacaaaaatggaaattttcgatttttttattcgactttcttataaattaaaaaaattttagcatacttagctacaaagaattaagtcgtaaatacacgcaataacaataatagcgcagagaaggataacgagagtcgaagctgccggacaaagattttatctttacactgtaaatttttcgtttactgtattaaaataaaataaaaggccaggctttttaataccgattcatctgactgatgaagaaaagttataaagaaaattttacttaaatgctaattttatcaagataattaatttataaaaattttcttataattatcgcaatgttataattctaataataatatttgtgagtgatcaaaaaatgaacaacaattataattaatcgcttaactgcatcacaaaccaaaattaaatgcattttttaagaattcggattaaattctttcagaaatatgacaaaactttgaaaccgtaatacagtaattaacaaaagataattatggtaatccaaattagtcgtttcttatcctttttgtgccccctaaaaattagacggattctcagataattaagactatggtcaaattgctcatccgttgaagagacattgaaaaattaagagaacaaaagtctcccccctcttgcacaccatcacattttttaaatcataatatgggtggcctttcataaaatggtgaaaatggataataaaaacgttgaaaaatggaaaaacatttgaattcataataattaaataaattaaaaattgagctataatttttttcttattgcgaaaaaatttttcaattaaatttattttaaataagaattttcaactgaaatatattttatgaattttttttgttggcatttttcacttaaccaattcccatttatttctttgggccaaaaaattggattattagaaatttaattgataaaatctttttataaagccttgaaaatgagtttcaaaaagcttgtacttttggccgtcaatttttgaaaaaaaaatctgagtaaaaaactaaaacacatttcctgtttttttcagattggcaattaaaaatgagaataattgcgagaaaaaagacaatatgattttaaaaaagtatgtaagaatattaattttactaattcaattataaatcttaataattgtttaaaacaataatattattcaattaataaattggtttattgggtttgtcaataaattaggaaaaattcttattatatgaggaaatagataaaattaaacaaattttttcactttaagcgtgtcaccattttacaaaaaaaagagtgatttttgcttttaaattgaaaagcaattgcattgtgacagggcgggcctcatcagtacagaccctgtcagaatgctaaaaaaaatgtgtttcggccctttctgtagacacaatcaaataaaaacaaaaataaataaatgtgatcaaacctaaaaatggggaaaaaataagtgaaatttggcacttaattagaaagtaatttacaagtgatcaatgggatttactcaaatgcaaacttacgcccaccacgccgatccaatcattccgtcacggcttcttgaattggctggcacgctgtcggcggcacgcagttgacaactcgcggatttgcacccatcgtagcagcacctgaatttgaaaaacaataaacaaaacgccaaaaaagtttacattattattaagatgcttaatccttttaagcagggattaattgttttacgccgtttaaagcaatgatttcattttgttaataattaattatatgttaaagcatttagcacaagagaaaaatggcaaaaaaaattgttcatttaaaaaaaatagaaaaagtcagcgccacatgcgcaggcaatgggaacgcaaattcgcgcgccttgccaacatttcccggaagacgctccggtcaagtcaaagaaagccggcaccgcctcccatgaggtcggccacagcgttatcatttggcttcttggggtgcgacaatttttgaaaaggtagttagggcgaggcttatg

SEQ ID NO: 18412 - DNA, 359 bp, Heterodera glycines
cggtgtcatctatgttactagatcggggatcgatccccgggcggccgctcgagcaggacctgcagaagctagcttgatggggatcagattgtcgtttcccgccttcagtttaaactatcaagagagggaaggtcagtgtctttgaaggaacggaggagtatcatcctcttaggcccatttcctcgccctattcatcggcacagagaggagcacgaaggggaggggagcggcgcgtagcgggggaggtgggtggcggaagaagaaaagggtggggggagtatgagtatgatggtcaatatggagaaaaagaaagagtaattaccaattttttttcaattcaaaaatgtagatgtccgcag

SEQ ID NO: 18413 - DNA, 1961 bp, Heterodera glycines
ataaggacatcggcataatttccgacattcgaacaaatccataacaagggaaccggttggtttacgttgaatttgcggtccccggttttgaggtctttcaacggctctatccgcaccaattgtcgttacgcgatcaccagcaactccaaattggcgcattggtttctgccacaactgttcaagttgaccgaccaccggacttggcaattgggcagtttggactcttcattttgccggccaagcacgacaaagcttcagatcagaaaatcatttctcataggccaattatgggaaaagggataattgaaacccttcccaagttccaattccccttcagtgccgcaactgacattcattttgctgaaaaaggcatcgcagcagcattgtcgtcttgttttcttaaaaatcggataaaaatggaagagttcgccattgagacaactctccacattttggacaataacggtaggacagttgttgccacttttgaacattttcttgacaacaaacgtaagtttgttgatttagttgaattttgggaggaagatgccgcaattcaagcgagattgaaaggggtaagaaaaacttgtgccaatggacagattttagaggtgaataagtatgtccaaggggggatgtacgtctttcaggcaagaattctgctggcatatcaagctgccaaaaatcacgactccgatggcgactttgaattcatttgtgaaggccatgaagttgtacttagcccttgtgaatccgcaacggccatggtcaatcggatgacactgttttattcgaattctttcagcttgatttcgtcggagcagagtggaaccggacaaatttggagagctttgttatcatcctcggatgaacagtccttgcctgctcaaatcacggagacgcgacacatacgtcatccggcattgaagcgccttgaaggtggtcaaaagcagtcggcaatgctcatgcttgatgatcagccgcgcattgttgcacaacaagcgcctcctggcagcggcaaaacttttactttggccgccatcgttgctgctctgctcgaacggcccgatgcaaaatttttgtgcatggcaccattgaacgttgccgtagtaaaaatttgtgaggaattggttgatgctttacgggtagagggggttgccgtaacgccgttagccctattttcaggaaatggtaaagggaaatacagggatcagcttgaccgcatctcggacaatttgcttgaggctgcagccacgtcagaggaattttggaaaaaattgaatgaaaaagagcaaaaggaggtaaaacggtacaaaaacatgcccgaaaaaggccgagaattgccaaagaggcgaaaattgcagaagttgtgctctcaattgaaagcaaaagaattttgtgttgcacattgggttttgcggaacaaattggcagactaatcatggacagaaacatgatagtgcttgacgaatcgggccaagcgccttttgtccaagtctgctcggtcctctcaccccttcaggaagttcagaagctgttcatcactggtgatcgttatcagctggccgtgaacatgaaggacatccctgaacaactccgagtcggcttcggctttgacacagttttactcaacacagactcatctcctggtgtggacaaaacaacgttggaagtgaactaccgttcacatccagaaattgtcaactgcgttgaatatgcggcatacacaccccatggtgaaaggctaagatcgggaccgggaatctttaggatgttgacgagttttgccaaaatgccaattgctgaatctccaattgtgctcattcaccaagattcgccaatggaagcggaagaaactagtttttctgcgaccaattctggtcaaactcggactgtcattgaccttttaaggagctggaggggttttcctggttcagtccgggtcatttcactttactcag

SEQ ID NO: 18414 - DNA, 2559 bp, Heterodera glycines
  misc_feature (2547)..(2547): n is a, c, g, or t
ttcgaacctggacctccgaaaaataggaatttaaaccactgatcacaccgtttttttaaattttccccacttcaccaccttccctgaaggggaaaacacagccaaaattttgatttttgaggtccaataacttttctatttggcttcaacacaccgctaacattaaaaattcagagtagccggccctgcactatcaaatagttatgatacatgcattttctgacacagttctgacggttcccttgttagatttggcccaagctataagcttaattttgtaaaaaaaatgtattgtacgagttattgcctttgtaagaatggatagaatttcatacttaataaatttatgaataatttaatttttttaaaacatgtgaaacgaaaaaaaagtggctgccccatggggcccaatcggcggggcccaatcggcggggcccaatcggcggggcccaatcggcggggcccaatcggcggggcccaatcggcggggcccaatcggcggggaccaatcggcgggacccaaccgccggggcccaatcggcggggcccaatcggcggggcccaaccggcggggcccaaccggcggggcccaatcggcgggcccaatcggcggggcccaatcggcggggcccaaccggcggggcccaaccggcggggcccaatcggcggggcccaatcgacccggtccgttagtctggtgctgagcctgtccggcttctactagttttgcatttcaaacccataaccgatattcttttttctcctcttttttaccgtttcatttctgtccatccattcgtcgtgcactgcccacactttcacatcgaactgcttacagttggccctgttctgctgcgggttcatcaccaccacaatctccgcttttgtgtaccctttgaattccgccgccctttgctcaccgcccgcgcaaaaaatgtccactcgataaaccatttttgaatttggcgaaagggctggcgaaatgtcaattttgaaatgggtgccaaaagttatcctcaggttttgttgggcaatgctttgctcattcagacaaatttgttttgtgaagttggtgcgcttaacagaattgtgcccagatgtccttattttaaattattggaaattcatttaaaatttgatatggagaaacctttttaataaataataaaataattttgaaaatttgtcatttaggttaaatttttacctaataaagtttaaaggttgtgctttttcgcacatttttatttgacttttgattttatgcagttttctcccaacaaaataatttattaatttttattattttgattttttattttcaccaaaatttgaaaattcaaattctgtctgttgaccattccaatttccaatatgtgcgggtcctttctctctccacgttcaattcggataatttccactgtttcggcaccacgtttaattcgctgtgtgtatccgaccaaatgcgttttgttgccattttgtagcgcaaactgtccgaattatgaattaaaattaaatttatttgcataaaatatgtttttatggattaaatctgacattttattatgataattaaataaattgttattgactcgataggcgtagtctccgattagagtcggcaccagttccacgaccagcgcattttcagctgcacaaccgctgatgagtgctagcaatacgacaacgaaaggagcgaaaatagcgaaatttggcggataggggagcataaatatgtgtattttgaggctaattacaataaattaatcgtaataataagaaataatttaaatggttggggaaagattttaatacaaacattaactaaaattgattatattaaggcgattgacgtggattttattggaattgttttttacaatatcaaaatacaaaataattaaaataattatttcctttccaaaataattcttattcgaaattttgcaaatttatgaaaaataaatttattattggtggccgtggtctcatcactttgtcaaactctgatttttgcactttcgttttattttacggttagcgttgccgaaaaatcgaatttacaggacactatttgcacgtaccgctcaggctggctcggatgcagaatttccgggttcctttctctgtaagtcgacagagataagaaagagaaggagaacagcacaaatcaaaataagcattttagcaaattattaaaattttgtcaagaatgaaaaagaatttattgttttgaaaaataacaaattttagagtaaatttgggtatttaaagccattaaattaggcaatgaataaattattgtgtttattcaccatcgcttattgttaatctgtcaaataaatcattttcactttttatttattctaatatttaatttttattttataaattaatttcttataatttgtcgcttcaaatgactttttcttttgctgtgcttcttttgcttttgattcctccgctgacattggcaaaaaatgcgcgagcggagggacccgtgccggttgttctgtggcatggcatgggtttgttttaaaccgnggtgaatttgat

SEQ ID NO: 18415 - DNA, 2914 bp, Heterodera glycines
aaagcgaaattgcacctcaaagaaaattcaaattctgtgttctgccgcgcccgtccggtgcctcatggcgttcaagaagcagttgatcatgaaattgacttgaccgacttctggaaatcgacgctaatcgctcgattgatttttcacaatgggcagcgccgcagtccggaagaaaaatggagctgttcggatttgtatcgatttcacgaccggtttgaatgaagccttggaacttaaccggcacccgcttccaagaaccgatgacattttccattctcttaggggttcaaaaatattttcccaattggatctcagggacgcttatttgcaattggaactcgatgatgaatcaaaagcattggtcggaattaacactcatcgtggattattccaatatcaatgacttccttttggcgtcaaatcagcgccatccattttcaaaaagtcatggatcaactcacgtccggtattagtggtgttttcgtgcattttggcgatttgatcatcgcttcgccgaacatggctgaacatttattggtgttcaacgcgaactcaaatttcttgggcatattgtttcagcggacggcatacggcctgacccgagtaggtcagcagcaattcgtgaaatgccgcctccgcatgacctttgcacattacgctcatttttgggagcaattaattattatggtcgtttcattaaaaagatgagaaccatccgtgctcctttggatttgttattaaagaaggaaactccttgggaatggggtccaaaacaacaaaagcttttgaacaggcaaaaagtctctcgcagtcggaacttcttctgacccattatgatccggagaaaccgatcattgttgctgccgatgctagccaacatggaattggtgcgacgatcagtcataagtttccggatggctcagaaaaagttgtggaacatgcgtgccgttcgttaacttcagcggagaggaattattcgcaaattgaacgcgaagcgttgggattattttttgcagtccgcaaattccatcgcatggtttacggtcgtaaatttgttttgttgacggaccataaaccccttttggcaatttttggtggtaagaagggtatcccaatttacaccgcgtcccggttacaacggtggaaaatgaagacccgaaacaagtgaaggaagccgatcaaaccgaaatcacacacgttcctgactgtacgtaaaattcagtttgacaatgagcagataatattgaagaagcaggggaaggtaaaatgcagtgcaactaaatatgtgcctaccagaatttccgaagccggagtttgagaagccgtcatttccgaagccgccgccaccgcccgaagtgggactggtgacggaaggacgacgctccgattgaccgaatccgccgccagaagaaaagtcgttgttggagaagccaccgcccccgtcgctgtcctgacgattctgtcgaccgaatccgccgccacctccgcccccgcggcctccaccgcgtcccccgcctccgccgtcgttccaacgattgcctctcccaccgcgacgatttccgtccgactgattctgtgcgtcgccatctccgaagccttgaaatgacaataatcaatattttccaaggcaaatttcaaaaaaatcttatattagaaaatcttttacgaaaattctttaaaaaaaattttttgaaaaattttttagcgattttttgaaattttatggcgaattacatacactaaaacattaaaaaggggtggggtgtgaaaagttttttgcgaaggggggtcggccgctgagatcctgatgaccttttttttcaaaaccattttttgcggcgcactttttccaaaagaaaattcggggacatggggccggcggagccgataggtgccgccgggaaatttttgcgattttgagccaattttttttaagaaaaattgagatttttgggacttcgttgaaaaatttttcaatgatttttttcttgaaattttctcataaaaagaatattttaaaaaattcggggggggggggggggatgaagtgcactattttgatctcaaacaagattgaaatatgattcgaaaggatcacgtctagcattgtgctacttatggataattgaatggtacctaaaattcctaagccggagtttgagaagtcgacatttccaaaaccgccgccctaagtggcactgcagtcctcccgccgacactccaaatggccgactccccccacataagaaaagactgtgttcgagaacccaccgcccccgcaccctgtcctggcgactctgataaccaaagccgccgtcacatacataccaactacagcctaagcatgttatagctttgtccttttcgggctattaacgcgcgtaactatgcattaactaatatacatcactagaactaagagattgaaatgttgccaagaattttctcataatccacgtcataaatgatcaccgatatccgctgacgttgggcttcgacgctttccttgacttcaagttggaccaaatgggctctggctgctaatagctaagaattgaacaataaaaaatattattaattgtcaattttatcacctcattaacatcggctgctgcgccagtgacaaaaccgccattgaccggcagcgtattggcaccactggggacaattgactccaacgagcattcgtcctgttgctggaagcgcaatgcggtcaaatctgttgttaaaaaagcgcagatattttataaattttgaataattaattttctataaataataaaatatttttttatgatattgcgcagagatcaatctttttgagacttattctatgcgacaaaaatgaaaaatatatttttctcctcctttttaaataaaatatccttaattaattttttacgttaaatttttg

SEQ ID NO: 18416 - DNA, 1667 bp, Heterodera glycines
  misc_feature (92)..(92): n is a, c, g, or t
  misc_feature (124)..(124): n is a, c, g, or t
  misc_feature (147)..(147): n is a, c, g, or t
cagcacagctgctgccgtgatcaatgtgggcacattctgcaatttaattcgtacttcgaaatgtaaaatatggaatcgccgcttccatctcncaaatgcattctcgacaataaccctgtttttngcatgtgcataattatattgtgnttgagcagcagttgtggggtttgcaaaaggtgtcattagccagcgacgtgttggataagcactatcacccagaataattccttggatttggccaccttcaaatgcttcccatacgtttgactggcggagaacaaaggcatcgtggctgcaaccaggccattggcaagaaatgtttgaaaatcggccattgtgatcgacaacacctaatcacattgctaatgaattattctgtccattttatatgtattgtaccttggacgttaatcgaggggtatccttttcgattaaaatagtccttttcgtgagcggatgctggaggaataattcgcacgtgtgtacaatcaatggcgccaattacaccaggaaaattagcaacattataaaagcttggtataattatttctctggcctgcaaagggtactaattttttgaccaaaattcattcataattccggtacttgttcataaggagcaaaataaatgaattttccagccaaatttcgtaatgctgtagtaactcttagcactgatcgggacactgtagattgatcaaatcccagcaaatcaccacagatcatttgaaaagaatttgatgccaaataagcaagagttgcaacaacttgcaactctaccggaattgctccccctctcgaacggccgttagactcaacttcttcacgcaccaaattagtaatgtacttaatttacttttctaaatgaatttataaaaatggtacctttatcccttccctgtcaaatcgaaatctcttatagagatcttgatcagacatttgggcgagaatttctgccctctttcggtaaatttttaccgctgtttgtgtctcaattggaaaaaacgcggcacacattgctgcagacaaaaaagtttattaaaataaactgaaaaaaatacaaagtgctaaaacgcaccaattaataaatgaatgtagcattatttaagtttctttctcatttgaatgctttccacgaaaaaattcgcgaccctcagtaaaaaatgtcttaacatcgtcaagaacatcctcaaattttttaaaaatttcttgtttttttgtcatttctttcaattgcatctcgagaacactccgctgcagttccattacatcagcagctgtaacagttgaagcagttccggcacgagatcggaatggcacgcgagaggtgcttgattcaaattttggagttttcaccgcctctccgcgtggcacagtgccaagaacggcataggactttccttcttcaacaacaacttgctgtgaggaaaattcggcactttcctcttgttctcttgcgatcaagcgagccaccatggcttcatgaatcgccgatgttaataattttatgtatgccgccgggaaattgatttgggaaaaatctacttacacattagctcgaacacatatctaccctcttttgatgtgaatcagcaaacaattgggaaacattgcgcgaaacttcagtcatttcgaatttctttccccacgctgtggcacgctgatgc

SEQ ID NO: 18417 - DNA, 1422 bp, Heterodera glycines
  misc_feature (1346)..(1346): n is a, c, g, or t
ccttttctcaaatttttaaatttcttcctttttttctctaccgtatattctctaattatcgccccgtctccattaattatttccaattgtcaaagcatatttaacaatatatggtccattattgagtcccaaaattcttcgtttcatgggcacaaacattggcttcggcggagttaccacccattggcagcaaaatcccaccgcaagccaaaagcaaacagaacgccaaaggacgcgcgaaaataaatatttagggaaaatgcgaaaattcaatgagccgcgcatttagtctgtctgctgaacaaatagtaataaaataatggaataaattgcatttaaaaaattgtttatggaagagaaagcaagctgatggatgccaataatttccggtatttcgcaaaaaatttaggaaatcaagaatcagaggcttaaaataaaaaccaaaatttcaaggttcaaaaaatggtaatttaccgtagaaattgaaaaaatatcgtaccttttttgtaaaccttgagattaaaaagatgtgatcagacagatcaacaatcacttcttagatcagcgatgataacaacagatcagtcattctatcaaagctcttaattgattaggtcgagtttttaaggcgcgaaaggtgacctgatcaaactgatccaaatcattgaaagcgtttaaaaggtgattgatcagaccaattctcgaacccaatcaattcagagcatatttctcaaaaaaacctcctaaactggacccttctacagattaaacgcaaatgataaattgtaattttaatttataattttttttttaatttaaaattattatttttaatttccacgaaaatttcaaaatttctccggctaaaaatcaaatgcaaataataaaaaattatttttaaaatttccatggaaatttcaaaatttatccaacatttaaattgatcttaatcaattcgatgaacgaatgaatgaatgaataaaagtccttacgctgtacaaattttcgtcatccaattcattcattttgcctctcactttttcactgactcatcgaaaattcatttgggaaaacattttctcagcctttacacaatattttcattatttttttcctaattttcttttatgaaaatatttttctccgacaattttttttgttttggagtcaatcttttcagcaaacattaaactaaaatttatttgattaaattgtaaaaatattttatgttatgaaatttattttcatatgatttcattttttgattttttccttttcctattttttttgatcagaatttattttaaaaattatagtctcccgatttatttaattcccattcctanaattgtatacaaaaactgttggattttgtctagatttttttcgggttagacattctaaaatataaataattttttt

SEQ ID NO: 18418 - DNA, 1372 bp, Heterodera glycines
gaaacaacagcagcagcgggggggagggagggaatgtgtggacagaggggaataggtaattggaaaaagccaaaagggagggaaggaaaggaaaagcatgacgaagggagggaatggccacgaatcgccaaaaatgacagatacatccaatggaagggcgatggactgtgcgatgccaaaagtgggacgactaaatttcaacagaggacagcgaagggtgtgttccataacgtgcggcgattgcaaatgatcagaagcgaaagaattacataaatgtacaattacctatcgtgctgtcgcataaccacctagaacatgcgtgttagaatctagattagagcatcatgtctttgttagtggttgatcacatccaacgacgtcgggatcattagaaagctcttaactagctgtatcgtctatacaaaaatcacaaagacgttccgacatataaaaaagttataaattaaaatatgcaaaaattctgactttttggtagtgttcatgttgcaacttttttataagttgttcaatcgcttagcaatatcttatcaaaagcttctaaacatgtagagctttcgaatgatgccaactttataaaatttgacaaacaaagaaaaaagttatggtgctttatgcttggctcagacgcaactggccagacgcaactgacccctaccgtttttagcctccgattgcatattaaatatatgggatctctaaattcctgtttctaaaatttaaatgcagaaactttttgatattgttttgaataatacgattttattttttgagtgtttccaaattttaatttaaggaaatggattatgcataaaaatttgcaaatttttcatttcaataattttttcctattttttaaaattatttttaaaaaattttctaactcacctaaaaatatataaagtacaaaaatgtttctgtacccccaacaaacataaaaatataaaaataataaaaaaaaaatggcgaattgattggcttgctcattcattcattgacacaaacgacggcgacgacgacgaaaaacgacgaggcggacggacggacggacggacgataggggggagcccacaaaaacctcacatctccgcagaccaaccaaccaatccctccaacaccagcagaaccatcaccacccgagcccaagcccaataaccccccccccccccccccgtcctccgaaatcgatcaccacaaaacgccaaccacacagtgattttcgcgccgcgcttcaaaacggccattttttttgaaatggataagcgatcccgacaatttgttgttgaggctttggtgtgcatctgctctgctctaagaccagagggttctttttttgaactggaccaatgatcca

SEQ ID NO: 18419 - DNA, 2567 bp, Heterodera glycines
ttgtatcaaaaatgcaaagaccgataatcgtaaatataattgctctcgctaatctcggtaccggaattaaactaaactctctgacgatcaccgaatgcgaatttaagtataaccctagaaaattcaatgccgcggttatcaaatgtataagccccatcaaagccacggcattattatgggaatccgggaaaatgatatgtctggggacgaaaagtctgatagactgtgaaaatgcgataaaaattttcatagaaataattaagggctcggggtgtccgggggcttcttacacctgacacacgattgaaaatattgtttcgacctttaaattcggacatgaaattgaactgaacgaattcagaaaaaatcgtcgtgcattttatgaaccagaaatattttgcggtttaaatttcaagcggggtaaaagcatgacagcgttaattttctggaccggtaaagtcgtaattacgggaactaaaaacaattctgaaattgaggaaatgtatcatcatattctcccctatttgaaaatggctcaaaagaatttaatgagacgataaaaatttttatttattgagacggtcccgaaattcttgcagatgacctacttttgaaaaagtttttttttcaatcctaatttattattatttttcaattttatatttaaattgaatttaataattatttttactgtaaaattcattaatttgctgcaattattaattaaatttgcacttctacaattccattattgattaatttgcgcggcggcggcatcgtggcgcggggagggagggcgtggaggaaatgcaaaaaaaaacgcacattggcaaattttcaaaatgagttttaatttcaggataaaaaatcatataaaaaatctcaggatttgagaaaataccccaaaaggtttggaatcaaaaaggaattaattggcaaaagaatttccttcacctgtcactttggtgacaggtggatgattgatgaccttccgcggcgctgcgcggcgcggagagggggagtgaaaaaaaaatcgccagtgcggatttgaggaaataaaatctacaaggcggcagacttcaaaggactgcacccctcctataggcttgggattgtgcgggaaaatgtccccgggcggcaacatcaaagggctgcgcccctcccataggcacgggtttgtgcggtaaacacccgtgcgcaaccgtgcgcttttgacgccatatactactgttgtctctttcttctcctctctctttctctatgttttccatactctctccatttggttgtctctttcttctcctctctctttctctatgttttccatactctctccatttggttgtctctttcttctcctctctctttctctatgttttccatactctctccatttggttgtctctttcttctcctctctctttctctatgttttccatactctctccatttggttgtctctttcttctcctctctctttctctatgttttccatactctctccatttggttgtctctttcttctcctctctctttctctatgttttccatactctctccatttggttgtctctttcttctcctctctctttctctatgttttccatactctctccatttggttgtctctttcttctcctctctctttctctatgttttccatactctctccatttggttgtctctttcttctcctctctctttctctatgttttccatactctctcctctccttccatctgttttaatttaccgttcgattcgttcactttgcgcagtttcccctggttcagatgcaacttcggtgcgtaaatgatgtccttcaccaagttggccatgtcttctcccaattgtccgctgtgcgtccattcgtccaccagcaaatcgcataagcggatgaacgaattggcaccgctttccagcagtacgacgccacggcggaagcagtgtttgagttgcagcaaagggtaaatgctcagcagagagatgtacggcttggaaaggcgcgtgccggcgccctcaacgcactgctccaacttaatccatctgaccgtgccatattagagtgcttttccatgctggataatgccgaccggtgcgtctgttgccaaaagagcgtttgctgaacatttgccagtgccattggactggccgccgtttcggcacttccttcgccactttcgacgactcgttcagccaattccgtgttcaggtaaagcatttcgcagaagagggcattccgatggctgtggtccgtctgcgaatgttcgcccatcgaactgcactcgcagcagccattcgactcgagcaaacgccgcacattgtcaatcggaccttttttcaaaacacattttgccaatcccttgctgttcgagagtgactctcggccacttttgcctttttaaccctttgccaatgtttcattggctgtgaatgcctttcggctttttccttttccctttttgccctacaattcccaaattagccgatgactgactttcgcattggcttcccaagttcacattttgcggcattagcagtgcgtccgttagcatgttgcactcctc

SEQ ID NO: 18420 - DNA, 1296 bp, Heterodera glycines
ttatttttgcctttatttttttggacggataaatatttaaaaatatgtctttcacagagagacaatttttcacaaattaacacaatgatgactatatgtacaacaccttggttccaaaacatcataacctattaattgattaattagctaattagcgcacatttccatggtcaaaccagcgcatttacaatcatgtgaatgagtttaaatatgaagacattcacaatgagaaaatgcactagtccaaataaaggagaagcagaagcaaatttcaattttaaattattaaagaataaaagaggtaaataaatacataaattattcagggagcaaaagagaattttgtgctaatttgggttttggtgaatggctttggcatctatcatttgtgcttttatatgccatgatgtctctgcccatctctgctgttgccattttgtttctcttctctcagattaattgccgttcatctgtccatttgattttacttgggttaatttgagcggctaaatgccctcctgctagtgaatggggacgggcggcattttctttgctcgcacaatggcactttgggaaaggtaacttaatcttcaaccaaaaaatgaaaaacaaaaatgaatgggtttgatttattttctctttaggccgaaagtgatcatttaaaagtgaatttttataaaaattaagcatatgtctaaataaatgaaccggataaaataattggcaattccttagaataagaatcagctaagcttataaaatctattgagaaatatttttttatattataaaattggtaatttaggcaaaatctgttaataaatctcacaaaatttttctcaattttatttacctttcttcttaatcactttttcacatttaaacgccacttttgttcatattgttctcacaaatgcaaagaaagaaattttagtcaagtagacaaaatgaaaacatttaaagttaacctttttattttttcattaaaaatttctttattaaaaactaggtacctacctaaaattatctctttctaacaaattcaattaggtaatccagaaatgtttttatattccataaacaaaatgcataaatgaccttacctaattggttccgcgattgggtggtaattaattcttccatcgtatgtttgtatttgtttttcttttgcttttctccttttggcaatcatcccttcccttttaatttcgtccttttaaccatttcaattgaaatccattcgtctttcatatcagctgctgaccgaagaatggaggtcaaacgctcgagaaattt

SEQ ID NO: 18421 - DNA, 1166 bp, Heterodera glycines
cccccccccccccccgcgccaccaaataaatatttgtaatgcaattaaatttgccccattaatttctgtcctttttataacatttttccccgccttcggtgaattcaattatcctttatcagtgcatatgccaattttcggactcaattacctcattcagttcactaattgaattcactttcacatttttatttacaatttcacaaaacaaagacaataattgaaatcaaattcattgacacaccaatcgaagtgctaatttaatttttaaatcggctttggccgggtgatggcacttacttttatcagaggcacattaacacatcgcattaactcattgttcgatcaatttagaaatatgtttatttcaaatatcctgcaatcaaattcactttttacaaccaaaaaatggattaaaacatttgttatttcattagtctttcgaatccatcattataaaaaatttttaagacaaattcatataaatacatttgaacaatcacattttaaatatatcacatttaaataaagctaactatttattgttttcgttttcataaattctctactttttagtgtgtgggatgtgccaaaaaggacaatggcatgcgtttggtgccaaatttatccgagcaataattttggaaggccaattttccgaacattgctttaaaatttttgtaaaagcacaagcagtgtaaatggagcagatgagcaaacaaagtctgctgctgctgctcttttgcgtggtcatcggcacaaaaaaaaggaaaatgaaaattttacccatttgaaattttagatttttacggcacaaatgaaattcaaataaaagcattttaagacactgctgcaattttactttttacttcttcccgtctagcaaataaaaactgccgaacttttcaaacaaatctctttccattttttcaattttctaattttacaactcattaatttttcttagcgctcagaacaaacatcaattttcgcttgtgctttatccatttgactgtgaatggcaataatccatcgcccgtggcaaaatcaaaaaaagatgccatccgcgcatttccccaggctttagaaagcattccaaatttatgaaaatccaaacagaaggtaaaacataaaaattttatttgtattagagaaggtcgggaccg

SEQ ID NO: 18422 - DNA, 2186 bp, Heterodera glycines
aaagaattaaagaaattctatcatcttctctacattttttttttgaataaacatttaagcaaattttggtttctcaagcgattaaatttgatggtttagggattagagtaataactgttcaaatagttgaaatctcttcatttttatttgtctttattttatacttccatgcatattcatatactattaaaaaaataaaatttgtatatttatatattattcatttatttatttattatgaaaattaattgatttcttaaacttaacaaatttaatacaacaaaaataacgaaaatatgtaaaagttcaaatgacgcctaaacatttgtgcggcaaatacataacatttatttcaacaaatgttgctccttttttaccattgaatcactttaaattctttaccaaatcatatgaatgagaataataataggcatcgctcacttatgtaaaatcgttttttatttgtaaagaaattaaattttctttacaaaagaattttaattggtttcaaatcgatgggcttccaaattcggatggttttgctgtgtttcaccggttttgtactgatataccatttgttcaccaacaaacaaaacgaatgggacgatggaggacggacgacggaattaaatttgacgcaagaattatacgactataaaaaccagagggtattataataataataatggatataaaataactaatacacaaagataggggggggggcggggttggcattggcatgccatttaatttaatttaataactgatactctctcgactaaattacgagttttagaatgatttgaatttatttaggctaactcagaaaattggtctcctgttttgagaagtaaaagtttaaaattcctttttaaaatgaaatgagtgatttggaataatctttaagcatttaattaactttaattaagaactttttggttcggtttaaaaacattcggctgacatatcggatggaatttgcaaatgcgtgtcccaatgacaccaagctgatcatgttgtcgatggcacgaagggacggcttcgacaagcggaagggcgtgcgtcaaacgtggatgaatgattcggtaaataaatttttctttaaatgctaattaattaattaatttttatccccctgttgaaacgattcgttttttggtcgccgatgcggcgaaaggcgaagcgaacgaaacgcgtaaaaagttggaggaggagcagagaaagcacggtgatttggtgtttctgcgcggttttgaagacaaatacaaacacattcatcttaaagtgaggagcaaaaaaatttaagaaaaattattaataagacaaaaaaaactaaaattcatcaaaatcattaataactgagaggtgaggtactttttaaattaacccaaaagctttttggtggccttttttctaatttttataaagcagtgccgacatgcgccgattggaatttgtaaattttagtgggacatattagataattttgatggaaattaacgatttagagaacaggacaaattttaaagaatcataacaaatataaaaaattgacattcaacattccgtaataagtggtacaccgcgctccaatggcaacaatcgttttgcaaaagtgccgaatgggtgatgaaagcggacgacgacgcggtggtgcacctgcgccgtttgtcgcattgggtggacgcaaaatttcgtccaatcgccgcgaaaaatccgctcatttacttcggacttgtcttgttcaacccaaacccaatccgaaacacaaatagtaaatggtaaggaataatcgattatgaaagtcaattaattaattctttaaaagattaattattaattacatagttctattgttaaatttcttcctccatttggttttttaatttctaattttcgattatttgattgatttctcttaattttggcatccaaatcatcttattttcaattatttagctttatgaaattttgactttctttgagttaagtctttggaattctttttccaattataattaattatttaaaaataagaaattttgcaattctttcagcggcagaatattttttatgctggtttaggtacatttcggaggatgtttacccgttggattggtttcccagtttcatgcagggcacaatgtatttgacaacaccggcaacagtccgtgccgttttag

SEQ ID NO: 18423 - DNA, 2851 bp, Heterodera glycines
  misc_feature (42)..(42): n is a, c, g, or t
tcgatagttcgaaaagacatttgtcgactctttgttcaaatntcgggttataccacctctgaaaaccacgggaatacaatttcaaagcgcatttttctaatattaaaaaatggctacccaattttaaagctgggccaaatttttccaattttttttttgtaaaacccaaaattcccccgcatttccaaaaaaaacctgttttgagtccatttgtccgtccgcgtcgatcagactgtccaccagccttggcacagtgcccgctttgatcacccactcccggatggtctcccattggaggtggtccatcgccacggcagaaccatcagtcagcgctaactgttgttggccaagggctaaataaatgacaaaaattgggatttggttttttaatgaaaacccgggaatttagagggaattttaaatcgaattttcaagggatatgtctccgacagaaattaaaacaaaaaataataacaaaaaaatatataaaataacaaaatcaaaacacaattctttttacacattttttggtcggggattagcccaattgtcccacttttcacataaataaatatttgttgctaatccgtgggctctgcccaccatttcccccttttttcattaatccccacaggcattttggtgacttgtactgataaatcgggaagtggtttggcgttcttggtcctgctcatcgccccccccccacggcccaatggtgcccaactctcgccgttgcccgtccatctgttgcccgttgctcctcccaacactgtcgcccacccaccgcttggccccaccaatcaccactgcccgcccaccaacaatcacccgaacactgtggacccgcccatcccgtttggccgtataaaaagaatgaaggatgctcgacaattacttactcttctgggcgattacttttctcgcctttttctcgatttcgccatttttgctctacctactcgccatcaatcttggctttcccctttgcctttctcactttggctttaccattttcaccttgcttatccatttcaattttgccttcgctttaaaaataaaaacaaaaaaaaaccttttctcttttggctttacattaaatttctccgcgtttttggcccctgatcatttctggggcatttctcattttggtgctcttttgaccattgcgtgggcattcccccgtttttggcccttttcatcaccggctactcctgcccgtggtgcctattttgcctttgctttagccattgcccggccattttgtcgccgctttggtcctcgttcgtttccgttgcctttggccagcattccactgactcaggcccctttgtcccttttttggtccccccctttttccctgtgtttaccacaagtaccaaaaaaataatggaaaacgcataaactgaccaattcagactgaagaacgaagcgatttccctgaataagaaataataaattaaacaaattttgcgaaacgaagttcacttggctgagcaatcgactgacgcaggcgaaagtgtcatcaggggaatggtaatggaggaaaacggcacagagcgggtagagaacctgggaaattgaaaaaatcagacagaatttaaaaaaaagtaaaaataaataaaacaaaccgggacaaaacgaatctcgggcttggcgtattcgatgacctaaaagaaccaacaaggtcaaagcgtacaagaaatgatataattgtaatacgatgaattcaattccaaatttaaattttgtaaaacattcattggcttacgatgagcagccgctgcaagttgatgacgccgacctgcttcagtccgtggtcacaaacgacgatgccgggctctgacagaaaggcgggtcggaaattctgtgctgaaagtgtcgtggaaccgatttttgggttgggcgaaagcggcgagcgaaaaattcgaaaatgaaacaatttggcattcgaaattattggaatggccattaacttctgttttattttttggcccatccctttgtgacgccgtgggaaaagtgtcgccgttttaccctttccacgaaacaaagtgtcaatgtgttcgtggaagaagtgccgtgaggagtcgaactccttgtccccgttggagaccaacacgcgccaaaggtccctccgaatttcgtggctgaccggccaattgttttcgcgcagaaagttcttcaactgaacggttagcggacctcggattaaaatgatgccaaattttggagttaggacttttaaatttttaaatttttcatgaaatttttgctaaaacaataggatttttaatgaaaattttctaaatttgatcgtattaatttcgacctttttttacctggcgaatgtgtttagggttcaacagattgagaaggtcttcttttgatccgtacgacggatggacaaatatttcggggcggagatcagtgaaatcggtgaaaggcggaagctagaatttgaaaatttaatgaaaacagaactaaatgaacacaaattatagccctccattttttgacttacgcttaaatgcaaatccatttgtgaaagagaaagtgaaaagatttaaaatggaaaaaataatgggcactaaattttgcatatttccgattggttttggttgcctggcaacaaaaagtaaactgaaaagtaaataaattccgaattacaaaatgggaatttcatggccaaattcattcactttgttaagattctgaagtgagtgagggcccactacaattccaagtgtttcccaggattcgggtgacacataaaacgcaaaacaattccattttagtatggttgaaaaggggcgcggcatccgcgaattcccatccccaaaagtgaatg

SEQ ID NO: 18424 - DNA, 2777 bp, Heterodera glycines
  misc_feature (2715)..(2715): n is a, c, g, or t
ctcctttggcactctttcctcgcccttggcactctttcctctcctttggcttcctctctcatggctccccccaacccaacttcgttttccttacagtgggcggtctcatcgccgtcagccatcgttctctgtcgctttcgctgtcggcattcagcaatagttccatctgctgattgcccctggcattctgcgctaaagtgcacaatatcaggtgcaaattgctgctgctgctgccaatggcgtgcagtgcgcgcaagggaacgcgcgcgtcgtttgcctcgaggggttcggcgaagacgaagcgccgaagggcgtaatctttgcagacgaaagtgccgttggtccgccctttggtgaccagcaacagatcggagaacagaaaaagcatctgcaccacaacaaaaccaacatatcaatggtagaaatatgcaaatgattgaaacgttaattaatcacttaattaattaagcgctaattaatcaaataatacttaattattaattcgttattttaccaaatgccgcgttttcagtgcgctcgtcccacggcgctccaccaccagctgagagaggcgtccgcttttgacgagataacgcccgctggacaccagcggaacgcggcgcaattcgctgcctctgtagacgaccttcgcgtcgatctccaacagttgctccgtctgtgccattttccttgctccttcgttgcaattgtgcacaaacggaaaagggaagggaatgaatgtgccattgtctccgcttttccgcgccttcgcttgcctggttggccaaagtcagcgcccgcgtggcgacggagtgttggattttgtcgggatggagtcgttctcgaatggcgaaaatgagcagcggatatcgagtgattcgctgcataggcagcatcagaaaagagcgcatgtccaacccttggcattggcggtccgtctcgagacgctgaatacaggccaagaagagcgagttggacgccctgtttgggggggggggaagggaatatcaaggcaaatgccaaagaaaaattcaaacactgtgaccaacttcaacgccttgagggtcctgtcctggtacaccttaagcaatggaatgtaaatggctcaaattaggatgtgggcttgatcaatcacttggttggagcagtagctgatgtatgggctgaaatggcactcgtaatagtagcaaaggatgtcgcacagttcgctcagcaccaaactgtccttcagccgcgtctccaagtcgcacaaaaggcgctcactgcagtcgcgaatcgcaacaatattactgagaaaaagtacaaatgaatgggactatttgtgctaatatgaggaccacctgaacaaatgtttcctctcggaagtctgaaaagtaaaaaaataaacgagaaaatttgacagtaaaaaaaacagtatatattcattcacacgtaccgtaatgatggaacggtcactctttgagccgagcaattcgggcgaggacataaagtgggaaatgagaaaagagagcgatcggagataggaggcctcggaagtgatcacctggcgaaaaagcgatttttaaggaaaacccaaaaaaatcagccgacttcgaaataggcctcctgcaatttcttctgaccgtcgtccaattggtcgagaaggcccgcttctttcacttcttaaaagggaaagagtgcgaagtaattaatggaataaaattgagtattttaattttaaataattaatagctgtaattaatgtggacaattaattaccgggcaattcgcaccaaagtgaccgttgagagccgtatttgctgcccccaagcaaacgttcccttcggaccggcaaagtgttgggagtgctcggatatgaggagatacgagagagcgaatcagctgaaaaacggcgggaaaagaagtgaaagggcaaggaaaagcatttgggaacaatggacaaaaaaaaatcaaatttgggacctcttcccgaatcggcggacgatgaggcggtggacgaatgacgacgaatgttaacgacggcagaggaggagctgacacttgcgatatcagtgggatcattgcaaacgctaaaaaagcataaccaatcacaacgagcggataatcggaattgatggggagaatggcattccccggacccgctaggagatcgaccaatgatgccatcccattggggataaaccgatgatgccatcccataggcaatgatgccatcagcatatagaggatcggctgatgatgccatcccattggggataaaccgatgatgccatcccataggcaatgatgccatcaccctatagaggatcggctgatgatgccatctcatgatgggatcggccgatggacccgccaattaattcagagacaattcccagtagaagccttccgtctgaggcatcctcccttcctctgccgacctgtccgtctcctccaccttgtcctgctcattgcgcgtccctcgtccgttcgtcccccgctgttcttcccctccggcgatgcatttcgattggctgtcccacccgctgagttccgcgatggtttctaatcggagaggcgcaacggcggtagaaatatcgtcgacagtggtgagaatggaggagctcgggtcggaagcggaaatggaagctgagggagaggaggaggcggccagccgaagtgggtcagcagcagcaggacgaaggtagtaaatctgatagagtggctgttggatgngcaattgggaagagtacacgacggagtcggaggggcaccgctggggggaggggacgagcgga

SEQ ID NO: 18425 - DNA, 2468 bp, Heterodera glycines
agaatccatgaaaattaaatatgcgacgaccaaatgacagtcataagtaaagcccaaaactatgaaaaggggtgcaaaatcaaataagccaaagtgccaaggcattaattgcctaggtaattagtcattttcatccaaattgtcccctcccctcgtcgcaaaacccaccgtctttcaacgcattggcaaccgcccgctgtccgtcgtaaatggcgtccttcagctgcatgatgctgtgcctgttgggccctttgagcagcaaagtgaccgacttgggacttttgcactcctccacaaaagtgtatttgtcctcgccctaaagctgtacggtaatccatgttgtatgttacagtacaccaatgggacaaatactgtgacaaaccccggccaagcaacaacggcactgctcccccttaactcaccaccacatgctcataaacactgcctgcccagccgagcacatcgggcgtcaggtcgtccaccgaattgaccgcctcgccgccgcaggccaactgcagccgttccatgttccggcgcttggcacgtcgcagggccaaaatgccgtgctgcgccaacaaatccaacgacggcggatcaatgcccttgggggaagcggggattagttatttttttttaaattcgagagcattcccaaataaaacaagcacacaccttttggttaatcaccacaaagccttggtctccgccggcacagaccgtctccttcagttccacaattttcagcactcgtcgcgtgatgtattcacgctccgcttgcagcaaacgttcacgctcagccgccgtcttgtagaaaaggcccgaattgacctcactgaaaatgagggattcaattaaaaaacaaataaaaatccaggatttggcatttccatggtaaacaaaatttttgtcccaagtcgcttggcatttctagggttcttcaactctttcgacggattaaataaataaaatgtacgttttctcaaactccaacgaaacattgcatgtcaaaatgtgcacgtttcgcacactcttcggcatgtccgggtgtcggccgccgtggtcaagcacgaggccacggatcagctgcgtgtccgtctccatctcgtgttccatttgctaaaggtggaggacttttttacaaattcagtactttttcatctgaattttttggaaatgaaagaaaatcgaccaatatgaaacagaataaacccatttttgcacctgaatttcaatcatatgcaagtcgggctccgtgtcgttttcatcccgacgaattgccaaaacggcgtccacaacacattctgagaaatggggaaacaatgagtattgaaagcagtttccgacttttttttgatttaagtgtcggaacaaagcaaaaactcgttaattacacaacgtctaatcaaattttctgagaattttgtaagggttttatgaggttcgtttgctgtttaagagaccaacccgtgacgtggtcggccaacttttggtccaattttgtgcgcaacgtcgtcctggccacttcgatgagcagcggccggtcgataggcaacgtctttttggaggcggccaacagttggagcaaatggtcatgggccaattggaaaccctcggtgaccaaatgggggtggacaccctgcggtgaaaaagaatgaaaaatcaaaaaaatatcagtgacaccaattaatcgttatttaagcgagtcactaaaaagactacaaagttaaggcgaaactgtatttcgccgtccgaaaaataaaaggaaaatgccaaaagacggggtgtgccgtcgcgttttgtcactaaaccagggttggaccggattccggagtttattgggcaccggaatacccaacattatccgaaacaatccctgccacatacctcgctgacgtaattctcggcctgtttgagcagttcgccaatcagcagaacggtcgacgtggtcccgtcgccggtgacgtcgttttgcgcggtgcacgccttggcgatcagtgaagcagtcggatgttggatttgctgaaacatttgaccattttaaaatgaaggcggtattaaattcatgtacatgttttcatttttagagaattattttacatgcaagagaaaattggtcgagaaatcgtagaaaaatgcaaaaaatgagaaatttactcggcaaatttacgtttgccaaagcaaaacaaaaaacacaccatttcatggagtaaaacattgccgtccttagtcactttaaggtcacccgaaccggagacaagccttaaaaaaagaaaagcagaaagtttggccagattaattgttctcgaaactttctcacattttcagcgtgcccttcggcccgaggttggtcttcatcacttcctgcaaccctttagcaccgctgatgttcatctccagtgcggccgcgtgccgggccaactccgcttttgggttcaaacatgcgatggaagccatttaacaggtaagca

SEQ ID NO: 18426 - DNA, 213 bp, Heterodera glycines
cccctttctccctctatccctcccctttctcccctctactcttccccctttctccctctatccctcccctttctcccctctatccctccccctttctcccctctatccctccccctttctccctctatccctcccctttctcccctctatccctccccctttctcccctgtatccctccccctttctcccctatacccctccccttttccccc

SEQ ID NO: 18427 - DNA, 1530 bp, Heterodera glycines
tcccctctatccctccccctctctccctcccccttattccccttcttgtctcgtgtcttctcctctcttcaccaaaccgatcacctggaaagcactttgcacttcggattggcacgaataagtggggctaatgaagaaagaaattaatatttttatcacagaaatgactgatcaattacgggcaagggttgttgggtccattgatggcacatctaaccgccatttttgaggacggatcgcgatactttgaaatgggacatttttttttgaatggataaccaatttaaccaatgctttgccgatcggacaaaggtctgtagtgaatattttgtgatgaattgaattatggccttaacaaaaagcacctcctgaaatggacgcgcagcagtaatagcgatttttgggcgcgttgaaacggcacaaataattggaggggcaacttccgtccacattaatgagacactcgcgcacactcatgtccaacgcgttcacataggccttttcaccctcgggacaaacgcctgaggggaaatgggaaaagaaaaagccatgaggaagagggaaagatgaaatatccaaggggaaatcaaaacggacaacaccaataccataagaaataacccacgagaaatgaagcaaatccactgaacaaacccatgtttgtggcaccgcagcagacgctgttcgtggacaaagggtcgtaggtgcagacaaagttgttggggcagctgttgctcagcgcggaattgcactcgaatggcaactgaaaaaggtgccgggttgagagggcaaatgccaactttggggtagggggtggggagggcgacctttgtgtttgggttcacataagccacgtcgccgggagtacaagcggccgaaaggcaaaaattgttgcactgttcgatggtgccgaaattgttcaaattgccgctgcatccgttgtaagtgaattgggtgctaaacattcataaagcgaacgaacatctgtcaatttgtgttatgaatgaacggaccgaccattctttggtgacaatgttaaagtaatagcgagacgaagcggacgaactgcaagtggcgccctgctgaggcggcagggagcaaatgtaagctgagggagacacactcattagtggccaattacgctaatgagcacctctggtgggacagcagcggttgatcacgcttgtgccggtggtcaccgaagtgcactgaaaccatttgtgagccttcaacctgtgccgccccccgcccacgttcccttggaatggcactcgcctcgtgcgtggatgggcaattaactcccgtcccacaaacgattaattgtccgaattcgtttctctccggcgtccctccgtttgggcatcccccgactccgcaataactctgccattggtttctcattttttcttccgttctctcttattacctcacaatcgtcccttgtcgcagaaattattcgaatttccgtcgcatccgttgtattgataagaagacgcattcttgcgactgcgaatttaaaagtagcgataa

SEQ ID NO: 18428 - DNA, 3319 bp, Heterodera glycines
  misc_feature (46)..(46): n is a, c, g, or t
  misc_feature (134)..(134): n is a, c, g, or t
  misc_feature (140)..(140): n is a, c, g, or t
agagtgaaattgtcagcaaaaaagcggtaaaaattgataggacagnaaggcaatggatggcagtccggttataatcgaaagagtcttttgatgcaaaatcaaactgcagcagaagcttaacagataaggagtcncaaaanttcaagggtatgtaagacgcacaaatacgcatctcagagcaaaagactggtatacagtaaaaagcctgtttaggctaaacccggtaaatgatgtagcatggtcaatgaccgacgaatcagaagacgattcgttcgataaaattgctgttgagcaaataaatgaatcaatgaaaaaaattcgcgggaattaagccagacaacgtacaaacaacacataatgtgcacagaagccaaactgaggaccgagatttcgagagaaacttcggattcccaaaaggtcagtcaagaaaattgagaacatttacaaatagcaaattcacatttgggctattgagcctttttatgttgttgggcgtaaatttatgtcaaaaaccaatgatttgtcacagaaacgtgccatcaagatttgtcaaaattggtcgaaacaatagtgcctgttcagggatatctcaaatatttgaaagaggtacaaaaaatttagaacttacattgtatcgtcctgaccaaaaggaatacaccttttgggggcatcaatgtttactccttaaacattcggtccaattttggacaaatttactgaatgatccattcgacatcaaaagtcaagaaatgatgccgatttttgccgaagaatgccaagaaatctccaaaaccaaaaaatgcagattcggcattctagtaggtgactcagacggtaccatgataacagaaaataaactcatttatgagcattatttgtggtcttggggtaaaaagtctgttgagacggttaattgcatagtcaacaatataacaatcattggatatcccggatcccaaagaattgattcgattgtcggagacctccaacattgtcaatacgacgacggcagatgcagtttacacgattcgattgtagtttgggatgttgatcggtatcacacatctgaaccatgggcggctcgacacggacattgcgtttttaaaagtttttcaaagaaaaatggaaccatttatcgaataggttggatcagtgacccaccggacttagccctaacatttggggaagatccgacatttattacttcttgtttaagaagattggtagttagccaacaaggattcgcaatcgaagaaagagaatttgaaaaattcaaccgacaattggacagaactcgccggaatgttaattctgatgaaccgttggacggcgaagtccgcacatcacaattagatgctcaactcacagcacgttcgatgtttgcagataaagaaatgagaaaagtattacaggcatattttaaacttatttgtgactccatttttggctctgttttgagcactgatctgacacatctcaatccgaattttttaattcgtcagctttcgaacaaccagctaatcgaagcagaatggatttcaaaaaccattttaaaaatttggccatgctcaccaatttacgaatatgaattcgcgaaaacaaaagaccaatgttacgaaaaaattccagttaaagtgactttggttaggaaagataagccaattttggcttttcttgacccaaaaaattttataatcagtgcggaagctaagaaagtcaattgtcaaattaatcgatacaaacatatcgtattggaaggtcaactttatgaaattgaccaaattatgggtattaagagtcctgttaaggaaataagtgagattgaaatcagcaacaaactttggaaatcagctgtaccatcaacatctctgcaaatctttcgtcttttaatcataaacaatttgacagaaacacaaacacaaatgatgagtgaattaaaagcattaagagcgagtttttcggaatttccgttagattcaacttctgtgcggggagggtcgagtgagtcaagtgaaaatgatcactcgaaatttccagttctggaagtgaatgtcctgaaattaataggaaacaaaattttggcatgggaaaacctggtcaacctggtcatcctgctagttctagcagaatggggggctggaaagtatatagaatggtgataggaaaatggatagagttagaggtaaaaagggaagtaaaaagggcaaccaaaaaggaaatggaattaaatgaattattgaaagggaaacaagaagggaaaatggaaattccctttaaggaatcggacagtggcggcgattctgaatttgcagcggaggcagttatgccaaggagaaaggtacggaggactattaagaggggtcgccaacagtgaaaatcttctaaagcgctgttcagcgatattttcgttttttggtgggaatgtcgaaaatcgctaattctagcaattttcgatttatagatttctatgctttcttttccgaagaaagcatagaaagggggttctctcccattggtcaactatttcgcctggctgtttagccggtggttcgccgcgggctgcgcttaatgcattcatccccttattccccccccccctttttgctttcagccgtacaccgcctcagcgacgccttcacaatttgctcttctccaccgccgtcgccccagccgatccaatcgtctctccgcttacagcacgacggcggccaaacacccccacccccttccttggccaatgcactgttcgtttgcccttcgactcgccactgttccccccgttcgcttgtcttccccctgccactgttccctcgctcgctttccctcgttcgctctctgcttatcgccgcgtcgtcgccctttgtcccgatgatgaccggccatcagataaaacgccattctcaccatttcaatttgttgcgatccatccgcccacatttgtctcttcttcgttttccccccgtttttgcgattctttctttttatttttgctgaacatttaacaacaataaatttgtcttacaaatttcttgtggggagggaaaactttccttgcctaaggcacgaaaacaacaccgagtttctgcccccttaatcaattcgaatcccggggatcggggaatagcctattggtttcggcacttcaaaattgcgggactccccctcccgctgatcggaacaattttctgatcagtcccaaaagactcaaagggacaaattcgatcaatccaattttggactgatcagttgtgaatttcgcctcatttcaatttgttgtctgattggctttttagccaggctccgattgccccatcggaaa

SEQ ID NO: 18429 - DNA, 2887 bp, Heterodera glycines
  misc_feature (9)..(9): n is a, c, g, or t
  misc_feature (2788)..(2788): n is a, c, g, or t
  misc_feature (2798)..(2798): n is a, c, g, or t
  misc_feature (2808)..(2808): n is a, c, g, or t
  misc_feature (2859)..(2860): n is a, c, g, or t
tatttatanttgattttcaaaaagcatttgactcagtgccctatgaattacttttatacaaattggaaaaaattggtataaagggcaaacttttaatgtggataaagggctttttgagtaataggacttttcgagttaaaattggggatactttatcctcaagtaaaaaagttacctctggcgtcccccagggctctgtcctgggccctttattatttttgatttatattaacgatcttcctgatgccttgccatcaggagtgaaaataaaattatatgctgatgatgttaaattatatatttgttataaagcaagagccgacacggaaattatgcataaagcattgcataatttattcgaatgggcaaataattggcaaataaaagtttcaattcaaaaaacttttgtattatatttgggttccaaaaacccaaaagaaacatataaatttgatgggaatacaataaatgctgtgaatgcaattagggacttaggaataaatattgataataaattacaattttccgatcatgttaaccaaataacaaggaatgcctatttacgtatgcgttccttgttttgaataattaaatccaaatcatctaagatttggattacgttatataaaacctatattaggcatttattggaatacgctccggaggtttgaaatccgtctcttcaaaaaaatattataaaaattgaaaagtgtcaaaaaaattcaccaaaagggtttttttaaatgcagccttccgccaattccataccaaaatcgattagaatacctgcaactgccaacacttgagaataggcgaaagctgtttgatctgttcatggcgcataaaattgcttatggccgaacagatctgaaactattttctatttttaatccctcaacgcgctttaacatccccttttacagatttaactcaaaatataaactgggcaaaaaattcattccctttgctgggagggtaacaaaattgtggaatcaactcgataaagaactaataaaaacaaattctttaaatcaatttaaaataaaacttaaaagttcactagggtaatctgtaagaccgggaaagttagaatgtaattctcgcccttctgatgacttttttattttttatgaataaacaaataaataattggagggggcattctaccagagaggggcattcaaatagcggatttacggtaaattggtttttttatcacagtcatttcataggttttgatggcccataactttttccaatttcttttttatccaaaaattccttcggattcatgattagcagaacgtgaggaatcgattggtgtctatttggtcgcaattccatgcgtttatggctttggatggttcagtcccaaagccatttggccatttcagtcccgggtctgtaactcttcagggattggttcccgcagaaaaattctttcggattcttcaattacagacctagaggaatcgattgatatacagtcaggtgcaaaagttttgcctcaaaaaaatttttttttaactggttttctcaaaaatgaatggtgaaaaaaagtcttatttacgccaaataaacactaattacagtgctaataaatagccaaaaactgccccgataactctctttgtcgacgagaaaattggtcatgatccaattgaccccacattctgacggtgcaaaagtaatgcctcaaaatgtttaatcgaccaaaactcaattttttattatgataaaattctgaaaaaatctctgttagattaacttttgatgctgatcaaaaaagtctcttacaccaacttgatcagatcacttcttcacggtgatctgaaaagacaaaaatggcttgaaatcgggaaaattttagaaaaaaattcctaggggggttaggaaattttttctggaaaatttgagtaggcctaaatttgtgttcgacaagcaatgcgtaatgaaaacgaggtgcagctgcttttactgttgtgaggagaaatacgcaaagaattgccccgacggatgttacaactagagaccggtaaaaaaaaatttccgggagcgggagcgggatcgggagttcaaaattttacgggacgggagtcccgaacgggaatcccgttaaaatcccgtccatttttaacgggagtcccgggcgggagtaattcgaaaatttaattaaaaactcacaaaaatatttttaatgcacaaatttgaaggacaatccttttattcgatacagaaaaattagaatatgcaaaaagttgaaataaaaaaacagattttagggtcgaaaatcagaaaaattttttcaaattgctgaaggagaaccgaataattgtaaatcttttttaaatcttaattgtcgaacaaaagttaaaggagctgatcataatgattcgaagctaaaattagttttttgttctttaagtcagagttgatgcaccaaattcggctagaacagccaatgctcttagttttcgagttgtatgtccaagagttaagtttaaaacgaataaatagacgaaaaatagaaaaaaacatttttttaatgcaaaaataagtaagggaaaaaaagtgagtaagaatggcaatgccaaatgagaaaacaatgcgcttgtgcagcatataagctgcgtcaatacaatttggactcaattagagataagacaaagatttggtaatttgttgagaacctcaaaatatgtaaataaaagtccaataaattattttcataattttccaaataaaattgagtcgcattttcaaattttaggaaaaaatttaaatgccnaacttatganagtaccattngatgcttctcattgtcagttttgttcaattcaccatttccttcaaatgctnnttgtcagccaatgcttaacatggaaat

SEQ ID NO: 18430 - DNA, 3008 bp, Heterodera glycines
ctaaacgagaaattcatcaagccaactctccggccccccacgatgttgcattggtcacatcgaacacctgcaaaaaacgtgatgacatgacaatgaagaaagcattttttgaagcgcataacctccagaaaaatggcacacacataaaattcaactttctgtttttttgattattattgaattaaatttttaataaattgtgtgacagaaaatctaaaaaaaaattgtcaacattttttttcccagagattcgatgctacaaaatgagtttatggcatttatttgactggcccaccaaaatgcacgcgtccgagccccggtagaaagcgttgcccaacgattggaagcgctcctggccgcacgtgtcccaaatttgcatttttacttcggtgccgtccacggtgatggttttggtcaggaaatcgcagccaacctgaaccagaaagaaggaaacgattttgtatttaagtggaaatggcaataaaaccaggatttgaaagaatgccggaccaggaaaaggtttaaaaatgggttggagggttaaaaccatgctaaaagagggaagatcagttgagcaaaacaccaacaattccagacaaatcgggactgaattagtggcagtttttatccgggtttgcgtcggaaaaagacaaagataaatgaatactaataaaaatcgaattcgcccggacttcggggaggtcccagtcattcgtactgcacttaaacatttgcaccgaagagcagtttttaaaaagaataaattaccgtcgctttgtacgcactgacaaactgtcgattcacatattggttcataagtgatgatttgccaactccagcctcgcctaaacagatcagaggcaattcatttgaacaattcattgttttggactagagtagagcgggaccaggacaactgagtactgaaaaaacgggacaactgagtacctgagtcccggttttgaccgggactagtcccggttttcccagccaaaaattcccggttttcaaccccaaaagatcccggtcctggctttgcccaaaattcaattcccggtcccgctctactctattttggacagaaacctaacaaaatgattttcagcaacactttgcgtcgatcactcatttccaaaatgaagtgtattccgtgaaaaagctgaaatatgtaaagggtcagtgtcttcaatgatccttaaaaaataaatcgttctggcattcttctacactttgtgttctcttcccctcactagaaatattcattttaatgggatttaattttaaagtgctcacttttcaatttttattcaaacccaaatcaatggttaaaaaatgttttaaaaaataaataaattttaagaataacttattcctgtataatacaacagccaataattgagaaaaagtcaaaatgtttcgacgaatttatttgaataaaaaacaatgagaaattatgcaaaaaataaccatctatgtaaacatatcaaaggtcacacaaacaaaattctaatcggcgcaccgtcaaacaatggcaaatttcttcagccttaacacatcaagttagaagcattgaaaagcattcaaaatttagcacctcaaaaatggtggaaaaactgctcactaatgggcacagcaaaagcgagttgagtgcccggatgagaagccatttcgctgcgtggctgacgagagtttgtcgaacactcctaaaaataaagcagcaagctttggtttaatgaagaaaaataccgttcagcctaagcaaactgcccattttttcaaagaaatgaccgaagtcgtcgtaaaaaatggctctcagtcttttttgagtaataccaaaaatcaccttcaaaagttggtcgggaaaggcgaaaatggcctccatcttgacatagtgtgcgtcttgcgtgaccaagtgcttcacaaccaaatgctgactgtcctgacgcacaactgtcccgtggcacatgccgagtttatcatgacggaacagcacgaactggccaacagtgaacggcggagaaagtggcggttctttcagagactccaacaaatcggagtaagcgctaaaaaggatgaatgcatttaaaaagataatgataaaaagaaactacctcagcacagactcaattttttgcccacagaagtgcgtaaattgagggatgtcatcagcaggcttgggctgataataataataataataataaaaccagggcctctttcgcaatcctataattattttctttttgacaaaatttagatttcagaaagggaaggaggtggattctgctttgttttttatctgctcacagttaaaatatatggactagtcttcaaaaaacagaatttccaaaaagttagatagagcattttacttgtcctccgccaataggcttccgtgctgttgtgtccacggaatgcgccggagatggtacgttggacggcggttcccttttgatagacgctgaggtggagggacggcttggcgctgaactcaaaggaggagaagcagaccaaaacaacgaaggatccacgcagttgcctaggaaattaattttaaatgaaaaacaaattttgcgaaaaattcatgcctgtaaggcatggcaacaaattgactccgtaataattggccatgcgctcggtgactcgaaataatcccgggtaggccgcctttgagaaggagtccttggcaatgcgagtggcggccggggcaccgagaagacgatttcgctacaaaaaaaagagtattaaaaacgaacgtataattctttacacctcggtggagttcaaacgggtgccgtagttgtccgaatactttttctcgagtagatcaatcttgctgaaagaaccaccgctctgccggaaaatgtggatgagacgataaatgccctcctgaaaatgtgggtgagattggttagcaattaggaaaattccagtttagtgaattcaaaaacgtgggtacctatcaaagggatctggatttttcggggggacccccccccctcgcaaag

SEQ ID NO: 18431 - DNA, 2170 bp, Heterodera glycines
atggtgtaaattattagaagagatgatgtaaccgtaccacttgattggttggctcattcacatacataactaataattatatttactttcaaaatgtaatttttattatattatcttacattaaaaatatctatttttatttatgataatggttcttttgtatattataaataagaatatacatatataaatttatttcataaaggtatttgtctattttagagctaatatcattctgcatatctttttttaaacaattttacaatctcatgagttgtcttttttattctttttttgcttttttatttatattttttaaagaaatataactgcttaaaataaatcatttaaaaattaggatagtattgcttttaaatgaggacattctgttgcaaatttttattttatacattaatcctttttgaaggagtattttattaatattttttaaatttaaattaaactattttaatatctttcaaaaaactcttattattcatttaaattgataataattttttggttgtttataattatatgtaattttttatatattaaaatttaaataaaccattattttatggcctctttttattttggcattttttttcttgtattgagagggtccaaagatttattaaatttcttccatattttatttaatctgttttttttcaaaataacttaatattttattaaagtgtcgaatatagttttgtcattgtggaccacgagtgctgcgaggctaaagctgtacgagtacatggagcaggtctacaagaaggaggggtgtaaactgctctattgtgacacaggtgaaaaggaataaaaagaaaataaacaccaaaattttagattctctagcttttgctcatcggaaggggcgctgtccgttggtggaggggaaatttttggggtaaaacataatttttgaaaattttctataaacatttgtttagtgagatgactcgagagtatgctgacagcgaaattttggagtttgtgtccgcgggtccgaagcagtacgccttgaaacttagaagaaagaaggacggtgtgatttggcacaaaaccaaaatcagagggatgacattggatagacgaaacgaatttaaatatgatttgttcaaagagatggtgttggattacaagaaaggggtcaaaaaagtttttcactacccggagaagattgggccgacaaacgacttccgggttctctcaaaagatgtacaaaaagaatatacgccggtgcagaaaaaaggaattattgacgatcactttaatgttttgccctttggatattattaataatttttgttttgataattttgtctcatgtttataacatttaatattttaaattaatcaaatttgtttcttttttttagaatgtcaaagaaaaacttccaagaaacttcaaaagaaattcgccgctcgaaaaatacaaaaaattatttcaagaacagtgctaatttgggaaaatgttttgaagaagtggagagtcacataaaggaaaataaaaaatttgggataaaagagcacgtgacaactttctattttaaatgccccgaaaatgaagatcccgaaaaaatgtttaaaaaaatcctgaaaaaattaatgggggatgcaatgagccgagaagatgagccgggctggaaaattgagaagatttcagtggacctttattgcagtgccctgtcagacccagtgatcatccctgcccgccccttccaacaatcgaacccagacattgttttcaatgagttcatgcacaggcagcaatcatttggggaagtgaatttgttagaccagagaatttcaataattattgccacttattctttccctgttaaataaaattttttcatttttccctttcattattttttgttcattccattattatttattcgagttttttttctttattaatttttcagttaaaatgtattcgtttcaaaaatattttgtggaggctctcgaaaaagaagattttttctggcagaaaaacagagcagaagtggaggcattgttaattgaggcttcaaattataaaattataatacacagagactacgaaagccgctattctgattatattgccacctatcgccgcaccccactcttctgtttctgcatgattgagagaaatttaagatttttttacgac

SEQ ID NO: 18432 - DNA, 575 bp, Heterodera glycines
tttcgtgaaaatagacgaaaataaaacaaatttattactaaaaaaaaaatggaaaataaaagtaattaagtattaactagtgaaataaaaataaataaataatattggtgcaataaaagaaattttaaaacaaataatcggtctatcatattttttttttatataaaatgataaaatttaatttattcttcaaaattaaaagtacttaaaaaataaacaaatattattgatgcaatgagttaatttttgataaatattttattacacaacacatgaaaataattaaatttatttggaaataacatttttttattccataattaattataattcttcatttttgcctgtcctgctggtggtggcataatgtgccgattatgacactgtgtcgttgggtgatgtacggcattggcatgcgaccgtggtggtggtggtgctgctgtttgatgaagcagatgtgtgcttgaaacatagtgcggcgttgagtacaacggttgtgaggaggagctggtggtcctgcctaattaaaagcttttaattaataattgaatatttaataaataattgaatttttt

SEQ ID NO: 18433 - DNA, 1816 bp, Heterodera glycines
  misc_feature (1777)..(1777): n is a, c, g, or t
gctgcggtccatcattttcgccccaacaaatcccgggcccataccgtcgccgtcaaatggcacggtcagctgaatgttttcggcacgaatttcggcttcatctcagacggcactttttctcccccgcttttcctctacgtctctgtccctttcatatttcccatgatctgtctcactttgtgttctttctctgcccatcatattcttgttgttggtgcttgtgtgggcgttcatctcctccacctcctctgacgacgcgtcttcgcatggcaccaacgcgtactgcgcctcgcacgcgcgtatcgtacttaaaaaatgatgataaaataaatcaatgaattagtttattgattttttatcgaatagatcaataatagggagctagctgttcattggcctctgcgcaggttagcagttcctcccggacggcctttgcgtagcgagacacttaaggggcaacagaaacttccccccccccccccccccccggcgtcgtttcccccacccccatataaattggcatgcgcaaaagttttataaaaaatctaaatcttagaaattaaaaaaaaaaaattttttttttgtgagaaaatattttaaaaggattgaaaaaaaatttctgcgatttgttggaaaatttttaaaaatttattaactcatcataaaattttgaaaaaatcgctagaaaacaatttattttttaaattttttgtacattttttggctacaaatcacgtaaagataagctaaatgcaaaaggaaaagcttcaaggagaatcattgaattttcaacattttaataaattcgtattaaatttctttggcacttcattgataattcaaattggcgccattgcgcgccatttctttggcattttaccattttggatcggtgacgatttgtaagtcccatttggcagggttgaatcagcctttttgaacacaagcacttgtcgagcgggcaatgccaactccaagcagagcagacaaaccttttttttaaatggcattatgtttttgaaagtgccaaatttgaaaaagtgccaaccaaatgtataaacactccgccaaaccaaacatccaaaagggttgcagatgcttgtaacgggagcacagcatgggaatgttgatgctgtcataaattcaatcaaattcataattaatccaaataaaaatattatttaaacaatcattattttaaaattgaaaagaaattaaataaaattgaaaatgaattttcattcctttaaatgtatattttttttaatcggaaaatggaatttttatggaaaatttttatgaaatcttttatatattaaataaatttgtaaaagttaaagatttttgttcttttaattatcttttttttaaacaaaaatcgaatctaatttgtaaaatttaaaataaaatttttaatttttcttttaattaatatcttccgtacaaataaaattaaattggccaacagagcgcccattgtgacgatcacttggatttttcggcgcctccattgggccaacagagaacataaaaacagaagaaggctgggcagataagctgagacctaatctttggaaaattgtttttttaaaattagtagctccagaatttaaaaaaatttgaattaaaaaaaaaatttttttttaaagaaattatcaaattttaagtgattttgtaacaatttttttgggggattttcctcctacctatttccctttggttttatatattttttttggctttttttaaatttccattcgtgaaattcattcgtctngtgagtttaatcccagaatctatggccatcaaaaagcac

SEQ ID NO: 18434 - DNA, 2090 bp, Heterodera glycines
gtgaaaatgaaaatgctaaagttcacagtttttaaacataggatgaacaaaaatcaatgctttttgcaattggcaatttgttcctcggatttacgcgaaacaatccattcggaagcccgggggaattaaaaaatatgctaattgactattcgaaaagcgaatggtttgaacagaacaccaatgcaatggagacggtgctgcaactttggcagaaatttccaaagacggcactgctggttacggtaatggcaagggaaatattgtagtggtgcttttgtgccgaggacaaaacaatgatggcattttcatgaattaaaggcagagcgattatttatagtgaaaacgaaccaatatgtattatatgaaattaattttagaatatgttaaatgtcgacagaaagaaccgtttaacagccaaagggattttaaattatattaaaggatcatgccaaattggagagttcagagaagtcaaaagttccaaagatttgcgaatttttaattcagtgaagttcggcgaatttttaaataaactgcgaattatcaaactaaagaataaagcgaaatgtttgattgaaaagtatagggaattgaatggaacatacaaaaaaataaagataatggtaaagaaagtgatcgaagagcaacaaatggaaatcgaagaaaagaaaaacccggaaaaactcgacgattgcgaaacgaattgatcggcggaaaagcgaagcacccttcaaaatttatctaaaggatttatttgaagggagtgagggcaaggcatgtgagagggggcggcggacggacggagcctttagaaataatgtcgagagtgtttgtttttaacgtggattttattacaaaaatttcctttatttctaaaattgaataaaataaattgagcactgcttccctattaattaatataaataaattttttagttttttttatttattaatttattacaaaacaacacttatgccaatgccaaaaaacaaaaacaaatttaaaccgcaatttttgtcttaattttttttttttttttgcataatttgcctccattctctgttcagctctccgccgcgttcatcctcacctgcaccttttgttggccactgattttgtgccgaatacgccgctagcctatcgcgtgctgaatttgacactgatcatcaagaggtaaaaacaattttcaataattttcaagatcaatttttcccacaaattcaattatattggaatccatttttaaattacttttctgactcacttcccttccctgatcactcttttataactctctgatcgttttttaactccgctgatcactctttagctactaatctctgatcacgaattgactctctctgatcctttttgtcctctcacccctgatttttatgagaaatttaacaattcgttttgatgctcgattaaaaaggcaaattcaaattaaatgattgtcaaaattatgccaacttatcaaaattaatcaattaatttaaaagatctgacttattttccccaaaagcctcaaaatttcccaaaaaaccacaaaaagcctcaaagcctcagtttgaaatatgtctgtggaatttggaggtgaatgattaagagatacgatttttattttttttaaccaatgttctgacaaatgagctcctcgtggcctgaaacgcatgaaaatttgttttggaaaatattgatcataggccccaaactcaaaaatgctttaaaacggtcagaatcgatgtaaaaaggttcgaaatgggttggaaaaatagaattaggggcgcgcttgccctttttcaggctgaaaaagtgccggaattggagtgccaaactcagctgggactcaagtgaccgcactataaaaagcactcaaaagacattttaaataatttttctatggtaatttttggcgctgatcacgaatatgacctttattttgcaaaattccaaaccccgaacctaaattcgaacaaaaactcgaaatttataaattaaaataaaacattattaaggggttttgaggttgctgaacacggttatgacgtccattttgaccaaatttgaaccccgatccctaattatg

SEQ ID NO: 18435 - DNA, 3311 bp, Heterodera glycines
  misc_feature (1712)..(1712): n is a, c, g, or t
  misc_feature (1736)..(1736): n is a, c, g, or t
tgagaaaacatttcaaattccattttaaatggagtgaaagtgaaaataataattatggaaggaagagacacttttcgaacaattaaagaattttaattagtttgtacacatatcaaatcataaattcaaatgatcgggcattggttatactaacagacgatggcataattagtttcacttatcattgagctgtttcggttttacctcggatttgagatcaaatttaaatgcattcccaaagctcggattatttgggcagttaagaaatttcggagaatgccaaagtgttgttttgctgtgctgattggctgattcaccttcccatttgttgtgttatcgccctaactgatgaccttccatttcattcttccacgcttaaacgatgttttcgtcctttgatgggccttttgtcgccacaacgaatcattagagagtttagagagtgagtgaagtggtcatcagtcagtgtgtctccctctaacttctcctcccctcccctcgtctcccctttccctccccctcttttttgccctctttcccttcgtctcccgctttcgctcccctctgatgccccccccccctacgtttccccttttccactccccttcggctcctgcccctgtctcccctttcgttgctccctttactctcgaagccccccccctctcccttcgcccccctccaaaatcgaatttgatttcgtttacttggcgcattccccagaggttttccgctgttttggccgtcacctttcgcccaaggcgcggaaatgtgtcatcatcagtcggcggaaccattcccgagacggggaaatcgcaagagcaccccaaagacgggggaaagaagcgatttctgagaaaataatcatccgaagagattcttttgtaacgcaataaaaagtcggtcactcattcactgactcttgtctttttgtcttttgtgctgcgatgtctcaaaatgaaaatcaccaaaagcggctaatgcccttcccctttcattcgttcgttaattagcctttttctgtttgttaattagcactttttccgttaatttcccctattttccccccaaatttccatgtttatcatttcatttatatcacagttttttattattttcttccttcacattccatcccccaaaggaggcaatgttttcggcaaagtcccaacggagggcgtgggccccccgtgccgccctcaacaacggcaccagcaaaaatggcactaatttcggcgatcgtcgctctttgccggtgaacacttcattccgtggcacttacagttggggcccaacgaatggaaaagcgaaaaacgccgtaaaaggatccaacggaagcgacactttgccaatcggtgacaattcgccaaaagaggcgtactgtacggtggaggaaatccaattgggcaaaaggcactcaaaatcgccgataatggacaacggaatgggtaccacaagacaaattcagtggaggcacaaaacggaggagggcgaggggaagtccgagcagggacaggacgagctggaggagaaccattacgaggacggggacgagggcgaggagagaaacagcggaggaagcagcagcagagagcaagcggaaggagggggacggcacgggaagggcacggcacaaatggccaaggtgggccatttggccaaataaatattgacactgctgtcgagctcattccctattgtatggcataatnttgcaattgtttaggccctccccncacgagtgccgcctcttccgccgccccttccgccacccaaactttttgggaatggaaagagcgagatgaagccgaggccaaagtccaatttgacaagggtaagcccgcttggcttatccaccgcaggtgttcgctaacggcatttctgttcagttttggcccgctttggcatttttggcgttctgtctgattttgttgtccatcgctttcctctctctgtgggtagccaacaacaacagcgaaaagaggcacaaaagtcagataaattggccactgaggctggtgccggtgttaaagccatcgtcgacgacccacgcgacgacgcccaaagggcggggaaaattaatagcgcaaagagaggaagaaaatgaggacgaagggaccgatgaagatggggaggaagagggagcggaaaagggagcattggcatcggaggaaagtgatcagcagtcgaagggagcggcggcacggccaatgcaatcggaaacaccggcaccgcccgagggcacaacggcactcggcggggatcagcagcagcagaacgcggtggaaagctgctcacaaatcctctgttcatctgccaaagaaaacgatcaccaatttgtggcacaacccgaggaattcgtccggtggattgccgacggacagatgagaaaacggctgcggttgttcgaagttcgggaaaggaacaggttagcctgacagaagagagagaatattctgactattttcattttgcttttggccattctgatcattttcccctttcttttttagtcattctgatcactttctgctactctgatcacccccccccccattccttttcattagtctaatcactttcacttattttgatcacttttctttcccattcgatcagtctgatcatttcggctactctgctcatcacctttcttcccctttgatcactttcagccatcctccgacccccgtggcattgccttcggccaaagtgcttcttctctcctctctgtcccacaacggcgtccccgtccatccgttgcaattccaacgacttttgcgttctgaggaggtcgaccacggctctgttgtgctcctttacgacgtccaatcatcacaacaattgtgggcccattatgccatttggatatttcgtgttcgtttcttttgtttcgtttcatttttcctctccaatttccccccttttcagctgttcggtttggaccgttcccttttgctaatgggtggcccaaattggtcggtcaatggcacttccctggccaaactgctcgagggcgtgcccttttccccggcgaatgctttgcccccggggcatttgtcctccgtcggcacttttcgtgcgcagtggcgaaccgaattcattacaacttttgacgatgttttggcgaattttgagaaggaaagcgcaaacgcaaaggcggacattgttgacgcacaaacggacaaagtgagaaaatgagggcaataggccaattatggcagatttggaagttcaaatggcctatttaggcacatttgccaattgtagcacatttggaagtcctaaattgactaattgtggcactaaaa

SEQ ID NO: 18436 - DNA, 835 bp, Heterodera glycines
ttaataaaaccgtccgaacctttacattgacggaacggcctctcggtgcacagaagacagctcaactggacgagggccaacgacggcgaaagggaggcgacggaagtgttcactttttgaagggcaaaagcagagggagaagtccaaccgagaaagggctgaaaatggaacagtaaaaagcattttgacacaatgattctcgatgaattggttttggctaggctcagattgttttaaattttgaaacaaatactcaatttttccttaaatttttttgactatttttccaaaaaatttttcaaaatttgataatataaacgaaaacttttaaaataaaagatggattccaatgtcgaacttttatcaaataaagtctaaaaaattgcgtactgtccgcgccgcctttgccgccgcgttgcatttggacagcaaacggtggcgttccatggcgggtgcacaacgcgtgacaaaggcacagaaggagcagtacctgccgtgaagaaagttcggtcaaaaagaacagattcttatcagacagagaattgttcggtgcaacgggtggtccaaccatggacggactcagggggagggttttgaaaaagttctcatattttcccggcgacgcccaattgttagaggctttggcggcaggggtggagcgcgaccgcgagatttttttgcacgatcctcgaccgcggcaatttgaatccgcggtgcgcgacccgtgggatttaagcgcttagcgccatggttttttagaaaaaaaaatttttatagtttgtaaatgataaaaaggtagggttcgagccccgccccaggggacgggacaggtttt

SEQ ID NO: 18437 - DNA, 1346 bp, Heterodera glycines
  misc_feature (1309)..(1309): n is a, c, g, or t
tgccgccgcgttgcatttggacagcaaacggtggcgttccatggcgggcgcacaacgcgtgacgaaggcacagaaggagcagtgcctgtggtgaagaaagttcggtcaaaaagaaattttttttcaaaaatatttcttaaaaattgctaaaaacttttttccggggaagggaaacgagctggtcccccagggacaatctcatggggcgggggcgggggggggcagtcggtttccgcacccatagtcgtcagggtgcacttcattcccccgtcgttccgcctcctcccgaaaataaaataaatagaaaatctttcctaagaaaatcaaaaaaaaatttcaacgatttttgcaaaattttatgctgacttatagagtttttcaataatttttccaaaaaatcgcagaaaattaaaaaaaaaattttttcttgaaatattcttaagaaaaaattttggatttttttaaatttctgttttgaaattttttctcttgaccataatttcaaacaatccttgactttctccccccccccaccccgctcaaacggaccgtctctctttgccgaggtgccgggccaaacagcgcaccatctgtccgcactccacacattggggaatacccaagtcgaaggtgaccaacgcgcggcttttgtccggcaccaatgctttcaagtctgaaaaagcatgagaccatcacccatattaatgcaattggacaaatgacaaaagcggaaaatgcttggatttattcttttgtatcgccccgataacccacaaatggcaaaggtatagattattggtccctaaaaatttttttaaataaaatttgagaaaattgtttttaggggtagtcttaggcgccgagcacgaatccggcattattttggctgtttcgaaccccgaaccaggattcgaacatttggtatactgtcgatggtaccctctttcttgaaaaattttaattttttttctaaaaataaagttgtttcggggttttcagggtcgaagaacccgattctgacatcaatttcgaccaaattcgaacccggaacccagattcgaacaatagttcgaaaatataaatttttcaaactttacatttttggttaaaaatacttagggtggagcataatttttgatacccaaattttttccaattttaaaaaattcataactccgttatttctgcgcctatttaaatgattgtttttttattttgttcttcatggtgtcctcttttatatcttactatcgtttcactttttatttgattgatagatttttctgccttttttccctgacaatgccanaaattgaaaattggctaatttttctcagaatttttta

SEQ ID NO: 18438 - DNA, 2119 bp, Heterodera glycines
ttttttatttttggcttggcgcctaacgtcggcgccaaaacgaccctggcgccaaaacgtcggcgccaaaacgacctggtcccacagtggggcgtacccatagtgctcctcccaaacatttcttttacattttctatcattttccattgaatacggtagaaattaatcattttttgaattgtcgaattttttacgaactgtttctctctgggtataggtcatagagctaccatctaaaaggtaaacggtagagaattttgtgctctttccaacgcgcctaactcaaaattttcaaaaaatttttttgatggtttttcgagtaacgcccattgtgattgttttcagccttgggtacactttgacagcgcgccaactgaccaaagtgtgtgtccatttccatgttataaactataaatatgcgtgttatttgactataccatcattcacttgacatttccctttcccttatttggttattttctttgattgtttttccttaagttcttccccaaataaatggcttctattacgcacgtggtcttcgaccttgacggtgttctgatcgacactgaacgtcattatacaacggccaacgagcggacgttggagaaatttggagcaaaattcactcgagaaatgtgggagttttgtttgtttaatacgttataataaagcgaaacaacgacaggaacctcaaaattatgggacgcaaaaagacggaggcggtcacggttttgctgaaggatgcggggatagcggatcgcgttacgatggaccaatacattgcggagtacgacaaacacgtccttcaaatcatgcgcgctcttacggaggtgcaattggtgtgccttgctttcgcttttttctgcttttttaaatttttgctttgctacgcttcgcttcgtttttatttcatttaatgaagtgtaaatgcaattgttaggaattgcctggtgccaccaaattgatcgaccatttgtacgcccacaacattccaatggccatctgtacgggatcggacaacgaggagtttgcaagcaaaatgcttaaatttgacgaatggcttaagaagattccgcttcgtgtgctgtgcggaagtgacccaggcgaatgaacgctcaaattccaatttgttttattgtaactgtttcagaggtacgcattggcaaaccgaatccggacgcatacgaagtgaccattggacgttttgctgccaagccgacttcgccgaagaatgtgctggtgtttgaggactcaattaacggagtggaaagcgcgttgggtgcgggatgtacggttcgggtttaaaactgttacaatacggcacatcatcaaatttgtttccttggttcaggtggtgatggtgcctcagcgtgagtttctgccgaatgattggcccgagaaagaactccgttcgcgtccaaattttgccgccttgctcgattcgcttgacaatttttgcccgaagcaatttggattgccggattatcgcgagggcactgagaagcgcggatgagagaaataaatgggacgagaaattgtgaccaaaaagtaatattgtaatattatgtgataactttttgtgtctatttgtccatataatggggacatattgtatgcatttgtttgtttgtccttcgtgtgtaaaaagagtaactttcattgaaatgctttagaaaagccaaccgacagtaagaattgctttgcttttatcaaataattacactgaagtgattgaaatttgaatcaaaaatgggagggaggaggaaaactacacaaaacactaaacgaaaaaccattttatttgaaaaaacggaagcgacaattaaaccaaaacaaacaaaaggtctaatggaaatcggctaatggcgaaagaaagccaaacattgttgaggtgttgaacgaattggagaaagaacatggaaacaaaaatcggaattatggtcaaatgtcagtcaaacccttaagacaaagacaaattgaaaaaacgaaatgaatgcttttggactaaaaatgccaaaaaacatttattgcacccaaaagcacagatccgaaattggacgagcattttttaatgaatgttgttgatgagtttgaatgtcatttagaaaataaacaa

SEQ ID NO: 18439 - DNA, 1038 bp, Heterodera glycines
aatgtcatgggacgcgtaaaatgtcacggggacgcgtaaaatttcagggggacgcgtaaaatgtcacggggacgcgtaaaatgtcacggggacgcgtaaaatgtcatgggacgcgtaaaaatgtcatgggacgcgtaaaatgtcatgggatgcgtaaaatgtcatgggacgcgtaaaatgtcatgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcatgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcacgggacgcgtaaaatgtcatgggacgcgtaaaatgtcacgggacgcgtaaaatgtcacgggacgcgtaaaatgtcacgggacgcgtaaaatgtcacgggacgcgtaaaatgtcacgggacgcgtaaaatgtcatgggacgcgtaaaatgtcatgggacgcgtaaaatgtcacgggacgcgtaaaatgtcatgggacgcgtaaaatgtcacgggacgcgtaaaatgtcacgggacgcgtaaaatgtcacgggacgcgtaaaatgtcacgggacgcgtaaaacgtcatgggacgcgtaaaatgtcacgggacgcgtaaaatgtcacgggacgcgtaaaatgtcatgggacgcgtaatatgtcacgggacgcgtaaaatgtcacgggacgcgtaaaatgtcacgggacgcgtaatatgtcacgggacgcgtaaaatgtcatgggacgcgtaaatgtcatgggacgcgtaaaatgtcat

SEQ ID NO: 18440 - DNA, 3199 bp, Heterodera glycines
tcattaaatttgatttgtcacttttaaggctacgggccgtgaacagtgagactgcatgtgcgtggtacaaaaagctgacccaaaaaacgtgtatcgtccgagaacagtgcgatgtgttcgcgttcaaattcttcaatttttgctccaaaatcaaaccattgccttcatggcttcgttcatcaaagcaagggtcgtcagctcatgagcttctcaaaaaggagttcaagtactcttttctttaattactaattgccatcatttgtcagtgtgagtaattaacgcttacttttgtttagtcgtctcaaaatttcaaacacgtggaaaatttcgtcggctaacaaactatttgagtaagtccaattaaaataatgcatgtcaatgtttttgaattttcacttcagaatctgttcgtcataccctcaatatttgattgttcccgcttcagtgtccgacgagaaactgaagcaaatgcgacttggcagaatttattaccgttttcaatttgcaaattttttatagctaaaaaaatgaacgctaataaggagcacgcacataagctattacaccagcaatttaaaaaaggcgaaaaagcggcgcgaaaagtgaatgaatttctcggcgcgtatgtgatctctcctcgtcaagcgcaaaaatggttccaacaattccgggcggggagaaacagcaccaaacgcaaacttgggtctggaaggccgtcgacagtggacaaaaacgttttggcacaacggttgcgacgacacccggaaagttcctgcgcagaattgtcggtgggacattgccataaaacaacagcatggcgctggcttcggaaatctggtcgtcggccgatgaggagcaaatgggtggcacaccgtctgactgatcagcagaaacagcggcggctaaacctgtgtctttcgaacatcgcaagacacaggagaggttatgtgctgaaccggctggtgacatgcgacgaaagctacatctgttacgatggcacagcacagaaaattgtttggagaaagaaggttttggtcccccgactcaacctgcaccaaaaaaagcgcatgttgtgtgtcttttggtcagtacatggcccactgtactgggaactgctggcacctggcactattttggacagtaatagatacataaaccaactgcgggcggtggatatcgcttaccgcatccggcgccagcagggccaatttgacggtcccctactctttcaccatgacaatgctccgccacaccgtctcatttgacaacccagtacatttcccagacattgaattggaatgtgttgccccacccgccttatagccctgacctagccccctcggattaccacctttttctttctctcaaaaactttttacggggtaggcgcttcactgaagacgccgaggtcgaggaagcggtggggcagtacctgacctcaaagatcggcccagattttttccgtcgcggcattaggaaacttccttctcgttggaaataggttgttagggtccagggaaactattttgttgagtgatattgtatttacagttgttatgattgttatttttgatattttatttataaaatttttttttctaaaaaagcgcccttttttatgcaacgaccttaattgtgcaaattgattattcattttttccttccttttttatttttagcacattttcccacccgaacaatcgacggaagaagcagagaaagagcactcattatcggacgacagcgaaactttaatttgcaaggattgtatggacaaatacgcttttttgggcttttatgtcaaagtgccatcgacgaatgaggaggaaatgagcacaagtcagaacagaaatgccgaagaacaaagggacgacgtgtgcaaattggaagcaatgaaaaagaaaggggagaaggaaaccgggaaaagtgtgtggatggaagtggggtggcgagaggagctttgccggtgccaaaaatgcatggtaatgacccataattgagtctttaaatgggagagagtgaagcgcactgtttttcagaatctgtacgaagacttggactgttcgtttctgctcgagcccgaggacacactcgcgcactttgaacaacaaaaccgagaaaaggcatcccaaaaggacggggccaaagacatttaccaaatggtggtggaggagacgaaggaacacgaaacggcactgaaaatgatggtcggctttgagcagatgaagcgccactgtaaggagtttttgcacaagcgagcagacgaaaagagcggactcatcacgggggaggacgtggagcagtgcttcgcggagttgcgggcaaagcgcatgaaactcgaggaagagccgcagcaaaacgagccgaactctgggggggatgggccatggactcaggtggaaaagaaagggtaaagaaaagcatcagatttcgtatttagtaacaaatgtttgcgatttggatgtttggatgtaaagctctcttaaataattttcattcgcatttgcatgtgtgcttcggtggctcagtcggtagagcgtcagtctcataatctgaaggtcgagagttcgaccctctcccggagcaaaattttttgattatattttttatgctgttatatttcgaatttttttctaagtacactaattgcgctgatttgatcattgtaaacgaataaatgattcctggctataatcatgatttcgttatttataatttttaaaaaaacgactgttttgtcgatcagttaatatcggtcctcctttgtttgcttaatttttgatttaattttaaagcagtgactgcttggttctttattcaaatggtttgttttctaattcatttttaaagaattcaaatttataggggcgacacaaaaagactcagaaattccgcaataagcttcagaaactgatcaagccaaccgatgacagaatgttaggatttgaatttttcttaatgattgctaattaatgctggtaataattcagaaaagatgaaatccgcgtgaaaaaacctcccaaagaagatgaaaatgcacttaaaatcaaggaagcgtgagttatggggtggggttagtgaccaatgaatgcgaaatgatagcccgaagatttcggcagcgatgtttctcaaatacaacacacaactcgggccccccttccacgtcattatcgacacaaatttgtcaatttttctataa

SEQ ID NO: 18441 - DNA, 3385 bp, Heterodera glycines
  misc_feature (2385)..(2385): n is a, c, g, or t
  misc_feature (3378)..(3378): n is a, c, g, or t
tgacccatctcaaatgtcgatccgattccactggtccataagttccatccaatcgcttcctccacccatttggcccatttgctttcgtcgcgcacaatcggacaacggatcagaagaacacggttgatatcgttcatcttcttcatcgtcaattgctcccgggtcaattcgttggtcagcacaaatggcagaggacgatgataagaaaaatcaatgcgaatgacagcgatgaaattgacgggagatgaagccgtgtaaaattcctaaaatagggaaaaattggttaagaaatacgaaatgataaatgaattttacggtttggtgccccaatttggatatacataattattttgtcagtgcgcgccaaagaccgtaaaaatgccaaataaaacaatcaaatcgcaatcaccgctttgaagtcttcaatctctggctccaaatgccagctaccgtagttcaaccagcatttgaacacctttggcacattgtccgaacggggagtgaaaagccatttggctaccacttgtccattcgatgctgcggcactgtcatcgcatggaaaatcggtgaagaaaccattggaattggcattgacaacgcgaagcgatggacagtcgttgagaattgacggcacgaatttgcgcaaacggcggaaactttctttggacaattggatgccacgaatgtttgtcgcgatcatgggccaaatgttgtgccaaatcgactccaaagtgcggtcatcgaagtatgtgtcgtcgatggtcaaatgaatgggacgggtggccaaaattggacgaaaacggccgagaaaagtgatgacattgttgttgaagtacctgtgaaaaatgatggaatcgttttacaaaacagaaaagtatcaaaatctcgcttcaatgaaatggctttgaatccgacgactctctttggcaacggcttttgcgtaattccaaacgattccaaattggcattgacaacatccatttccttggtgccatccgcttcgaacttcattttgattttcatcgatcccagattccagcgacgagtcttgaagtgttcatccacgtagaagtcaaaacggtggctgatcatcgcaattccaaggccaagttgtgaagccggaagcagatcgtacacacaaagccaacaatcggcggaaatgaagctgaaaaaaggaaaacaaaatttaaaattgaaattttaaaaatggcattttaattttacattgctttcgccatcttttgctccgcttcgtttcggttgtcagacattttgttgaggggaaatgatttagacagttttcgtcagatttcaattggcttagcaaagatgaaaaattatgtgaaatcggccgtttcttttttttaaatgtgtgggcttttgttgaatggcactttttcccggatggtttatgggtctctgatcgcgaaacagatacatatccattttgaccaattctaatccccaaaacacgaaatgtaatttttgactcgattcattaatacaaaaacatcctacagaccaaaagaaaattaaaggggaatggaaaatgaaaaatggcggaggaggagcaatcacttaaggtaaattgccgaaaagaaatgcacaaaacgtacaaagtgatttttgaagaaatttgtcaggtagaaaaattggatgaaagcgacgaaaagaatggataataatgaaaaatgacggagcagcaaccacttttatactaatttattttccaatttttacacaattttaataatcagtcgtagttcgacgccttactataaaagtcatcactagggccgcaacttttagtgactaaaaatctcaaaatagttaactaaaatagtgagtaaaaatgccaaaatagtgaagaaatagtgacaaaaagtccgaaatagtgacgaatagtgacataattttcagacaaaaattaagcaaaaataatttttattcactgattgcagttacaaatgaggtacatttccaaattttgaggcaagaaactcatccggttatcgcataaaattgttttgtaaatagagaaagtccgttcaacatcgcatgaagtgagaggggcgaatttgtagaatggaattacggtgggggaaacatcacaatcaacattttttccggaaagaatttggcaaaatttggcaatttgatcaaacgagggattttaagtcccccatctcgttaaaacagcctttggaggcattgccaaatccggaaacatttggtggtaaatggccgtacgttgaggtgctttaacaaaaacggccttcgtcttcgcgatcaatttgtcggcctttttgaattcatctcgcactttctctgcaacacggtgtaaagcatgacaaaggcacattgtgtgtatgagatttgtataanaaacctgagaaatatttaaaattaagtagtggaagttcccaactaattaccctttagttgttttccagcttttttcatgtaagctgcagcgtccgtgacaagcaataaaacacgattttttgtcgaagccatttgaaaagaaattgtctaaaaggataacatttattttgcctcggttgaattttaccgagtccttcgttgacgaaccgagcaattgccgcgctatcaactttctccaagcatttgacggaaatcaaatgtggggtgtgccatttttgtccatccaattttccaatcagcaaattggccaccgctcttcccatattttcatgcttaatgctgatcatgtaatttttgtgttgaatttagcattttcgtgcttgtttttgtcttaattggcatttttttgtaaaattttgagtaaaacaccgtctcacagcactaaaaacaaaaaatacacccctaggaatcgaccctaaagttttaaaaaatgctcgcctaagaaaagaaatattttttttgacaaactttttgatttaaaatgtcaatttttgctatgaaaatattagaagtcagtgcaaaaagaaaaattgagaatttattcttaaccgctaaaaattttgcctgaaagcaccaagttttatgtttgttttttcaatttttgtgcttttggcattttcatgcttatttcgtgcttaatttagcattttttgtgctgaaaaatccggtctctagtattagggttcgaagttgtatgcactaaaaaatgccaaatatgcgcataaaatatgcactaaaaatcccccaaatatgccctaaaaacccgaaaaaggcgcaaatatgcactaaaatatgccttaaaaattacccaaaatggcttttaaccctcaaaaaaatgccaaaattgtgtataaattaagaattgactttgaaaagaccaaaactagggctaaggagcattttttagacaattgcaaaaatatgaatttccanaatttat

SEQ ID NO: 18442 - DNA, 2116 bp, Heterodera glycines
agaatccaaaagaatttttttgcggcaaccaatagctaaagaattacagacccgagactgagatggtcaaatagttttgggactgaaccgtcgacttacataaaaatgcatggaattgcgacaaaaacagaaaattggctctgacaaaaagcaaaaaaataaataaatacaaaaattctaagaaatttttttacattttggtgcaatttcattaaaaaactgccattttcgccctattttttttgcaaaattttgccccatttgggccttatctcggttattaaaaaactgaattgaaactttcattttaatgcctttgtgggaatgagtgtaaatccatttgtatggcctctgcttatataccaattatgaattcattaacaaaacggcagaggtttaaattatgttcacaaaatcagagagaatgatgtcgatgtttatacagcttaatttctagttgaatttgtcaaatttttaattttcatttgcactctgtgaggaaatttcggcgctgagcaactttaggcaatcaaactacaatacatatcattttcatggttatatgaatattaattcaacccttgtgtgttaaatcgacagaagctgtcgcgtgatggtaaattcaaactacagcgccgaattcatttaagctcaaatactttttttatttactcagatattttgaaaaaagtttgatgtataaattgtgaaaactaactaacaaatattccagcattggctgattggtggaagatatgtgtttatggcagttcctaatttcgaaatagccgggactggggtcgggacttgaaaattgacccgtaaaatgcttacaagttttttattgtcacaggcctttttgggtgaatttttaacaaatgtggtaaaataggggtccagcgttgccgccattaggcctgaagattttagagttctgaatacttcgttagcttttgtcaaaaatgactaaacatttcaattaagagccaatgttttatgaaaattatgacttattgggtccggggccggtgacgcagataggcgccaatgtcctcgatttttcagttgtatcttgtaacaattaggacaaagtattgaaatttattttttatttttacggtcacttcaatggcacagtctaattaccttttgggcattttacttcttttttgaaattgtcatcaatatcgcatcttctggagagaatttcattgatttgttttggccacaaaggtatttttccattaattaattgtgttaatttagttttattatttaataatttattgtccaggagtgatttacaccaatgctttttgctggagtttactgattgattaaatattttttatgaaatatattgatttattcattaattagggatgcaaattatacctaagaaacgtctcaaaatatgtataacatgtaatccccaaatatgtaagaaatatgtataaaaatcccaagcctgtaccaatttttttgaaaagcataaaatagggatttttatgttgctaaaactgccaaaatagttagtttttatgttctaaaaacccccaaaaaataggtgctaaaaatgggaaaagttgctcaaaactttcaaatttagcgtgtaaaatgacaaattttatccaaaaaccaacaaaattaagcgcccaaatcagtaaaatcagtattgcgatagataatttgtaaaatcaaaatttttgtcatgaaaataaatgctactttgtctgttttaatgcgcttaatgtcacagtaatttgatgatcaccggttgtgttagttttttcatagtttaatcccaaaaattggtccccaaaattatttttttttgataaaaattattggtttaaaaatttgtccttattcgaaaaagtgtttaaaatatttaataaatatttaactgatttcgtttgattaaattttttacgtgttttactacctaaaaaatgttaataaagaatttatttcctatttttgtgcctattttgcttatttttctgcctttttaggtgcatatttcgcgattttttgtacctaaaataaaatcagaaaactataaatgttagttttattgagatttaaaaatattataaaataagcgcattaatta

SEQ ID NO: 18443 - DNA, 1155 bp, Heterodera glycines
atcgggcgaattttaaaaacgacgaaatatttttatgttgggaaaagaaaaagaaaataaacgaaggaaagctgaacaatttgtggcagggcagaagctcgcctcagtacaaggcgaaaggtgctcgcaaatttattcattgcgtttcattcattcgttgacaaatggcgggcgaaagcggcggatgaagccgacccccgccctttcaaacgccaaaatctgtttttgtttgctgctccatccccaatttgtttggcaacggcaaaaacaaaacaaaaaataataataatgggccaattggagggccacggaaagcgatggctataaacataataaataaatgcaaattgccaatgcggcgatcaaaatgtgctttcctcgccctattcagctgaacgctttgctaattgcgcgtgtttttcttttttattttgctcaaatttccaccgtaaacacgcaacagcagcagaccattcaaggtactgtagcaagcaaaaatccgttgccattcctctcgagactctcggttaagcttatccgacgttgctactggtaccgttgccggtgtacggcccatcatttgtcggctacgacacgcgcgacgaatgcgtcgaccgccgtcccgactgtgccattttccgtcacgtgtgcgaccatcccgactaccaaaagttcagaagcagaacagcactagcaaatgccatccttttaagatacatgtacggatgttgcagcgaaacgtgcgacccaaaatgtgcccggaggggcgaaagtccctcgggggaaacaaacaaagcgcgggacgaagcgcgggaacgtaggaacgaagaggcaatccgccgcaaatacctcggggacagcgaatattttcacccgaaaaggttttgacacgagagaaaaagggaacagagttttgctatttgaactgtttgttacctgtcaaatgatgatgcgtcttctccaacagagattggcagcagaatgaatgggcggtgacggaacggccgccgtttggaagggaaaagcaccggagggaaattgcggaaggggccaaatggaggggacgatgaccgatgggaccgaaacgacccgtggacacttcgggagaggatgatgaagcagaagaaagaagaggaggaggaaatggactaatat

SEQ ID NO: 18444 - DNA, 935 bp, Heterodera glycines
gggctatcacacattagtgatttgggagagggatgggaaggggtgagagaaaacggagggattaaatcgaaacacaggtggaaattgggggggggggggtgaaaacgaaaatttggatgggaacggaaacggacaaaaaaacaaaaaaccaaaataaatcatttgactgggaaaaagaaggatatgcaatcaaacacaaaagtgcactcactcattgttgaacactttggaggattgcatttgcttatgattgtttggagacgaaacaccgacaaaaagagaggggaaagggggggggggacactcgtggaagaaatgacaacaaagaaaggatgaacgaaagaacgaatgaatgggtgaataatgaatgattgatgaactgatgagagagatgcaacggaataaatgggaaaagccaattattagccataaaagcacaaaatgggacaacagttgaaccgaacgaatgaatgtttaatgtttatccccaaatccaatgctgatggagagcattggaaaaagccatggaaaagggagggagaggtcgaagagggggagggaggggcaccaaacaaacggagggcggcggcttggagcggcaaacagtgatgatgctaattagaagaaagttgggaactcatttgtcagccatttaaagattaatagggagggaaaaaagacggaccaaacggagataaattcaaagcaaatatgccgagaggggcaagtcaaaagtgatcaaacgaattttgagtaaagggcatcgtttgagcagagcaaagaaagagtgagtcgggagaatgggggaaacataaaacaaattacggaatgaaggaacaatttgggtgggatggacattaaatgggctgagatttatgggggacggaattccgggaggggggggggagggattagatcagattagggggggggga

SEQ ID NO: 18445 - DNA, 2404 bp, Heterodera glycines
aataaaaaatattctggcgtctctttatgaacttcgttcttaaattttagattaattccgaaaatttaaagattaatatttaaaagaaatttttcatgtttttgaagaattattaaccaaattatcttgataagatattaattatttcctgcaataaatcaattaaaaattatttatatacattaattaaattgacaattatcaattatttctacaaattattaattttgaattcggtcccaaaacaaaaaataattcttcttcacttaatctttgggctggacaccactctaatcattagggagtccaattatatggaaatccatatttttttcctggactctgggaggcctaaaacgcacgagaaacatgtttttagcttggtttgaagcttctatacaatggctatactaatcgagctaatcgagttcggaagattgtagtgtgggttttaggctgtttaaaaattaaagaaaataatagtttgaatattttataaattttcaatcacagaaaataatggtaaagaaaatattaaaaatattctgtcacagtggggaattgaacccaacagacgtagaaggtttacccactagaccacatttgaatctgaacagatgtcggaattggccaatgagtgctgacccaatcccgaattaaaaccaaattaagacaaaaccagaaagacaaacgaattccaaacaaaagatcgctttcaaattctctttatttccaccaattaagtccaagggaaaaagcgatgaatcaaaggcgaaggctatgcgaaagcaaaggcgagcgaacggcgaagaaaagggggataagtccacaaaaggatccaagggaaagaatgaaaaggcaagagagcaaaaaaccgcaggcaaatcaaagtcttttatggccactcggccgtcgggaacggaaggggtgtaatgaagcgaaaaaaggaggggggataagtgtaaaataaagcaattttatttgtcgggggaacggagggaggaaatacaaattatttcgcaaatcgcgacacagatgctgtaaatgaaaaaaaaaaaatttttttctcaatttcttctcctccattttccatctattttctcacccagacccccattcttaccactgcttattttagtcccgcccggaccggggctggcaaaactggggccgatatttcgttttttcaaaaccgggaccgtgaccgggacttttaggtaataaattatatgtttgcataactgctttattattaataactttgctaataatggtttttacttgttgatatttaaaaatgcggtcctttttgtttttatactgaaggaatttaaaagaaattatttaatattttcacaaattatatagtttattttattttaatacaataaagttaattaaatttacttattaaaagaattgactttcattttagcttgaaataattttattgttatcttttctattgtctaagtatttaatcaatcagaaatttctcattttttatagtctttttaaatttttcatagcttttggtataaatcacaataataattttataattctttttgggttatcaattgaaaaaaactttaatctagttttaactatttgtaaaattttataatgaaataagaaatcattccaaaaacattcacattataaaatgtatttcatctattaattattataaataaactaaattatcaattttaatttttttaattgtataaacataagatttttaccgaatgcattttacagtagcaaattttttttcttttctatatgattatagactataataatgctagttatcaagttctaattcttttgaactttgagaggtctcggcagtcgaagaagttgctttagcgcaaatttattatttatttggaaattatattattttatattttttttgtgtagtgaaatctttttactcagtatcctaaaacttttattttgttttctttaattgaaaaacatattttctattcaatagcagcaaagtattaattggttaatttttgaataaatatttttttagattaataattatacctgttatatattaaatagaatatagataatatttcaattttatatctcttgtctcaaatacataattaattgagttttttttcatttaaatttttaataaaatattttgttaaattaatattacaacattaatattcaacaaaacttaaacaattaattatatttttttggtaggtacaataaataaaatatttattaattttattattcttattgattttatttaatacagttaaaaaatatactataggttctttttaattgattttaatttttttcattaattaattctcattattatttaacgtccttgactttgttttcttgtgtcctttattat

SEQ ID NO: 18446 - DNA, 2376 bp, Heterodera glycines
tttcataattgatagtaatgaattattgcaaggaaaattagaataatttatttcgggggacctcaaattccattcttattagttaaggcatagagcaaagaatcgcaaaacaaaaccaaacagacaaagcccgatgaatgaagacatgagtcgattcgaatcaaatcggttttagtgcatttttttcaactcacgcaccccatcacgaaaacacacatccaaaagtgtattcgggttgctgatcataatccggcatccatttcaattaattctgagcccctgaccgaattcgaatatagtcaaaaagttttgagttttttgttttaatatgggtcaggggtccggaattggtcaaatggatgccaaaaaatgaaggctttgtaccgagactcccgccctgctttggtttccaagccctgccgttcctagtcgatttcaaatttccatccccaattaaaaccttgttctgcgatgttgtcgacatctttctgacctttgcttcctttgcagccgactcagaagaggacaaaacaacggcgttattcgaccctaaacaaacaaattgtttggccggcagtcaatcggtaacttaacgagtcaatggacttggggtatttcaaaacgcacctgggtcaattatcaaaatgatctccgatatggtttttcgaaaaaacaaataattttactcccggccattttaaactcaaaccaatgacgaacagtgtggcgatttttgtggacatggacccctcccagaactcaaaacccgaaaacaaaccttgccccccagcggcgccgttcgccgagtccgtttggtttgcactgtgtcgcttccgctgtccgcttgtcgtctcagtgcgtccgtctccttcgccgccactctctgccgccgttgtcgtcgtcgttggtggcgtaacagcacttttttgatgttttgacatcagaaatttatttgcaaattgttctgtgcgatgagttgtttgctaaatcgacagttacacgtccaatcaatgaccacacttagtttcttaagccataacttttttcttactcaagacatacattcttggtattaatcgaaagcttaaagtctaagttttatgtaagtaaattgttccagaatattctcgaaaagtactgaaattcggaaaaccccattgtaattttggtaatagtgcagtttgttccccaaagtttaaaaaagtcgtcaagcgtttttgttggggttctggggggtctttgatcacgaagctgacatccattttgactaatttcgaaccccggatccgaattcggacgaaaagttgaaaatttggattttcgactttttgttcgaatttgggttcctgggttcgaaactggtcggaactttcgattaataccaagaatgtatgtcttgagtaagaaaaaagttatggcttaagaaactaaggatgtgatgaacgcataaaaaatgaaataagaacagattaaaaatgcgaatgaaaggattcataaaaacttcctcttaatatacacaatttttctttttatttctagtgaaagcaaaacttttgaagccaataggtttggggtggaaatcaatcgataaaaaaagtggtctgttattgtagtaccgtccccaagagctcgtcctgctgcgttctgatcacaaacgaattgacctgatcggctggcagtaaggtgatgattgtggcggcagttccggcacattgaagtcctttggccgttcgggcacagtgacatgcgcttttttgcattttgattcaaattttatgctctttctgtccgccataacgtgtcccatcacattttacgcgtcccatcacattttacgcgtcccatcacattttacgcgtcccatcacattttacgcgtcccatcacattttacacgtcccatcacattttacgcgtcccatcacattttacgcgtcccatcacattttacgcgtcccatcacattttacgcgtcccatcacattttacgcgtcccatcacattttacgcgccacatcacattttacgcgtcccatcacattttacacgtcccatcacattttacgcgtcccatcacattttacacgtcccatcacattttacgcgtcccatcacattttacgcgtcccatcacattttacacgtcccatcacattttacgcgtcccatcacattttacgcgtcccatcacattttacgcgtcccatcacattttacgcgtcccatcacattttacacgtcccatcacattttacgcgtcccatcacattttacgcgtcccatcacattttacgcgtcccatcacattttacgcgtcccatcacattttacgcgtcccatcacattttacgcgccacatcacattttacgcgtccca

SEQ ID NO: 18447 - DNA, 2207 bp, Heterodera glycines
cccgatactttaagcagtcgattaatacacaagaatgtcttctttgactaagttcgaaaaaagttatgccctaagaaactgaggatagtcatattgatattagacgcgtaaactgaaatagtgccaatatttaccaatcatggcacatttccttggctttttgggccacaaatgcagcacgagtattcgtttcttgagcactgaatgatgttgtttggaacagggggctgtccaactggaaatgtaaatttgtttaaaattttttaatttggcttactgtccacagccaatgcaatgagatgggtgcagagaccaaactaaaaatattttgatcatcgtagtgcattttaaattatttatattttcaaattcaaaaaacctttttaaatacttaaacacgaaacattgtaaaaaacggctaccggacttttggggatgagcaacgccatcagaggaaacaagtcgagaaacgggattaaaaagatggaaaaagggtcgggaatgggatcttgccggaattgaaacctcccattttcatgtttcccaatcgactgcattttcattgctaattgcccgtaccgaaacggcgtttatgtccgactcgtgcccggggaatgtctgcttgcacatcccttcgcggatgtcccacagtttggcggatgcgtcgcacgcgccggagatgaacgtgcgcatgtcgggcgaaagcgatagagacatgacgtcaccggtgtggccggtgaacgcggtcacttgctgtcccgtttcaatgtcccaaagggcactaaaatggggcaaaggaaatggacgaattaattggtttttgagtgaattcaatgggaaatgccaaaatgatcgtttttcaatttggcaaatggcccgaggggactcaattggccgtctgctgactgactgaccaagtcatgtcgccggaggaggtgacgatttggttgtcgtccaagaagcggcagcaggacaaatacccggtgtgaccaggcaactcgcgcgacactcgcacatttccctcgcgcgtcttcagcgagtaaatgctgcaaatgttgtccaatccgccgcatgcgacgaacgatccgctgggggcgtacgcgcaagtcatcacccaggaggagcgcagcggaatggcatgtacctgaaggaaattggcaaatcagcatgtactgcttgaactcggactcactttattcgtggtgtacgagtcccacacaattaatttgccgtcctgagaagccgaaaccaaattccgcgagtcggacgcccaatgcatggcatagattttggccaaatgtcctctgagagttcgccggttccgcagctgaatgcgcccgtttggctccaaattagcggccactgatgccaacgtggtgtcattggcttgtttccgcgcttcctgaacccgattaagcactgatcagtgactccgatcactccgtcgtcccaccctgatttggcttttgagctgctccgcctcctgcctcagctgatccaattcgctcattttcgctcacttcgcttgcactgcttcgcgccttttggccgactcagttcatcaacagcgaaagccaccgttgggcttcgggaatgaaaggccgcagaatgaaagaaaaaagtcgcctgtggtcagcaggacaaaacgctgaaaataaaaatggcaaaaaatgccaaaagtgacggagagaaaacgcaccgaaggaattgtgaaggaaaggtatgggataatggggagggatgagggaaacgaggctgatcagcgaaagcaatgacagcgaaggatttaataggaaacgcagaaaagggcgagggaaaagactgatcggacggaggagcgatcgacgcggaaataatgatcagcaaagtgtgaaatctaaaacggaagtgattaatgggagggggaggggggggggggaatggcacaaatgggcaaatgaaagtgccaaaggggaaaatgcgaaaaaaaggcgggaaaatgagataatgacttatttaatatccaaaatgaataaataatgtacaaaacaaatcgccgtcgtttgctgcgtatttttattaatgaatgccccgcgcaaaaagcgataagcgaaaagaaatgatcggagaagggaagaaaatggggggggggggggaccgaagaaaagggaaaaacgttgaataaaagggataatctggcgaatgcagggaaagctctagaggtcccc

SEQ ID NO: 18448 - DNA, 828 bp, Heterodera glycines
gtaaaaaacatgcatttccattctaaaataagaatttaaaatatgtttttaaacacgaaatttttaagaaagctaaaccatttcccgattttaatttcaaaattttgggaaataaaaattaagtaaagttcaagcaaatgattaattcccgaaaatttcgtctcagataacatttctcggcctttctattgactctgaatgagtctcaacttatgggaaaaaattttgggcctttaatcttgagctaaatctggttgtccaatcttgaacaaatttgactctggaacagttatgtctgattagatttttaattttttacccagacagtaattgtggagttgtcaattcatttggtcgtattggggccagctttaggtagccaaaacggaatgtgtacaattcgttcatgcgctcccaatcattcatataccattgctcaacctatgatgcaaataattttttaataaatttgcaaaaattccgttttaataaattaataaagggagaattaattaataattttataattattagcgaaatcctatttttatagattaacaaagagccaattagttaattgactaattaataatttttaattaaatttggaatttccgttttaatagatttataaagagctaattaattaattattttgagaaattaacaaagagccaattaataattgactaattattgaattaatatttttttttatttaaatgtggagaatttccttttaatagattaccaagagccaattaattaattattttttttttgtaaaaagtttggagaatttctgttttaatagactaaaagagctaa

SEQ ID NO: 18449 - DNA, 2256 bp, Heterodera glycines
tgttctgacttacttgtgattgccgaaattggtggtgccaaaatcggccgatgaagaattcgttggcaaagtgttggtgttgtgccgacggcccaaagacgcggccaatccgatgcggccatgcattggaggagggtcccaagcacttgaaaaagttgcgcatttaaaacactcaaaatgaagcggaacggagcggaagccgcagcggacggagtcgagcggaaacacggcctggccaatgaacggatccgtcttcggaccgacgaaatcgccgtcttccacatgaaagcgcagcagtgccatctccgggtgccgcacatggaacacaaagcgttcctgccatatcggattcagaccattggacgctgatggaagaagggaacacaaattgggtgatggaaataagagatgattagccgagcaaaggacaactcgataaaagctaattgataagggacagacaatccattcgataaagccaaactaatgaagaagtcgatcaaattaattaattaaatcagtgaaatgatcagcctataaattttgtttggaagggtaaacgggttctttaggaggcatggggtggctctttaaattactcttcttttattcagaaattggaggtcggtctacctgttggagtagcccagccaaagtgccaacgagtcgagccaagtgggcacttggaggacgaggcgctgggacttgagcaaagccaagatgaagaagggcacccagcagcaaaggaacaccgacatcatcacgcccagcgtctttcgggctttgtcctcacactgactgtgctgcgattttccaaatccgccgccggtaaggacgccgactacggaagaggcggtggaggaataggagcccaactgacggagggaacaaaaatgagatcggaaaagagacgagggatagacagagacatgtgtacggtaggacaagacaacggtggggtaatacggtatcccaatgaaatgctatcccgaaaggtacggtactcattgagttggtacggttctgcagagaaagaaaatggggtgaaaaaaaggcacggaagaggtacagtatggccaagtggcggggggatacggttggttgtgggaatgacctcggttaattgtctttaattgaccgaccaaaggaattcgaattgcaccggtcattagtgaacatgccgatgcccttggtttgtccgcttttcctcttccttctccgtctgcttttgctttgttgctcgtgttgttgtttttgtcctgctcaatgctttgccgttggactttttgccgcgtcgaatttcttaaggtagtttggattaataatccaatcgatttgattggcttcaaagttttgtctttactccgttctgatcactgatcagttcattttcccctaattaattttgcctgggggtatttgtcagctgtgcgtttgctgttgccaacaatgaggcggatgagtgcgaattgttcatagccttttcagcaggaaaaccgtttgagtttggcactgagtcggtattattttggcattgcatcccttgccatcggagaacctaaaaaggggagagggaaggaacaagctttgacattgccaaacaggtgggtatttaatatttattgggcctactgattgaaatacagtgagtttttttatgtttttttggcattccttccttggcatttccttccttaagcatttctttggcacttttcttggcattccctcccttggcatttctttggcacttttcttggcattccctcccttgacatttcttcggcacttttcttggcattccctcccttggcatttccttcctccgtttaccattctgtcctggcgttgcatttccttggccgcgttccacagtttcacataaacaattaccataattagcgcgggcccccaaaaggcaaaaatggtggcgaatatttggaagaagcgattctgcgaaacctgcacaaatgtttatctctttgatttgccgatttttcattcgttcacttttcttttttctcataataaattaaaacttttcacatattttccctctctctcccggtcaaatgtctttttatttctttttattttgcccatatgttccgcaaaataacgccgaaatattttattttatttttatttgagttaaattccgtcggatttattttaggcacataaaaaacattcaaaggcaaaattattattttaaaggaaaaaattcattcgtttcaccttttatttgttgggatt

SEQ ID NO: 18450 - DNA, 2038 bp, Heterodera glycines
tttggctcaattccgaatcctggcccatttagaacatttttagaaaattaattttttttttttgcatacctatattgctaaagcatctattataaaactcatcaaattcattatagactcaagctatgccggattttatcaattttattttatttcgccaatttgaacccatttaattttaatttttatccgagagaaatgtggatgagttgaccgtggatgagatgccttgtggaccccctatcggcatctccggcccttttctgttcccaaaaagtttttgtaaaaagcgcgccgcaaatttttttagacattttgtgtccatggcagggatggcattccgaggccccaaaaattttcggaaatcggaattccgtgccatccctggtctcatggtattatagttgtcctaataactaagagaaaaactattttttttgtcaggtattcagtaaagtttttaactataaatttcgttgttaaacctaaggttatcatgacaacttatgcacaggcaactcgaacaatggcttattgttagactaggcctaagcttaggcttttgtaaatttttttcttatattagttgaatttctgttgacatcaataagtgtgcttagagttgcttttgcacatttcgatgatcaaagtatacaaacaagaacaattagactattcggaaggtataaagtttccgattgacggttcgaaaaacaatttttgacgcgtaaaatatgatgggacgcgtaaagtgttgttgggacgcgtaaaatgtgatgggacgcataaaatgtcatgggacgcgtaaaaccgactagaacccatttttatcaataatgagacgatttgattcttttaaagggaaatagccaatttattttagtccttaaagacgtatttggggattgattatgacaaaattaccctccgttaaacacagcggcccaattttgggctcccagtacaattatgcttattttttatttagtaatcagaacgccaaaactttgcaaaacttaaaattttccggagattttcccttgcaaaaaaagaagagccgatctcgagttaaaaactagacagctaaaaaataaactgtgattcgatagaggaggtcaaaatatgggcctatgcaaaatttcaagaaaatctgacccgaggaaaatttttttgaccctagtgaaaatttcaataaatttaattcttttttagccaagtgcgcaatttaaggccaaatcaaataaaactaacaatattctctagaattttcccttcaaaatgagcataaaatggttttatttgctctagtattcgccaagttataagctaagaaaatttcataaaattgtcgatgttgtacgtaaccaacgctttttgaatatgattttttattgacacgaaaacttttattaatgaaaaaataattctgccttcttctttaaaagaagaaattgaaattaacacacaacataaggaggactcgaacctgagacccccttttggtgactaactcacagaccactgagacgaaaaatccagcataattgtacttggagcccaaaattgggccgctgtgataaataccatggtcgtctctcttattctacgggttaaagttggcactgcataaaagagtgcagagaaaaaaatacctctcattttactgtactatattttttaattctattatattgttcctaataaacaaaaaaacaaattttcttaaatttaggtaatgctgttaaaacctctaatttgtaagatgaaaaaatgtttgaacccgattttacacaggcgcaaatgtccgagacgcaaatttccggggcgcaaatgtctggacacgggaaaaaacatgacgtatttttaacgctcaaatttaatttattttttactcttcgactaaagttattcaaaaccacttttcaaggacattttctacttcttccaattgcttagcataatcttgagcctggtactacaactaaaatcgattttcatcgtataattgtctgaatttcgaaaaaatcagccagccaat

SEQ ID NO: 18451 - DNA, 2584 bp, Heterodera glycines
tgaaatgctggtgggttgagtcccagtgtttgcttttgccggagatttgagtcccattgtttggaatgccggagaattgagtcccagtgattggaaagcctgagaattgagtctcagagattgaaatgctggtgggttgagtcccagagattggaatgtcattgaaagttggtgggttggtcccaatgtttagaatgccgcagatttgagttccagtgtttggaatgccggaggtttgagtcccagagattggaatgccggagatttgagtcccagtgattgaaatgctggtgggttgagtccccgtgtttggaaagcctgacaattgagtcccagagattgaaatgctggtgggttgagtcccagtatttggaatgccggagatttgagtcccacagattgaaatgctggtgggttgagtccccgtgtttggaatgccggagatttgagtcccagtgattggaatgctggtggattgagtctcagagattgaaatgctggtggattgagtcccagagattggaatgtcattgaaagttggtgggttgagtcccagtgtttggattgcgggagatttgagtcccattgtttggaatgccggagaattgagccccagagattgaattgctggtgggttgagtcccagagatcgaagcggccgagccagtcgattttatcattcataattctataacacaatcgtactgcctagcggggggatgcgccgaaggcgctgaccccgctagtattatttaaatagcataaagtttgttattttctaaaaatttggccatttgttcattcagtttgaaaatgaataaaattgcaaattggataaataaaatatgacaaatctaaaatttgattattaatcacaaattaatttagattttttttccttcactgcaatggcacaaccgctgaagaattatgaacgcaaattaatttgaacaaaaatgcaaattctttttgaaatgccgtgcgatattcaaaacttaaaaaaattaaaattatattaataataaattcaatttttgccttgtcaaaaacaaaattgggccacatgaagcagcactaaaatgtaacaaaatgcccataatttgtttacaattccataaaaatatggaattgtgatcaatgtcaattgattccagtaatataacagcgaatattgaaatgatataaccaccaaaattaaagaaaacgattatgaatagtgaacgaaaaattcttttgataaattgtgccgcgcttgaatttgacggtactgaaaaaaatggcaaaaaaaaaaacaaaaaaaaattcgaaatttgctgcagcatttaaaaacctttccgacaatgaattattaaggcgattaatgcataaataattactgtagatacaattgtcattgctccctcgaaaagaacaattaagcaatgtttctaaaataattgaaacaaccaagcaaaacaatgacaaacaaactgactgaatcataaatgaggctgccaatttcgtaataataaccaataactttaatcgcattcattttatcatcataaaaattcaaataaataaatgcctgcacaataatgtgaattacagtaaccatcaaaacaacagtaagaaaaagtgactgattgaatttccttattaaaacgaaaataagtaaaaagattttaaatcaaattttatactttagcggaaaaagcacaacaaacagtcggtcaatagcaatgaaaagcataataaggagggcacagccggtgcttattaaaggaaccacagtaaagcaaagaccaatttaaatgacataaaatactggcctgaaaaagccgtaaaaattgacaaaaaatttccacaaaaattgattatttcaaaaaatgaataaaatgccaacaaaatattcacagagccacgaaatgatctgaaagaaattttgtaatgaattattagttaaaaaataatgtaaactttgtccgaattgtgatgaaaattactgaaaaatttaacaaaattccactgattgtcaaaaaaaacaaaaatatgccataaccaatcattgtccagcaaggattttgattagaacacgtctttattaaaaaaattgtttagattatcaaaaatatttaaataaaagcaccttcaatattatcatttcttcgttctcgtttatttgcgtttcattcattgtaatttaggaaatgcttttacaaaaatttaatttttttattttttggaatttaatataatgaagatttacagtgaaataaatggcttaactcaaactaatcactgaaattttaaattttaaaacattggctcctattcgtgacattgcaaaacagaaatttcttcttttttttgtcagttttcgtttaaaagtgtcacgcaacaaatggtggggaaaatggtaaatttttttctgacttacaacagaaaaggtggaggagctgagatttatgaaaaaaaaatttaatgagaagtattcatgagaaattgagataaattaaagaaaaaaaaatgggaaaatgaacaaataaatgtgaagtggcaaaacattatgagaaaagaaaatttaaaaaataattaatgatat

SEQ ID NO: 18452 - DNA, 1516 bp, Heterodera glycines
  misc_feature (1476)..(1476): n is a, c, g, or t
attattttgccgttttgtttttttatccccccccaccaacgtaaaaataaatcttcaccaataattaatgttcattttttatttcttgattctccaataattacacttctattaaatcattttttggttagcattaaaaaaatgttgtgttgtgactgggatgtagtgcacttggtcctagtcaaaacagtaaaatcatcaaatttttatatgtttaaaaaaattaaaagtatttcatttaggcccgatgattggtcacgggatgattattgtaattttcgagaaactataagatttataaaagtaggaaaaacaaatctttaattttgctaatataatttgccaacattggtcaaagcgagcagcgttttaggtttacgttggggttggaaatgtcgctgtcatcgaatcagggccgggcttgagtaaatgagccagggataaatttattgaatctcaaataaaataagccatcaaaatgtgagaacatttactctaataactttcggaataaaaatatgccgtcaagtaaatttcaaaccgaaacatttactttacaaaattatgttggtatttgtgctccttttttgcttctttcactgtcaaatcgatgaccaatgttgctttgtcctcacttttgtcgtaaaagcctttgctcgggtccacagttccttaattagccataattgggtcaattaagggaaattttaattgtgactcactggaaatgaaatgaaataagaacccaagattttctttttgttgtcaaaaaagtagtcattaaattcattcttcaaatccgacccatcgttcttttgagagacaattcgaaaagttgcaggacatttgcaactccaattttcgtctaaatggaaattaatcatcgttgtaattagcattaattaacagttaattcgcaccttcttttggagcatcgaaaaaggttaaagcccaaacaattctgatcagtgcttccccatttccttttaatttgtgccaatattctccatggataaaaaatggaatacaatttttaaaaaattatatttcattttgaatgcactgaaaatataagaaaagcatattaaatttttattttatttatttaaattaattattttaaaaagttgacactcgttgttgaatgagtttaaacttggttttaatctcttttttttatcaatatccttcgcaaattccacgtttgacaaaagcggaaaacgtatgttgaaaagtgccggaccaagcatagaacgacaattctctgccgtgcattcaatgccattttcacggcacttcgaatcggcccaaccgagtgccgaaaaccaattaaaatttaatgacgactaattaaatgaattaatttcttactttggtttactagactaatccagcagcaggttaatcatcatacatatccaggccaataaacacgaatgagcgaacggtgaaggatccaaatgattatttggaganatttgaaaatcgcaaaaaaaaaatttaattattttaaaaa

SEQ ID NO: 18453 - DNA, 2775 bp, Heterodera glycines
tttttacgtgtgtatttacatataaatggaagccctctttaagagtaatctcggcattctctcattaattaattgtctctttctgatttgccattccatgctttttcctttgcttttgccaatgccaatgccgttctcatccccccccccgttcagcaggtgcttttccatggacgaggaattaaagtgtccccattgtcggcttttcctgtgccaacctgtcctgctgccctgcgggcacagttactgccgcaaatgcgccctccaattgcagcggcggtgccacccgccgccgtgccctccgcttccgccgctgcctttcgcgccgtgtccctcgtccgcttctccgcttccgcccgcgtgtccgtcgtcctccgcttcgccccatcctccgcctctgccccattcttcctcttccatcgcaattccttcttttccctctcatccgtcgtctttttccgccccgtcaagttcgggtcgtgcagctgttcatcaacatcaacttagtgactttgcgtcacccttttcaggtgcttccgacactctttccttggccccgtcctgcgacgagtcggccgccgactcggccaccagcaacaacaacgaggacagtcgctcgctgctcagcgactccgccgattcgggcgttggcggcacatttcgcggaggtaacggaaagatttttttctgtaaagcgaagcgatcggataaaattcgattataccaaactttccatcaatgacttctctcccacaagaggaaattggtggattttagcagaagccactgaccgttcattttgtaaaacaaacaaaaaagtgagggggggcggtgaaaggcgataagcgacgacaaacgccgcgggggtcgcacagccgaaattggccttcccacgacacttttgtttgcgctaagtctgtcctaatatgtgaatgtatttgctgctgtgatgcgaatgttgacctaagggaacgccaataaaacgaaaaggaaaagcaaagctaacaaatgaaagtgggggaaatttgggtaaggggagaggtaatttaaatgccaaatttgcacttttggccaaacttactgccaaccgatcacttggtcccgttttgctcagtttaaattcctctgatcactttgagtccctttgccaatccgccgatcacttcggcccttgaactgatcactttcagctttccatttctcccccgctccttaaggctctcgtccgagttcgtttctgtccaccaccgcctcggctgtgccactccgttccgtcgtcctttccgcgtccgttccgctcccttttttccctccgaatttgccgcccaatgccgccacttccattctctccccgtccacttctgctgccggtgccgttgtgctcaaatgcgtggcgtgccaaaagtcggcacattttgcggacgaagaaattctgagaaaacaaccggaaaatgtggcagtgagccgattaatcacggcgaggcaacagcaaaaagaggaagaaacagcgcaaaaacagagaaaaaagcagggaaatggtggaggagcgacggatggaacgacgacgacgacggaatgtcaggtgaacggacaaatgggcaaaatgccaaagaaagtgcaatgaaagaaatggacaattccaatgccgaaataactggtaaaagcattttgattggttgtttcagtggtgcgaagggcgagctcagccggcaaagtaccgatgcgacgcgtgcaattacttttactgtgccgactgtcaattggtgctccatccgccgaggggacctctgaaaacgcatcagctgattccggccgacgagttcaacaagtacaaacacaatccagcaaaacttacttgctgataaagactcttacttttgataattatgcttcctctccttaattaacaattaatcccccctaaggcgtgcctcttccctctcccgcgacttcgtcctccccccgtcctgctcctcccccttttcttcgtccgacccaatgccttcgtccaactgcgagtttcatcctgcccatgagttggcattgtactgcactctatgccaacagtcgctgtgtgcccaatgtgccggcgatgttcggcaccaatcgcatcacatccaaccattgcaagcggctgcaaaatcgcataaagtaagtcatgtacgattcgatgtgcccttttccttggcacggcattcattttggcttttcaaatgttgcacttcttttgccaatatgtgccgaattgtactccaaactttgttttcccatttttaaatttggccttttgctgcgtctgttggcccccaaattcccccggcgcctttctttgccattcattcgttcggttttgctttgctttctcttctccatcagtctcttccatcctcaaattccggatgagcgcacatttggcctcatccgcatcaccagaaatccaatctgttcgctaatccctcccctccccccccccctttcgccaactgtccatcccccggggcggcataaatcaaaatgagtcggtgccaaaaccctctgggcgtaattgcccttctccccctccccgaatttccatcctttctcgcctttgccttttaaagagatggccaaaccgatggccatctctgcgcgttaatgcaataatatttatttgatttcacactccaacgactccaaatttgggctcgccgtgggggcggcggtattcgccgccctttcattgtcttttccttcgctaaaagtgagaaaaaaagcatcaaagagagagagaattcg

SEQ ID NO: 18454 - DNA, 2218 bp, Heterodera glycines
  misc_feature (32)..(32): n is a, c, g, or t
  misc_feature (41)..(41): n is a, c, g, or t
  misc_feature (205)..(205): n is a, c, g, or t
ttataaattttcttttggactaattcccaacnttttttgcnaatttcacattcccaatggagaatgggacaaatttttataaacactttctttcgcaaattccttttcatcaaattaaattcgtttaaaatctccattttgtttcttgtttctcgattctaaaaaatcatttatttttaattaaaatcttagaatttatcgattntaaaaatacttattttctaggtatgatattcttttatcggtcatattaccgtattattgtaagcttcttcattggcagaattgctttgttcagcatacgaaatattctgatcaacttgttcattaaactctttttcaaatggatcttcgtttaatttgtccaattcaatttttggcacttttatttttaaattgttattttcatcctccaattgttcctttttaatattttgcaatttttttggctttatatcttccatttttattttattgaaattttgttgttcatgaatttcattattatcaacaatttcttcctttattgcataatttttaccgaatttttgttttttgaagttttttgaggtcgatggcttttggtttttccataaatcatcaaataaatcttcatcaattccatcaattagcacgaataaaaatatgaataaaataatcacaaaattaatttgcggcattttttgatgcaaaaaaaataataaattttgtttttctgcttatatttgttatattataagtggaatatatgcaaaatctctatttatttttaaaaaatctcaatcaattgcaatctattatatttaatggtaaatagttgattttaaaaatttttaatttccctttcctgtttgtaaatgttaaaaaataatttatggaattccaaaaaaataaatatattgaaattaaatgaaatataatcagccaaggaaaagtttattgatcctcgatttatattaaataaaaaattaaattaaattgggcatcagaaaatttgataatggcaccgtcggaattttggacacctaagtcctcttttacagaataaatcctgaaatagacatatgtgcagattaagataatgtggttaatataatttagggtcaatttttagtaatttgtatgtttatatttaacataatttggtaatttatcaacattttattaatttcgctcttttttcaattaattaaacattaatttgagtaaaaagatttcacataaacccaaaaaacgccgaaaatattagagatatgtatgtatgtatattctcagaactttttgaattggaaagaaaattgctaagggatgggataaaaatattataaccatcaaaatcgaaatgaataaaaaaaaactcgatttattaataaatgaaactaaataaaaaaattaatttattagagaattttaatttaaataataaaattctattaactacagtaccttccttcaaggtatttgccgcttcgtcatagtttagtatttttgacatggggtaacaaatagatttattaggcttcaaaattttaaattctattgcaattttaaaaaattttatccttttaattttggccaactatcattttctttttattagataaaaaaacagcgtttattagggatgtgcgagactcgaatttctcggtttgagaaatttgtcgggtttttgcttctcggtctatgttctcggccgcggtttttagtctcggaaactgataaatttgaactaaataattaattatttatttagaatacagaaaaaagaaaagcattgaaattgttccaattcaatttctggcagttttatttttaaattattattttgcttttgttgttgcacatgtaaattttcattttcccttaaatggaattggaatttaaattgattgtcaatattaatttttgcttcaattattaataaatttatatacgatttgtaccaacttttttgcaatttcacgttcaaatttaataattggcattattttataattccaccgtaattcctttttcataaaattaaattcgtttgaaatatccatactaaaaatttatttgttttatttaataaatttcatagatttcagcggtacaaaaataaatgtttatctaggaatgatattgcgctcattgttcaaattcagttttggtctcttttatttttgtaatgattccttttattttttttcaatagttttttggagctaatcaaagc

SEQ ID NO: 18455 - DNA, 2418 bp, Heterodera glycines
atcccgtgtcctttttagaaattcccaaatgcgagcattcagttttaatggcaacaagtttatggtcaaatttgtgctctaaatatgaaagacccttgtggaatgagttcgccacataatcacgagcaatcccgtgtcctttttagaaattcccaaatgcgagtaagcagttttaaaggcaccaagcttatggtaatatttgtgctctaaatatgaaagacccttgtggaatgagttcgccacataatcacgagcaatcccgtgtcctttttagaaattcccaaatgcgagtaagcagttctaatggcaacaagtttgtggtcatatttgtgctctaaatatgaaagacccttgtggaatgagttcgccacataatcacgagcaatcccgtgtcctttttagaaattcccaaatgcgagtaagcagttttaaaggcaccaagcttatggtaatatttgtgctctaaatatgaaagacccttgtggaatgagttcgccacataatcacgagcaatcccgtgtcctttttagaaattcccaaatgcgagtaagcagttttaatggcaacaagtttatggtcatatttgtgctctaaataagaaagacccttgtggaatgagggcgccacataatcacgagcaatcccgtgtcctttttagaaattcaacacatgcgagtaagcagtttgaatgccaacaagaatatggtcaaattggtgccctcgaggagcgacatgtcgggggtcggggcggggaataggcccaaaaatgtcggggatcggggtcggggaccggggagctcggggacggtgagcaaccctagttttcagaatgccggcctcgtcactatcatcactacacctcttaatgcgggtgcagcaattcgcgaaattttgcatagatccatcaaatgcggatatattgagattttgtgtttaattaaccatttataatgcatatccttcagtcattatttttaaatcaaatttaataaactgatttttgttgcaaatctatacaaatttatgtctgttttattaattttgtttttttcaaattgctaccaatttctatgcaacttttcaagcataaatattcttgtatataatcattttttatttatacaatatccaaaaaaatattaaaaaagtaagtgatcccacctcccccccccctcctcttgcacagctatgctaaataatcaattgcaccctactcctccccctcccccgctccgattaatcaattgcatcctcctatgtattcccccgtaagaatggtcatttaatgcttatgttcatgcaatgaaaattttgttgatgaatgtcaaaaaatcttcgacgaagagtttaaacctattttcaaatttttttaaatttttgtcttgcaattataaaatcattaattgcaccaaaaattaattataaaaaatttttaaataaaaattttcgaacaaattggtatcattcgaaagctcttgacaagctaagtctaaaaatcagggaacaattcaccataagaaacccagacccggttgaaaaactctatttttatcagcttgtttaattttttaatttatattttcaagttttcacgtaaataattttcgtcaaatatttttcggttaggattcttatttaaaaatagagtagagcgggaccgggaattttgggcttaaccgggaccgggaccttttcgggttgaaaaaccgggaatttttggctgggaaaaccgggaaaaaacccgagactggtcccggtcccggtcaaaaccgggttcaaatttcataaaatgatttttgttacaaatttatgtctgttttattagttttgttttttcaaattgatatcatatgcaactttaatattttaaaaaaaattttaaacctatttttaaatttttgtcttctctaaagatttaaaatgtttcggaaacagaaggcggcggacgactacttggaattggacattgagcgggaggaacccaactgctggacgatgtgaggggaataaatttcagctggaagagcagctttttgggaaaaaagaaaaatttgaaaataagaaattcatgccaacatattgatgcttatcaaaaaattcctttaaccaacttggtcaaatcactcattcatagtgatctggtcactccaaaatacaatgaaaatcgggggggggggagggggggggggattttttagacattttaagtagttacattgaaaagagcacaaaatgctctacaagatgcaaaagacaacaactctacaacttttacctgcagggatatgggcacttcagttttgatgctgataatttctactataaaatgcgctatcttcagaagaaatacagtactttttgtagacactgaaatcgaagtgcccatacctcatcgggtataaatcgtatagactttca

SEQ ID NO: 18456 - DNA, 2159 bp, Heterodera glycines
  misc_feature (2092)..(2092): n is a, c, g, or t
  misc_feature (2109)..(2109): n is a, c, g, or t
aaaaaaggaaaactacaaaattttttgtgtgatagagagagcgaaagggaatcagggctgggcgtgactggatttaattttttgatctaaatcattagcagggatccagtttttagggttttatctatttttcctcagctccagtggcctgaaacacacgcaaaacaagttattttgatggttattcagctacttttcgtgtttttagtatctatttttaggttttttagagccaaaaacctaaaaaaaaatttgaaaaaaaagctcttttgatatttttggaaaattattaacaaaaatgatttatatagttatttcattattgataagaattttcaaaaagctaggtgaggaaaaaataggagcaaaacgacaaaaacgcccctattttctaagcgaaaaactcaaattatgatgttaccttaataatactacaaattaacaagaataagtctggtttttaatccagaagaaatcatgaaatacgggtagtcctttaaatgaagtagaaaaaatcgtttaaaaaaaattatcttgcatgaaatcgtcgaaaaataatccaaaaacacaattacagattaaaattacgaaaaatcccaaaatccttaacccataatccgtcatgaacgggccaaaaaggccgaaatttccataatccgtaattacgcccagcattggttcatataggccttttgtaattttcgtttcttttcctacaaatttcgtctgatgaaaacgaaacgaaaattttaaatttaaaacactatattcaaattcattaatggctttttacaattttcttttggctgtcttcttcataaatttttttattaatcccagcctatttaactgcaaaaaattctataatttattatatgtatgagtcttttgcccattacattttagacttgtaccgtctttgtgaattctatgaggtggacgatgaatggacacgaaaactctgggttaaatgaagaacttctcaatttgaccttggaaattttccacaaatacggcaaaacgaactcagaatctgtcgaatgtttaaaattgcgtccggagaaaatttattatgcctaactttgcctattttagtcttttgttctttatgcctaaatgcctatttccgtacctatttcgctatttttggcgcattttcaggattatcggaaaaattcttaacaaaaatacaataaaaacgaaaaatacacccataagaattttttaaaaaacttcacaaaaattgatccccaaaaataaaatttctttcttgataaaaatttttggtttaaaattgtccttatttgaaaaaactttaaaacaattgaaataaaagcaaaataagttttttaaatttttatgtgtttgttacttgaaaagtgttaataaaaaaatttatttgccttttttgtgcctgtttaatgcctatttcaccattttttatgcctaaaaaacgaagccctattaataacatttaagccttaaatgatatgaatttataaatatgctcatctttgggtaatggctatgatttatctgattttattttgggttactggcttggttctaaaatattgttttaggtcgaataatagcccgacgatgccaattgcatcgccggaaaatgatgacttttagctttttagccattaaaaaggtaatttaagtgtgggatgaacaatttggagagtggcggaagtgaattagattcatttgaatggtcaaaatggaggcttaaatttggcaaacaaaattttgtttctatcgtttttaggaccttatgtgccattttattcacagaaaccgtttgtcatatactttatcgaatttaaataaacatatgaaccgagcatttgtctaactaaactcacaaccatcaatctcattgtcgtccttcgaatggacacgaagactctgggataggtaaatgaagaaattctcaatttgaccttggaatacaataaaacgaactcacaatctgtcgaattaaactggggattccctgctgtaaattcaatgaatggcaggccacactgacagcaaaaaatgaatgaattgaaaaaagaaatttcataaatttggtggcaccggngaaaggcgccgtgccgngccatcgttgcttttgtcctcggcttcccccccccgccatcgcatttaac

SEQ ID NO: 18457 - DNA, 1820 bp, Heterodera glycines
tgaccgggatataagcgggatttggtcgggatccccatccgatcaaagtttcccggtctcccctcctttccacctgttgttgctgttgctggtggtgtacaatttttggtgcagcttgttgctgctgttgttgttgttgttgctgttgctgcctctgctgttgttgaagttgcaagaacatattcgtggcggagtttggcccaaaaatttgttgcgcaatgttttggacgccgttaaaatcggcgtacggaacggaggcggtagaggcgccggatgagcctaaacaggcgcaaaataaacagtaaaattgctaattatgttaattattttaaaaatatagttaaaaaatcaatgggaaaattgttttttgaagatgaatttaaaaattcaatttatattgtcgattatttaaaaaaataataattagttaattaactaatttattcgtttgcaaataaatagaaaaattggtacttttgaaatagataattaaattaaatatgataattaatcccaacattaaatcatttatatatttggacaattaatttaaaagttaaagagatatttaatttaaaatagcataaattgtaagaatttttaattaatatgcaaatattaataattatttttaatctaaaatctcagcttaatgtaattaattaaaatgactttttctttaaatttaaataaataaagttcacttaataaagctaaaaaattatttttaattcaatgcaaataaataataatttttttttaattatccaaattgttttttttttcaagttttggcactcgccttgttgtccgttggcgtactgtgccgcggtcgccgccagcgtcgcaatttgcgattgtgtgaaggcggccgcagtgccagccgagccgctcagtgccgccatttgggaggccaaagcgcctgaaaattttttgaaaatttatttcgattttcaaaaaaatacatttcccaccatttccgttttggtggtcgttagccaattgtgccacgccaccgccgccgccgacggtggcgggcaaagcggacggactcgcggggggactgaagccgtcgtcgtccgagtcggcgccgacgccctgcttgccctccttgcgctgcaacgtctgaagggggggggggcaaaaaatcaatcaaaaataaattatttaaaaacaaattttaatttattttaattataaaattggaagatatgggaattatagttaaaatttccacaattttagcttagtttataaaattttgcttagtatttaacaacgctaagttcggtttcaaaatttaaaacaaaaaagcgaaatttcaaaaaaaaaattaatatttttaacatttcttttcgccgcatcgcttactcacttccataatgtccgtgttggtgcgcgactcgtgcggctcgttgtattccgtgtacttcagcaacactttgtccatgtccgtgctggcgtactgtaaaaggggatggtatactgtacaagtaaaaagtgaatcgaaacgcaatttaataaatgtttaaaattattttgcctgaaaaagccgatttgacgagttgaaaatgatcagcgcaatttcgcagtcgcaaagcaccgacagctcataggcctttttcattaggccgaatttgcgttttgtgaaagtcacctgaaatttagggcacattgatgagaggatgaagcataggcatcacacattttgttggttatctcgagagactcaaaatgaacgagagtcgagactgaattaaacactatcgaaagtcgaaactgagaagcgcactctccggagtcgggactaattaataatt

SEQ ID NO: 18458 - DNA, 1070 bp, Heterodera glycines
gttttattagtggacatgaaatttttatgaatgataaaaaaatgggaaaacaaaaacaaattctgtgttttgtgatgtttttgtcacgggaaattttttttttttttttgggggggggggcgtcagcgaatgaatggaaatgaatggaagggacttcgattgattggagaaaaacgggggacggggagaagaaaacgacgacgacgacaacaaaaatgaaagacgacgagagaggacgagagttagtcgatgttttttgtgagttttgggagaatttcaatggtttttttggtagaggggggggggacaaaaaaaaaagtgcgaaaattttgacgaaaaaattaaaatttaggacaaaaaatggaaatttaaaagggccaggggatgccgaggaaagtgccagaaattttggcagggttaggcagggtaggccgaggaaggggccaggaaaattggcaaattggcagggcaagccaaggaaaaagccagaaaaattggcagggtttggcagggtaggcctaggaaggggccaggaaaattgacagggacgggatgcctaggaagaggtgggatgagtgataaattagatcaaatttaaaaaaatgaaaatttagggggaatggaattttttgggaatgaatgagcaattgaaaaagctttattaataagcgaaaatagaaggaaattcaaacacaacaaaaacaaaagcttataaatcgggagaaaatttaggcctccggaaactgaacaaatccggtggaaaaaataaacaaaaacaaattgcgaaattaaatgctaattaaattaatcgatcgaataatggacagacaaataaaaaaaaagcaataaaaatggcaaattgatgacgaaaattggcataaatagagaaggaaaagcaaaaatagtcttaaaaaacaaacaaacaaaaaatgtcacggcaaaaggaagcaaaaaatggggaaaataaattaaaaatgaaaaatatatttttaaatttaattattattcataaaaagggattaaagatgttattaaaaagcaaagaattattaattttagacctttttaaa

SEQ ID NO: 18459 - DNA, 2885 bp, Heterodera glycines
  misc_feature (2877)..(2877): n is a, c, g, or t
atctgtacaaaaataattttctttaattttcatttaaggccttaagagagttacgtcaattatcaaaaaggttcggcttaatgtcagatattcgtgtgggttctataataagttttaatcacttaaatataattttaatatattataaaatttttaaaaatgtatgggattttaccgcattatgagtcctttaagaggataaaattgttattattcaaaacacgctgattgtgatgggtttagcctttttagcttttacaacaaataaaaatcaaattttataataatttgggcgtgggcaaactaaagagagagcaaaggagagacggctagaagggagtgtgggaaaataagagagagaaaagactgttagagaagcgacgtgagaccggttgccccccgcactcctttaatgacccccctaattaccccgtctccctataatatcattaaattaatttaattatttataataatttattttcattacattgatgactaactctaattacatttctttttctgtcattgatcagtcaggaatggccagaacagcgtattatggagttgtaccattttatcagcatggtgttcaactgtttgctgtccatacggcactgaattggaccaccgattttgatgcacggaatagcagtgaaatttatctaacggaatgggatttgaagagcaaatttttggattttgctgaaacatattgtgtgccaaaaaagtgagtttggctctagtaatcaataaatcaaatctaagacgaattttttttttaaatttagaattttattatttttgaactcattttattttttgaaaatttgcacaattccttatcatatttcatcgaaatttgcacaaaaaaaaaaaattccggcaccgctggaccccataacacataacattctttattgataatgtgaccctaaactacatattctttttatcaccccggcactccaaattaaaaaaaaaacaacattggataaaaatgtttttagcccgaagagcaacaacaaaagttcttcgggtgcatccccgattttttttctggatacgggcctgattatagcccaattaataccaatttgaactgataaaaaataaaatggttttattcctaggaaatacaatattttaatttattatttctgaatatattcaaaaaacaacaggtggactggcaattgcgacccatacgacccgaaaatgcgtgcctggtttgcggcaaagggttggacaaagcgtttggagtcttggctgcctgtgactgtattttaattacagtaatgcaatcctgaatttttggcctgttggctggctgttactgtatttccgttacagtagtttactcaatttaatgttagcaattttttttacattaagccggttcaacttattaatgaaatagttcggtcagtatagtagtatatgaattttctttcattttccgggtctcattccattgttttcttgcctttttaccaccaccgtttgtctattttacatattatatgtatgcacataattttatttatttttttacgccaattacattgaatgatggcaaatacttattcaaaatggcatatcttttcaaacatttagtctggttatatcaaatctcttattgttacatatgcatatgtgtgttagcttctttgtttttttttcatttgaagaaaataaattattttaagtctattccattgacttttttaatattattaaagaacttttataattttttattgaattttaaaaaaggcttttcattttatgcagcataggtatataatgcttctcttaagttaaaatataaataaaaattcatcctaaagctttaaaccaagctaaaacttaatttgtaggccaaaaaatgtaccatacaaatccgggcccaatcatttgcacgagactctttcaaaaaatcgggaaatcccggtagaaacccgggactagtcggggtaaattcctgatttctactctattaagcacctcaattttattaaaggtattttcaaagccaataattgtattatgtataagcatagtatgtttttgaaagtcccactcgacccaacaacacaaccataaactttttggcatttgcaaatgatggataaattagataaaaaaaatagggggaaggcatttgtttgtcattgagagagaagtcagacactatttactgaggaaaggaagcagaaaaaaagaaaatagtgaattaatatgaaatacatttgagaaaaaagggaatgtaactaagccaccaacaaaatgagcaaaagatgcagagaaaaataaaaaatactactttaaaaatgagaaggcgcaagacggcaaaataattgaatttcagtgaacagtgagtggaaaatagaaggtagagaaaacagacaaaaaaatgtattatgtaagtcagagaaatgaggaaaagcattgaaactgaaaattgacggcacagtggaaaagatatgtgccgtcaagtgacagcagacaacggaaggaaatgccagacactcactgactgggccaagaattgactgacgctcttcaatgccgtggccatataacagcgcccaatccatggagcacagagagaattccttccttttatggacaaatggcagcccgcccgactaatccgaaaatttatgcaaaatttccaatgcgtcgcggtccgtcccgttgctatggcagcagcaattgctgccatatttgcacctcgatggattgattaattccatcatatatacaaaaagttttgttagctttagaaatttaaatttatatgcacaaacggtaataattatttgacaaaaatatgctaaacgataaatttatgaattccaacgggtgggctgntttaaatt

SEQ ID NO: 18460 - DNA, 933 bp, Heterodera glycines
aggcgattgtagaatgaatttgaagcgctaaaattcttccataagggttttgagcgtaattacgatttttacttgaattattttttctaggcttagatcacatgcgattttcggcactctgataattttagcgttcataatgggatgaataaaggcgattgtagaaggaattggaagcgctaaaattgtttgagaagctttttgagcgtaattacaatttttacttgaaccattttttctaggcttagatcacatgcgattttcggcactctgataattttagcgttcataatgggatgtataaaggcgattgtagaaggaattggaagcgctaaaattgtttgagaacctttttgagcgtaattacgatttttacttaaaccatttttttaggcttagatcacatgcgattttcggcactccccataattgtttgagtaccccaaacggacacttgaaaaatcgatttttttgttttcgggctgtccccccgaaccgatgcgcccagatttatggggagaccgaatccttcgggattagcttccctatagtctgtactttaattctgcgttggatttttgctccccataattgtttgagtaccccaaacggacacttgaaaaatcgatttttttgttttcggggcagtccccccgaaccgatgcgcccagatttatggggagaccgaatccttcgggattagcttccctatagtctgtactttaattctgcgttggatttttgctccccataattgtttgagtaccccaaacggacacttgaataaatcgatttttaatttcataaatattttttcagaaaaggctctaaccccgcaccaattttatttacaggtaattttaggcctctgatgctttaatttcaaaaagaaaaatggaaaaaaaattttttaaaaattttttccttatattt

SEQ ID NO: 18461 - DNA, 1596 bp, Heterodera glycines
ccgaaggccccccacgaggccgcgatgcggccgagtgagtactttaagctcaggaaaataattaactggggttcattatttatttattttttgcaaaattaattcataagtattttttcagaaagtgctctgaaacacaccaaactttatttacaggttaattaaggctctctgatgctttttctatcaaaagggagatgaataaatattttaaaaatttttaattcctttttaaacaggccaaaaagtttaggcttatattttaaaaagttttatcgaacctaacgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataagtatttttacagaaactgctctgaaacaaaccaaattttatttacatgttagtttaggcactctgatgctttttctatcaaaagggagatgaataaatatttaaaaaatttttaattcctttttaaacaggccaaaaagtttaggcttaacttttttttcagaaacttatcagaagcgccccaaactttgcagggatactgaaaggaagagaaataacctattttaaatattatctagtcagtttttttaaataatttttatccaaaaaatttttttttgggttttcggggcagtccccctgaaccgatgttaggcttaacgttttttcagaaactgatcagaagcgcagcaaactttgcagggatactgaaaggaagagaaataacctattttaaatattatctagtcagttcatttaaataatttttattcaaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaaatgctctgaaacgcaccaaattttatttacatgttagtttaggcactctgatgctttttctatcgaaaagggagatgaataaaatttttaaaaatttttaattcctatttaaacaggccaaaaagtttaggcttaacttttttttcaaaagactgatcagaagcgccccaaactttgcagggata

SEQ ID NO: 18462 - DNA, 2821 bp, Heterodera glycines
tcagtttgcctccgattccatcgaaacatatgggctcagtgtgtgcaatgcctattttggccaagccaatcagattaacatccaaacacggccattcaatggccttttaggccttgccctgaacacaagcaatcaaaatgctgacccacttttcatccaggcttacaaacagggcctgttcgaaaagccgttgttctcactttatttggccacccaaggcaacgtgaatggcacattgggaggaggtgaggcgtgtggtatttttatgctcgaaccactgtaaatggttaattatagtttttctgataattttttaaattttttagatttttagtgccaattgggattggctataaatttttagatttaaatcaattaaaaaaaattttttttagtttggaaaaatttttcggtcctcggtaaaaaaagaaaattataaattattaaaacattggaaaatgtgcaaaaaaaaaggcatcgacaaaaaaatgaggcatttgtcatataatatagtatattccagcgctgtactaaatcgaaacacagcctgcgtattttttttatcttgacgcaatttaattggttcgaaaattgtgattataatttaccgtacaccacggcaatttaaaaaaaaatatgattaaggagtattaaatattaatcgagactaatttctggagagttattttttttagtgacaccgattggattccgattgcacacaacagtagcggcttatgggagtttcagatcgatgtgagatagctagaaaataattttaatttataaagtaaatttaaaaaattatagttgtttttggccgaaattttttaaataaatactacaataaaaaaaaaaaaaattatcttttatttataatttacaaaagttgcggccaatttttgtcttttttttggcattttgtttaatttttggtgtcaaaaacttttataaatacttatttatcaatgattgtttcaaagaaaatcacgttggacgacggcacaactattaatggcaccagtgctgcgaccgtcgactcgggcacttcgtttctgatcggtccgtttgatgaggtcaacaacattttacgccattacggcgttgacccggaaaacagcacaatgccatgtgatcaaaaatttggccccatcattttcacgatccatggccaggaatacaaagtggaagaggtgtattgtggttgattgagcgttgcttttttcttgagatttattaagcaaaatttgtagtttatttatttgtttttttgatatttcactaactatttaaggaaaagacgcagatttttcgttttttttttaatatttccttttattgagccctcctgaatttgtgccctcttatgattataaagtttaccttttgatcaaagttggaaaataaagccccgggggatttaatttcaggaaataggcatttaaaaaaatccttataatttcatttgagatcatttggttttaataacaaagacccagtgaattattatcatatttaccataaaattttcctctggaactatttatcaaatactatgaaatttttaaattttccagctaaaaaacatgtgtaaaaaacagtttgaaaaatcacacttttaagtctggtccgaacggttttctaattaagaatgatttattttttttaattatcatgccgttcacgtaaatataaaattttaaaaaatttcaaacaaaattatagaagacgctgctctttgataagggcgatggcacttgctttgtcggcctgcgcaccttgaactcaatcccattttggctgcttggtgacccgttttgccgtgaatattgccaagtaaaatatccacacttttatttatttttatatgtaattttaatttctaaataatttctctaagtaaaaagtgaggagaaataatttttaaataataattattttttaggaaaattaataaaatttgattaattttgcattttcaattttttgctctgtattatatttttatacaattttaatcaattttaccatttaagattcatgacgtcgagaaaaagcaatttgcattgccgcaagcgatgaaggaaaaataaattttttgaaaatttacaaaaatggaaaataattattaaaaacattaaatttgtcaaatgctacctaaatgataaaaatttattaagggtggatattgactttattttgcaataaaaaaaatttaaaagcaaaagtaaatttgtcagctattttattggcaaaaattaatttcccaaactaattaataacatttcaatgttcagcaaataattttttcaaattactttttatttcaattcttttttgttcaataaaatacttttcaactaatgagtcacaattttcattcactaattaattaatgaagtcctctaattgttgaagtgaaaattcacacattttttcgagaccaaataataaattcttaacaaatttaatttaataattttcaacaaattttttttttaattttatttactttttctgcatttttaattatgcattagatttttgaaaaatacttaaaaaactatctttttataaaagaaataaatttaacggaatttttttatttctgtctttcttccattcaattttggagcacatcattcgcattcctcaactccaatgtgaaaaaggaatggttctgtggagttgaaaagcaattcgcattccttaaaaataattaatttaaaaaaaaagaatgaaaatttaagtaataattgtcgagaaaactctaaaaatgccaatcccaaccgattttagggaaaaatggtgctaatataat

SEQ ID NO: 18463 - DNA, 1191 bp, Heterodera glycines
taacatttcataactttttttaccaaatatgatttcgaaattttataaaaactttgaacaatttttcttaataaatttcattaaaagtcaaaatttttcctcggcgacgcctacaaaaacctaattttttacatggcttgatataattttaagctaaaataaaagactaaaaaattttttcgaattttttaatcaaaattcttaaaattttgaaaaaagtccggtcaaaattttggacctggctcggggcgcccggtaaaacgggcttttttttgaccgggcggccctggcccggtaaattttcgaagcccgtccctgtactttcaaaattccgggctctagtgattattagtgggcaaattctatattattttttttctcagtttttttcgcaatttcatgtctttaaaagttaaatttattttggatagtaattattaattaattaaggaaaacagcacgatgatgctgtgggaggacgctccgaacaatgcgaacagagttttgctgttcaatgcgttggcaatttgcatcaaaaaggtaattggcgaatatgacgccaaatcaatgaacacaaatttggacaaattgaaagaatttggggaaaaaacgagccaaaacatgctgaagtgtatggcaagattaagctcaaaaaaccgccaaataaaagaccaatttttggccaaattatatttggacaaaattaccaaattaattgaggaagacgcaattagtgaacagctggaaaaagcgctaagagaaaagagtaatatttttttattgaattaagagaaaaataagccaattaaaaaataagaaacaaaaagagaagcatttttatttagcaaaccgcaaaatttagtttaaaaagctaattgatcccttaatgtttcttgtttgtattttaaaacttcagatgagttactatacgaactaatgggttcggaggatgttgacaaacttgagcaactctataaagtgatttttcaagacttttatttaatatttatattttccattaaattaattaataattttattttcagcaaaatcacagttattttttgccttctgaaaattttatatcgtcggacgaagaaacttttcatgatgcagtcgatgataaatgacatatagatggaaaacagataaaaatttgaaaatgataaaaatctgacaaataacaaaaac

SEQ ID NO: 18464 - DNA, 2416 bp, Heterodera glycines
agttggaaagtaaggaacaatcgcgaaattgagtgcgccttgcaaataagagggataacactggataataaaaccatagaaaatatgcagtagggcagtgtacaaggtaaatcataaaaatgatgaaatattgtgggaaaatgctgcagtatcagagaaaaattcggaaccgaattcggaaaggagcgaaaatttagacgcattttttgctttaaatttgacggacgaaatgaacgaaagtgaaggccaacagagcaatttgaacaacgaaagcgaatggtcatcggaaaagaattcgtcgaaaatttgggagcaaaatttgtcggaagaaaacgccaaaaaaataaaggacgaaattttggggttaaaaacggaaacgaatttgtggacacagacggaccaatacagaaaggggaagagcaaaaagttgaagaaaatttacaaaatggaggacaaaatgggaaaaagtgaggaagaaaattcatcaaaaaaggacaaacaaaatttgaactcaaacgccgaaacaaaaggccaaacatccaaaaagttggaggaaaattcaaatttgaacccttcaatgctaataaatactgaaaaaacacatcaaatgctggagggaaaaaatcaaagcgaggcaaagagtcaaaaggccgaaaaaaaattgaaaaaaatcaacaaaaaacaaccgaaaagtggaaaccatgaggaaaaagggcaaaacattagcaaaaatgacgacatatacccaaccgattgcacaatgttaatgggacaattgggaatctacaaaatcaggggtaatgttgaaaaaggctaatatgttcagtttatggcccaatcagatttatgcgtctaattataatataatttatttatttctgtgcattttaaaaatttcactgttattcactttttatcttttggcaaaaaaacagtaaatgtttgttgttggccgtgttgactccaacccaaggcttgctattaacaaatcacaaaacaaacgtacaaaaattaacatgattctctctctggccgattaagtgcatcattttaagtttcttagattgtcttaaaaaaacaattggacgcataaaaagaattagagccataaataaataaattaattaattaaaaatatgcaaaaaacaatcatttaaattcattaagatttatttaacgattcattaatgagaaaattgcacataagttcattggaaaatgttttttacaatgaatgtgaaaaatatttgggcatttctgcatttgcactcgcaattgaggcaaatttggaatttaataaattttgccatgaaaattatgcacagaaaagtgaatttgaacagttagaaaaaagttgggcaaaatttattacaacagaattggatcgatttgaaggaactcaatttttgttggagaaattatattttgtgctgaatgagctgatcgaattttcatttgagtaagaaaataattaaaaaaattaattaaattaaataaaaatattacaaaatataattctcgttaattaatacttaagcccttctaacaaccaattcattgaaaagggcttagcttttatggaagagcctcagcttagactaattggcaaatgtaaagaaaatgaaatggataaaattggcaaaaattcaccaaattcggaaaaggaaacgccaaaaagggaaagtgaagtgaaaagctcacaatttggacattactcaactgacaaattcgaactaatgattacagttttgcaggaagatatttttaacataataaaagcaaaaaatgaaattgaaaaattggaaaaaaaggaaaatgaaacggaaaaatgggaaaatgaatggcaggaaaaatttggtgctaataaaacgtttaataaaaatttatttgacttatacgaaaaagcaatcaaacaaatcgtggccatgcaaaaattaggtatcattaagcagttaataatttattttattcataaattgacaaattaatgatgctggctggggctttaatgcagccaagggtttccaacgtaaatttttttttaaattaacaaaaaattgaattcacgggtttttttcgaaaaaataagacaaaaataagagatcgtatttggaatttattaaattataacaaaaattagaaacctgcataaaatttaaggggataatttccgttttacattcggtcaacacaaagacttggcctagaaacctaaaaccaagttcgaaatcggtttttcatgcttattaaagctcaacatgcaaaaaatttaagcatttcttcaaaaccatccctatttttcaacaaccaaataaataattttttaattagaaatattattgttggaaatagaattttttaaaatataaatggaatatttttacaatgatcccgttgacaattggaaaaattttca

SEQ ID NO: 18465 - DNA, 1959 bp, Heterodera glycines
  misc_feature (1934)..(1934): n is a, c, g, or t
gtttgttttgctatttcagacacatcaaatatgttcgtcgtcatcaactccattctgctgccgggcgtattgatgcattcagttggagatacaattgaggcgaacttcgaaccaaattagcaattgcctaaaccatgaacaaatcatactaagatcggaattaaatttcacaattgtaatttttcaagaaaatccaaacattggataaattctttattggcaaatgcagttcgccttttctttattaaaaaaacatcgaaatttcgatgctttctatctttgctagcgaattttagatttatgagtaaattttttcaaaataaagaaggcttttatggtccggctaatcgaaaattttatacgttaaaccgtccttggttctgtaaagtaataacacacagtactgtacaatttttgtggcaactttctcaaaatttctaaaacaggactaaagtggcccattttatatgctgatcagtgtcaataatgtacaccaattttcgggttcgcctaatcatgcataagacaatcaaatatcagcttgataaagagtgattgatgactgttggatatatatctgttagatgttttgaaggttaatttcgaggtggtcgttattttcgggcctgcgtgactctcgagaatgaatgccattccattttcgcacatttgtccattgatttattgcattcgtacaattcgttgtaaatcttttgattatgcttttagtcagtcatttgattcgcattttatttcttataatgcattatcttttttactcacagaaaaatttacaaatgaaaatttggcagcatttaacacttatttttttatttttgttcttacaaaaacccacatcaaatgccacgactgaaattcaggcgaagggtatgttttaaattttgcagattttgcatcaaaacacaacctttctgttctgattccgagtagcgaattggcaaattttaagtgccgttctctagttgtggactttgaactgattattaaaaaatatggaatagatcttatagtagcaacaacaggcgccgccagggataaattggcacggctccttgttagattttgttcgggttaaatatttagaaaaaagtaatttaatgaaccaacgcgctttttaatgaatttgttaagaaaaacgaattaaatttaaaacaatgcactttagtaacaactttttttatttagacctaatagcccaatttatctcgtcattttttcagactcaaattttgcttcaacgataaggaaatttatggagaaaaaccgtgacaaaatgagtcaaatttttgcggatttggtaatttaaaaaaatgttttttattattctttttcatttggcaggaaaaagagaaagaaaaaagaaaggaccaaatgctttctgaagaagaatcgctgcaaattgtaagctcaaaaaatgtatacaaaccgccaggttaagtttttagaatgccttgaaatttgtagttaagattttgccataacgactatgaaaaagtgggagttatttctcaattacaaattaacaaaggtaacatcgatggaaaatatttttctgcatttaattaattttgaaaatactggaaaacgagctaaaaatcaaacatgattgaaatgcttttttaggtttattcatattcatcttttttcatttctcctatattagtcatttaatttttgttttttagccaaatcgttggagtgtaagcaaatcgcaaatcggtttactgattttggagcctgactatcggaaagcagcagtcattggaaatattaacggttaataataaaatttagtaaaacatcaatattcataataagggatattttaatatactgaattgctgtggaaaatgtttgataatgctttttaattacattttattaaaaatatgagaaaggttatttacagaaantattttaaggttatcgaatgttatt

SEQ ID NO: 18466 - DNA, 1888 bp, Heterodera glycines
attaaaataaaatgtttaacggtgttaattgaattttcaaaaaacaataaaaattggttgttagttagtaagcatatttttcacgattttaggacaaacgccgcctggcagtccgaaaggtgggcacggcaacaacaaatcgccaacgacgccgcacagtacaaaacgggaaacagaacttataattgagaaaggtaaccaacagaaccatgctaccggtaacacatttattcagcaatcacaaaatttttatctaaaattaacatgaaaattagaaaattttataaatatatttaattattttatataacatatatatttatcagaatggcataacattttactcaaataaaagtgaaatttctgttatttttttttgtttcgctccaaatgtgtccaggaccaaaatggcggtgcataaatggcaccgaatcattaaaataaaatgtttaacggtgttagttgaattttcaaaaaacaataaaaattggttgttagatagtaaacatatttttcacgattttaggaaaaccgtcgccagacagtccaaaacgggaaacagaacttataattgagaaaggtaaccaacagaaccatgctgccggtaacacatttattcaaatgaaaatttttttatctcaaattaacataatgattagcgtcattttttggagttacataaaaccactaattcaaatctttcttagtttcaaatgtggtgcagaacgttgacaacaaacctcggccatctgctggtgaattatgcttatttaaaaaaataaattgctaatttttcacatcggaaataaaaagccaggctaataattaagctgaaacttttctataagaaaaaaaggtggcattgacagtcattttttgcgccaaattttgttaatcattagccttaaaatgccaatttttttctcgggcatgccttttttggaaaatcatttcgaatgccgacttcacccccccccccccccccctcaatccacgactaatcaatcacacatttctgaaatctaatttatatatgtcacctaattaaatgcaattaagctagattaaaaaagaatcaatgcaaaaatttgtgcaattttgtttatatcttgtcattttttgtgccttttccatgccgaattcacccctccctcctcaatccacatccaatttattgcaccctaattaattgtaattaagctgcttcacaccttgtgccaccaacaccagggaacagccctactgcgcatgacagtcgccacacaggcccaaaagttgcccatgttgccgccgccgccaatttgggccaaggacaccaagaaagtgccaacgtgtcgcgtgttgatgatgtaaccggtaagtgtgtgtttatatgttgttgtatatatttgattttattttaaaaattaatttgaaaattttgaaatataattaaaattaattcattattttttcttgacattctatcaacatttcaattaatttttaatggaaatgtaaatgtatatctatgaaaatagagttttgaaaaaaatcagcaaaagaaagaaacaatacaaaaattaaaattaaaaaatattttattgatctttcacttcctctaaaaaaaattgttatttattttttttttgactcgttatttttttaataaatagaagatcaattttttaacatttttcgttgtaaaattttgttaaataccacgagggttggcaaaaatctggatataaaatcgcaaaaatgtggccataaaatcctttaaatttaaaaccaagataaaaactatttttttatttcgtgcctttcacaccctcccagtgtccagggaaaaaataatggattgctgccatataattaattgccaaccatataaatcacatttttttaa

SEQ ID NO: 18467 - DNA, 2298 bp, Heterodera glycines
aataataattttagacaaaatatcattaaaagaaatgaaattgttcctaatattcgctttaattatatttttgctcatcctaattaatattaattcggtgggatccgaaatgaaaaagctacaacaaaagtcatttgatgaaatatttggagaaaaatggaaagaaaaagaagaaaaacaacgaaatgaagagaataaaagagaaatatttggaaaatattctaaataaaagaaaaaacagcaaaaaggaagaagatattcagccaaagaatgggaataaaattaattcgaaaatagcgaaaaaattggggaaaaatcgtcaataaatttatgaatggattaaagaatttggtcttcaaaaaacccaaaaattaatcattagcacattataaatttgttttcatgtttattttttgtcatcataacaatgggatggatttatttttaaaaattaaataatgctcatggcaaaaggagtaggatttttgtttgcagattaaaaattgattatccataaatccatttaacttgacaaatctgcataaaaatttttcttagattcgcaaagatctttttttaatttgtattagaaaaataaatgaatttttataataataataataattatacatttaatagctctttatatttgttagaaaaatattttaatacaaaaatggatcatatggaagcaactttgacaaagtaaaagcaatattttgaggtttttcacataaataattcaaatcatttatttttttaattcagaataagatgaaccaaagaaaatgccaaagaataaaaggcaaaaatggaaagggcaaaagcaaatcaaccgaatgatcagcaaaaatacttgcgcccatttttttctaatttgagcctaaaaatcacaaaattttccatttgcgatataattattaatgacagaaataattcaaatgtttgcacagttgactttacattttatgtgcaagcattttcctccgccatttaaccaaaaatacatttatgattgacggataattaaaattcgtaaaaacgagtttctcaacgccaaacaaaatagattaagaattactaatgatgtcattaaatgcagcacagattagtcagcccaatgctaagtctccgttcccaaaatatttttcacaaaatttttgctatttaaacggaatccaattttgcaaatttcaatcattgcttacaattaaatccgaaaattatataatttatcttgaatgatggccaattcgtctctgatgttgccaattttcagtctgttcgtcgtgctcattgtgattcaattttacgccactgagcaaagttcaatcagcgtagacctagcggtgataaaatttttgatttaaattttataattttctgttatttatatgtagtattatttaatgaattaaagtgaaaaaaacacgataaattgtgtactttttattattttgaatttttggtattataaataactggaatttaattgaatttttaaattttcaaactaaatttatatttgtcctaaaatttaaattttatgggaaattttttgacaaaaaatatatatggaataaaaattgcagcaattggatcgccaaattagtgagaaaaagcaacgagcggaccaattgcgacaacaaattgcaagtgaaaagaacccggtgattaagcagtcggacacgcgcacattgcaagcaattttggaagagatcaacaaattggaagcgcaaaagaaatcgtttcaaaacacggatcaaaacgcaaggaacaatcttggatgagagacacagcaaaaaatgaaacggagatttggcaaaagtgatcagcagtgagcaaaacgattgaaaatgtctgagtttgatcgatcgattgcgattgatcagaaaagagtgattggtcgatctatttatgtctttaaaatgtttttaattgtgatttaaaaaagttcaatatcagagaatttaaaaatttattatagaaacaaagtaacgacctctaaacattagcatggtttgttacccatacgttaccgtaatggaaaaggacagaaatcagccggtcaacgccaacaaagaaaatgacccaaacggaggaaaacaggccaaagattgacaaaaactgaatgaaaaagtagccaaaattgctgatcatgttctggccaagcaacgaaagggcaaagggaccaaaaatgagagcaaaaagagaaagttaaatgagccgatggccaaaagagcggcacaagtgccgcgctgattcctaaaataataaaataaagcactatgtttccat

SEQ ID NO: 18468 - DNA, 1416 bp, Heterodera glycines
  misc_feature (1280)..(1280): n is a, c, g, or t
aataattcatctccaaaattttctctccaagttttgacaagattttgattttttttaaaattatgcatttcattaccatttttagcacctatttggaggtttttttataatcagggagcaaaaaactttttttttttgacgactttttccaattttttgtgctgctgattttgccttttttgtgctgttttcatgcttattttgtaaaaatttggtgctgcttacagtgcttaatcggtgattttttgtgctgaaaactgagcactctaataatcatttttggactatgatcgaatattattagaatttagatttgcttttcacataactttttttcggcgcgctttttccaaaagacttttggggaaaatggggggtctggcggtgccgattggccgattggcgcagccgggaaaatttaaaattttgacgtttccctcgatcggtttccgaagaagtttttgtagcccaggtttctttggttaaaggcaagacacaaaaaaagttcttgaataatctctatatcccaaaaagattgttttctaataattttgagtatttgctcttttttgttaaattcccaagactttaaatttatgaaaaaagttatggccgaggaaattgaagattggacgcctaaagtatatgtatttaggcttgcgcaatggagcagctttttcagcaggcgaatatggaccttcatcagatccatctcgaaatgagacatttggagctttgtaaaaatgagagtgaagcgcagcctctttttcagaagctccaccaacaaataaggcatttagttaaatgtttcatatttgtgcttataatatttaatatttaaggcaatctgccgctcagctcgacggcctcgatcgtttggtgaataaagagccttctgggaagcgtcacacttcgaaatatcggtttgaacagctgcgacatgattataatgcccttgaaatggcaattaattcactgcaaaatcgactcacaacgaaatggagaacggctgcggaaagggaggagttgctgaccatgaggtgataatgcaacgatttgcttctattggaaattcacgaaacttggcttataatttgatgcaatttatttgattggctttttgacggtttattttagatttaaaccaaacgaaacgcatttggactttgaggggacggaattgctcgtcaacgaccgactgaaacagtcgcacaacgccgtggacgatctgattgcgcatgggaattcagtgctcacttcgcttcgtcatcaacatttgnggctaaaggacgttaaacggaaaatgctcgatattggtcaagtggtaggcgatagtttttaagtgacctaagtttagtcggacggatatattcaggagctattggattttttagggggtattaacgcaaaatcagt

SEQ ID NO: 18469 - DNA, 1166 bp, Heterodera glycines
  misc_feature (26)..(26): n is a, c, g, or t
  misc_feature (1138)..(1139): n is a, c, g, or t
  misc_feature (1152)..(1152): n is a, c, g, or t
  misc_feature (1162)..(1162): n is a, c, g, or t
cggtacggaaacgcgtccttcggtgnccgcacaatgtttggctgcgattgcttgcgtcgaattgccatccaatgtgatttttttgtctaattctcatgtccttggctgcgttttgtcctttgttaaatgattgaatgaggtccaaaatgtatttaatcaaaatttagtcatttttagacagagtattttaagcaattacaattataattcttaaaagttgctctttgttttgtttgctaaatttcccttcccttttttcgtccctttggccatttattcttttgtcccctcttcgtcagcaatggcccgaccttttggaccgtttggttgccaatgtaacgactgatggtgcggacaacgctttgctgcgcgaagcttccctggaggcactcggttacatcggcttggacatggctgagaagcagaaaattgggcccgttttggctgccattgtgcgcggaatgcaacgcgaggagtcgtccgtccacgtgcgcctggctgcggcgaaagccctctccgaaatcgtcgattgggtcgccacgcgaactttggaagagcacgtggacgcaattgtggacgcaacttgcgcatttttgtgggtgtttttctcacacatattcaacgggtgtctcagacaaggccatacgacggagcttgggatggatgagcagatctgctagggagtgtctcggcagcaaattttcatacggcggtccacttttttctccggcgtcgaccttttctttacttttacaccacttttcttgaagtgcgctttttccaaaaaacctggggagcaagaagggtttgtcgtatccaagcccgtagtcataaaaaaatttcggagggtcgaacccggactttttttttgttgctcttcgggccaaaaaagtgccgccggacaaattttattaacttttatgaattgttaagaaataaagccaaatggtcctctcttcccccttacgacgaatacgagggggggggggggaggaatctcgaaacactccttgtccatgtatggtattgctcttttactatttccattttgactgtctctccgtttatggccctttttttgaagacaaacggccgaactcaatttgtacgaagaagctgcgaaatgcctgtggaaaannttgcctcgcgaanaagtgcgcanaaaa

SEQ ID NO: 18470 - DNA, 2860 bp, Heterodera glycines
caccatttttatacattttgcgttttaattgctttttccttcgatcacaaacggaggcaattgcgcatcgtttggctttgaattggcgaactgttttgaaaaataaaacttttgagggtaaaatattctattttacaagtaaatcatcagaataaagattcgcagtaattgaaaatttatagaaagttctagatttaaatactaagttttaaaaagatttatatttttgtaattttaaagttttagtttactttttaaaataatagttataaaaaaagataattacagaataaataacaaattttttctttttcttttacaaaacctttagttttttccaagtatgaatttggtttatttagtatttatttttcatattaacaaaattttagtttgtctgataaaaaccgcattttccgtatttataagttttgccattttcaccataataatgtccataaactattctcatttcttcgcttttgttataaataccaaaaaatatatttaatttataatttttgatgttgacatgctccaaatctgttatcgaaaaatgatgaaatacataaaaaaaagtcttctgctggaaactctagtcgtgctggcgcgtttcttaaatccgccaataggttcgaaaacaaaaaatgggtaacaaataaaaacttcacccaaattaatttttcttggtatcattcaatagctttatttgttctctatcagaattttattttcccaaattttttacttaagtataaaaaaagttattgtcataatttcaaaaagtctcatgtcagaattttttgtccagaacttttttgaaactcaatgaaattttctaaaattttaaagctaattagagaatttttagggctagcgaataaattaattaattttggctcatttaaagactttaaaattttaaatgcttataatggatatatgcatgaccattgcaaaaaacatagtatgttcaatgctttataactttttttattcataagctaaaaatttggaaaaaatatattctgaaaaagaacaattaaagctaattgaatgataccaaaaaatattaatttggttgaatttgagccaatatatgaatttatatattttactaattttttgttttcaaacccactggcggatttaagaaacgcactagcaccactctagttaataaccgatttgccccttaaattcttcgaattcatgaaccaattctcaccatctaaataatttattttagttgttttttggcacttgaaaaataagataagaaaataaatagttttttcggtatttataaattaaccaatgaataattgtttccttttgtatttgggggctcccggtaaattggacactggaaaattggacactattgtacataaaataaataagttaaaaataaataaacaaaaattttaattgaaatatataatgttattattatttgtagcatcagcagcagaacgccatcatacattcataacgaaaaaagttttcattttgatcgggttcccattttttgcgtatttttggcacattgaacaaccatcgccaattttctacattttttggcatcttaaccaatcatcgcctaatttcgtacactttttgccacatttgatcaataatcgtgcctatttaatgtttgatcgactctaaatgccttaatccatttatccacaccaattatttttcaagctaattcctgtgtttattttttaaaagaggaatttggtgtccagttttccagtgtccaattttcctttggtgtccaaaattccgacggtgtccagttttccgcttggtgtccaattttccggtgtccaattttctggtgtccaatttaccggtccccatttttgggacaagccttataataaataaattaattgtactgtttaggtaattttctaatttttgtgagattataagccatcaaagacttgtctaaaatgccaactaattattagtgctgttcgagactctcggtctcgagtctcgactcaagaaaagtctcgggttttttggtctcggtctcgggaaattttcggtctcgaacagcactactaattatatgccaaaatgtttcagccaaactgtcgtcagtcctccagagacaccaaccaaaacatgaaggcacattacgtaaaaaaacaaattttattgtttttttttactttttaatttaagaatttcaacccgaaacaaaaacgagaacaacaaatgcaaaaaatgtcttggagagacttaaaaagaaaggattaattgtggacattctgccaaagggcgacggaaatcgtacggaagtgataaatgagctaaaaaagctcaagctgaagcagaaaaacaactaagattaaccgcccggagctaaataacaatatttactttagtaagaaaatgaatttgttgttgattattcgaatgatattatttattaaaaataatttgcattttaaataaataatgtaataatattcatgcatatggggctatgatctttgtgatttatcatatttattccttaacgcccattggtctgatacgacatgtttttaggtgtttagttaagctaaatttagagtctatggtcatatttctttatgaccttgctttttaggccatacataaaataatagcttatacacaaaagcatggacaaacatttccattttttcaagccgtccattactgatcagttcagataaaaaaatgttctaaaagcattagtttttccaaaaaaatatatagtttctcatatgaactccgaatagtacgttttgaaaagtgttcgggatcgggatatgactccgaaagacaccacgggagcctcgatcctgcccatcgc

SEQ ID NO: 18471 - DNA, 2097 bp, Heterodera glycines
tttaaatccatttttttggttgtttatcttattttctaagtatttaagcaaatattggatatttaaaccttttttggattttggagggtttaaaacatatattttggcagtttttagtaaatattttggtccatatttggccatttttgagctttttagtccatattttatgtccatatttcgcgttttttagtccatataatttacaaccctaaaaataaaaaaataaaatttttcccaacgcaccaaaaataaaaatctttttaaaaaaagggccgtaaaaatatgttttaaaaacaaaaaaggcatatttaactggcttgaccaaattctaggctaaaataaagattatcattttttcaaaaattttattaatcaaaattccacaatttgcggcgcctaaatgcaccgccggcggttcctaatttttccatattttttttttgcaaaattttgtaccaataagtgaatatcgatcgaatccctggcccaattattatgatcactctttctttgatcagaattgatgaaaatcgtatattatgtattgtgtttcgtttagtctcttcaacgcatggcagcaaagaactgaaaaagttgcgcattattagcattaattagcggaaaatatgaaaaaataataaataaatgcaataaatagatttcaatttgaatttacaaattctcattgatcgcaattcgtcagcagtggtgttggcacaagtgccacaatgggacacaacttcaatggacgataggagcactttgttgacccagtggggccactgctaaaattcgaaaatgcaaaaaacatgcaaaaataattattttaaacggtataaaactaagacaaaatttctgtttttgacctaagtattttaaaatcttaagaaattgatggtccggcactgctggtaagcgccgcccgaagaaaatttgacatttttaaagaatttatttaaaaaaagcattgaaatttgaatttttaaaaccaaaaaacgtatcaatcatcaacttatcccttttttcaagctaaaaaccaataatgaagtttaattcacagaatttgaactcggcggagagcggccaaaaagcagagaagcgtatttgtagcagaagaaaaatgcgtagtcggacagatctaaaaaatggtgtacattggcttttatgtgcattttaaattaaattaataaaatgtagttgaaattaaattaaattaaagcaaatgtaaaaagttaattttacatttttgcagccattgcaaatcatcaacagttgtttgagtgcagaaagcggacacgcttttaaacacctttataagcatcttgttgacctgagtaaattgcgtagattatctttcatacagtaccctgaatgagtccaacttagcatacggtatctgagtatcatatttgaaaatcggccgaaataaaaattaatttatgtttatttcaacacctaaaaatatctattcgtgtacgtagttcgctagccaaatgttcaaaaaaattttgtgaaaagatttatatatgaatttttcaggttttcaatacggttaaatagaaaaatcacataaaaaattattattatttaaacaaccaagttgataattttattaaaatttttcaaaatttaatcttgaaatatcggcaggcactaagttcgttctgcaattgttgcaccgaagttcgaatactaaactgcatcacttacattattcgggtccttcttgttcgacttgaacggcaaaccattaatttcaataaaaagttgagaacaattggtccaacgtacaatggagtaaacagtttcattaatggggggggggggggataattaggaaattattaaataattattcgaaattttatgtaattaatttatttttttgtgctattaaaaccattcacgaattttgaagcttgaaattgtttctccggaagtgagttaagcagcaaattatcaggaagtgatctgatcattttcactatgcttcgcaagaggaacatacatttggcaacctgccaaagaattaaatgatttgacaaacaaattcaaagcagttttatgagcgatttaatgcttaaagagtgatca

SEQ ID NO: 18472 - DNA, 1819 bp, Heterodera glycines
cggacccaactaagtttacgatgtatttatttgtttcgtttgtgttgcttgcccccttttcgacggcggattgggggctaaacacctaagaggatgtggaaggtgttgttggaggaggacttattgactaagctatatgtattgggggattggattgtgcagtttgcacccactcgctcacaacccctgccctccagcgtcctatgccccccctttttacacagtcgcctcccggtagggattggcgcataatattttgtcaagaggctttgggcggtacagtgaccgggatcggaagctaactcaaacctgctcaagctaattccgtactaaatgattgctgaaaaattgagttggggaactgatgtgtgcaagtgtgagttcccatctcagtttacggtatttgactttcggtggcacaaatgggtgtttataggccattagttcttggcataatgcaaagaatattcccattatctcatacatatttctccaatcccaacaaaatggcacaaatcactcccggtactcaaacccactaaagtcccatcctcatgccgacggtgcttacaattagttaaccgaccattcactctccttggtgtactcaatatcattcccgtccggtactaaaatcactcacaaatttatctcctcaactgatggcgctgagccgtccgtcccacattcgagcaattttctagcaggtgctctctctatgagctggggatggtgttttgtgtatattatttgtctatcagcttgttgtcccccacaacaagccaatccccccggaggtaagaagaagcatttgctgtgctgctggtgctgaagtggtggcggtggtggtgggagacggattcgcgcctcccgaagtgtgattatcccccggggggacgacggtggagggggggaggagggttggtggccccctattgtttgcccatttgtacacacacattttttggtgatggtggtggggtgccttaagagaattaatggacttgggccttaaacaaaaaaatttttttttgttcccaatgatttttttggggggggggggtatatggaaaaggtgttaaaaagtttttttgttgttttcaatgtttaattaatggaagaaatgttggattggatgaataaatgtgctgctacagtgccattcattcattcattgtccaagcaaacaattttgacacaaaaaaaagcattttttgggaatttaattcaataattgaaaatcaattaagccataaagtaaataaaattgcttagaaataaaaattttttattttaaatatttgattttaataagataattttggtaaaaatgcaatttaccaataattatataagctacttcagttgtctgacgtaaagctaatttagaatgtttaatttaaattattttttattcatcttagtaaataattatttaaacaaactttttcattggaaaaagattaaaaaatttaatttaaaaatttttagaaataaaaaacatttttggcacgaaacatacttatggatttgcattcgaaagttaatgcagagggtgcagaagtgccatgccaaaatgaaaaagcgaaaatcggttttgaatgttttggcacgaaaacaatggacactcgagagacaatgcgaatactgtaaccccccaaaaaacagggaaagccaagtccaaagtattcattaattctcgaagattttgacttaatggaagttattgtctcgagagtttaatggaaaatattataaaatgaaaaacttattagaaattggccaaaaaatgaaattgaataaaaaagaaaaaacaatt

SEQ ID NO: 18473 - DNA, 1219 bp, Heterodera glycines
tgcccccaccgaaattataaaatcaaaaatttttccagtaaaaattggcaattaaaaaaataatttagccaatttcttagcaaaatgcattaaaatttcaaaatttcccggcgatgcccatcggcaccgccgagccacaatttgaaccattatttttttgaaaatttgagccaaaaatggcaaaatttgcgattttcggcccaaatccactactatgcctgctttttggctcaggcgctgaagattttgaagaatatcactgaagaaaaaaaaaaattttttcgcccgaagagcgaaaaaagctcttaggttgccctccccgaaacttttttctgaaatatgggcatggggtacgcagtaattaatatttatgtaggcaaattcggacagattatggcattataatagaaaaatattacacaatttacaattaacttctgcccgttttacaaaattaatatttttttatgctttaggtcgatgttttctctgagaagatgaatggcacattaaaagcgaaaaatgcgattgccgatgccaacataacatgcggactgaattcaaacttctacttgtacgtttgtgtgttagttcaataacaacaaaatgggattatgattatgccaatcacaaacacaatgccgcgaactattggcatttagcattgaaaaagcggcaaatgcaacgaaaaacaaaatttgccgggattcaatttcttttaagggtcgttgctttatctcttccttatgcccttttgcatgccaaaattctatttttaaaaaataaatttatatgtaaggcggatatgttttaattacgacgcaatagtgccgaacattttgtccatttcttgttcaatgggaaaaataaaatatttaattgttatcaaatatttatttattttttatatttaaattgtgccccattttcagtggatggtccacctgcatgaaagtgaatttgcttctttttatgtgcattttttttttgattttttgtttcttttttcagattgcattctacggggatgacggctatgaaaagcatgccgcaaaatacggtctcgagcaaacagaagggccggaggaaaacttcaagaacatgacccagttcgacaaatacggcttcatgcacggtgaattgttggcattgaaaagccattgacatcataatttgcagcattggagagagctaaaattaattattaaatctgttttca

SEQ ID NO: 18474 - DNA, 1758 bp, Heterodera glycines
  misc_feature (859)..(859): n is a, c, g, or t
aaaagtgccaagtcgccagttttagctttgcacgtgtatttttttttgttgtttgttcagattcgcaacctcaagttggattgggatgaattcgacgcaggtgatgcaatgctggacctgaccaacaacgacaattacgacagaagcggccagtacattgatgccaaattggtcaaaatggagcctaaaatagtgagcccaccgaagccaacggtagggtgccatacaacaaaaccaagcaaaattatttagaacaaaaaaacattaaatcatttttaggaaaaaccagatgttgtggagcctgtggagccagtaagtctctttttatctgaacaaatcatttgtgagaatataaattattataatttattattattaacgcacatttgcaaaaattagtcatttaataatgcctttcatttagacaccggcggggaatcaaacagcagaggttaagaagaaggaaaaggtggagtcaaatataaaaagaaaaagcaattattttttaaatggtattcattaaaattccattttttaagaagtcgaaggaagaagagggcgaaataatgttcgacgagaagtcgaagtcggaggatgatgagttggaggagaagaagaagtagaaggatgggatggaaggatgaaaagcggtggtgaagaaaacaaacggacggatcagagaaaaacccaaaaaaaatgcacccctcccaagcccattttaatcatcatttgtgtacccctccaattcctcgtcccccgccccaaatttcattagccaattgcccccatcaacctgtatcatcatcaccaacccaattcaaaattagccattgccccacccaatccacccctatcgtcncagtctcccctccctctccctccctttgttttggattaattttttgaatttaatttgtattttaatttatttggaatttgcataaatttaatttaaaatgcggtgtctttcaatggaatgaaccatacaaaaattaatcaattagacgcctaatttaaaagcttttaagacaaacaaattccttaaagttgggctacaaataaaaacatggatttccaaaattttatcccgagatttttttgaaagaaatttaaagacaaaaaaaatgaaatggccaattgtaagtaaggagttgcaattcagataaaattttgcactcgcccaaaatttggtgcttaatttcaaagtttaaagtaggagaggtcgggatcgggcgggaaaatcactgaaaatggaggggtcaaaatgaaaaattagggtggaaattgggtgaaaggaaatgttggggaaagtaattataaactgaattaattaaagtgcgcaaattgccaattggctaagcctgcagtctctttccagcttttgccctgcttcaatccccagatttgttgtctgtaatcagttgccaaagcatcccaaaactgcaaatcacatcaccacccatccaccaaatgtttttaatttttaaactttatctaaaattataattattattgctacgatatattttttaatttctaaacccgacaaaattgtgagtttttttatggaaaagttcaaagaaacatatcatcgattaacaaaaaaaattatttaaaactttgaattttttacaattttaaattttgaacgaaatgttcgtttaagaaaaagtcacttttgaaataatatttgctcacggcttttttattttcaaaataagcacaaacaaggctaaaactaaaatttgaccgcagccc

SEQ ID NO: 18475 - DNA, 794 bp, Heterodera glycines
tgatttaaatttgatcaccattccgacaagcaaataaatcattaaagtcattatcgaggatcaacaaataaacaatgatactgaactttgacgtaaactaaaatatatatttttttaattttataatttaattagacggaatgggtcaaatccgtccgccaactccgtccagtcaagtttaaaaagccataactttttttttgttgaccaaacataacaaccttagtatcactcaaaagctcttgatatctagaagatatttgtaagccttttttaattgattaagcagctcacaaaaaagttctcgcttgaaagctggaaaaaaactcaatttttgtatatttttcaaagttgactgggacagagttggcccgttccgtaattagaccatgaaaaagtcaacagtgcaaccggtgatcatcagatcaccatgccgtgcaaattcttttttttttgttaattttactctctcaccaacagaaaattgtcgtcatttgtttttttctttccaactttatttttgacctttccattttcggcatttcttcttcataatgccaccccagcaaaacaaagtttggacagttttgcctaatcccgagcagtaaaactccccatctttttggtgatggatcgtcgtcatcatcgtttataaggcaaaatgccatttgtcatatcagagagcggagtgccaaatttgaatgaatgatgtatttattataatgacctgctgctgctggggtgcgtgctaaccatggcatggcaaaaacatttcaaatggcacaaatttacgg

SEQ ID NO: 18476 - DNA, 1836 bp, Heterodera glycines
aagagaaaaaagagatagccattttctcggcaagaatttttttcgttagcatttcaaatatcgtgtgagtgtctggtagacatcagtatagagaaggtaaaggaaggtggtaggcgtgccgtccaattctcaggtcacccccccccccctccagttttcgtcatcactgaaatttccaaatttggcaccaacatttttagtagtgtgactgggttctgactgactaaatccccagtggataaacaaagtgaagtgcacagatagagttgttgtcccccgcccccctcggcccctgtgccattcaaatttggcaccctattttttctccgttcggcacaaattggtggtcccccgacgcgcccccccccctccctctcctggcccgggtgtcctccgccggacgactctaatttggatgatttgtgccaataaaattaaattaaaaaactagccccggaacccaacccgccgcgattcagccatataaaaatgttggagtttgggcatttgtgctgcagtttttcaatttcctttatgctgattaaaagtggactaatcattacagtgcacagccgcagggctcagctgtgccgtgccgaaacggcccacaaaatgtgccaaacaaccaccgcctaatggcctatgccattaaaaggccaattagtagtgcattggcacttttcaaaactcatttcagttcgttcatttggcatttttccggccgggccattatgcgtagcccatttttgaggctgctgattagccaaaattgtgaaaatggaattttggcaaattaggttattgtaggtaggtagccctgttctaccattatacattaacatggcatttgtctcgccaaaaaatgaaaagattttgtccacatttttaacacttttaaaaaaaactataattaagaaattttgctggattgaaagaaacttataaacttaggcatcgattcccaagacatcaaaaaccataaaaattagaaaaatcccttcaaaatcattttaggctttttttcaatttctctgtcatatcaatgttctgacggacgtcgtatttttgaccgattttgacttttaacagtattttattttttcagaatcgaaaatatggtcattcgatttccctaaatgttcaaatccgtcaaatttatgacgtcagaatattgagtgacatgacggaaattgaaataggcctctggaattttttatttacaagtttaaaaaaaaaactcggaaacacgaattctcgattttttggtctctaaatatatactttcgttaaccaaatcggtttaattcattctttcattcatccagcaccaccaaacttagtgcattttttaaattatattttggcacatatcacaccacattttggagcagtacaccgcccgcaaaatgcctgcatcatcaccatcgtcatcatcatcattatcattcatttccgtgtccaacagtgccatgccgtcctcgtcgccaccgttgttctcttttcctgctcagtgctatgcttcgtcatcgtcctgctcgctgctgttgatggtgttgtgttgctgctactgcttgctgtcgtgtgcagcagaagcggcgccgctgcagccgtccggcggcgccagcggcgaacagtttgaacgcgccgaccgggactatcgcccgttgcaggtgagacaggcaggggcaattagggacaattaattatttaattgactgtcatttttatttttttaatatttaaaaattaaattacatgcgtcaatatttattcatccttggaattatgttctatgaggcaaaaaaaaaaatatatataaaaggtcattatcaattg

SEQ ID NO: 18477 - DNA, 2721 bp, Heterodera glycines
attaaaaagcataaaaaaataaaattttaataataatttattcaacaaaagtgctcaaatgtataattaattatagagaccggccaggatcgggatccgagtttctttggatctgactcgggaatccgaccggttaagaagcaaccgaataggaatgccgaaaattttctaatttttatcccaaaccctgttccggaagcaattctcgaagaatgatctctgagctctgaatttcaaaaaatccgatctctaataaataagggtaaatacaacatgagttttttacaaaatgtattcctaacaagataatgccaaaactttttctgattgcatttacttcttaaaccatatcagctggaccaaaagtgccataatcatgctgtcgggtattcagttcaactaaagaaagaatttttaaattttgtaaaattgaaaattttctattttatttaatattatattttaaatgtttaaaatattataattttattttgaaaattcctctacctttcccgtcttcatattcagtgaatatttttgtacggcaaattggacaagaattattgtagcccttcaaccttaaaatgggatgaacataccgtatattctttagatcttaccatatttggatgcaattggtatgaaacagatgctaaataaattagttaattttttgtaaatcaaaaaattattaataattaattaatagtttggtaaatcaaaattaaattataaaaataattaatattatactaaatcaacattaaattttcaaagtcaaattaattaatattttgtttaatcaaaattaatttttatgtttagattaatttaaatatatattctttttactcgacaagcgggcaattttttaacaattatcccgggttttatttcgtccaaacaaattctgcatgtttccggcccagattgtgccgaacttcgttttccaatttttgtgccggacaattggtcgaatgccgtcatgtcttagcatttaagagacacaatttaaaaaaaattattaaaaatgttagggttacatgtcgtctgggtacccaagctggtccagaccccgatatctggcttttccaagacccggacccggtacctggaggcggttggaaaacttggacccggaccagaacccggtttttctggactcagcaattcctgaacccggcttttctgaactcggcaattcccgaacccggcttttctgtatttcgcaagttccgaacacgttttttctgactccgcaattcccgaacccagctttttaggttcagcaatttccgaacccgtcttttttagagtccgcaattcccgccagctgttctggattccgcaagtcccgaaccccggcttttctggattccgcaagtcccgaactcggcttttctggatttcgcaattcccgaatccggcttttcacaaatatcggactcgattaaccctaaaataaattaaaaattgtacgagcttcgccaatttcggttgaaagtataaatgccgttgtttctgttgcaaattgttcttctgcctcttcgtcagaatgccaagtgcaacaaaaagtaacgattctgacaatccattgacaaagcataactaatcccaacataattaaaatacccattatgccgaaaaaatctctgcgcttttttcgacgacgacggcgctgcatttctaggtagaaaatgtatatttaatttaaaaaaaaaacaatttggtattgcttcaaaaatatattggcgcgcaaaagccaaatttgccattctccgaaggggtaatgatttttggatttagcgaaaaataaccattttcttttttaaacccataaaaatgcaattttgtatatgtttacattgttaagccatctaacacatttttttcttaattacccctttacctttatgaaatgaattaaaccatttcccaaacaaattgttcgaattgttgctgagttggcgaaatgcccatttttggtttttccgatatccgtcctgcccattttcttctttttcatgctcatttccagtcctatcattttcaaattgatcatttaacaaatttgtgatttctttaagcataaatgcactttttcttggctcaacaacattcgaaatttcgttgaaccgaatgccaaaacggttggccattaaggtcatagaatgttctaatgaggcggtcaaatagttttcatgacgattggcatctaaaaatagttttttaagtagattttattaataatatatgcttgatcctaagattttgaccccaaaactcttttacctccacctttccatcgaaaattgaaaattggcaacaaaaaggcaaaaaaaaaaaaatagtcccgaaaattttgaaaaagttgaattaaattattcaaaaatattgcaataatttgttgccaatcttagaaagaatcagcaagtaattaattataatgaacataatattaggtgcggttttcgattaaattccattaagcccgaaacgtaccaatttttaagctcttcagcatttgataaatgaaaaataatttttccaaactgtataaaagtgccggatcattttgcaactgattttgtaccattttctgaaatagaaattttaattaaaattttttaaacgaattaaaaatgccttttccgctggggtttctgcaattttcacgatgacttcgtcaagttgacacaattggcctgccaatacttttgc

SEQ ID NO: 18478 - DNA, 2083 bp, Heterodera glycines
ccaacgttctcatgattcgaatcgccacattttttcaaatttaaatgaaatgaaaatgttaatgcaaaaattaaacgtttttgctaatgcacaatttttcgatcaattttataacctctcttccattgtcattcgaattctcgaaaattgggaaaatgacggacaaaagtaaaaaatgataatttacaatattggaattttaatgggtttttttttgtttttttttgcatgttcagtccgactccatcatttctcagctcaccggcggacgacgatttgaagggtgaaattggctacaattcatgcaatttagccaaacccatcattttggaggggcggttatatccaaaaactattttatttgtttatttaaccaaattcattaacagagtgacccaatttcggaggcgaaatctgacttgtcgaaaaatattcaaattttactatttcaaattattttcaaacgttttttggggaaagaaatgctgtaccaaaaaagatttgctttgaagcattagaaaaaagatataggcgttcaaaattttgttttttgaataactttttagctaaccctttttttttgctcttaaaaccccctaggttttgttcgtaatttttttctttctcggtatgaaaaattaaaagaaattctgcccgaggaaaaaaagttatgctgttcgaaatgtggataccctaagcagaaaataaattgttttttattttgtattaaaaatcgtttcattttccatagccaaaaaaaaaaaacaaaaatgggcatttttgacgaatttgttattgttgacgaaaaagcattcaccaatttgctgattgagaaaggaaacacatgccaccttcacatcaactgtcttggttgtgcaaatggccgcacaaaaaacgtcacaaaattcagtgatgtgactcaattcgcggcactgtaaaattattaatttgcaaaaaaaaattgtaaaattaaatctaaatttaagcgaatttcaattccaaaatgcgaattgcgcattggaagtcaaggacattggcaatgcttccgagtcggatgtgccgttggcacaaatcattgtgtggcggtggaatttgaggggggcacagacggtcaaaaatgtgcgaacgaactcatatatttttttctaattaaccctcgagacatggcccaaacaaaaaaaaaccaagaaatatttggatgaccccctttttaggcaataaattttcaaaatctctgtgttaaaataaggattttcggggtcggaggaaaacccgctttcggcacttaaattttgaaggtatgccaccaaaaaattgtaaaatattagcgtggtctccgtaaatacgaaaaagaaattttttccaaaaaaaggggggggggggtccatctaagcatagtattaccgagatttcccttcttcgagactctcgaatagaacccagaaaatattttttgtccctttaattttagcggcaaactttgaacattggtggcactttatttttccatcaattttatgccagttcttccattatcattcgaattctcaaaaaacggcaaaaggacggaccgaagtaaaaaaaaatgatcatttaaaatttgggcattttaatgttgtttttttttgaattttcagtccgactccatcatttctcggctcaccggcggacgacgatttgacagttcaaatcggcgacaaaaaggtgaaatcggcaacagtgcatgcaattattgagtttaaaagtgccgaaatgaattaaaaagtagccaaaccgttcgcttttcttttggggggggggggggggggggctctatccaaaaactatttgatttatttactagagaccggacaagagggtcggtcgaacggtttcggttaaaaaaccgaaaaaaaccgaagaaaaattttcggtataccgtttcggtttcggtttttttgaatttttttatcttttcccaaaaaaaacaataaaccatttttatcaatagaaaaagcgaaagatcacctctgagtaaaattgtagagctattgaagctctctatcaatggtgtactaaaggttggaaaatgatagaaaaggca

SEQ ID NO: 18479 - DNA, 1789 bp, Heterodera glycines
atctctcaatctctaggctagggctcaatacatacacacctatttattgatttgtttttctttttgaatgacctcccccacccctcccgaaaattgttttttgttccgccgtcggttaacctttgccctttacacattttcccaatatttgtgacattggtacgttcaattcaacagcaatgttttttgatacataattttgtcatttcgttcaagtcgagaatgcggtgaagaattatcgcataattttgtcagagatgagatggtatgtatcattataaaaaggtgcacaacattcctccacccccctcccaccagttcccccacccgtatcgtttcccttccccacgaaaattttattttaaaagaaattaataaacaattttcaaaatttttgttatttattgtttcccccacacctccatttttcgaaattaaaaaaaaatgtaaaattcaaaggaaataaaatgtttgatcattgatcatcatttgccggggttggtgagcgccgccgagaacattttgaaatttgagtgcgggagttcaaagattcgttccttaaaaattcaaaaaatgcaattttgcattctaaaacaaaataggcagtcaattagtatagttgtgttaggtaaattctcaccgctacagtgtctcatttcgtccgtttatttgttatttaaaataatgcttgattggcattttgtttgttttttattttttgtcaaaacatttttctaagtgaaacaagtgcaggtgcgtgccatttgcgaacacaatttcttcatgttttgtaaacaataacatttcttagtctttaaaaacaacaacacaatcaacattaaatacggttaaatgttaaatggactagcttttttgggtccaatgaatggccattctcaatttcttaggccatagttttttttttcattttcgatcgattcctgcgttcttggtatcagtcaaaggcttaaaatttgtagaaggattcttttgtaataaattctgggctaaaacagcagacaaaaaatatcatgaatatattcggaaaaaccccagaatttcgtatttttttttgtaatttttttcttaatgtcaatttttgctattttcttgcatttatatgtaaattaaccagattttaagcttccatttaatacaaagaaatagtcactgtgaccaaggaaaaaaatggtctaagaaaatgaggatggtcattgattggacccataaactgaacttgagccgttaaatgcggattatttttaaatcgtttttaataaaatataaaactgtcaataattttgttgcccattttttaagattgctaatgtctgaaaatgagcattcaaacgttggtggcgcatctcaccaagatgaagattcttcggatgatggactttggaacgagttcgaaacttgcgccacttcaggttccgaaagtagctgtttggcattgttcgaatttggattgttttcagtgactcacctttatcgcaattccaattggcgcacattgcaacaagcggccgcttcggctacccaattgtacaaggtttgtagcaaagaaaatgaatacagaaattgttgtagacttaattgccttggttgttagggtttaggacgatggttcgaatttggaattaaaaagttttcttaaagcgacagaaatcgaatatttttacaacaattggtttctcaatccgcgtgaaatctgattcgaggaattacttctttttttttaaatggcgacgtttgtcaattttgtccactaattacaaataaaatgtaa

SEQ ID NO: 18480 - DNA, 1315 bp, Heterodera glycines
  misc_feature (1286)..(1286): n is a, c, g, or t
taatgcgaaaggcgaaatgccaaaagcgaaacctaggcacatccctgctgccgacctatgtcactatgaatacaatagaataaaattataattgttcttgttcaaaatttgtaaaaccatccattttgcaattatataaaataaaatcttgacgaaaaaaataaataaaagtgcttaattgatcggtttcaacatttctgctgcctcggtgtgttgggttgtgatcggggctggccgtgattgaatttacaatcacggaaatccgtgagccatgatcacggcgcttccaaaaaaatccgtgagcctcggatgaccgggaattcccgacccggtcccggtcccgtgacactctagtataaaccagtaaaaacactaaataaagttatccttattataaattaaaatataaaaaaatttatattaaaaagaaatgtaataattgatagttaaaatttattaattgtttacataattcgaattttctacatctcatataaaaattttttacaaatttgctcaatccaaaaagctttcctttaagctatactctaacaaaatcagaatataaatataatagatttattgtacctgatttttaaaaaatttattaccattcgttcattagtcgccccgaaggattggtttaatgaaattaatttaaattaattttttaaataatttgcatacaatctaaaaatttgaggcaaatatacaatatgctaaaaaaatcaattactaaatttcaaaattaatacaaaaaagtgcgagaagataaaaaaaaatgctggtattagtccaaaattaaaatattttaccgtgattaaaattttaaaagttaatataaaaacattttatcattagcattttgccgatttttaatgactaaaattcagcgtgaaattcaaaaaaatatgaaaattattagctgaagaagcattaaatcctatttttgcgatgttaataactaaatataatgaacatccaacataataacgtattcaaataataatccgataaaattaaacaataaatttataacgaaaataaataaaaaaatcgatggtgtacaaaaataaagcaatggaaatacactaccatgaaaactttaaaaaatgaacgattgaaatttaaattttcaaacgaggctaaaactaagattttgacccgaaaataagattttttctaaaactaatacaataatagcgtcaaggaaacgcaataaaaacatgaaaaattgatttaaaacaatttttttcgtgtaaaaattgcaactgaaaattttctanatcagtatttagccgcaaaaatcatcttt

SEQ ID NO: 18481 - DNA, 795 bp, Heterodera glycines
ttttgaaaatatctctgtaatttgttaacagatttgcaccaaaaaatgatcaatttttgagattttgagccaatttttatgaaaacaatatgatttgggggcaccacggtgccgataggcgctgccggaggaaaaatagaaattttgaccatttttaaacagattttcctgaaattttggagcattttacactcaagaaaatgaaacaaaaatgtaattttttcaaaattaaaattaattcaaatattcgcttcaataaaaaatgatatttattcaaaaaattattcaatttttgcatttttatttttaaattcaagaataagcacaaaacaaggaggtcgtgccaaaataaggacaaatcttacaaatacggacatttttaatttctaagatcttgcacctccaaataaggacaaatcttacaaataaggacacttggccactctggtatatgtacatcaaaatagacatatttaaattggaaatattttcaattttcaataatataaaaggagctaaaatacttggaaagcatttttaaaaatcaaaagataaaatattatttttttaaaattttgcgagataaaaaatatttagattgaaaagtttccatccatgttttcattaattctcaaagcttaagaattcaaagaaatttaaaaatgtttatgcactttaaaatttggcaacaaggtaagtgccattctacttcaaaatggagtaccatggcactccttaaaatgaattgttaaaattaaagtgccatgcattcctttcaaaaacttaataattcaa

SEQ ID NO: 18482 - DNA, 2161 bp, Heterodera glycines
attcatttttgctttcttcttcaacttcaacgtttaaaaaggaacattaataggcatctggggtagccagttcacatgaaacaacaaagcttaaagaaataaaattaaaattttaaacaattttaaataaaaaataaaatttataatttattatattttttttttttaccgagcaacgcattcccgatcaattgctttggtcaacaatgttgaagtgacttcgttcccatatttcatttgataatgccaaaatgacaatgcatttaattggttattgtcatcataaaatgaatataaatccatataattctgcaaataattatgagtatatttatttatataattttgagtatatttaattttaaggattaaaaagcaatataattaatttatttaaaattaaaacaataaaatttaattttttatttaaatagctaaaaactcattaaaagacgactggttttaataatacttttggccgaaactaatttagaggtttttttaaataaatttttagcctaaaataatttaatagttttttatttgactgaaataaattttttataaataaaataagccaaaattgaaccagtgatttataaataaattttaacaccaaattttctttaaatagttgcagaatttgaaagtttattttaattattttaatttaattgacgaatgaaatttcatcaaaaatctgcaaattatgggtttaaatggggcggtcggtggttccaaatttaattcctccaaattttccgtcatgtaaagtcagtcagtggcgggtgaatgagtgattagtggagcaaacaaatcgccaaataataaatgttttacgtcacacaaaaaattaaattccatcatattttatgaagtgctgtttaatattggccaaattgttaattaataattattttttcaatttccttttaattggatgacacattaattagtgaatcaaattttatttttattaatgaccaaatcataataataatgcgagtaaataaaatttgggataaaaagcaacgaagcattaaatggatatttggaatttaatttaaattagcattttttcacattttggcattctttcggctacgcccaatcattcttggcgctatgtgcattatggaataatctgaaaattttggagattttttttattacaacaatttaataattactaatcattagtgtttggtgaattgttcggtgggagttttttgaattatgctgtacaaatactaaaaatcatgattaaaataatatttttgcttattaattctcttaaatttaccataattacatcacgcactgtgtcgttttttacgaaactttgctaaaattttgaaatttttattttttatagaaagtttgatagatttttaaaaattttttttacattaaataataattaccaaaattgcatcttgacttgggtttgttgcattcgccggactttgctgaaataataataaaaatttttaattttttaatttaaattaaatatttttttaattaattaaattatctaaaataacattaattacaatttgtcctcgggttgaattgttggcatttgacaaattggtctttaaattaaaactattaggtaaatttagcttttgatcaaaatacattaatcggctctcgaattttgttgttggaatttgtcacattcggcttaataaataataaatttaaatgattttattttatgcaacatttaaaatatgcataatgaattttcaaaattaccataattggtcctccaacagtgttgttggcattgttatgcttaaaaaacatattgaataatttgatatatattttttagcattttaatattttttagttttaaaaacttcaaataattacaacatttggcgcagaaactctgttgttggcatttgcaaaagtttgctgaatcaataaaaataaataatttctgtgtttaaattataaaatatttacaatttggccgggcgttaaattatcggcatttggaggggcaaccttaggaatatttggtaattaattttttttaagtcttttatcattacctggatttgaactcgaatggggtttctggcgcttgtggaattttgcttaaatccataaatttaaataatattttatgaattttaaatttaaa

SEQ ID NO: 18483 - DNA, 1553 bp, Heterodera glycines
tttggggcgcactcccgttttaccgattaagtaaggaatcgatgaaagtagtggtatttcacgggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtgaccttagggatgttctcgtcgccgtagactccctttcggggtcaccaggctgttagcctctgcgtctctgagcgggttgctaccccacccaactctgcaggagcccactggcagcatggtcgccagtgcggtttcccgaatgcgctaatcgagattccatccatcccaatacacgaacgacctgctggcgcaagcaccaacaggaaaaactcaagcttttcggttctcgcctggtctctcggttattatttcttacgttcgcactaggactaacgctaccgcaagcttcaccgttcaaccaacgatcaccgtaaacattggatacacattctcaccaccggggaaggttatcaatactcgggctacaagtcagtttcggacccgttcctcggcacactcaaatgggtccgaatcacatgtcctgaaccgataatcgcagctcgctgtattgactcaagcaagttcggtacttcacgggctgaaataccaagctcgctcaacctaccagttatattcggtagtacttcaccgcacgacccgactataatcggcaccactttcactattgggaagtcttttccgtaagcgcgacctaacacattttgcaggtttggtcctggtacttcaacttccgctagttccaatggttcaatcatagaattgatcgcatatttccgccacttgatgagttcctgatttctcaggttctctcgccatggcactgaaatttccacgattctgatcgtgcggcttcctttatcaaatactaccatatccggtctgttgcttcgcagaccaatataaccagtactcccgccttcctgaggaagaacactcgctggtggagtgtgtaacgctacatcgtagaggatcttggctcgttcattttcaagtactgcgtgtaggggcacagtatgtgaagacacgggcaacccgtactttctgcagagagccgtgtgtacttgtcgtactacaccgttatgcctatctagcatagttccagttcgggaccaagcacatccactaaggatatgctgttcggtctcgacacgcggatcaccacacctccggcaccacttagctctcgcgctcatgtgcgggcactttaattcccgtgcctttaactggccctcttgtgccgcaatacaatctcggaacgaacgtttcccgatccttgctcgctctagccaatgatagcttcgaacttgatcgagctctggcaaattcgcgactcgaccacccataggtttacccttccaggcggtcaggcgccgttcgtcattcgcagaacgaatgatcttcacga

SEQ ID NO: 18484 - DNA, 2038 bp, Heterodera glycines
ctgtcctttcttcattcattcttactatcggcatggttttctgccttgagatcaagcactattttctggccaagtgcattaaccgcttcgattagaggcaaagtcttcagcacaatgaccaaatcggccacattgtgcttggccaacattgtcccctttttgtaagagccgacctcgcgcacttcctcaatggccttacaatcaaaaaagatggttttaatcaatgcttattacaaatatggtaaaaaacaaaccacagagttaaatgtttccggagcaacaatgattttgtccaaagtctgcttcacttttccaaccaatgccgaaatagcagattgttccaccgtagaaggcagaatgtcattgtgtttggccaataagaactaaaattcgaaaaaaaatttgattgttaatgaataattatttaacgcccacaaaggaaaatacgggcccaccattcttacgattgccattagtgttggatgaacctgtgtctgagctgtttcctcagcctctgtgctgcttcgtgggaaaaactgatcgcaaaggtacgggtcaaaagtcggtggcttgaactgatagatctgttgaggcgatgctccatggacactcattggaactggcggacgcattggaccaacgccaggagtggcggcggcgagcggtgtaggattgtaagcaatgggaggagcaccatagaaagaccccaggctgtacatcatcactgaattatgctaaagtggtcatttttcaaagcaaagaaaaaagtaactaaaaatattgttcattcacattacaaaagtgaaaaacaaaaaacagcgtaagaaccaacaataacattttacatagacctcatcaaataacgtcaacaacaattccaactgatcgacttcatgatcggtaaccaaacggttgttttagcctcccttcttcttagacactcccacagtgcgtcctttacgtccggtcgttttcgtatgctgaccacgcacacgaagaccccaataatggcgcagaccgcgatgtaaacggatcttcttcatgcgctcaaagtcatcacggtatttgctctccaaattggtggacaaaacctggaacccaaaaaatattgtaaaatactgttaaattattcctctaacctgttgatttttaccatcgcgaatatccttctgtcggttcaaaaaccaacttgggattttgtattgctgtgggttcaacataacagtagtcagcttttccatgtcctcctcagaaagttctccagcacgcttgtgaatgtcaatgtcggctttgcgacaaacaaggaaagcataacgacgaccaactcccttcaagatgaaaaaaactcaaaaaatattagcttaatcaccttgatcgctgtaagggcataaggaactttacggttgccatcaatgtttgtattcatcacacgatgaatatgttggaatttttcgggcataataagcgacattttccttttttcaatctgttaatgtcttaaaaatcaaattcaaaaagcctgaattgtttaaagcaaaacctttattatagatttaagtacccctttatgctgaattgaaaaccccaaaattcgcaagactattttaaaagagcatagagttttcagattggtccgttcaagggctaaaaacccaggaaaatagcaccctaaaatcaaatgtttttgaatattacaaaatgccaaagtttagagattgagattcagcgagactgagattgcttcaaattcatatgtcccgtttaattttgcgatgcaatttttaaatcaaccatcagccagtttttaaattttaaaatattgctttgcgactgaatatgcccagaaaaatgaatattgacattgagagacatcagcacttgacaatgccatttatcacagcatcaaccagcgataaagagcattacgtaatcaacggtcgaagtgcttcgtgtagttcagacgaccagttcagctgcacaaaatacgatcacactgacaataagaagttcatttatttaaaaactcccccaggaattg

SEQ ID NO: 18485 - DNA, 1659 bp, Heterodera glycines
tcaatttttttttattcgttttcaccattattaagactgaaaattcggatggccaattttttgagcgactgtgtgaagaggaatgcgagcagctggtcggcattttgccatcccgatatttgaaggcggaaaataattgtgcaaatagcaatggcattatggcacgaaaagaccccaacaaaatgttgagcgaaagatttgctcaattttcactaaaaaatgcagctgaacgcaaaaatgagaagccggaggaactgaaaaagcaaatcaatgtttggaaataatttttatttaattaaaaaataatattaattaacttttatatgtaattattttgaaagttttttgttttttaggacctttatttggagacactctatacaattttgcataaaattggtaaagaagctgttgccaacgaggaccaacttgcgcaatatgccaaatcagctttccaagtcgaagaacgtactcatcaaacactgatggaaaaagcacggagcgaaaaagtggcattttaaaataaaatatcctttattaatttaatattttttattttaatttagccgccaatccttttgttaaatgtccttttgctggaggcccgtgatttaatcgccaaagatatgtaagagtgaaaataaattaagataattaataattatgcataaaaataataattgaaataatttatcaaaatttaatgtaataatttacgtaaatttgatttgaaaaagcataaaatataaatctcgaattagtaaacaataagcttagaaaagtgccttttatattcttaggttgagttagcaaaaaaaatgacaaattgctgacaaaagccgcttcgaaaatattctaaaaaataattttctaattatagtgacggcttttcggatccatttgttatgcttggcttggtgccaaggggtggcagtcaaaggagccctggcgcagatgatcagaattcgccaaccaatgtgattaaattaagaaaaaaaatagttttaaagattttaattatccactaattttattttaggaaatttcggaagcggattcgtctgcttcagctgctgacggtggtgccggtggtggtggcaattccgcgcgaaaaaatccgctcctgcaacgcttcagcggctcatttcgccgcaaagcgcgcaaggcgcgcggtgagacgcaaacatttgacgccgagaacggcattccggcacgcatcatcaaagcgtcatcagtgcagcggaagacgctgaacccgaaatggaatgagaagttccaatttgtgattggcgatgtgactgatcgcttccatttggacatttggtgagatttaggcatcgaatttttaaaaaattgggtgccagaccaataatttacagtgcctaatttaccggcacttacaagggaaccgttcaaaaaaaatatgggttgtaaacacgggaatgtttataaaaaaattttgaatatatgaaatctttttaaatttagcaggcagaaagtatttgtactaaggtatttctctgcaaaaattcatatttttctgaaaagtacgaaacgaacaggaaaatcagcatttttaaattccgtgaatcttataatttaaaaatcattttaacacagaaaaagtaagaaaattttctttaatgaaaataattgaaa

SEQ ID NO: 18486 - DNA, 182 bp, Heterodera glycines
tttcaagtttttccgatcgaatgggaccgatttcggcggcacaaaacattccgaattccattccactctagtgtaaagtgatacccaattatgaattttccggctgacagttcaggaggttcccttgtcatatattttttttacttaattctttggtgtgattaatgagataattaaaataa

SEQ ID NO: 18487 - DNA, 2365 bp, Heterodera glycines
ttatgtacaataaatattcatttgtcgatttatcggaacgctattccaatataactgttcgtttgttataaatagggcattctattacatgcaaatgcatctttttttccccgaactatctaaggtctgaaaagtatgttttattagcttggtttacgcttctaggaccaagttcaatttgaaaatatctgtccgctaatggcttattattccaggaacgaatgatttgaatcagcctaaaattactcacgatttttttatttataagtccactgctggtcggaatgccgaaccccaagtcagacttatttaaatggaaagttccctttttaatttctatttattaaatataaaatgtgaatatgcctttgtttattaatgtgttaataaaatcaaaaatgccactgctttattatgctcttctgtcattttctgataatctatcattattattatcattttcaatggctgtttgctgctgctgatgttgttcattttgttctgttccattattataattattatcatttatttctataatcacttcgttttgtgttcctccattagaattattattgttgttattatttgcttctaaataattggtggtattttaactgatttaattaataattatgctttaatgccataaatttaagtaattaattattatgctcttacgtgcattttctgttgttgttgacaacatgtccgtgtccaatatttcttgtcgacaaattggacaaccattatgaccgcctccgatcctaaagcatatttattaattaattaactatatttcccctaataacttttgcttaccacatttcaatgcattcgttgtggaacatatgctaaatcggcacaaaatgattaatttaatgtgttcaattcaaatggcaccacaccttacagatgggcaacggtttgacttttgtgccggcatcgatttggcataggcaaattgcgcattccgtccgttcttcctcgctcagttttctggcgccgacgacaaccgaaggaatgccattgaaagtgtccaaatctgtgcagcagaatgaaatattggcttatttagcaagcataaataaaattgaaaagcttcccccatttttaagagtttattaattgaaaaattgtgacacctaattaactaattagttaattaatattataatgccttcttattacatcgtttgttgctcattgctccgtttgcttctgtttgtccattgtttctgttaatgttccgtgcgatattttgcgcgttatgacaagcgatcaaagacaggcaaagaatgattagcacgcacatagccaaaagcaaataacaaagtaaatttgcgaaaatcattcgtttgcgcctccgtcgtcgcctttcgtctgaatggttaattagacttaacacttactaattttcctaattaccctttcgcccattaaaaagtgcggcttcgtccaaatcgatttgattagctctaaaagcaaatctaaggaatttttcttcatcatttggccttccttttcttttatttttatggcaacttgagcaatttccaccatttcggtaacgattttttggctaggtaataataattataataaattagaaaatattttaattaacttcctaaatttgaattaattactttgtccgaaaatccaattaattcttccattaaatattttacgctttctttgcttaaatcaaattgtttcttctctccgtatttattcagctgaattcggcgacgttttgccacgaaaagcaaagcaaaagcgacgctttgctttaattctttcaacaaagaaatatcaccgaaacctaaaaaaatatgatcaattaaatgctaattaattaggcatttaattatttgcctgccaatgactccaattttcgttttgcgcgcatttcagcagcaaataagccgtttagcaattgactcaaagcggggtcattagcatggatcgaattcagttttgttttcagacattcgaattcatcggcagcaattaaaggaggaggaaaagcatccgagcggagcaaatgctttaaaaatttttgacaataattaattgttaattttattttcttttttttactttttcctcccccacaaaaagtgcctcaaaaattcgctgctttttgctcagctcaaagtgaaacttttccattaattttctgtccataaattttgtttgcagcagctttaaattcttaatttggcaacccaaaaattggccatccctcaaattttgttggccgtcgaaagtggcaaatgccgacaaagaaaaggataaaaacagcagcaaaagcagacaaatcggtaattcagcagacattttggggattttaatggaaaaa

SEQ ID NO: 18488 - DNA, 2455 bp, Heterodera glycines
atggcatacatataaaagttcaactgaagcggtgccaaaatcatttctgcataaaaccaacaacgatcagcctaaatttgttcatttcattcctaatacctaatcaatgaacgagtttttagttactaaaatcgcgaaattgttgcctaaatagttgttaaaaactgaaaatgccaaaatggttgctatgtatattattattttattagttaatttttgcgaaaggaaataaaagtcgacgattataaaagaggaaaaatcaattatttgcttggaaacatctaaaaatatctaatttacaaataaaatttgtttttaaatctatttaatcattttttgaaaacttgaaaaaacatcacttgaaataataaaattaatcgctccaaaaatgacaatatttgtaaaaaaaaggttgatttttttttatatgaataataaatttttcgaaaacttacaaaaaaatcgttttaaaaaaaagtccgctgtcgaaaagtccgggagccgaaatacgactgattattaaaatagtgaaaaattaaaaaaattagtataaaagtggttgctcttccttcctctgtcactttccattattcattcgccattttcgtctcttcaaattttctccctgacattaccatctgaaatgagtctgtacgtttttcgtttttttctccacatttacccttttccttctcattttttagtctgttcgttgtgtcaatgtttgtcgatggttgcgccattctttggagttattgggatcgcttcaaaaaaccaaaaaagaaaatgtaaaaaaaacgctgacccacgaaatgtccaagtctcgaatttgagttttttattattcagatggactaaggttaggcaaggggtaatataaaggggatattcgtattcagcgaccccgaaaaccctaaaaatcctaaattagactcattttgtttttataaattttgaaaaattttggacatttcgtgggtttttactcttttggacattcgtggcttggacactttgtgggggtgccaaaaaaacaataaaatttgaaaaataatttttcagctttatctccgccgattgttggctttgtgtcttcgatttgcttgcgccttctcaacttggcctcggaatttcaatgatcagccaccgttttgattattacgtggacgaacacttcaagacacggcgctgggcgttgaaatccatggaaatttggagcaaaattgaagagaatggcacacaggaagcggcaattgtcaatgatcgaaaagcattgccaattccgaaaattcgaatgccacgcaaagtcatcggattcaaaaacattataatagggtaaaatggattaattgtttgctttctttatgctatcatttaatttcacagatacatggaccacaatgtgatcacttttctacgccatttttgtcaaattttcgccgtctgtccaattaatttgtccatccacacgaacagcaatcgcattttggagttcgttttacgcaacatttggccattgctcgggaaaaacatttgtgccatggaattgtccgtcggagttttccaccatttgcgacaatttgtgccgtcaattctcaatgatttgccgttgctacgcattgttaatttccaagtcgccgatctcttcaccgaatttccggccgatgacagtgccacggcgtcggatggacaagcggtgaccaaatggcttttcactgcccgtccggacaatgtgccaaaagtgctccaatgcgcgttgctcatggacatggatgatgggaatttggtgtcgagggttgaagccttcaaagcggtgatttcgaattgatttatttggcacttttacggtctttgggattcgcttatttgaaataaacctaaaagctcccatattttttcgtgaccccttccccccccccccactgaaaagtatcacttttatcatttcatatttcttaaccaattttcatgattttaggcatttgcctcggcttcatcatctcctgtcaatttcattgctgtcatgttgtctacgttttttgctgactccgttgtgccatttgtgctgaccaacgaattgactcgggaacaattgacgttgaaaagaactggcctttattttctgctgatccgtcatccaattgtgcgaaatgcgagcaaatgggcaaaatgggagggagaagcgattggctggaattttcttgaccaccagtggaatcatattggcatgcgaatttatgatgaggatcaaatcggggacgggtcagtgaatgatttttcaaaaataaattcaaattttttgtggtgttccaatttttaggcttctcgacgcaacaactcccggcccaagtgatcagcagaaaaagtgactgaatgaattaattgctgagaaatgatcgatcaatttggattatggaattattgttgtactcatacataattatttggtcaactt

SEQ ID NO: 18489 - DNA, 859 bp, Heterodera glycines
tggtggttttttgaagcggtcccaataaaaccaaagaatggcacaacagatgacaaacattggcacagcgatcagactaaaaaatgagaaggaaaagtcgagaaaaaatgcgcaaaagtaaaaaataatattttgaaggtattttcagggagaaaaagtcgaatagagagacgaaaagaaataaatggcgagagcgaatgaaagagaatgggagaggagggaaggcttttattgcaaaactgcgtctataaacgaccgtttaataaaaccgtgtaaaaatggcaaactaaattagtataaaagtggttgcttttcttgcgccactttcattattattaattattcagccattcttttgaagcattgggaccgctttaaaaaaccaccaaaacaacacgaggccatcgcaaaattgaaaaagtgccggaaactgtcataacaattgaaaaagtgccggaaactgtcttgtcaatttgctccgacgaaatgtcatcagacaaccaaaatgaagcagaggaaaagatggcaaacgcgatgtaaaattaaatgccaattttcaattttaaattttgttttcccttttttcagtttcatctccgccgactgttggcaaacacttggccaatgctcgcaaaaaacattcatggcatcgaatcgtacccaagttttttacactgtttgcgacatttcgtcccgtcatttctcaacgaatgtccaccacttcgctttgtctccttctgttttggcgaactattccccgaatttccggccgatgacagtgccgcggcatcggaaggacaagcggtggccaaatggcttttcaccccacttcaaaacgatgtgccaaaagtgttcaaat

SEQ ID NO: 18490 - DNA, 3351 bp, Heterodera glycines
  misc_feature (6)..(6): n is a, c, g, or t
accaanaatcgcttggatcttggttatcaaacaaaaaagttcttttcaaaaaacatgtgctcgtacgaaaacggcctggcctgaacaatttaaagtgttctttgtggcctccgaggttaccatctgctgaacaccatgggaggaaattccagggagaatttacaataaaaatatacgtatttagagaaaatgtttctttttcgtattcttgaaaaaatatatttttcatttttacttattgaactaataaaaaaaacaatttggcacaacttacatttaaaaatttaaacccatcagggcacattatgttggctaccaagtgccctatctcatggtcagtcagcaacaatatgaattttgcatttgctgtagtcgtgaagaaagaaaccctctgaaataaggggaactgcaattaattggtttgttcaatttctttaagattttatggaaataaaagttaaggaataaaacatatgagtgaaaacagagtgtgagtgagcaagagagaaaagcgttaatgaactaaaagaaaaaaatagagaaaattaaaacatccccaaatagagagggtacaattaagagagaaaatagaagagagaataagaaagagacggaaaaagagcggaaatggaaaaattaaaaaaccaaggttgaaatttaaatttgaataagatagatcgaaaaatagcaacaattgttttaacttgtgtgaaagttttaacataggatacaacttctgtccaaaatcaacaaatgccttaacttcgtaacttttcttttgtgtccccggagttaaggctttaagcaatttttaccgttttaaacagctccagctcgcagccaccgagggggaaattatatggacttatatacttgcacaatgtggatggactttggataggatgagggatatgacggcaaaaactcaaatggaatgtttaattgacgatctcgaaaaattatcatttaattcttttgttttaaaaataaatttgcttatggatttgttactgacgtattgtccacttactgatatttgaaacctatgctttggtacttttggcataacttaactgaagtcaacaaatttttttgcaattttgcagacaaatagagaattgttggggctatcgaatgatatcatgatcatgaattagtaattttatttgagcaaagttatacataggttgttttttgctgaaaattttcatttgatgttttttataacgccctttctgatggctttttataaaggcttaatatcagcaccgttgaaagtatttttgtatactaaacatttattaaatatatataaagaaaaataatataaagcaagagagggtgagaaataaaggtaagaaataaacaaggagagaaagagaaaaaaaagaagcgagagagagaggggagaaagagagatagagagaaaagggggctggagagagagaggagagagagagagaaaatggggcgggagagagagaggagagagagtgagaggagaaagagagagagagagaaaaaaaggggctggagagagtggagagagcgagaatagagagagaaagggggggagaaagcgagagagagagagaaacaaacgaagatagggtaaatacaaggaaataaaacgagagaaggtacgtaagagagagataaaaaagagagcggaaacggaaatgaattgaaatttctcaaaacatgaatttaaaataaaataagtggaaaagagtcggaaaatgtttcaaatttttctaagctaattgatacagaagttaaaatttatttaccatgtgtaccataccgcattagaaccacttctaccgtaaaaataagattaaaaaataaagccaccggggactatatcttaaggaatacgatatatatacttaaagttttcacctgatccatttggaaggtgaacgcgcgcacatcaatttcaacgcatttctgcgtttaaattttttctttttgagtcaatattgttcaataaaaagttttaaaaatattcctaccaatattttgggggttttgtcaatgctttgaaatatttttagaattttttcgaattgttcatgtaaaattctgaaattctttaacaaaacacaataaaaaatatttttaaattttctttgacacgatcacattttttgtagttatgaaaaaagaaatcaaagattcctaggaaatttctttttcttacccaaaaattttttaatccactatactaatttggtgcaataacgaacgagaatgatagataaagagaaagaaagagaaacacagagaaggaaagaggagagaaagagagagagagagagaaaaaagggagcgggagagagagagagcgagagagagagagagggggggagagcgagagagagacaaaacaaagggaaatgggataaaaaacaaggagataaaacgggagaaggtacataaaagagagaggcaaaaaaaagagcggaaacggaaagaactgaattttctcaaacatgaattttaaaaaaataaaaaaagagagagagaggaaacgaaagcaagagagaaataagaagagtgagtaagaaataagggaatgagagaaagaaagagaagaaagaaaaatagagagaggaagcgaaagcgagagggagaaataagaagagtgagtaagaaataagggaatgagagaaaggaagaggaacttgaagggaaagagagagagagagaatgaataagaaaaaagagagagggagaaaaagagaagatagagagggagagggagggagagagaagacagaaaaagaagcgagagagagacgtagagagagatatatacttacagcgaggagagaacattgaaagggtgaatgaaagagaaagagagagagaaaggggagaggggagaggggtgaatgagagagagagagagaaagatagagagaaagcgggaaaaggatgcgagagaaagaaagagaaaaagagagagaaaagtgagagtgagaaaggggaaaagggtgagagagaaagaaagagaaaaagagtgagaaaagtgagagtgagaaagggggaaaggatgagagagaaagaaagagaaaaagagtgagaaaagtgagagtgagaaaggggaaaagggtgagagagagaaaaggggagaggaatgaataagagagagagaaagggggaaaggaatgagagagagagtgagaaaagagagagttggagagaaaggaagcgagagaatttaaggaaaagaaagagagagaaaaaaggggagaaagagataaggatagagcggagagaggtttgatgaaaagatgacataaatacaaaagaaagagacaggaagagaaaaggagacaaagagga

SEQ ID NO: 18491 - DNA, 2128 bp, Heterodera glycines
tttttcgaaaaaacggtaatttatcataaaatttcaaaaaaaattgcttaaaaattttcaaaatttttttttctttaaattttccttgttaaaaattttataagaattttttccttgaaaaaatttgtttgaaaaatttttttgaaatttctgcggcgagattttgtcccgtccccgaacttttgcgagattcaactaattttcggtttacaaaaaaaaaattttcggagcgcgggaggaggtggaaggtgcacgcacccatctgaataaaacgctcaattatagcctggtagtaggcttagtaattgaaacatttgttggctgagtgtttgatggatggatgattaaattggattattttagaaaatgctcgagattgacttctaccaaatggtcatccgacatttgatccggcgccaatgtacgctgaccaggtgagcggggcgcataaggtgcactttcatttaccccgttatgttcaaattcttcagcaccggagccaaaaaacaggaatttttatcggttttgctccgaaaaatcacaaattttccattttgggctcaaattttcaaaaaataatgatccaattggggcccggcggtgccgcgccgataggcgccgccggaaagaatttttggaaaattaaatgcaatatggtaagaaaatgtgtaaaattttcagaaattttgcccttttttgcttgaaaaatttcgcagttttttcgaaacccacccccccatcagtgtctttgccagattcgaaatcggccaccggggagaaaattgaaaatttgagtgcaatttgttaacagattttcaccaaaaactttggggccctttgcgggcgaaggagggggggggacaacccccttttccatgtatgggggtagcaaaacctacaagtacctattaaagaacatgaaagggattgcgtgttggtattcgcgctaaacctaattctttgaaatcaatttcccgtttttttgcctgttccacaaaaggggtccatggcgagtgcgccgggccgagttttggccaagttggcctggatgaacgcgagttccgggtccatcgtggagttgccgatgtaccggcgctgactcagagaaaagagtgtcttcagatgtcctcgcccctctcccaaccaaaaaagaggaaatgtcgcgccattggtaacgccggacggacttacgagtcgtacaaagtaaactttgtccggcgtttccctccgtccgttcgcctcgtacatttcgatcaccgagaacacattgctcggatgcgcaaggtcaactggcgcgagagtcagaagcggaatggcagtgtaacgctgaaggacaaagcttactgtagaaggacacacgaaaagtacggtatgatggaaaaggggttgtcactcagtgttctttcccctcattatttgtctgttcacctcaacaaccgatcgggcgtaatcgccgctgcgcttcttttgatggggacgaacgagcagagaccacgactgatcggcggagtcgaagcgctgacaaaaggccattcattgcgcggaaacccaacccaatggccacaatgagccgccaattcaccgcaagcgacgaactcggatcggatgccaatttggccatcacttgctcatgcccgtccccctcggcgatcagttcgtacgccgctttcactaacacggccctttccaacagccgaaagacgtcaaattcgtcgttttgaaactcaaacgattgaatgtgtatctgcggacagaacgaacatattgacccaaaaaataaataaataaataaaaccccatccgaaggagagttgggcaccacagaaattcccttaatctgacaaatggcatcgaactccgcacgtctaaaagtctggtgagcctgactaaaatgaagtaagaaacggcgtttactgcccatcgaaaaataaatttaaatattggtaaattttaaaaacagaaataaataaacgttactaaaatagcattggtacccaaacacacaatgtgtaatatacatttattttaatgtagagataaaattaacaattaaaatgccatgccaaccacgccccccacccattaatatcgcttccgcacaaaacgcggcgctctccagtcgtctttg

SEQ ID NO: 18492 - DNA, 3339 bp, Heterodera glycines
ttcataatatattttttcgtaaatttttaaccttaagtatgagaaaagttataaagcattgaagctatgttttttgcaatgatcatgcaaatagaagtataaacattaaaattttaaagtctttaaaatgcaattgagccaaaattaattatatattcgatagccctaagaattctctatttacctttaaaatttcagaatatttcatttagtttcaaaaaagttctttgcaaaaaattctgacttaagattttttgcaattttgtgaccataactttttttatacttaagtaaaaattttagaaaatcatattctgatagagaacaattaaggctattaaatgatatcacgaaatattaatttggttgaatttgagccaggctatgaatttatatatattacccattatttgttttcaaacccattgacggatttaagaaacgcgctggcggatttaagaaacgcgctggcggatttaagaaacgcgcatgggtggtggaatttaagaaacgcaccagcacctttaaatgcattagtggctgaaggatgcgatctcaaatctcaaaaagcgggcacagagtcaaatttagcaaattgttttttgccccattttacaagtacttaaccactggaatagtaaacagccggcgggaaattccgaaggtaccatcagaaagaaagcgccggaagaaactaaggttgagccccgacccctcgggggcaaaatgtcgggggtcggggaccccgatcgggtagtgatcaacaaaattttttaacgaaaaagcctttttctttttaaagctaatcttcctttttcactttaatcatctgattcaaattcattcgttggcgccagtaaaagcgtccaaattggcattttataaccgggcattccgatgctccaaaaattgtcagaattcgaaaatcggaattccgagattaaaaagtttttgcggtgcgcttttcaaaattttttttagaacatgggggagaggtccgggcgtaccgttaggaaccgccataaaaaattttaaaaatttgagcaatttgtttaacagattttgctcaaaaaattggcaatatttgcgatttcggaacaatttctaggaaaaattaggtgttttggagagccgacggtgccgataggcgtcgctggaaaaatctcggaatttttaatgaatatcttaaagaaaatcttttcaactttcaaattccccgcttcgtcgttgaattaacttttaaattttacaacgcttggagtccttgattccggggggggggcacatgtcgggtcgggaaataggcccaaaaatgtcgggggccgggcggctcggggtcggggcttaaccctagaagaaacctctaacttttgtcaaattcttaaagtaagtatttttcttacctttgtcctaggattttatcaacgaatagtactttaataataaataattaaattaataataataaaacttcaaaacccaaagtatttcattaaaaattctgttaaaattaacatggatttgttagattggctttaatcactccctaagcttgatattttacattttttaatttcaatgccggaaggaacttccaaacttcccacttcagtgtacaaagatgtcaaaattgttttccttctctcggaattgccctctttctgttcgttgctttcctccaaaaccattttaaataatttcgaatgatttatttcaattttattttttgtcatattttcggacaacgaaattcgttctctcaatgcaaaaatttcgatggtgaacagcaaatagtgcttaaccgtttgcgggctttctcctgtgaaaaaatgaacaattaataatcgcaaaatttaaaaaaaatttaaaattttccgatgttttttgggacggacgacgaaattcaattcgtttttgtatcaactgattttttgggtttaatgaattgaaataaatgtaattttaagaataggaatgctttttaaactaattttcatatgtaaactttttttttaagttttaccgtttttccttttctttaagctttttggtaaacttttttttttgaaactgacaattgttctattttatattagagccggatcggaacgggaacccgccgggattttcccgggattccgatcccgtcttttttgcaaaaaaggccgggttagggatcacgcctaaatcgagatttgaatcccggtatcgagattgaaattccagcaaaaacgggatttcaatcccgctaatcctatcccggcctaattccaaccctaaatcccgttcccggcgaattgtggtcggaatgtgagttttaagagcagaaatctcagttttcttcgctatttcaacatttttttaaaattttccagtattctcaacaaagtctatggatgtcagatctcctaactatagtagtttaggtggaaatcttttaaaaagtcggattaaatttattaatttttttcaatctcacaaatttcgacagaataacaaaaaaaaaacaaagaatagaagcttaaaaacatatttgctaaatttgtggcctaaaaactcaatataaaaaacaattggtccaattgataggtgaaattaatagaaaatttactcattttcttgatgggaagaaccattcctaatgtgatttattcgacaaataaataaaagggtggagagatatgataaaaaaatttaaaaactttatatgcttgagtgaacaaactcgagaatttgagtgaacaaactcgagaaccccccccccccaaatttgttcattcattttaccttttattattttctttataaaagaaaataaattctccattatctgtgccattacttgatcattctttttcactgcgaataatcgtttcagtttttctttcagttttttcaacatttgttctcccatcgatgctttctttttatttgactttgaaggagtttcagactaaaaaaaatgtgaaaaaatttaataaataaggaaagatacaatttttaaaaaaatgcaatgttaaacaatttatttaatcaatatgaaaataagaattaaaataaataaactaaaactatttaatttttatttaaaaactccgtcgggccaactccgtctcagccaaggttaagagccatatattttttcttaattgataaaacctatgtaagatattttgtatattcgaaagctcttgtgtttagaagatatttttaagctaatgctaattgtaagcaattaaacaactcacaaaaaaataatcgcttgaaaaccgcaaaagtcagaatttttattgttttttttgcaaattttttttctgtgtgaaattcctaggctaaaaa

SEQ ID NO: 18493 - DNA, 2238 bp, Heterodera glycines
ttttgcggcccaagccaaaatcggacatttgcggcccgacatttgcggcttcacccaaattcatcattatttttcactatttattgtacatcaattaaaacacaaattttttttcccaatgatttgctcaatgcttaacgagcttacagatcacccatttatggtgggtgcccttctgcaaggcgatactttaatgtgtttaaattacaatgcaatgttctaatgcgttctttcgtatttttccacacttttaatgctctaattaacctaaattaatttatttatttcaaagtgcagtgctgcaacatgtattggtaaagaaaaaaaaaattaattgtgacgagatgtgttaactcttttaggtggccacataaataagtttaagcattgtgatgcccttgaacctagagcaagccattggaaaataaaaataattatatgtgatttatgattttcaatatggttatcgttgatgaatttgggtgaagccgcaaatgtcgggccgcaaatgtccgattttggcttgggccgcaaaattcgacaaaaaattgggccgcaaatgtccgaaaatggcccttaagaaatgggccgcaaatgtccgggacgcaaatgtccgatttggctggggccgcaaatgtccgagccgcaaatgtccgggacgctaatgtctggacacctgccatttttggcactttccaaaacatcggcactcactcaccttcatgttgtgcgcgtcgaacacgcgcaacggctgccatccctggcatgtccacagtttcatggtgttgtcataggagccggtgaccaggaactcgccggacgggtccatccgaacgcgggacaccaaattctgatgggccggcattgtgtacagctgacggcgcattcgaacatcccaaacctttttttggggaaaatgcaataaatccaacataaatttgatttatttttcgtatttctaacaaacaaacaaaaaaaaacagtttaagatttaaattaacaaaattttaccgaaaaccaatttggttagaattttttcaaaattttttccaaatatactttttaggggtgaagagcgatcaaaaaatttcttccacttctctattccgaatttttttttttggttattggcctactggtcccgtctaaaaaaaaagaagttgtcgttgtcgggaccccctctcgcagtcattagtaattagaaggggagcagctaaccaactttgtttttaaattttcaaaaattgcggaaattttttttcttggttttctttaaaaaaaaattcgaaaattgaagaccaagcagttcacccccccctcccggaaaattttttaaccattttttaaaattttatgatgaattattatttttctcaaaaattaccaacaatttttttctttcttataccttgcacgtgttgtccgcactgccggtgaccatcaggaaaccattctggtgccagcacaccgtgtgaatgcccttctgatggccctccaaaaacatgatgcatcggccggtgcgcaagtcccacacgcggccgtagcagtcgaggcccctggaaaaaaccaggaattatcaacaaccgataaatcaatcactcattcactgatcgattgatcaaaaaaaaaaaaaattgattaatcgactaaaaaaatgcgcaaaactgttttaaaaaataatttttacaaaaaaaaagtaatcaccaaaaatatttgaaaaaaaaacaaaattatttttctggccatcacttttttttaaatgtaaccatgcccgtagctagaatgaaaaaaaaattcggagggggggggaagcgaaaaattttcgtcagaattttctttgctatttttaatagaatttgtttaaaaaattgctttaagttttcaaaaaaaaaaattgatttttgcttatttgagcaataattattcaaatgtgcgggtgattggtttctcacccggtcaacatcagagagccatcggcatggaaatcgagatcaaagacggatttgctgtgcccctcctggtagagcagttcctgcagcgtttccaggtcaaagaggcgccatgaagagtcaaaactgttgaaaatgaatgaacaattagccgagaattggaataaattcgagagttcgagttaagtaaggagagaggcattggattctcgaccaaatatgcggtggtgttaattgagacaattgaaatcatagccaaaaaattttggcaaaatggtaaaaaaaatca

SEQ ID NO: 18494 - DNA, 1239 bp, Heterodera glycines
tttaaattcaaatgcctcaattgtttcttgctataaatactaccaaaaaaaagttaatgaccaaaatatacaggtttactgtccaactccaaatcattttgcggagacacagcacagtggtgcaaacgatggcggaagggatcattgaactgaaggagaccggtgggttagaaccggggagcgagcagggcatccaatacttcctggaccgcttctacctgaacagaatctcgataaggtcgcctcttttgctgtgtctcattgtcagtttaacaaatggaacaaatgcaattttcagaatgctgcagaaccaacacttagtggtacagacggactgaccacgaaaagagtccgatttgaccacccccttcatcccctttgaggtgttcggctccgttctgccggaatcgccgcggcacgtcggctgcatcgatccgtcagtttggctaattaaaccactaattgtttacttttcatgaatcgcaatttcttgcagaatgtgcgatgtctcttccgtggtcaatgatgcatttgaaaatgcgcgtttcctctgcgaccgtttctatttgacttcgcccgctttgaaattggactgtcacaattcgattagcccggacaagaaaatttccattgtgacagtcccttctcatctgtaccacatcatgtttgagctcgtaagcgatggtctgcattctgtgccaataatataccaaaaacacattttaaaaattcagttcaaaaattcaatgcgcgcgacggtggaaaacattggcacggacgaggatttgcccgatttgcacgtccgagtggtccgcggttacgaagacctgtccattaaggtgatgaaggggcgggggagaagttggcacaagaataaaagttaatttgtccagtcatggatggacatggtggaaatgtgttttctactaaatcgtaaaaaataaaaaataatttttcggttgccacaccttttcttgtttttcttttttttgccacttttccactaatctcattcatatttcgtgcacagatcagcgatcgcggcggtggagtcccacggaaaatattgagcaaattgttcaactacatgttcagcactgcaccgcctccgccccaggacggcactcaaacgccgttggtgagtaaaggagggaaacagcatatattagtcgatgttttctgttggttcaaaattttaaaaattaataatttattcaaatgttgtccaattccattctt

SEQ ID NO: 18495 - DNA, 1459 bp, Heterodera glycines
  misc_feature (1435)..(1436): n is a, c, g, or t
atcacaaacatgtcaaagtgaatacatacaaaacaaggcaatggtttagagaatgcaataaacaattaacaataataaatgatttgagtcagaacatctgcaaagctgcttgtaaggtaaatgagatcggacagagacgaagtcgcggtcaactaatgatcatctggttaatttgcttgtaatttgtcaaaagtgatcagttttggtcgagacttcgtccggattttgggatatttcgtccgtcagtcagtcattcggtgtcccttcagagcgccttaaggcgatatttggaagccaaacgcgagacggactcccttctgttcttcaacgtcactttcttcacaattaccaaagctggaaaaatggaaccatttgcaaacaaaataaatgtacaatttggcaaccgatggtaattccgttgccaatcgcaatcagcgagaagagcagtgcgaggacgagcacctgccaatcgcgggagcagttcaagcggaagtacaggtcgaagagcacaaaggcacagtaggcttggagaaactgcaaaaagcaaaccgaaaaaatagaaaattcaatccaaaaattcgaataaatggaaattaattggtaaaagcgaacgggttttagagcaaattcacttttcaatttatgcttacatatccgatgatcagaaagggcataagaaatgtcttaaagggagagaaaataaggcaaattggaggaaagtgtcaaaagagacccaccaatcctttgaacatccaactgctgaaacctgaaaaggagggaatgtacattagcgatatttaagaccaaaatttttcggtactcaaaaccccgaatttggccccaaaacatggaggtaaattttattttccgcaaatacgaaatttccgggctctaccttcaacggtaatgtccattgagtgacgctgtcccaaggcatctaaaaacggggaaaatagagcaattcagcagaaaatggaggcgaaatgtttacggagtctgcgcaaacagcccgtttggtatttgtacatgaaaaggaaaaaataaagtcgaatttaaatttgtactatgcaatgaatttattcactggattatctgcacactgctcacatagcacacgagcacaacaaaggtcggacgcatgtgctcgtagcagtcgccgccgctccacgtcaaagtgatgcagcacagaacgcaggtgatgtaatggtgcaacaccggaaaggaggggggaattggtcggggaaaatggcggacggaaagaaaggacaacaacaacgacaacaagttcaagcagtacacaatggtccattcattgcaagaaaagttcaatttttgcaataattgaggtgtgaatggaaaaccgattcttatccctacgccattgtgtgcagaatatcccaattaggaaacgcttgtgggggcaataaaataaaanntttataaaaacaacaaaaatgaa

SEQ ID NO: 18496 - DNA, 955 bp, Heterodera glycines
tttttgaattgaatttgccattcttttggctttccaatttgtctcacttttgtggcgtttcgtccctgcaccgcctccgccacttttctcagattggtgcgcgaatggaccacattcagtgccttctcatccaatcgcaacattttgtacacctttggtcaatattctgttgtattttaccaattgttttcctttaattcattacagtacttcattctcatttactcaatgccattaccgtattgctgtttcgtaccgtatgcttttttctccaattttccctattttccccgtttctgctcaccctctttttgtacttcagttcaacataaggcacacagtcgtggaatggatattcgcgaatttgccggtcctccagcagaaatttgccggcccttccgtcgcagggcggcagaaaaaggccaaaattgaactctttgtccaatttttggggcaacgagcgcagaagacggaatttgatgtcccaaacgaactcatccaaagaaacgcacagacatttctgagggggaaaaaggggggggggagagttggggagaaaaggacaaaacggaacgccaaaaaaagggaaaacggacgaaacggaacgccaaaaaaagggggaaaagaaatgaaacgctaaaacaggatattttactagttctacttggtcccttcattctgctgattcggtgcttccacttttgtgggcttccccaacattttgtggattaacagcaataaataatgccttgtccaccaattggcgttttccgagcagtacacccaccaatcagcagatgatggaccatcacaaaaatccggaaaatttggacagaaataattgtgactccaacgaaaaccccgggtgatcgaggcttattcaagtattttgctcgactttgaccggattggggcaattaacgcaatttatacccccaaaaatcccctgaagggg

SEQ ID NO: 18497 - DNA, 2076 bp, Heterodera glycines
  misc_feature (72)..(74): n is a, c, g, or t
  misc_feature (95)..(95): n is a, c, g, or t
  misc_feature (103)..(103): n is a, c, g, or t
  misc_feature (105)..(105): n is a, c, g, or t
  misc_feature (113)..(113): n is a, c, g, or t
  misc_feature (119)..(122): n is a, c, g, or t
  misc_feature (131)..(131): n is a, c, g, or t
  misc_feature (144)..(144): n is a, c, g, or t
  misc_feature (162)..(162): n is a, c, g, or t
  misc_feature (172)..(172): n is a, c, g, or t
  misc_feature (180)..(182): n is a, c, g, or t
  misc_feature (192)..(192): n is a, c, g, or t
  misc_feature (195)..(196): n is a, c, g, or t
  misc_feature (198)..(198): n is a, c, g, or t
  misc_feature (202)..(202): n is a, c, g, or t
  misc_feature (218)..(219): n is a, c, g, or t
  misc_feature (222)..(222): n is a, c, g, or t
  misc_feature (229)..(230): n is a, c, g, or t
  misc_feature (232)..(233): n is a, c, g, or t
  misc_feature (238)..(238): n is a, c, g, or t
  misc_feature (240)..(243): n is a, c, g, or t
  misc_feature (246)..(246): n is a, c, g, or t
  misc_feature (252)..(253): n is a, c, g, or t
  misc_feature (261)..(261): n is a, c, g, or t
  misc_feature (271)..(272): n is a, c, g, or t
  misc_feature (280)..(281): n is a, c, g, or t
  misc_feature (296)..(296): n is a, c, g, or t
  misc_feature (310)..(310): n is a, c, g, or t
  misc_feature (313)..(313): n is a, c, g, or t
  misc_feature (316)..(317): n is a, c, g, or t
  misc_feature (322)..(323): n is a, c, g, or t
  misc_feature (326)..(329): n is a, c, g, or t
  misc_feature (342)..(343): n is a, c, g, or t
  misc_feature (353)..(353): n is a, c, g, or t
  misc_feature (355)..(356): n is a, c, g, or t
  misc_feature (362)..(362): n is a, c, g, or t
  misc_feature (367)..(368): n is a, c, g, or t
  misc_feature (425)..(425): n is a, c, g, or t
attttactagttctacttggtcccttcattctgctgatccttcggtgtccctcaagcagggccccccaacannngggggccttacagcaacaaanaaggcccngnccaccaangggcgnnnnccgagcagnacacccacccaancagcagaagacggaccancacagaaaanccggaaannnggacagaaanaanngngacncgacgaaaaccccggnngancgaggcnnanncaggnannnngcncgaccnngaccggangggggcaaannagcgcaannaaaacgcccaaaagncgccggaggcgganccnaannagcgnngcnnnncgccaaaagcaannggcggcaacnanncggagngaaanngcggaggctccactgaatgagtgcgatttttgggggcccacccaaccccttgggagnttgcagcaaaaagtgcaacgccaattaaagaaaaaaaaaaacgattaatttgcaatttttggaattttccgctttttcttcccatctctcatgccattctttacctgcattttgatgtccggcacaaatatttgtaggttcagcgtgccgtccgcgcgtccttccgccgcgcttcccgacgcgacaattccgccgatggcattgcccaaatgcctttggtcccccaaagtgctcaatgagtcatcagcggtgccggtgtgaagagaaagcgacggggaagcactgccggcggaggaggaggaagaagcggcggggaaatgcattgggagacgaacggacgaagggaaaagcggaggaaaagcggcgagggaaaaacaattaaaaaagggagggaaaatgaacataatttaaaaaatgggataaaataaaatggagtcgaaaatatttattaattttttagagaatgaggagaaacgcattaaatgcaaaagggaaaaggaaatgttgcgaattaattacaattaattaattatttaattacagagagagagagagagagagagagagagagagaaggaatttgaaaatggaaaaataattacgttaaatttatacaaataattggaaactccgagaaataattgttggtcattcgcgacaaaaaaagtttaacttttattgttaaccgattaattattatgcgatcaatgatcagtcagtcaattactcagcgaaaagcgaagtgcaaaggaataaagacccatccgccgattgatctgtccgatttatggatttgatctgtccgaccgacccattatccctcctcccctccgtttgatttgtccgcccccccccccccgccgtccgtccgtcaccccatcgatcatcgccaaatgagcagctaatctaatgctttgtatttcatatatcttttaaatttattttttttcctcagattttattaattattacaaatattatttaactttgtcggtttttaattaaaaggtcaaaaaagtaacggacgcaaaataattagaaaaggaaaaaaagatgaggaaagaggaaaagcaggagaaagagagggaagaagaaaaggaggagagaaagatgaaaaggaggaagaggaaaaggaagaggaaaagcaggagaaagagagggaagaagaaaaggaggagagaaagatgaaaaggaggaagaggaaaaggaagaggaaaagcaggagaaagagagggaagaagaaaaggaggagagaaagatgaaaaggaggaagaggaaaaggaagaggaaaagcaggagaaagagagggaagaagaaaaggaggagagaaagatgaaaaggaggaagaggaaaaggaagaggaaaagcaggagaaagagagggaagaagaaaaggaggagagaaagatgaaaaggaggaagaggaaaaggaagaggaaaagcaggagaaagagagggaagaagaaaaggaggagagaaagatgaaaaggaggaagaggaaaaggaagaggaaaagcaggagaaagagagggaagaagaaaaggaggagagaaagatgaaaaggaggaagaggaaaaggaagaggaaaagcaggagaaagagagggaagaagaaaaggaggagagaaagatgaaaaggaggaagaggaaaag

SEQ ID NO: 18498 - DNA, 1925 bp, Heterodera glycines
catttctccctccttcgaaaaaaagcctcctggcttttgcctcatcacttctgatcagcttcgtgggtccgtcgttctgatcagccttcgggcactcattgatggtcaaacattgatgaacatgatcattcgctgtcgatcagttgaacatctgacaacgctcccatttgcttcattcaatcatgtcattttctcttgacacccatatctcgggttatttcactttaatggcaaatttcgcttttcctttctttataacagtctccggttttaatttcatattcatttcaaaagtaaaattttcgcttacttcttacgttactcttctttttcattttatctttgcattaactttctcaaagtgtgctgctttaccttttcgaaggttttctattccaaaatttattcactttttttgaccctttacttttccttttttaattacatcatcttttcaattttaattaaagtacttcaattacatcttttttctgccttttctctgattttcacacattcattcctttttttggcttctcccaaagcttattttctgcatttccattaaaatttcatcgaattatgcatttaatttattcagtaaaaccaattttggcattaaaaacggttcaacatttaacctggtggcatcacataatacaaacaataacaaaaagtcacacaatggctttatgccttttaattcacaatcatttttggcattaagcccttggcacatagtcattttaagcacacagcgttaccaaccattttttcgcttgacaactaagaacacacagcttcgactagtccatggcttacgctcatttcacccattaattgatctcttttctgggagcacacagcttcgaccagtctcgtggcacacagccacaacggcactcagcccagctaggagcacacagctgcgactagcttttatcttttcatgctcaaaaccgttgcacttatcctttcgaaaacagccaaaatcaaaaattaacatattatcacattaaaacacaccgcattgatcaatcaatgatcacaaaatatgccataaggtttttgtattaccgtactcagccaaattagccacagaaaatttgccaaatttctttcgcaagacaatgcatttttgtttgctcatttgcgttttactgaaaaatagcaatttcccattgctttagtcctttttttttgttgccaaaatgtactttaatttactcttccaatctccaacaaggaattaaaatttaaccagactaaaactgcttttgggtctgcgtccctttttaagtctgcattgttcaaattagcctttaatggcctcagacactttttgtctggaatgctctggaattttaattctctctctttctctctgtttaacaaaaaaaaatttacacaacgggtcgtggcaccaaaaaggtgttgtgtccccgggtttaaggctttcagccatttcaaattaccgttttaggagagaggaatttattataaggaaaagcattgacaaataattatgaattgaaaaccgggaatatgtttggctcaacaacaacctcagagcattttgggtgggtcagtgcaattggttatttgggaaaggattgccaaaggcaaggaacagcacagactgacccaccgcagacatctcgcagcccccgagggggaaattgggaggacttatatattgacacaaaggggatggactttggataggatgaggggtatgacggcaaaaaacataaagggaataagagaaatggatggcatatgcaacagaggtgaatgggatagaaatggcacggtaaatgagagggaaggattggcttgggattggatgaacagacggacaagtttatgacgggattgggtcggggaatagggcaatgtacattatgcacaaaatatgaaaattt

SEQ ID NO: 18499 - DNA, 1453 bp, Heterodera glycines
atttaaaggttcgagattagaaattggtccaaatttatgtccgattcgtgatcaggggaccccgaaaacggatccgagccaaataaaaagggtaaaaaaaacatgccgacttgccggaattttccaacaaaacgccactttcaaaatttgttcctttcctcgtttctcaccgatttcggcggactggcggaggcggctgtctgtggcattttgtcacgaccagccgacatggtcaggccctggtcctcaggaattgtcgggaaatggttggccgtcgtgccatgttgtggagaactgctgtacagtgccgacgcactggtggccgacttgcgcagcagaccgtccgccgaggaaggggcgacggcggcactattactcatcattccgatggcacttttgcccttggtcaactgctgattggtcggggagaacgggtgatcgtgacgatcactgaggagggggacaaacgaatatagtgaagttaacagttaattgaaaaaaacaattggcgccaacatttttgtttttggcattttgttttgaatgggaggagtgtagagagagagagagagcgagagagagagtgaaagatgagacggaaagatataatggtagactggccatatggacggctgtatcctttcctgaatattggttggtgaatgcactgacaaacgaaaattggagtgattttcggagtaagaattttatgtttttaatggaaatggtctgcatttatcattatcagacctgcgcgcaaattttgaacaataatcaccaaatttcgaccatttgtcttcgaaaatgacagaatcaattaaataataaatcccggaaatggcagggatggatcagaatgccggtttctgattaccgactttttcggctcgtaattttttacgaatacaaatgggaacgaaaaccaacaaatttgaagataacattttacgagagaagcacaaaaaatactaatccccacccaattttcgaataagaccagcagggaccgatattctgtccttataagaaatgttctgatttgaattattctaatctaacaaatttaatgtgtccttatttgtaagtttgtacttatttcgcgattcttaaaattactcataaatttttgaatttatggtatattcaaaatttgatctaggatttttaaaaattgattctaaaaatttggtcattttttgacaaaatttcttaagtcattcatttttctcccgacggcgcctcgcctattggcaccgccgaacgccccccccaccacgccgcaaaaaaagagtgtaaaaaaagaatggtacttctaggttttgtcaccccccccctcaaattttttttctaataattttttttagcttaatttttgatgctgatcacgaatatgacatttatttttagcaacagcgtgtttcacgtgagttacgtgaaaatttacgtgaaaaat

SEQ ID NO: 18500 - DNA, 922 bp, Heterodera glycines
atttattttggttaataatttttttttaatttttttattattctcattcccaacgttgccttaggcccaagggtttgggtggtttttttggaaattattaagttttataatttaatttattagtgatttgactttttcatctggttgggaggatattggaaaatccttttgggcgttctgcggcgggaaaactctgtccgttggtattgcacagggtcctttattttaaataaattatttttgaggttttaattctttacaattcttttgggtcaacgaatgtgagtccgggtggtgatttttgcaaggctttgccttggcttgtattctggctttgagacttgatttctgaagtttaattaatgtgatatttaatcaaatttttgatcatttttaccttattttgggttttttgcattagtttgttgcatttttaaataatataattagtaaaagcactttaaatataaagctgagttgcatttgatatttaaatataaggattcgtaggcaaatagcaatatagcaattgtgggaaataaaaggccgaggaaacttacgtcagagattttgtaggcccccccccccccccccgctgtgtctgctgaaaactgatcccccctgtgacatatttgaatagtgacagattgccaaatgttctaaattgggaacaatcggccagtcagacacaacagagtcagttaatctgatcacgtttagtctgtgtgctctgatcagtcacttacaattagcaaccgagagcattgatcagacaaaacactgatcagtcccccacctctgtgttagttgttgccaaaaattgcaacaacaaaatgaaaaattttcaaatgcagattcggggggggggggggggggaaggaagcatttggcgggagctttttttgtccaaataaaatgcaga

SEQ ID NO: 18501 - DNA, 2173 bp, Heterodera glycines
aaaatagtctcatcttttgaaaaagtgcaaaaaatgggcataatctttgaaaccttttgatgttttgggccgttcttttttttaattctcagaaaaatatttattaaattttttattttctgacgattaaaaaaagaaaataaattatttatctattaaggtatttaatttaatgaatgacaatgaactaaaaaaatattaaaaatgcagcaaaaactcaccatgcaaatgtacaaatattcctgaaaaatggcaaaaaataaattcgtggcaattttggcatgattacaaaacactcacaaaagtgatgatgtacccgtagtaagtgacaatgtatgggcaatccttgcacttggaaatcacctccaaatccatgaaaatccgctttgtctccgtcacattgtcagtgcgcttcatttgctaagaaaatattgtaaatggaggacaaccctaggatttttaaaattagttttacgggatttttaatatttaataaaattgataaagcattttaattgctcaaaaattgatccctaaatttgttaattgtaaaaatgcttttctttaacgcgtaacccaaaaatttgagaaattaagggtgaaaaacttttgtggtaaattgtacaaatctcctctcgcaaaaacgagccaaacaaagcagggaattaactgtttattcatgaaattgattctttttcaaatttgccacaaatccttaaaagttccaaattttgcaaaatgtgtccagacatttgcgcctatgtccaaaattgggttcaaacatacattttcaatcttagaggtcttaaacagcattaaatttaagaaaacttgttctttttggtttattaggaacaataattaaatgttgtttgaaaaattaattgttttttcaaaaagttgctgaggatcaaagtatcccatacaatcactttcaatcgcttatttaaagctgtttaagccctccgggattgaaaaaatgtaagtttgaaccctattttggacaaagacgcaaatgtccggggcgcaaatgttgggtaacggtgcaaaaacttgctgaaaatttgttttgttctcatggacaagcccgtagcaagaaaataatttgggaaggcggaatccgaagaagcttttttctgctcttcaggtcaaaaattcttttactccattttgagtgccttttttagccatttttcaccaaaaatgcccattttttttggaatgaccaaaattttttttggaaatttcaatcacacaccttcactgcaatgggtcgacttctgaaccgatatttgcacacacttccgctggcaccggtgcccagctgaccgccctcaacaaaacaaaaaaaactgttcaaagtgccaacatcagtcatcttttgtttgcaaattttctgtttcggcaggcaattagaaagagcggaacagggccggtttctgccagtatttatcggactactgaacccagtattttagagaaatgcttgcgaattaggaatccggaaaaatgatggtttgtaatctgtaatctggtccggctttgtgtccgaattctaatcctgaatttttcaaaattcaggtctcacttttttgttttctttttttcaaaaaatccgtatattttttgcaacttttgccactaacgcgcaatgtaaatgccgattttcattggtttttttaaattttcgtctccataaattcgtagaatttgtggccatgtgttcacctgctggtccatccgttcaaggtctttgggctgcacattgaacacttggccaccgatgctgagctggcccgacttggcctcgatttgtttgaatcgatcggtcagcttcaataaattgatattgtgtaaatttagacaaaaatttcccatttttaatttaaattaattgtgttttccactaattgtcaaatgggcccagggttataactcctttcatagttgtcctaactaatgaatttgatatcattcaacagcatgggttcggatccgctcgacagatggaaaattatttctagtttttattcaaagcattattgcatctagcatctttttcttgagtcattttatttcgatttttatggcactttcattaattaagacaattatgagaggaattataccccataaccgttgagctgtagccattttttccattccgtggggg

SEQ ID NO: 18502 - DNA, 2444 bp, Heterodera glycines
  misc_feature (2245)..(2245): n is a, c, g, or t
  misc_feature (2315)..(2315): n is a, c, g, or t
  misc_feature (2327)..(2327): n is a, c, g, or t
  misc_feature (2338)..(2338): n is a, c, g, or t
  misc_feature (2343)..(2344): n is a, c, g, or t
  misc_feature (2357)..(2357): n is a, c, g, or t
  misc_feature (2359)..(2359): n is a, c, g, or t
  misc_feature (2364)..(2364): n is a, c, g, or t
  misc_feature (2366)..(2366): n is a, c, g, or t
  misc_feature (2372)..(2373): n is a, c, g, or t
ccacacctccttgaaattgttgatccattccttctcccttgccaacaacgcaatcgcttgggttggccatcttttctcggagaatgcaaccatttggacaatgcttggccagcagaaattgttgaatttggcccatcaaaatcatcaccaaacgcagcgggcgacaaatcaaaggaattgattgaattcaattggttgagatcagtgagaattgtcggcgaagtgcgacgaagcaaatggtccaaatcatcaccatcgttaaagcccaagtggcgaatgtttgtcgaaaaaattggccaaatttcacgaccaaaaatgtcccaaatccgctggccatccatgatgagtgaagaaggaagccacaattttaaattggtgcctcttttgtcgaaaatttggtgatttgaacgaagaaaagcgatgacggagtgatcaatgtacctaaaaatgggatgaatgcttttattgccataaatctctgattccgaattactcaatctgaaggcgcttaaaacggattttgctgggcaacggacggtcgggcaatggaaattccacaaatttgtaatcgattcgtacagaatagtttcggttctggtcctttgtccttgcgaatttcgatcgttctccaaattgtcaattcgcttttgccatcgaaatgtttgtccaccaacgcattgaaacgtggcgaaagaagtgccaatttgaggccgagttgagcatggtcaaaggatgggaaaatgtccatccaaacgtcgttgcaaatccaactgaaatgggaaaacagtttagttaaataaacgacgaatttgtgacttttaatttaattaccgtcgtttcatttttgtggcaattagcacaattttggccgagttccgaatgatgtcacacaacaaagagcagaataattaattgcgttagaaatttttatttttttcaaatgcgagacaaagcgaaaaaacaaacatttttatagacatgaaaagggattgatgaatgtttttgtatctttttgtttatgtgtcatgattagggaacggattttggctctattgcagtttatgagtccaatcgacttttatgagtccaatcaattgacaatcccgggtttttatacaataactttgttcatgttcgaacaaaccctatctttttggtatcattcgaaagtataaaacgtggcgaaagaagtgccaatttgaggccgagttgagaatggtcaaaactggggaaaatgtccatccaaacgtcgttgcaaatccaactgaaattatggaaaaacagtttagctaaataaatgactaatttgtttgacttttaaaaaatgccttaccgtcggttcatttttggcagcaattagcacaattttgtccgagttccgaatgatgtcacacaaatagcagaagaattggtaatactgtcgatggtaccccccttttttgaaatttttttttgttaacaaaagacatgaaagcatgtttcctagggttttcggggcagctaatcagaatctggcatttgtttcgaccaatttcgaaccacggacctgaattcgaacaaaagttcgaaaattcaaattttttttcgctataacttttttctttggcatccaaatccattagcctacaaaatttcaaaaagtttcgttaagtttcaagaaagttatgagctaaaatgttgtaaaaaacttgggtttttgagcttctcaagttataacttttttgaaacttaacgaaactttttgaaattttataggctaataaaaaacggtttggcctttttatgtcaaaatgtttccgcgccttccgtttgtatcaatgatttttcgcctcccattggccattggcaacaatttaagacgaacaaaattcaaaaattgttggataaaatgtgattttcgttagaatttttggttttccgcttttctcattatataaaaataaagtttccaaaatttggaggaattacagaaaaagttggtcgaaatggatcatcagcagaaagaacaacagaaaagcattgatcagatggaaaaggtgggaaaatgtgaaaaaaggaaaatgaagcaaattgatcagcacattttgaatttgattttcttttttgctaaaatgccgtaaaagatgctacagacgaacgctgatgccgaaaaggagaatgatgacaacatgaaaaataagaaaagcttgagaaaaatgtcatggcacaaattgatgtgaaagtgcagacgaaggaagttactgtncaatagttaagggaaatgagcaatggttaattactgtacctaccgtaacattattatttatattactgtncaatattaatangatttgttccnatttnnagtatttactgananggcantntgattnngatcgtgaattggaggggacacaaaacaccaaagcagcaggggagaagggacaaaggcgagtgtaattaca

SEQ ID NO: 18503 - DNA, 2580 bp, Heterodera glycines
  misc_feature (49)..(49): n is a, c, g, or t
cgacgggatgcgtccttaaaatccttggaattcccggactggccccggnatcgctcaattttgcttttaattaaaaataaacaaataaaaaaataattttatttatttggcgttatgttgatcaaaataaaaaaaaatttccaaaaacaaaatgtaagttatatgtagggcgaggattcttagtttttaaactattttttctgcggcttagttacgacgagaaatgcacgaaaaacacatttttagctcggaaattctttgttttaacgccactattcatcactaggaatcattattttggagcttcgccactaaaaaaaattattttgaagttggccactaaaatacttttttgccactattttggcgtttcgtcattatttttgccactattttggcattttttggaaaatttcccaaaaaatgcaataaaaacgaaaaatacaccccaagaatcgacctaaaaaattcaaaaaatacacccctaagaatctacctaaaaattttcaaaaatacacccctaagaattggaaaattttcacaaaaattcttcccccaaattttttttttcttgttcaatatttgctaagaaaatattttgtaactgcaatcagtgaaaaagttgtttgccttaatcaattgttttgcgttttgatcgtttaaactaaaactggcttagagcaactcaattattttatggtcaatgtagctgaaaaggggaattgcttttattatctaataaaaatgtttctcaatttgaattacaaaattcgtagtatcttaaatcaaacgtcgccacaaatcaaactgaaatgcatgcgaaaagataaataggcaaatgaaaaatttgtaattttttaaattcctcgccctctgttcatttttgctgcaactttgccgttttccaattgattgatgtcacaaatgaattaataattgattgatgtcacaaatgaattaataattgattgatgtcacaaatgaattaataattgattgatgtcacaaatgaattaataattgccctgcaaaatccttttctaaacaataatacaaatcaccgtctgttttttgcacaaaaaatgtgatgaatttatttctatttcaaaattgtttttgcgttctttttgctctctcatttttcccaactctctctttttaagttacataacaacagagttttgccttgccttttgtgacacaattgaaaaatcgtttttccacttaagcttttttctttggcatccaaatccaacaatcttggtatcattcgaaagctcttaacatgctttattagccttatcaaaaacgaaaagtttttcaagcctggaaaaaattttattaagaaaaaacttcaaaaattttgacttttcgcaattttcatgcataacttttttgataattgtctaatcgcaaagcaatagcttagaaaaagcttctaaattgattagctttcgaacgacaccaacaatgttggatttggtttacaaagaaaaaagttatagccaaaaacatgctggcgccgaaacgggagcgccgaaacgcagtggacccgatggcaaaagacaaacaattggtttttacaatggcacttttttcgagtgagcgcatttgtcactcaaaacaagtttttttcgaatgtgaaaattttaaaattgtttaatgtattcgcgttttcgtattactgggcatgaaatcatttttcaaatgaacttagacgacaaaacactaactgacaggaaaaacttcatgcgcgacgttacatcagaaattttcagcaaaaatccaaacaaaattggtcttcaatgccattttgaggcaaaagtatgttttatataattggaacgaaagaatcaacaaaagcatttgtgacagggaataaaagcatcaaattgagatctgtcgtttctcatcatttcttaaaagcaattaatctccgttgctttgatccgcttcttcttcctcttccgctggtggtgacaatggcctaaaattaattaagtttttttatttttcgacaaatcaaaaattgctgtttttgctgctcacccaatggattgactgaaactccacagatcaaatcggatatggttcaaattggcattggcaccccaactaccgtccactatccgtgttttatacaaaaaggcctcctttctgctcacccaatgtcatcgtaaagacggaagaacactttgttcaaattggcatccgaattttcgtccctcttctgctgctgtttctgaaccgccgccgtctccccaataattgggcatctctccaacagccaattgaattcaccagtgccattttcatccttcgtcagtgtcagcttctcattggtccgttcgttcaccaattcaaatggttcaattggcattggttccacatgaataaaaagttgaatatggtaactgacagagcgaatgacaatacgaattttgtagccgaccgaagcagtggcacggagaaatgtctaaacaaaattagtaaataaaaataataataataaaagaaaatatgacagatcacctctctgaaattgttgatcgatcggatgacacattcggaatttgaaaa

SEQ ID NO: 18504 - DNA, 1870 bp, Heterodera glycines
  misc_feature (1853)..(1853): n is a, c, g, or t
aggtcggcaaactcgcgggccagcttcgctgcgcgctgctccgtgaccagccgctgcagctcaacacagacgccgtgcagcgcgtccaattgttcccgggccgggcccaggtccgcgtcgattcgtgttcaccagctggaactgctcctccagcgtgacttggcccaggttgcgcaggtcctcctccacgccgtccaggtgttcaacgagttcggccatgccctccttgaggtcctcggccaacggcagcgccttctccagcacggtgatgcggctcgcagcttcgtccgccagccgggtggtagcgctggcgcaaattgtccgtccggaattgtagcgacagcgcctcggcaccgctcgtgtgggcacacaactcttgactgatctcgaccacttgagtgaccagctggccttgatcagcaatggaggcaaccagagtctggaaaatggggaaagcatggcattggttgatagtcgatcaaagcaatcaatggcattgactggattggtggtccaaaaataatcaaaggcatttattgattgatcgattgaaaattgattttttggtgactaataaactttttataagatttattaattctttttgatcagagatctaaattcctacagttcactaagttgatcaaaagcgattgaatcatatattaaagtgatcaataaatcacgccttttacaaatcatttctgctgatcagtcagtccataaatatttattttttgtccgcttttcccttaccgccaattcgtcactttgtctgcccaattcttcgggctctgttgacgggtcgtcaaatttgtgcatttcatcttccacctccttcagccaattcaacagctgttccgtgctttgtaaaaattgggaaatgtcttccgccaacgttctgaaagatcagcaaagtgtatagattaatcagtgatcgaaaatggaaacaaattcgggtaatccatgatcattatcagaatggattgatcaaacaaatttcccaaaaaatgatacgtcaaggaaaactctgagataagctcaatataaaatattattttcgtaatttacagtattccagtgattaatttacagattccttttattattacagatcatgttggtttaggacatctcatctcatgatcaaacacaaaacgatgcacaaggaaaatactgagatacgcacgataccatattcttttcgtaatttacagtacccaatctggttaatttacagtttccctttcttaattacagtattcaatcatattaatttagagattatctcatcttgattgattttagacagaatcccatgattaaaaataaaataatgctctacagttttctgcataaacccaccccatcagttggccgatttggccaagccgtgtgcccagcgtgtcgtagcgggtgatcagctggtgcatgtcggcgtccaactcttggccctcctccaggctgaccatttgggccaattcggtgcccaattcgaccagccgatcaaagtcggcccgttgctgatccgtggcctgctgcagttggtccaacaattgcgtttgctcctccatcttttgcgcatcagttggaatgtgttcaaatgcgtgcagttggcgttccgactcgtccaaaaagttggccaattgtcgcttctgtttagcccattcctgggacaaaatgagcgcgtcctccaactgttgatggcgagcattgaccgagtcgagcaaatccgaatatctgaaatttttatgcttttatattccatgaaatataaaaaaataatttaatttttcaaatttcaaaaattcccttttctagcaacaaaaaagggatttttttaataaaaaaantattattgaaaggaaaa

SEQ ID NO: 18505 - DNA, 908 bp, Heterodera glycines
tgtttggatggatataagggacattttgacattaccaaattcgccccatcctctttctgacaatcattggcatacccaggactggcgtctgtattccatggatgaacggaattccgacttccaagtgccgtattagagtcggaattcccagggacggtcccaggatttcggcttgggggggggggtacctccccccccgggggggggtgaccttttttttttacttttcatcatcacttttttacggcgctttttccaaaaaaacctttgggagaatggggacatgtaatgatataattttataagtgataatcgtttaattaaaaatggaccattttctgggactaaaccgtgcggtactcactcagtcggacctcaggcgcaacttacagtagtatttttattatggaatttggaagccgcgaccaagtcatattttactgatcggatgaacaattttcttcgcaagaagcgcaaaattttgtacgacgattccatccaaaaacaaaatttaattttatgcgggtatcaaaaatggtgggcgttaaaaaaagttttcgattggaaagcccataaaattttgcgcataatttaatggcctcgctttggtccgatttgtcatcattttatcgccactttttattcctgacatatatacttggccataaatgtgccatatatggtacatgaatttcccgaattgatcgatttccctatccgataaccgagattcaccggtcccgactctgtttaaaattccaaaatgtaaaatattcccaccaatttgtccgtgctgatcccggggccggctcctttgatcagctccttacattcccgttctgtactctctttgcggtccgccagctcggacatttcttcgtttttcagcatcttaaaatttaaagaaa

SEQ ID NO: 18506 - DNA, 1923 bp, Heterodera glycines
  misc_feature (50)..(50): n is a, c, g, or t
taaattagcaattttttgatacgatttgcaaaaaaccattcaagggtggncatttttttgacaaaatctattaacacctttcattaaaaattacatgttggccaaatttactaacaattcttgcataccaatttcggtttctttttttttgcgattatttgtcggcacatacatttttcaaaaaaataaaatgccctcatttttaaagggcgaaactttgccactgttttcactgtaccgtcagcgccgatgcgcgttgtatgatcagctgaaaaaattgaaaaagtcgcagaaattgtcgcgagctcaacgccggaaactgcgccgggcaaagaaggaactggggacgaatagccaactgttacaacaaataaaaatggtagcctccccccgaaacccataaaaagaaaattttcagtaaattttttgaaattttatgcaattttcttaacaaaattgcatgaaaatacgcaaaaaaattttcccagcggcgcctatcggcaccgccggacctccattttagtatatttttgaaaaattgagaccaaaattgcaaaaatagtaattttttggcaaaaaacggcgaaaattttctaaaatacacccagtaattagggatttcaaaaacgaaaaatacgcccctaaaaacgaattttaacttcacccccacccccgccccccgaagccaagggtgttactacgacctagcacttgaatcgcaaaattgtttaaatttttagacaaaaaaggatgtgccgaaggcggtggtgactcatcagccgcagctgcagccgaatcaacaaaccaaaccgctttatggtgaaacgttcatccgggagtttggccaaatttttgtgtgcccccgggagttggttcagctgcacgagcttggcaaatccgtgtttgaccgtgttgcggtcgggctgtacgtcaagcagcaccacggcccatgggttgagcagatcacacgcgtgtcgttgggtgccaagccatacacaatgtacggccaggagttgaccacggtgctccattttgagcatgcccaccgctgcaccatcaaagcgctgcatttgttcagagcgcaaaacaaaatggactttgtcaagcggcatttgctcaacaacaacgatgacaacgacatcaacgagcagcagaggcagaataatgaatcggtccgtcaaatgccaatttcatttttatttttttaagaataggggggtcccggagtgccgattaagtgaatctttgagaatttataaagtttttatcatgaaatttaagaataatagcttgaaatttttttgaaattttattgtaaaaaaaattttgacgggggaaacgatgcggggcgggttcaaaatggattcgtccctgggtgcccgattagcaccgtcctgaaatatttagaaattcaatttgttgccagaatatgcccacaaaatttgccactttcatttgggatcggaattcatttacatttctgctgtttaaatccgttttttttgtctagacagacacaaaaatgccaatttttttattcagaatgtgcctacgcaaatcaaatttgatccaccaactgttgattatgtcaggcgaaagagtcagcaattgcgcgacacactcaaaaagagaagaacccgattggcaaatggtcctccgaaaacttgatgataataagagaatcaatcatcctctatccttttattgtgttatcattttcaatttattaatttgttgattttattttattttgttttgttgtcccatttcgtgtggaatgcataaaagtgcctaaaatgtcacacattggcgcaaaaacgtaaaaaagtcataaaagtcccaaatctcaataatttattttgaaaaaattgtaaaatcaattttttttattgtggaaatcccaaagataattccataaattgg

SEQ ID NO: 18507 - DNA, 2062 bp, Heterodera glycines
  misc_feature (37)..(37): n is a, c, g, or t
  misc_feature (120)..(120): n is a, c, g, or t
  misc_feature (135)..(135): n is a, c, g, or t
tgataaagtgatgtaattgcagaagacggctaggaanagagttaataattaaaaattttaattaaattggataaaaaaactcctgctaaggctgacctatcaatttaaacaatcaaaatntataaatccgtccantatatcattgtttaaaaaatagaaagatttttattggcctcagaaagaatcaaattggtggaaatctttcttaaaaactaattaattatacaaacaaatttcccacaattaccaatggcggtgatcagaagcaacgcattaagcaacagcagattcggttggaaagatggtgaggacgatgaacactgctgttattttgttttggcaatccaaataagtggcaaaggtccgcagggatttccgctgccattgggttacgagggggcaggaaaattattacggtattacagtagaaataatataaatataaataaatattcgacccggtaacaataatgtccaaaagagaatgaaaagggcagcaaataggacagaaaattaggaaaataaaattggattaagaggggggcatgaaatgtttaccgtagttacagtgggtcaaggcaactcgtacaaaaggcaactcttaatttaaaattaaagcctaagcttaagcctaggcctaagcccaaaagcctaagtagtcctagcctaaagcttacctaagcaactgtacgagttgccttttgtacgacttgtcatgaaaccatttacaggaggaaataattgtacagaactcactcactttccggcataattttacggttggtcatgtttttgtgcttttcgccaagaaaacaaaagcaactcgcttcatccggcagttcctttacagaccccttcatattctcggtacagtaatcacgtctatttcttatgtctgtatcatttgcgcagccaaacccatacaaaattggcttgcccactaattctaaaaattgtttgttttcgagatcatagaaaattatttattttttttgaaatatttgaaaaaaaaaactaagttttcttacattcactctcagtctaagcttacttatatcacaaatcgccgaaaaacaacgggtgttgtcttcattgcatatatgatcaagaggttttgttcattattgtatcctcttccaccacggcactggagtgctccttgattaataatttaagtaattaaataatattaatattaatttacataagtaaataaattatttatttatttatttatttataacaataaaaaccattgctgtttttaaacaacataaaatagcagaacaaacaccaataatgtcagcaagctgaaggccggtgaattgttgttcatttttgttggtccaattaaataaaatgctcttttaaacaaaattatatataatatttaagaatttaaaatatattccttacataaatttttgatttaaatcaaagttattcttttcgtgagcctcccccacccccccccaattttgccgtcctcactttgcccccttagagttggccgtgccggcggcggttattcctccggcttttaccgtttggaattcgtcttcgactgcgacgtgtcctgctttgtccaaattcacttctgtgcccgggaacaaattgacgaacagcagccacaacttctccagtaataaaaataataattcaaaggctttatcccttttctctctcccttttactacctttgcctttcggcgatatttcgttactttttttaatcttttggcaaaaccgttgatctgaccctggtccacccattcggagtgttcttcctaatttgtgaattaaaggctttacctcccctcgtcaaactttcaaaatttccctttttttcctggtcaaaatggtaactccccttccctcaaaggattgtctctcgtcagccccaatttgaacactccgaacgtttccatttccccgtgggcgccaaccaacacttcagccatttcaccttcaaaccgcaccgatacgacatgaaaatgatgcattgggacggcggcccagttttcccggtggtcatcgaaattcgatcggtgtccgaccaatt

SEQ ID NO: 18508 - DNA, 1635 bp, Heterodera glycines
agttaaacccctcatagggcatatttttagctttaaattatttaccaaagcactgaaatttaaaaaagattttcaggaaatttttgttcggctctgtgagtccggcaaatgttctcccaaacattacggtatctgctgaacgacacggaatgcaagtcagaaatgcgttgggtgaaaatttaattgtgccgcacaccgcgcaaatgtaccaacgccaattggcacaaagttggggccaaaggccaagcccagcggcaacagcatcagacaatggccaagtggacagaagcggagcaacaagccaactgcagaggatggcaagttttcatttctggtaaaagtcaaattaataaaataactcaaaagccccgccccaatgaactcggtcccaattcatacaaaattagagaccggccaaatgatcgatccatatttttcaataaaaaacgaaatcgatgcatatcaaaaaataatgaaaaccaagaaaatttatctatcgataaacgatatttatcgtttttgtgcctctttttccaatactaaaaatcgatttataaataagaaaatcctataaattcgaacctgagaattctatgtcggaaccgccaaacacctaattccttaatattcccaaacaattacggacgatgtagaaatttaaaaaattgtatctacgtaaatgattaaaacaaaaatttaataattaaattttcggaattgatctctttaaaaataagcgggtaccaacattttcaatgttactggcaaactggtaattttctaagttctaaaatttatagaaatttttattattcaaattcgttaaaattgtttattacctattttttaaaatccaaaagatccagtgccaaaaaaattaaagaattttctatgttttcaactaattgacaaaatcttttaatttttttttgtccgtgggtgccgataggctcagccgagaaaaaatttgaaattttgagtgaattttgttaacaaattttgtccaaaaaatgaccaatcattggttaattgtgggtttatggatgtttaaaattaaagaaaaataatttttaaagatagacaaagtttcttattaattaaattcaattaaaataatttaacgagaatatgaacaatctcctttctcaattgggaattgaatacccaagcgacaaatttttatccatttagcccaaatctgatttagtgatcccgaatgcactgaaatttatgaaaaatataataatagaatacatttttgatcgaataaaatgtaaaaatatttgaagcaattttgcaaaatgttcttatttttgaccctaaaatcttattttttggcctttggttttattttgaaaattttgagatagaaaccctggatttagacaaaaacacccataaaaattgcctctggcataatttataacccttaaatttggtcatttttagacaatatctatgcaattataccaaaaaagaattgaatcgaggcgatacatcgaataaaggaatgtggagccaaacacatcattcaaaaaaaaatttttgtgagattttttggagctaattaaaaacaaacccccgcccccgtccccgggggcgagaaatttctcacccccgcccccgcgactctga

SEQ ID NO: 18509 - DNA, 2026 bp, Heterodera glycines
  misc_feature (60)..(60): n is a, c, g, or t
  misc_feature (65)..(65): n is a, c, g, or t
  misc_feature (1896)..(1896): n is a, c, g, or t
  misc_feature (1932)..(1932): n is a, c, g, or t
  misc_feature (1947)..(1948): n is a, c, g, or t
  misc_feature (1982)..(1983): n is a, c, g, or t
ttagtccaatgttaattatatatgaatttagcacgacgttcaaaaattctgctatatcgnaccgnttcatatgctccctttgcggccaaccgtgccattattattattatggtgttacatgttgcgaaggtattttggcatttgttcaacaatttttctaattattaaatttgcgaacaaatgacatgtttcaaattcaaaaaaaaaattaattttaataatatattaaaacattcataacaatataatagatttttaaaattcaaataaagcctaggagtttatactaaaaaattcaaaattgaattttttctagaaattcaaaagctttatcatgactttttttaacctaaaattcctatttgaactccacccttccccgcacgccgctcccccaccccaggttgcaaaaattttttccgccgctcaatttcgatgatgaaggaatacaagtgcaataatggcggacagtgcaacgtcgaaaaaggcaaaaaaaattatagaaaatcaaaaaataattgtttccttcaataatttctttaaataatgaaactgtaaaaatatttaaaatagtttaatgctgattagatatggcaaagtttcagcggtgccgattgaacaaatgcttaacggtcggaatgaacccgcgaggaattggcataaaaaagttcaatgacgaacaaattctagcatatgtacaccgaattaaacagcaaatggcaccgacaccatcctcatcttcggcagaaattggcacgaatggatattgcgacccgaggcgaccgtacatatgcgtcccggacatgtgcggcccacttttgaatcctgcgttgtgacggcaaaagcagcacatcatgttagcgatgctattcctttttcagtgatgtgtagtgtccaaatttgtgccggatttcacggtggatagtttccaacgagcagctgcttgctgactgggatcgatctcgatcgatcacattgacgattttcttagccaaatttcgccgcgagccccgctccaatgtatccacgttttttacgccgtatggaagctgaaaacagaattttgttaacttaaaaagatgttaagggatgacattataattcattcattcacgcaagcaaaaatactctttttcgatccaatagaacataatccaatcgcaggaaaatttccctttctcgtttgggttcaaatatgcttttgaaagtgaattgcgaatcgatcaaggctgggatcgaaaattaatataaatttaacaattctgttagattttttcaatcgaaaacaaaaacccaaacctttacttttgtaattcttaatgggcatcacagcagctggaatactcatctccgagtcagccgccgttatgcaatattttgtcaaaatagcatgttgtagtccgtgtaacatttgtcacaccggtgccagacgcaacctgcaagtttgtacagtagctggccaatgcttaattcagcaaaaatggtttgtggcggcgttgtcagtaccactgtcgaattgacgccgtttttagggcatcactcttgtgtcagatagccttccggtgtcagatacatcttttgcccgtagttgtcagggcgaaaacgtgatagagactgatctttggactccgcaatattggtggggcaggggtaaaaacgcgtctgtccaataatgcaatgctgatcatacatccaagatttctggttcgcagctcttctcaaggctgtcattccagtgtttgaagatgtaggaataagaccttcgggaccggtgggaacatccagaatgacgaagcgcgttttgacttaggtgtattggaattaggcaacgtgttcaatgctgcacttcttctttattaatctaataagaggggagaggcataatataatttttanatgaagaaaataaataaatgcgcgaatttatatggngtgaaattacattgnngataatatgatagtgatgaaacttatataaatannatcaaacgtatgaaacaatcttggctagaaagcagctaattgc

SEQ ID NO: 18510 - DNA, 2696 bp, Heterodera glycines
aggataaatgagaagcgatggatttggtggttgggcgactcacctaaagggagggaaccccccccccccccccggactcttctgtatcaaacgaatattacagatgattgaaaaagaatcattcatttctccacggattcattttttcagaattgtcttttaatttaaaaaataattaatttatcactaaatgaaggttgttttttaaggctctgtatttgtctcgccccactacagtttttacgccgtctttgcatactcttttttgcgtagttcaaaatctgaaagtgattttatgtttttttttctggctcacctaataattatcgtttgagccattctaatattgtgattttttttttttttttgcttttctaaattatatattaagtggggctatgtttagacttttgcactgactgtatacatatagataaattgttttttaaatattatgcaatgagaaaaagtgaagagcaaaggtcaaatcacacaataaaaaacgaataattgtcgggttaattcgggaaagaaagtgtacctgggcataaacttataaacccattcggaagttgtggaaaatgaaagaaaaatggaaaaataaaccaaagaattggataataaagggggaacaatgagggaaaagaaatgtgaaggatgcatcaaaaaacccagcagcagaaaaaacgccctctcccatattataatcccgacaaaggaagcacttttatagcgtaatttatgctctgatcgagaacctgacgccataaatataaataatatcttttttatgattatcaacataattttgccgtaatcgaatgtgtggtgttttggccaaatgctaatccccggcttaatttgaagtggtccgccccatttcagcaccaaatttgttggattgtaacttttgctaaagaagagttctgaaaaatgtattttcgaagaataaccgattgtgatatttgatataagattgctttcttttctaaaatcaactaaatcttagatttttactaaaattaccctagaaaaaagcttcactttgtcgggaccaagattttttgggaggggagggcatgaccaaaaagtaacaaaaaaaaagcgaacgaaaggcaaattcaacgaaacttcttagcgaagaaggaatcagaggccgacatccatggacatcatcaccatgaagccgagaatggcaaataacgaggacattttgccattgccgtgtgaatacgcctcggggataatggagtcgaacacaacataaatcatagcaccggctaaagtgagtaaacatttaaagcaaagggcaattctaaggcacaccagcgaaggaaagggcataagggagcacaaattccatcatcagaacgagcgaagcgccgagcaaagcggcgattggttcgaccattccgctcatttggccgtagagaaaggcgcgccattttgagtagccgaacccggccaaaggcaacgaaacggccaaaccctctgggaaattctgcaggcctatgccaaaggctaagttgaacgctttttcaaatgttgccgaaggcgttttcccaacaccgccaaaaccaacaccaacggccaatccctgaaaagtaaaccttaaatgcgcagctcgtcttgaaattgttaaattaatttcaccaccataacctcctccccccaaagccaaaatcctgaacagtcaatgaggatgacggaaaaaccataggtgaacaaagggtgtgccggcaccccccccccccccctcgttcgtcgtaaggagggcggctgtaaaggaggggggggggtagtaacgaagggggaaaaacttaaaatttgaacaatttccttagcgaaatttatagaaaattctaaaacttttcccggcggcgcctatcggcaggaccccgcaccggttccacataatttttgaaaaaggctagccgcaaaaaaaggtgctttgaatagcaaaaaaaagaaggtcgccgctggagaaaattggggggccttcatacgaaaatttggtcctggcacaccccccccccctgcgccaatcgtccgtcgtatgggcctcaccctggcgcatcccctgtccatctatgatggaaactcgtgcgttttaaaaacaccacctcgggaaaattgtgcactgtcactgccattatcagcaggaggatcctccgccaagaaagcaattgcgacgctgagggattcgagccgagttccgctgactgttccgttccgctgggtcctccttcgttttcgttcgcccgcaatggaatttctgctccttccacatcatttcgttcgcccggaagcattctggaacggttgcgcaatccgttagcatcagcggaatgggacaaattctgagccctgaaactcgggcacaattaccatggccagcagcctgatgaaaggttctgattttgagaaaccaattgaatgaccgagtttcaggtggatgagtcactggaaaaagtcgcaacagaatgcgctaagggtgcggcggtgtttgaatttagaagatttccgtctttacgagtccttccctcccctgtaaaactttaaccgttgtgttgtcgcatcatcgtcgatctttgctttctgttccaaatttcgctttttactcctggctttttgttgcgagtcattactttggcattcaccagaaagtgcactaataacagtcaattcggcattaa

SEQ ID NO: 18511 - DNA, 2738 bp, Heterodera glycines
  misc_feature (1527)..(1527): n is a, c, g, or t
ttgtaattttaaatgaaaattttgtaatttttcaaaatatttgctgaccgtcggttcattttgtggttcaatgagcacaggtctcaccaattttttcaatttaatttgtgtgtcacaaagggcaaaaaaaaactgtgttaacttaaagcatagacaattaggaaaattgagagcgcaaaaagaacacaaaatttagagaaggtacatgaaaagtgaaaaacagtaatttcacattaaaaactgtgctattattagggttgtaaattatatggactaaaaaggcccgaaatatggattaaaaagctcaaaaatggccaaatatggaccaaaatatggactaaaaactccaaaatatatgttttaaacccataaaaattccaaaaaggtgtatatattcaatatttgcttaaataaacttaagaaatataataaacaagcaaaaaaatggatttaaaacataaaaatgcaaaaatgacgaaatatggatttatatgcactaaaaaccttcaccaaatcaaaaaattttaacgtagaaatgctattttgagcccctttcttcatagccagggaacggattttcctttcaattagagcgagtttttagcacatataaaaacatattttggggtttcggcagtttttgtcatatattttgacaattctttgaaaaaatttgatttttttaaacaaaaatgtcttttttggcaccaaaattcttggccaaatgcccaaaaaaattttcaaaattttcaaaattttttatttttttttcattttttgaccattttaatgatcttttcatttttatggcaaaattaaaattttagcgaaaataagcattttgctagcgaaatgggtaaaaatgagacttttatgcaaaattcacgtatttattaagtagtttttttcagtttttggcacatatttttccttttttggtgtttttagcacatattttgggggttttttggcacatataaatccgttgcctgttcatagcatatacgaagaaaaaatatgttaatccatataatttacaaccctagaaatatgtacaaaaagtgttcaaaatatgtacataaatatgtaaaaaaaaatcccgaaatttgtaagaaaaccccaaaatatgtaccaaatatgtaaataaaattgtccaaatggttgcacactccgacaactgatggtcaaccgaagagattgtttgcagtgattatttggatccaccaaaaattgattggatcaacaacttcaaagaggtgtctcgccatttttctcaattgtttttgtttttcccaattttgtttagacatttctccgtgccacctcttcggccagttacactgttcgaattatttttcgtgtgaaaccaacgccaattgcgccatttgaattgatgaacgaagtgacaaatgagaagctgacactgattaagggtggagctttctgtgggaggcctgaaacgcacgaaaaacatgtttttagcttggtatgaagcttctaggaaggatttctatatccatattttcnatatttttccatatttcgcgatttatgtccatatttccatatttttccatattttggcatttggtccatattttatgtccatattttgcgaaaggatggagcttttcgttggctgttgaaacggtgcccaattgttggggagacggcggcggtggttcagaaacagcagaagaaagacgagaaattggaccgtttgaacggagtctactgtctttacgatgccaatttctcgactcccgggcacattgatcagcggaagaaaaagtgatcacttgagaaatcgccgaccattattgatttttgataattgggttgattgatgctaattgtttgctctttgaactcatatcactttagtggtggacttttcaatgttactataactgaatctctagacaatttctattgatactaaagaaatttcccaaccaaaaaaatcaacaatggtttatataattgaaacaaaagaattaacaaaagcatttctgagagaaaataagcacaacaaattgagatagatcatttctcaaatataattaattaattattcattttcgtacacttaatcagacgacatttccgttgcgtttatccgctttatcttcttcttctttttcttctttcgttggtggcgacaatggcctaaaatgaattaaatattttatttttcgataaaattcaaatgctattgctgctgctcacccaatggatttatcgaaactccacagatcaaaagtgacattgttcaaattggcactcggatttacgctgtcttcccatttaattgccgtcgccgtctccccaattgggcaccgtttcaacagccaattatacacatttacgccgaattcgtcgatcttctgtttcagtgtcagcttttcattcgtccgttcattcaccaattcaaatggttcaattggcattgtgtccacccaaaaataaagttgaatatggtaactgacagaagtggtggcacggcgaaatgtctaaacaaaatttgtaaaacaaaaggtttcatggcaactcgtacaaaaaaaggtacttgtgtgttatctgtgggcagattttaaaaatttttatgtttttcgctataacttttttctttggcatccaaatccaagattgttggtatcattcgaaagctcttcatatgctctattagccttacaaaaggaaatgattttctagcctggaaaaaattttattaagaa

SEQ ID NO: 18512 - DNA, 2231 bp, Heterodera glycines
ctaataaaattcgatcatttaatccaaaatgattaattcgtttgaaataattgaagaaaatttgatttgaaaattttcattgctttaatttagctttaacttttggagtttattcaataaaaaacaaagtaaaaatttaattttgtattattttcaattgaaataaattaaaataaatttttttgaatttttaaaatttcccggttggtcccggttcccggtccgaacaaaaatctaggtcccggtcccggcttctcaggtcccggcaagtcccggtcccggcttctcaggtcccggcaagtcccggtcccggttttgcccaaaattcccggtcccgcttcgctctaatttttaggaacatttgaccgtattgacaaaatttcgaaaatctatgattttcaaaatcaatgatagaatcaataatttttgtaaatctgatatcatattcgtgatcaaaggtcccgaaaacccccgggttaatctttttataacataaacgaaaaaaatttttgggtggagccaagattctccagtattaccggcctaagaaacaggaaaagcattgattggacgcgtaaacagaataaaaccctaatttgacaaaagtgctcaattgtaccactgaaggtgaataaataagaatgaaaaaacaatcaatcatttctcgcgtcagaatcaaagcagttggttcagcggagtcatttgcaacggcgttttccctccctcgccgtttttctgtttttggtggcgattatccccgtttctgtcctcctctgccgtcatttctctgccgcacattttttgaaaaatacgcaggaattcgcgccgaaatctgcgcgacattacggtgtaaataatcgggttaagtgttgcgctaatgtattggaggaggccagtgattgggtagagaatggcgcagacgcgggcacagtatcccctggcgtacttaacgacgagtcgttccaaatggtacggtaagtaacagatgaagaagagaatggtaatggtcactaaagggggggggggggaacggacaaacgccggcggggggagacaaacgaacccaacattttgagcacggttttgtgcgcctgctgacttcggactgaccctcgcccggacgaatttcgcgtcaatttccgccgtggcgtcgaattcgccgtatgtttcgaccacacgaaaaaacgccgttcggcccaattttcatcgggcgaaggcggcaaagactcgcgaggggcgccgccaggcgcacccaccgccagcaatcgctgctgctggcggcggttgcctttgccattgccttccgccgctttttcacttcgctttggctgtgccgcggtcagctgatgcgagttggaagtggcctcattaagtgtttgcagaattttgatgtaacagtaaataactgaaaagggacaaaagtcggcggggaagggacagaaaaacgaaataaaacaatggcacaccgaatgccacggggaaaacgaaagtgagcagaagctgtgccttaaataaaggggaaacgaaagtcatggccaaagaatgggctgaacacctcaaaggtcaaatggtcgtcgccgttctgctgtttttcgtcccatccaacaaagtcacaattgccaaaaacgttcgaatgcgtttttcctttatcggaaaagccgccataaatcgtaaaagccaaaaactcaccacaaaaatctctcacaactgttttgaactttaactcagaaagcatagaaactgagaagaaatcactcacttgaaggccaatgtaaagcgaagggaagaaggaaatgagccacagcacagcgatgagccacaacttaaggaaaagtgggcaaaaagaaggaagaacggggacagcagcaccaattaccatggagcggtggtaaaaatacggcctgaggctgaatgggtagcaaatggccactaaacgctcaccggtgagactaattgggggggggggatcagccgcagggggcaaatgagcaactgtacccgacaatggtgagaatggagcagaaagtgaaccaactgatcgaagtgcctgagggggggggggcaaaaggtgggaatcgctttgtgactgtgccaataatactcgtggcttcgcaaaatccactaaatgcggtccatccattcaaatgacgacgccaaaggctgaacaagtcaaaggagatgccgacgaaaatgagaagcaaatcggacacagccaaactggcctaaattgg

SEQ ID NO: 18513 - DNA, 836 bp, Heterodera glycines
gcaggtgagcagcaaacgaatccatcccccgcctttggtcctgcgcgtacgaaaacgattaattaacaaacattgaactaaaaaaacactcaccggtcttttggccacagattccgcaagtaatttggccaaatcagagacatgtttttgggcacagaaaggacgaagtccgtggattagagtgcccgggtcgacgagttccgactgaaagtattcaaatttggccattggcgcgcgtgtctttggtgcgcacctcggccaaaagaagcgttcgattctctccatcgaattcgaacaaatggtcgacctgctggggagaggggctaaagccaagtgaagaaattcaaattgaataccttcccgaaaagggatgagaaagcggcggcagacaattcgccattttggaagggaaaatccacgcgagggaccgacggaggagagacaaagggaagggcggtgatattcatctcggaaggaaaagagatactacggtaatgtacggtgcgaaagggcggcggtagggcaggcaattaattgctaattggaccacccaactcataccgtaagcaaaacaaccgcgcccaaacaaaggataagttggacacggtagtgaagggtaaaaataacattaattacgccttttttactcgccaattacaaatgccatcatattctcattgatatagaaaatgccaaccattttatgtgtggcaaatttccaaaatgttaatcgatcgatttgcagatgatcgatgtgagaaaaaattaaaaataataacaaaatcaaataaaattatttatatttaaagaaaatatacaaaaatagcgaaataaaa

SEQ ID NO: 18514 - DNA, 2699 bp, Heterodera glycines
tttggaaaagcttcaatttgaagtatagccctgctcctttcgtaattttcaattctataatacaaaacgccaaaataaatttgaaattgcatgacaaatttgcataggtatttcctttaaaaatccttatttaaggagtcaaattggcccgcccattccactttattattcttcttattaatttgctataatttctaaaccaaaaattgtcaccttttctgtttgtcctttgttactctaaaactgtgaacttctgaatccgaattcggattctgattgattttcattgactgtgctgaaattgagcactcacatttctggatttctttccctacattttaaaaagaatttcttgatttcagttttttcgataagacacgacatacaaatttaaataatttttattgttttttcatcacaagtatgccatatttgttcagaaaaaattaagcccagtccttccttaatattcatcataacccatccatctaaatggcagaacagcgcgaggaccacatccaacgggccaagctggcggaacaatgcgaacgctacgacgaaatggccaaggagatgaagcaggtgttgtgagcggcgatggatcgaatggatgctttttccggatttccctgttataatttccctccccccatttcaggtggccgaaatgagcgtcgaactcaccgaagaagagcgcactttgctgtccgctgcgtaccgaagggcgatcagcactcgtcgttccgcgtggcgtgtcatcgaatcccatgtgaaaaagtcgaccatcatggacaaacagaagcaaggtgtcaaggtgctgcagaagaaggtggagagcgaggcggaggagaagggccgtgaaattttggtcagtgcgtccgtccgtgcggcgttttcccggaaagagtttaactccaaaaaattttttgaaattttacagactctgttggacaaccagctcatcccaaaggctgccgacccggaggccaaagtgttctacatgcggatgaagggcgacttccaccgctacttggccgagatcaaaccgtcggaagcggatggtaaaagggcttcgaaaatgctaaaattcaacaaattcccccctccccaattttcagatcttcgcaaggcacagaaggcgtaccaggaggcgtacagcattgctcaggaaaaacttcgaccatcgcatcccatccgtcttggtgtggcgctgaacttttccgttttctacgaggaattactgaaatcgacggaggaggctcgccgaatcgcacaaaaggtggttggaaggatttcattgttttagagaggctgctgttcatttcatttttgcgcaggcttacgacgatgcaaatgcggttatattgacggactcgagcggcaacgaaacgctgatggaggcactcgcaatcattgagaagctgcacgacaatctggcggagtggaaccagcgcaaaggtggagctgaatagaacgccgctgctgtgaatggagatgaatcgcgcaattgatatgggtgattaaattccgatggattgactcaattgtacacatatgtatgtcatggtgttgtgtatatgtatatattgctgtattatattgtatatattgtataggctgtataaatgcgtcaatcgacttttaggcgatcaatcaatgaccatcgtcaatttcttagggcataccttattttttcttacttggtcaatgttgtgtatttgggtaatactaaccgatggtaggaatgaaattcttaggccacaaatttttcttcgtcagtgtcaacatttcttggttacgcttttttagtatatcataattagggaacggatttttaggggcgaaaaagtttcaaatataagggtgaaatttattaaaatattgagcaaaatcatcgccctgttttacgtattttttcacagcaaaacgccatttaaaattttagcatttttgcacaattgataagcttgttatttcaacaaatgggtttagaaaaatcgctcagtcggccggattggccgggtgtactacaacaccgacgacgccgacacctgtgcgagttgtcttcctctgtcgtccacccattccgaccgccggtcattcagaacagcgacgacgactatgagagggaggaacggcagtctacgggccggacgtctttttgaatttgaacgggtgggtgtgggtgatttgattggacgaatggaggaaacccggaacataaaatgcgggcccgaaaaagggggcgggtgtttaaagttcgtcaattttgtccaaaaaaaatttgcgatattgagcaacattttgttttttttaaattgttagtaaaaaagagaaaattccgtcaatttttttttttgtcttgtttgatactcttttttattttaatgctaaaatattagaaaaaaattttctattttttgttgattttttcaaaaaattagcaaattttcttaaaaatcagcaaatcatccatcatctcaaaaaagcatcattgattccatgaaatcagcaaaaagatgataaaattgcagctcatgattgttcagggaagagaaaaatgtcaggattcgggtgacccggaacagcactgttgcagctaagctctctttcttccgcttatttccttgatttttcagctattttttttttgaaaaatttgtaaaaaaaatttattatttagaaaaaatcgctgaata

SEQ ID NO: 18515 - DNA, 2787 bp, Heterodera glycines
tatttgctttaaataatcagaagaaatgggactctaccttttgggaagccagcaccaaagtaaggcacactaactacttgaccaccggatcgcttgcctccttttaatttccttttcactttccttcttttttggcataaaatatttataattttatgtttaggtaacttattaatttgtctccattttttaaatgattttgcacaaaaaaggtcaaacaatagatttttgggctaaattaggaagaaataattattatttttaatatttaaaataaattattttaataaacttaattaattttaaaaaaataaaatcattcaaaaaatgtaataaaataatggatgaaaacacccagaataggtgggacccgagccgtcgcccaccaccaccaaaggcaaaaactaaaaatttatgctattaaaacagcaataatttagttggaaatatttattgaataaaagtaggagcagtagaaaactgatgatgtaaatggaaacaattgataatgaactggggaaagaaaaggaggagacattttttgcttattgaaaaggcgaggtcaaagaccactggcgagcgtgcattacatataaaaaaaggaaagaaaggaaagtaatcaatttttatccaaaagtactttgctccaaatttttgttattatgtctttctcttttgtaaacccataaaattttttataggaaaaatattaaaaacaaatttaaaaccaaataatttaaatataatatttgacgggaaaatccaataaattaatgggactcgaacccacaacaccccatgaccaaaggcaggcacactaaccacttgaccaccgagtcgcttgcttcttccccgtttaattcccttttctttttccttcttttttggaagaaagcccgaccaaaagtgcttgtcctccctttttagagcacttcccggacacggaccaaaacaaccctggtatcattcgaaagccaagagtttgtagatgtgcacaaacatattaaagttttgatttgaccctttttaaggtatgcaaaaagcgttcaaaaatgggacacccaaaaaaagtgcaaattttgactcgttttccgaacgcagttcgaacaattcttaaccgattgggatgccgatagtttttccttatagccagtccaaaaccctatcgaatgataccactcccgacccgtaacattcggtagaaagtcttaaattagtttttaagcttgaaactggggtatattattcttatatagggaattttctttggtcacctcccgcccgtgtgatctttaccaacttaggcccaccggcggaagcttaaaaatatgatactcatcttaaaactacagtatataggcggatagtcagcaacataaactcgaccttttgtgggattatgaacagattttgcgccaaaacaggcccactttttcatgtatttgtatccgctctacagatgatgattattttgatttttcttccaagtattttccatctagcacctatttttcagttatactattttattttatgatattatttttatagagaaatcttgttgatcatcattaaaaaagttaatggctctagcatgagttgaaatatcatgaattttttaaaatttcatcacttttatcgaatcactttttctgatcagttttggggtagggttaaaaaagccaaaaatttccaatagcaaatcgcctatgctctacatgatatcgatacattcccttgtaagcactcattagggatatgtgttaacgaattaatttaaattactttaaaaatttaaatataattttttagacaatccataatgccaggttatctgttctttcatcttcgttgccatattttgctattatttgcattaataaatgaattgttgttgaatttatgaccttggtccaaccatttcttatgtagcatgtctcttttccaattcactttgtttcttcccttttcctttctttctctttctcattgaccaactcttctccatcacttccctttttcctcctttctcttttcacccaaaagtccatcagtcgacgcggcgtatcaggtcgcaccatcgtcagtgtcgtcgtcactaaaacgacgtggaataaacacaaatgagtggtggatgaatgagtgggaggatggggaggatgtgaaggacgaagcgggggaaggcggcagagggggtaatttgggagtctgcgcttttctcaatttattggcgagcagaaaattcgctatcattgtttgtatgtacatttagtgaattgaataattgtaatattcctaagaaagaattaaaatcaaaattatttatgataagataaaattaaaaaaaaaactttcgaaacgattactttttctttttaatctatatactgtaaaaaaaaatatttttaaatatgtatgtatttatgtacattatgttatatacgtatatttgtttttgcttataaaatatgcataaaattttaaaaaataagtacgcccgtgcaataggtttaatcgcgtgggtttaatccgaagaaattaattctaaaaattagatcatttaggataatggttttgcttctgaattttgccttcatattctttgcatttttggtgagttctgtgtaatttatccatattttttgttttatttgtatttagtcttcaatttatgccgaggaagaagatcccaaagttacgcataaagcatttttcgacatttcgattggtggcgtcaaaaaaggaaggattgtgattggtctctttggtgaagtcgtgcccaaaacg

SEQ ID NO: 18516 - DNA, 2683 bp, Heterodera glycines
aaaagacaaaattctctgattttttctatcataaaaagacgattgatcacgaacgaatcggagttcaaattttgcaaaatctgatttgtctgtgtatgatttttcactaaataattgaccttcaaatacacatacttaattttcaaaaggatcattcttttttgacaaaaataaataaataaaattcatgttgcgcatcggactcgaacctccgctctttgtccctttattttcttacaaaatttttctctcttttttatgtactatttcatgactcgagggctctttttcatattgccaaacaaaaaaaaatttgatttctttcacccacactaaatttattttttttaaagtaaaacaaaaaatttttttttagaattttaccaaattttacgtcttacatataccctaaattgtatttacattttatgtgctattccattctctgatatggattatgtccgtacactgacaaggtgaaccaaaatgcccaaccaattttcaatttttatttatttatttttttttgcccttttctgactgaaactgaaacttcggcacaatatcaacataaaactcttaagtatggtcgatgtttgtctaacgctggaaccaggcttttccactcttgaagatttggcatttctcgacttggccggcggctctgtgcatctgctgggcaccacttattcgtcaaaaggcatgcaaattaccgggatcccatcaccaccacgacattcgacgatttttgagacaaaatttgtctaaaatttaacaaattttaaggcctgcaatgtctatgttctttgttttcatggaaattttgatgaaatttttcatgggctgagggatttgaaattttgatggtttaagtggcgacataaaattttttaattccttttttgttatttgcagatattgaagcgatcaaggagttttcgaggtccctcatatggtttacatatcgcaaaaattggccggcacccatcggaggctttgacggacccacctccgacagaggcatcgttttttgttgaaaaattggaatttttaccaaattttattataaaataacgaagccaaccaattttggtcccgaaaattctccaaaattcgaaaaaaaaaattattttaacaaagtcttagttgagatgaaaattttttgcgctaaaatgaattttcatttttaggctggggctgcatgatccgagttggtcaaatggtgttggcacaggtaattgaaaaaaatgttggctcaaaattccaatttacgcgtccaaagtgaccatcctcagtttattagggctatgactgtttgttttttgatcagggtcatcattattggtataaattcaaagcttaaagtctatagaattgctttttcaacatttcctatttaaggcactcatcaaattccatttgggctcgaattggcgatgggccaatgaattggtggaccaacgggcggacaatgaacaggttttgacatttgctaggaccacaaattggtaccacctgattctaacacggtttttggccttcatgatttaagaaaaatgaaaagttttttaggaaatttatgggtttcatactttttaatagaggggaaaatatccggaaatttacaaaaaaaaaaaaaaattttaagtttcaagcctatctccgcctgttgaggatgttccaggacaaacgaactgcacaattctccatccaccaaattggtaaaaaatggtacaattttttgaatctcatgaccaaaaaggggaacccattagaattttaacaaattaaagcaagaaaattttggggtttttttttcattttttcgtgcctgggaggtaaaaaaaccataattttcatgttttatgataatcaatttcagcacagtttggcgtttcggaaggcaaaccaattggcgaatggttgggcccaaattcaatggcacaagtgctgaaaaagtcagtaaattttagggggaggggggaggcgcgcaaaactccaataattttgctcaaattaaggattgtcgtctacgatgaatggttttcacgcataaaaataattttctgttgtattttttgcattttttccaggtccaatttggttgtacatgttgccatggacaatgtgtgaggcattttcaaaaattcaactgacacttaccaaaaaaaccgaaattaaaaaaaagattttctaacgcattttgcaaaaattactggtttccattgttttagcctaatttcggacgacgttcacacaatggtgtcattgccgctgaaaacggttatttattcatttttatttttttttaatttattttattccgtcattaggaaaatgggcaaaccgacgaatctgccgaacgtgaacagcaaacaaattctcccaccaccggtcaatggattcgtccgttgctgctcattgtaccacttcgacttggtttgatttaaaaaaaatttttttttttgaaaaatttcattggattttccacaaaatttaggcctaaccgcgatcaatccctgctatttcaatgcgattgcggtaagtggaagcgattttcggtttgtaacacatgtcttaatgaatgcacattttaggaatatttcaaattgccgcaatgcgttggcattttgggcgggcgtacgcggcacgccgtttatttctatggcactgcggggaaaaa

SEQ ID NO: 18517 - DNA, 1343 bp, Heterodera glycines
tggagggtggcattggcactttcgaacttgaaaatctaacgaaaagtaacgacgacaattcgggcactgattgttgtgatattttgtcattgttgctcacctgacgataagtcatccggcggagaataaagcgatgaatcggcacaacgcacttgggagtggtgccggaagagctgctgactttgtggctgattgtaatgggttcggatggcattggcattgggcgcgaaaagtgccgtcgaacttgctggaggggaaaatggcgaacaaagcaagaaaaagcaacaaaataagacaattcatcaaccattgttctctcttttttgtcattataaaaatttttgatttcgaaattaacccaaaaaattaattgggccaaaaaataatggattattttgcttttcattttcaaaatataccattggaattgtaaaaatgctgctgggcggtgacgtgctgaaagtgctgttgatgggtggaggaggaggacgaagcgatgggagaacaggcggaagagggacaaacgaagtcggaagagtttggagttggggacaactgagggaaaagggggggggggaagggtaaaggaagagggagacaaatgattattgtcgcgaaaagaaaggcgggaagccactcactccctttcccatcccaacggtgatcggattgaacatatcttattcgaatgggattggactgatcggccaaccaaatcccaccgaatccctccccttttccctctcgccaaaacccacccagcagttggcattctgttcctccatgctaatgccaatcggccggggctgtgctcccacagtgggcccgcctccgcccccaatcggatggccacacgattcgaatgctttaattgtaatttttttatcatttccagtccccccctgagcgtcacctgtcttccaaagttggagctgcgcgtgcagagtgtcgcctccgtccggaaatcgttcctgaaactcctccacactcagcgccaaaagtcggcgcccgtccatcgtaaaagcgccctcctcgggaaagcttagctgaaactgtgcgcacatttcgccaacccatcggcggcagtcgtcgccactccacgcggccaaatctgtgatgatcaaaacccattattgttgtcgagattgggttaaaatatcggttttcatttaatcggcacattttggcgagcattggctgccctttgttctgctctgatcacctgttgaaaggccgagctttgtgcacgtgccgctgatgtcggcgatcagatgcctgaggatcagctcccctgtaatgtccgtctgatcagctgtgatttgcgtctgctgttgctgcgtcag

SEQ ID NO: 18518 - DNA, 724 bp, Heterodera glycines
cccccccccccccccgccccctcttgacgtggatcagccgcgcaccttcccctcctccccgtcgcttcactttcgcttttccttcgctgtgccctctggcgatttcgctctgctttctcaacattctcttcaattgttctactatttcatcgtccctttcactttttatgccgcgcaaatggaacgaccgaccaattgaaaagggtggacgaagcgagggaggggcgggggagtgcttctttcgttcattctttttgctgctttttcatcgtcattgctgagtgagtggacaccctacggggaagagcgaaaggaaagcgaaaagcggggggagaggggtaaaagcggggggtgccccttcacttcgcacgcccccccccccccgcttgaagcgaccgaatgaacgaatcagtgaacgaaatgaaacgacgaaacaaacgagatccccttcttctgatcccctcccctgctgatcccactccttcccccgcctattgccgcccctcccgcgacactttcatcccagaaaagagctgctttcccttttgcgcgactatgatggcggcaccgcgcaaccgacggcggacaatgacgatagcaaaagcgaagggggggtgaagggttaacgaaggcgacggacgaacgaatggacgacggcggcggagggtcgaaagtgaaagtggggggggggggattggattaaatgggattgaaaaatgttggg

SEQ ID NO: 18519 - DNA, 2453 bp, Heterodera glycines
gtgtgttcacatatgacacaaatttgtaaaactattttatacaatataaaaagaatattgtaataatattatatttcattatatattgtgcaaaaatgaaaacaaattttaaatgcttaattctagtgaaagttcggcatcggcagtgcttttccatgttcgtcaaagctttaagccgcttccaaaaaatcggcgtcctgaacaggtgccaaaaagggcagcatttttaaaatgccattttactttcaattaagttgtacgctatgatgagcatagaggtaagtgcagaaattcagtggcattttgggctcggaatttggatattaaaatgaacaatttttttggtttaaatataatttaatttacccacgaaaaaagaaccaaaaaatgtctgattcaaaaattcaaattttagaacttttaggccactttcttttatgttgagcttttgttcaaaattttttctaattttatagatatttttcaccgggattagttgggatcgtgatttcatcggggatccaacgacaattcgccaattccgagggtcccgcgggattggagtcattaaatttttcgaatattttcaaattacttataaagaccctaatagataaaaaaaagttaaatttgtttgagcaaaaatttgttgaaatcccaagaacaaacaccatgtacaaatgatgaatatgttgtttcttttttattcagtctccctactggtgttacgaaaagatggaaaatgtgccggacgattattttaatgtgtccataacgtaccatagcgccagtaccattccagtaccgtatagccaattgaccccaattacggcactgacgtcaccggaagagatttggagcgctgcggaagtgagaaagggacaagaaaagcaaaagaaaaaattctcattcatattacttgcaatgatttgctaaaaaattgtaatttaaaatgttttaaggttaggaaaacactccccccgcccttaattggttttttaagttcgccacctttgatacatttcggatattcatttgtttttcacccctaatattcgggcctctattctccttcattttgtcagatcagtgagagaatgtcgcgcaaaaaacgatttgccctccaaattgtgtcccattgcggggctccctccggcagagacgtgctgacaaagcaattgcaggagctcatcgagttggacatggtcggcgagtgcagcggaaaagattgtgatcaaaagtgttatgagcagcaaatgggtgagtgaatgacaaccgaccgtttgattgggcggcacagttaatttgtgaaaaagttttttggatgcgcatcgaggatttggagataaaacattgatgggactgaaggaatcggagtcctgttaaaataggattttatctcctgatcatattcggatccgcttggaatacgagctctggtccgggtttgcgcaattacaaaattccgggccctattattaggcagcgctccgatcgctaaaacacacaaaaaatctgatcctatttacatatatatgaaaaaataaaatccaattttgtatttttggtttttatgagccatgtttataaattagtcgctttttactttaattgaaatatagtttgggcacacattttccctctttgacacatttttaccagccgcttaggaaacttctaaaaatattttctcctacagagtcccactttttctatttggccttcgaaaatacggtgtgctccgaatatgtaacggagaaattttggaacgctttgcgcagtttgacagtgccggttgtgctgtgcagggaagtggtgcgcgagtcgggcattccggacgatttgtacatcgcagcggacgattttgacaatgccacggcattggccgaccatctgaaggcattgcaaaaggacaaggaccgatatttggggtcagtatttaatgagcaaaagggtcaatgacacgtgcaaaattaattttaaatccaatagtatgactaatttaaaaattaaatataattttgcacgttttgagttttgccatggcaccgccgaccaaaaagcgttggattaagttttttatttaaacatacctaatgccattaatttccaacaaatcttttgccaaattaccttttaatttttaaggagggttgtacggaaccgggaaatttaaatttaaattttgttttttatttaataaaatccaaaagttaaagctgaattaaattaatgaaaattttcaaatcaaattttcttcagttatttcaaacaattaatcaatttttgactcaaatgatcgaatattaatagaaattcagatttgcttttcacatcaattttttggcgcgctttttccaaaaaacttttctggagaaaggggagaccggcggtgccgataagcgccgccgggggaaattttgaaaatttgaatgtaatttgttaacacattt

SEQ ID NO: 18520 - DNA, 2389 bp, Heterodera glycines
  misc_feature (2315)..(2315): n is a, c, g, or t
tcattaaacagcaagaaatatgtgtgagtttcattaaaatgttttcgcacattaattaaatccaaatttattagccactgaaaaaaaatggtaaagttttgtcgacagataattcgaatcagcaacacgaacgaacacgcgaaagcgaaaagagataaagagagagaggaaaaacaattttagtattgaagatttttcatgatgaaaaatacaaccgattgggggagagctaatggaatttattgaaagaaatcctctctatcccttaattcctagaaattacgaagaaaaaccaaaaaaaaagttcgatatgaattgagttgaacggaattgttataccatatttcatggacactaatgggaaattatgaacactaaatgatgtccaagacgaaattgaaatcagaaaaaaaagaatgaaatgggggggaaaatcgggagtttggcgaaaaatgccaatcccgggaaaactaagtttgaaaaaagacgccaatgcgaaactttgacgtggcacaaaaaaaaatccaaaatttttaaaattttcacaactccgttatgaaaaaacaacatcttcaacatgtgtaggtgtttgtcgatttaatgattttacagcacagaacataggtacataaatgcaaattgacaatgaaaatgcaaatcacagcaaattaatacctttttttctgtgtggcaatgccaaacaaattaaatgatttaataaatccaaaaaaacaaggccgtacatataccacacacaccaagaagaagaacatgggaaactgccatataaaacaaacagaatgtgatgctttggggggggggggagatgagaaatggacggcctcgtggtttacagtacgagtgaatgtgaagacaaacatttggggaaaacaaaaaccgtagacacaaaaacattaaattattactgtaaaacttggaaaaattacataatttgcaataacataatctccacttaaatacaatcaatcgtcatgatggtacatgtgcctaatgtatagtataataaatctttcatgaaaatttgtgtcaattggagaggaagaaaacaggggaaagccatttcattcatttcattttcaatgtgtcagtcgcgtgccggccgaatgggagcgcggcggtggcaccaccgaatgcgacgacaacgacagggacgatgccgcagaggttgacagcttgcgcaactcctgcaacaacaggcgcacgccgtgggcccaaccgccaatggcacagtcgctgtgaaaggtggccaccatttgctcaaagaattgccacgcctcgtcgtacacgtgccggtcaatggctgaaaatgtgggggaaaatgatgaaaaaaatgttttttttttgaatcggtgaaacggggaatggaaattgcaattttttggagattttttagtccccaattttgtgtcacacattaaattcacttaattttcttaccatcaaccacaaaatttagcttcttcaggcaggcctccgagatttggccggcttgaacatgttcaccgaactggttgaacctcagctgaatgccttccctcgtaggcccctaaattaaatttccgttaaaattttaattgtcctcaaatgtgccagcccaaccggttgtaaaagcagcgtcgccttggtgagaaaagccgcaagctgaagaccattgagcgacacgtcgccagccgctttcacaggaaccctaaaaaattgagattttttttttggaaaatcttggttagaatcccaagcaagccctgtgtacaaattgtgttgtacaatattgtgacaaactagcatttggattttctttgtttaatagagattgaaatttaggaaaatttggtaaccaaaattcgacatttaaaaaaaaatttggacaggcttttcgtcactgtcattgtctcacggaaaatgccgaacccgaccaaggatgcataccatataacagccaaattaggcaccccatttacaccactgacttgtagttgttcaagtcaaggctgccgccggcaccgtgcgttggcatcgccgccagcgacggattgtggtggccatggccaacaaagctattgttgccggcgatgaacagctgctgctgatcggccgcaattggcacaatgttcggcggcgagaaaagcatttgtgccaccgccgtcgcttggtgcccgttactgacgccgccgatgatggacgatgatgtaacggcggaaaagccgagtgccgcggtcggtggcggtgccatttgttggtggtgtgccatctcaacgggtgggtggaagtgccaaatttggaggcccaacaggtgnggcgacaagcgaatgtttgatgagcggtggacaacgaattgaaactcggacggtggaagaacctgcgatgaaaa

SEQ ID NO: 18521 - DNA, 1255 bp, Heterodera glycines
agaggaggggatggcagtttgcgcgaattgagggacgaataaagcgacgaccaatggaggagcgggcacgaaggggcggcgggaggatattgcggaagttaccccccccctccaccccttcctccttcacctcctctcccttccttaccccctccattgcccttgccctcctccctctccgccactctgtccattcgtttctttgaccccttttggcccggtcaaaagggagggggggggggggtaatgcttctcatattcacatttttcttactccgttcgggcaaaagctctttgtgatccctcgcattacttaatattttggcaccctccctcttttacatttcatcaaatggacaaacaaacaacaaattttctcaaaaactcatccattttttgttgagacaatcggatgaaaataatggaaaattttggaagttttttcgttttttgctcacttctttttttttatcaaattttctttctatttcttgtaattttgtgagcacaaccacaaattggttgtttgggagggatgggacagatgccctaaaaaacatttgtgcattggctgaattaatccccggggatttcccccccccccccgccgtccctttcattttctcataacaacactttcctctctctccttccattcttacatccatcccttcgtttcgtccacctcttcatcagcaaaactatctctatataagccttgtcaatcatccgttcttttatccaaccattcccttatccttactcttcctgctcattcatcccctctcccgcatcccttctcactcatctccttccttatcctcctctccctccctctgcctcatccctcctcactcatcttctctcttatcctttctcttcctcctctccctccctcacccccatccctcctcactcatctcctcccttatccttactcttcctcctctccctccctctcccccatccctcctcactcatctcctcccttatccttactcttcctgctcattcttcctcctctccctccctctccctcatccctcctcactcatcttctctcttatcctttctcttcctcctctccctccctctcccccatccctcctcactcatctcctcccctatccttactcttcctgctcattcatcccctctcccgcatcccttctcactcatctcctcccttatccttcctcttcttgtcctttcatctcccccattgtttctcccttcctcttcctgctcattcatc

SEQ ID NO: 18522 - DNA, 1053 bp, Heterodera glycines
  misc_feature (120)..(120): n is a, c, g, or t
tgaggggggggggagtggacggagaggggccaattcgaattgagagtggcataactaacgcggacgaggcgaacaggcaccatcagcagcagcagcacatgtcgcgcagtctgtcccgcnccgccagaagtgagaatgccaccccgggccacagttttcttttgactttgtgaggtgccatcactcggctgggtgagcggcgcggacgccgccagtcattgagtccggaggcaagtgaactgatcaaacgggtggagagtgactaccgatcggacagcgcgccgttcaaaaacccaaagagcatttacaaccgattggccgccagcgtgtacaaataccaatacttacacaaggcaatccttcgccgattccctcccctcttagcaattttaaactgttttcagcttgatgaccgcactcttcgcaaggtaaaaaatgcataaacaattgacataaaatggcaaaccaatgttaatgctggtcaattaatggtagcgatggtaattaaggacgataattatgctcattatgcgaaagctttttgatgaccgtttgtttgtttaagtatatgctgtcactgcgaaagcaactcgccaaattggaacggttccgcgaagtgtccttcgggccgcatacaatggccaaacatccgccgcaacagttgcagcagtcgtggttcttccggagaaggtccctgccctccctgaacagcgcaaacgctaaccaatcgcgaacgcacacccaacaaactaacgcgggagggcaaaggtgcgataggcagcgattggccaacgtcggcaagcgcccgacgcttcggcacgacgaatgaatgcctcggcacttcgccgaatgctttcgccgtccgattggctgtctcctgtcctgtccacccttctcactttgcttctcctttttgttgctcattagcaatgctttcccttctttttgcttcgtttgcacttttcctatccctccagcccatttcctttttcattttcgtttttcccccaccaaataggcattttcagaagtctcaaatcgggcctttcccac

SEQ ID NO: 18523 - DNA, 2055 bp, Heterodera glycines
ttcgtcttgcttctttatattcacagcaaaaaaacattcactgttcagctgcaacggacctctccacggcttttttctttcagccaatcacaatatgggctgattttagtgaacaaatctaaaatatttcagttatgatatgcgtccatatttgtgaatttatatgtgatttgaaggtaattaaaaatttgtcaaaaaattttcaatttaaagcaatttccgcgcttacttttctttgactcgtggccccgtacaattccaattgcataccatttgcccccactcttgcgcagcagtggtgaaccgctgtcgccctcaaacaaaaataaatttaattctacttttttggttataattaatattttgattttttttaatatgtattttagaatattttataaacacataaaaagcatacatgagacgtcttgtggatgccactcagctggcaaaaaaatccttgtggacacacagaagccaaatgcaccaaatcctgtcgtaacatcttcgggtcgatctgctccgcgtctgccgaaatattatctaagaaaataaaaattttagacaggaaaaactttttaaagcattctttttaaacaaaaattttgaaaaataatccaaatttacttaatttggtctttccccagccgattattgttgccgtcgtccctgtccgttgttccttctttggaagacaaattctgttgatctgtggaccaaactccaacaaattttttagctaaacaaataaaattcatttaaattcattaatgtttaaaatttaaaactgtacctctaataatgctatgtcatttgccgatgacgtcagcctgtaatgttcgtgccgtttgatgcgtgccacctcgtgcacagtcccaaatgttctgtctttgttccccacggtcacgcgcatctcggacgccttggctggcaaaacaaaattctgcatgacgtcatttctgaatgaaggaaaaggtgataattgggttataagttatatgcactaaaaaatgccaaatatgcgcataaaatataaaataaaacccctcaaaatgccataaaaacccgaaaaatacacaattacgcagtaaaatatgccttaaaactgctaaaaaaggctttaaccattaaaaatgccaaaaaagtttttttagagaatttcaaaatttgtatatttcgatttttaaaaaagtttacttttatgctaaacaaaattacattttttatatcaacaaatttcttacaaaaatcacaaattttcgatttttaagggtgtatttaattaatttccaaaaactcgatccttagggggtgtgtttttcgctttatcagaataatttaattcgttttaaattttagtgaaactgccatacctttcgtccggtttgtaacgcaaatgaaggtccataagaagttgtttcgtttcgtcgcatttgttctcgacaaacaatgtgacattgacgtcggcacgatgagctgctgtgacgacccatctcttttgtacgaccggtcctccacgagtactgtatcgtccgtttgtgtccgttgatggtacaggcgatcgtcacgtacgccataaagggccattggtgcacgcccatcaccgcgtgtccgatgttcaacctaaataaagccccagttggttaattaacaaggtaaatggttaattgcttaatcataaattactcgaaaggttgtgcgcaactctacgccgcatggttcgttgctaacggtgtacggtgcctttcttgtgtcggatgccgcatcgtcgcttctgtgcttcaccgtctcaaagtcgatcacgcccttttcttgtacaaatgccgacgccttgctgcttccatatgccgcaccctgttgatggcggattaattaatgttgaatgtattaattattatttacaatagacccacatttttcagtccgtgaagaaccagcaaaataagcaccggcgaaaagacatttttcgtgaacatcaatgagcaataatctataattataatttatataaattattttttttaaattcacatttagaaattattcaaaaaagaa

SEQ ID NO: 18524 - DNA, 2386 bp, Heterodera glycines
ttttcctttactgttctgcagttcgaaataaaaatcataaaacaaataattttttgcttgactttgactattttaagaatttaaccatcaattttcaaaaaccctcaaataagtgcaaaaatccgaataaaaggcaaaatcagcacaaaaaattggaaaaaagcataaaaattaagagagggatgtatttttctgaaatttttcggatcggttcttagggggtgtatttttcgtttttattgcatatttgttaataaattttttgaaaattgctgaaaatatttttaaaaatttctcaaaatgacgaaacagcacaaaaaaaagcaccaaaatgccaaatcagcacttagttaaaaaatttttcgtttcgtacgaaagcgtgtattttttcgttttcggattttaaaattttttcgttttcgtgattcgttttgttttttaatttttttttagtttttgcacacccctgtttcggatagtcgttttttgttttcgtttgctctacaattatttattttcaattttttcttcgtctaatttacatagaattttctttttctgcgctctttttgatgttttttattcctaaaaaatgatcttttttaatgagtaacgaacgtcttaacatcgctgctgataacttcttttattttctttttaaactgtctaccgtatatactctttttatatgccatggtatattatttttcaacctcctcagaagggggtagataattggagattggtagactaatggagactgggagattatttttcgatgatttatttagtggaaaatttttgaaatttattttgaacatgtcgccaaaaaatgtcatcgcgtaaaaaaaaaatcatttttattgcatttctgttaaacaacttctgaaaattgacccaaaaatgtgccattttcttgcttccgatatgcataaaaatttgaatttttaatggtcaaagatggacgaagaaacgatcacgaagaagccttttttaaatttttttatattaattttaatttaaaatttttaggtttttttggcttatctgatgattagggtcgctacatttagtgatttactaatttttttatcaattgttttgaagaaaggagctcaaaaaacgtatttctgcgttgacatttttcaattctgatgtcactatcggtcactagaaatcactattttaacgcttcgtcactaaaatagtgaaaattcattattttggcgttttgtcactattttttcactttttcgacattttttggaaaatccttaacaaaaatgcaataaaacaaaaaaatacacccctaagaaccgacctattttttttttaaatacacccctaagaataaacctaaaaatttttcaaaaaataccagttagaattggaaaattttcataaaaatttttcccccaaatttttttcttacaaaattttttgtttaaaaatttcaatatttgctaaaaaatgtaagaaaggaatgcacctcatttgtaactgcaatcagtgaataaatatatttttttgctcaatttttggctgaaaattatgtcactattcgtcactattttcgacttttttcactattttggcactttttcgtcactattttagttaactatttcgggatttttcgtcactaaaagtcggttccttatttattagcccctcttactgttgaattgagtttaatttttttggaaaatgtgccaaataaattattaaaaaattctattttcccctctgacacataaatggagactggtagattatttttcaaccttctcagaagggggtatataattggagaccggcagattaatggagactggcatataaaaagagtatatacggtatttctccaattgacagtccgtcgttcatcgcagttcgtcatttgtggatttttctttgccgtttctctctcactttttgccatttatttttattaattatttccgttttaaatttcaaaatgtaccacgtcacttgggaactgcaagcaaattgcaaaattccttgcgcttttccgaatcgctgctgggaaccattgcatttcgacaaccctaacatctgcttgggggcttccgtggaccctaacaatttcaccaattatttttcgcttccggcctttcaatttgtgctgattttgattgcccaattggtttttggcctgttactcggctttttcctcgccttctttgtttgttttttgtgttctggcagattttctcgtcgttcttcaaaaaatgtaattattggggaggctttctcttatttttaaattttccatatctttctttcactcagcgtgccttcggcgatcattcgttgcccaacaaaaacattttgcgccactctttgcgctctggggctcgtaaga

SEQ ID NO: 18525 - DNA, 2114 bp, Heterodera glycines
gggaatgaatgatcatcatactgatcagactaattgaataaattgttattaattaatggttaatataagttggctaatttgtgcttctgaacatcacctcaaaattagcacagcaaaaatatttaggagccgaaaagcaattggaaaaaaaattgaaatttaatcgctcataaataaatttttaaattatcaaagcatagccttttgtatatacaaaataatatgtcatttttgttgggatgatatgtcctttctgctgttttgccgttgctttttaattcgacaattttcggcttccgttcgttggcacaattcgaatgtgatttcggttgttcgatgaactgttcgtccgattgccaattgttcgtaagccgtgttcgtggcttttgaacggtctgctacttatgttgtgggttttcgtccggaaagtcgtcttttgttcgaggcgaaatgttttgttggcgggcactgagacattgtcttaaaatggcgggtaattagttaatttaaaggcatgataattaaaaatttggtaattactcgatttaaaaatgtcccataaaattgaagtatgagccatcactgaacagaacgcacaggacgcataagtcattgaacgaaacgcgcccacatagacggaaatgttgaggtcaaactgaatttgcaagattatgcatttaattgcctaattaattaattagccaattattaaattgatgaataatttacagcggtcaaaataaggttgatgaaatttggcaacaaatcaagcagcaattcaaacagaacgcaatagaaaatgaggcggtcactctgaacattgcgattttttcaaaaaaaaatgagaaaattaaaaaatattttttcaattaaaatttccttccgtttaccatttttcgtgagtcggtgttaaccgttgccattttcgtgttcaaatttgtcaccgttccattctgctgagtgctgtttctcgtgttgttggtgttttgaacaattgtgattggcccattaattccatttaatcggcgccgaaatgcgaaaagcgcagccaaaaaggaaatgccggccaaaaagttgggcagcgcaaccgcaaaacgattgacggcgtaaatgaggcgagaagcatcggaagtgaggcagccgaaggaaatgcattctgacaaaagtgcaaattgagggaaaggatcagaaaaagagacaattaattaattaacgcacgaaaaattattttaaaaaaagacaattaattaaataattaattaacgcacaaaaaactattttaaaaagaggcaattaattaaataattaacgtgaaatattatttttagatggtttgaataattttaggatgtatttttattttgcatatttaatttttcgaaaaacattatttgaacactctcatcagctaagttggttttttgacattgaaaatttaaaaaaaacattttagggttttctcgagaatctgttttaattttaaaattcctcaatgataaattatgtcaaaaataaacaaaaaatgaattttcgatttttggtcgtttttcggaaattttcataatttagaaaaatttatgtccatattttacattttttctatagtttatctttccttggaaatggtccctagcaattattggacaatggtttaacaaattcctcacatttggtcattacttaattaaaatttaattaatttatggcccttgctcttacccgggtgttccgttgccggacgttctgccaaattgacgcccaaatttgtgccaaacaatgccaccacactgagcacactgaacctggcgagtgaacgtttgatccatcttttcatgttgtaaattgacggcagcagaatgatcagcagccgatcggcggacagaaagaaaacgcaaatgggcgtggcggggatcagcgagccggggacgaggccggtccagaagatgaactgagtgggggaccaggcggagctgaacacgtctaacagggacaaggtgagcagagcgtactgaacagtcaacgcggcacagcaaacgccgagggaggacaaatacactgaaaaggaggggaattttgaaattgatgagacaaaggcaaaatgaccacttatggaa

SEQ ID NO: 18526 - DNA, 3665 bp, Heterodera glycines
cttttctcactgtttcggcaaaagagtgctcagcgattcgttaatgggtaagtcgagacaattaattaaaaattataataaaatcatttgggtttttcagaaactatggaacgaagggagtcattgccgggtcattctccgctctgattgatcagattttgtctggcaatttcaatgcaattcgaccccaagttttcatggtgctttctctgttttgctattttattgtattaccaattttcttgaaggaattctttgctcatgtgaatgccgaattggccaacggacagcagcacgacgcccatgaattcctaatttatttgctgaacgcgcttcatgaagacacaaacagagtggggctgttttaaaataaaaacgattttatgctatttttaccccaattttcaggttgaaaatcgactgccgtttgatcaaaattacgataacaccgatttgagggccaacgctttcgatttctttgagaagtcaaaactgctatcttcctcgccggtcaacgatctgttcaatgtgaaccgatcactcactgatcactccgtcattttcacctctttcagctcactaccatttctgtgatcaaatgcatcacttgcaatgcgtcgagtgttcgttttgagtccgttaatcaattaaggtgggttttattcgcaaaaatagcgatcaatccttttgtgaatttgaatttagcattgagttgtctaccaattttgactgtctgaggctcaaagactgtctcgaggcacatttctcatcaacagtatgcagcttacttttagagtgattcccgattttggtaatttattttcctttttagaatctcaatgatccatgggattgtccaaaatgcaaaagcaaacagccggcgactcggagcacaaaaatttggaagatccccgaaattttgatcgtccatttgaagagattttcgcataatgatggcaactttgtcaaaaatgaggtcactttccgtcgggcgtcgcattttgcgatttaaattttattgtaaaataggctcaagtgactttcgatatgaatgagttggatttgtcgccctatattcacgaaaagtctctgcttcccaacacggcatttactctttatgccatgacggtgaccaaatggctaaaactgtcctaattacgctaattgctttaatgcctttaagaagcatatcggcagtttgcaccttggtcattacacatcgactgtggttaatctgacaagcactgatcagcaatggctaagctttaacgatgagtcatgcattccgtgtgccaccgccccatcgcccacagtgagaatttctccccattcattagggaatcattttgaagattttgtttatctttttcagagcaaagaggcatatcttctgtactacaaactgaccaacaactcacaggccaagtgatataatattatcattattatttatacctgtgtactgttaccaaacattttcaaataaatattttttattattttaaaattaaaaagataaaatatcggactaaattggaaatactgactgtaaaattgcagtaacaaaagcgagggcgaaagaaacgacgctgacgacgacgacgacgatcaaactgagatagaacagtttaacagagaactcaatgaaatttgtcaaatgttgcgtgaacattaccgtaatgaagttccgaaaattggccgactttgcgcccaaatgagcgaaggaactcgccaagcgttggccatccaacaacaaatcccaaatcccgacgaagtgcaacaacaacacggggagaacaatgccagggacaacagaagcaatcgttcttccgacgaaaccatttcttcgaacaacagcagcaactgtgacaatgccaatgtcaagtgtgaatcggtgagcaacaccaaagcattgtgatcactaatttttcttagctcggattatcaatgccataagttaaaaagctcaaaacaaaatactgggcatgaaaaattaaaaattggagaattgccccattttttagggtttgcatcagaacgcgtggtggcaacaacaatttcatgaaattgagcaagcacttgataatgatgctgatgatgaaggcatttcgtctgtcgagtgcagcgaaaacggaaccaatgaaaatgataacaaaagtgacgacgatatcgaaagtgatgccgaaagtgacgacaaaccctatgaatgtgattgcgaaagtgctgaccacccaatggagtgtccgttgctggccgctcgtcgtgcgcttcgtcgtctcaaattgccgaccattcttgacatttgtgccgcaaccgaagcagaagtgcgacaatacggcacaaaattaagtgacaccattaaacaaatcgccaaattacgcgttcaaaacggcggagcactgacaagcgaatgggaactgcggagcagacagaaacaagcacaaaatctgctgcaacaaattggtaatttaatgccacaattggtcgttgaagagatcgaagtggcgaaaattctcaaattcgtcgaacaaagcgccgatcgcttttccattggatttcgggacagaaagcagcaaaagcaattcaaaaaagcaattcgacagccaaaaaaggtgtgcagcaatttgaaattagcgagaagtttcttccttttatctctagtcgaatatttttggtattttgttatttaaaaagttacaaaaaaaaaattgctgagaaatttccaatgagtgaatggttggtttgcttaagctgcaaatttatatcccttcgttcaaacaaataattattcggctaccaccaccaacaggctttcgaggttctgttaaagcacaatttggacagtttggtggagccattttatgaggagtgttacgaaaaactgtttcgtattagcgatgaaacacgggaacaatcagaattgttcgtgaagcttttggccaaaattgcttttgtgcacgtcgtgggattaaggatacaactggaaatggtcagtagagaaggcatggtttaacaaaataataataataatgcattttggcagtgattttcggatattttttatgggatgttagactagatcagttgacagaaattatacattacatcatagaaactaaaaatatttgaaaactcattaaacaactttcttattacttataatttgtgcacttttcaattatttataaaatttaaagatatatttaatgaatttaagtcataaaaatttgacaaaacatgctttcgtaggttttctggtccctttttcaacttgggtccgttaattattcttttatgccaaaatccaacagataattaattcctcctgtattgttcaggtggaaactgaatggacgcatattgtgcacgcgatgttgcagatgcgtaaattaataaatgcagctcagtatttggtgaaagaggcacaaccgaaacccttggcgtgcgaccgaaaattttcggatgtaataaaaagattgcaatatttataaatattattatttatttatttttacttcaatttattcaaaatttagcaaaagcaaccgagcttgtgttcattggacagattgtatgcgaaactctatggaaaaccgtctcaaataaaacgtgtaagagattttagggatttggtcatttcgctttaattaataaaaatgtacaaa

SEQ ID NO: 18527 - DNA, 2568 bp, Heterodera glycines
  misc_feature (23)..(23): n is a, c, g, or t
  misc_feature (2556)..(2556): n is a, c, g, or t
tggtgattttccggaagcctatncgcaccactttcggggcactcaaaagtgcctgatccggagcccggaccggcccggttaagaacaattttctagcaccctatttatgtattgtattatttatcatttaattaatgtacttttatttgcagttatcatagaaattttatctttttttgttacatttttatattgtaagtatttttaaaatgttttatgtattttaaattagtattaagtctctattataattttgttttgcgataacaaatttattatagaaaaatgacaataatttttttattttatagaactatatatctaggtttttatttgtacgaacttgatatgctaatttattctgcattaaacgatagcaatttattctattacttaacacgaagtgttaaattacttttaaattaaatttacatccattcttttatgttaaatgtttgctttaatttttaactttggatatttattatctaaatttggattttattttttaataggattgttcagtttgtgtattaaaaatcaaaattataataaaaatgaaaatgaaagtttattaattttaatatttcttttctcattctcgttgacgtcacatggtccctactgtaaaattggaatattccaactcttaattagcaaatataaaaaaatttcatcattattttttataaaatttaactctgaaatatatttgattgtgtttatggtaattttttgtttttaatgtagtcactcttgttgcccccatgccccaatttttatttcgtataaaatcattttaattcagttgacaggtttattgatttatatttatattttgaaaatataagtgtaccagaatttttaaagtattttagagtcatatatttttatttttcttaaatcattattttaacttattttgtttaaaataatatgactctatataggataaaatataaatacatttcagttccttcttgaataagttaaactagtgaaacttcttgaaatatgttgatgaataaacaatgagtttaaatctcaattttataagatccaagtaatttgtgaaatcgatttaacaagaacgattttttaaatataatatataaattagcatttttaatgattttttagaaaagataaatattttttaagttagtttttaattttttctcatgaagttgtagcgaataattttatactttcacgatatttgttaagaatatcaaattgaaaagtttctatttttccattaaaaaatataattaataaagtttataaaaatcatgatcctgattctccttccaaatgatttacgtaattctgccaaaaagcaccacacatatataaataaatagaagctaattacttaatttattattaaataaagtgcattgaagcaattttttgattagtaaaagcaaagtaaattaaagaaataataagttttcattatttttgccaataaaattgttgtcgttagattatttaattatgacatttaataaataatttttttataaatattaattttatttcctatttaatattcaaaagttaaaaattgaattcgttgtaaattcattcattaaattaaaattgtcataaaattaattgttaaactcgtcattggattcgttttaattttatagtttttagttagatttggtccgccaatttgcaggtttatatggttagccgacttttgcgccgcgacacttgcgccgctcagcaaaaaagactcttgcgccgcggacatttgcgcagtgccatttgcgccgcgacacttgcgccgcctaacaaaaacgacatttgcgccgcgacatttgcgccgtacagcgaaaaaagacatttgcgctctgattaaaataaatttatgtgctttatagaataagaattgatagatattcattattaattcctttttcgaagcctttcatgtcaattccatattgaagtgcacgtaatgatttatcaaatcttgatcattttggttttcattgggaccatatgcgagataacaagccttcgtattgcctgatcattaagcggctgattttaagcgaaaaaaataggtaaataaataagggcataaaaattgcgaaataatgcgaaaaatggtaaaataggagcgaaaattgaaaatcagtgcgttttttcaatgaaattaaattaaaatcgatgaaaataacttattgagaaaattaattacaaaggaattgaatttcattcttttttcgaagcaaaaaaataattggggtttctacagaaaattcttttttttcacttttttgttagtttgtattcttaatcattttttcatatctttgatgaacctattcaatgttaagattttaatggttaaaaaattgaatgtcaatctttgtgactagtaattttttcgaattttcaattagttatttttgtctatggcttatagttttagtaaaacttattgataatagtggaatttttatgaatataatattttgacagcgcggcgcaaagtccatttttgctgggcggagcaattttcgcggcgcaaatggnagcgcgcaaata

SEQ ID NO: 18528 - DNA, 2012 bp, Heterodera glycines
  misc_feature (1855)..(1855): n is a, c, g, or t
  misc_feature (1994)..(1994): n is a, c, g, or t
cctcttcaattgtggcacttgtcgcgcaattccgccctcttttgcccgcagtgccgctacattctgaagccgtgttcttgacggcaattggtcagagggagtgccagcggtaggatggcgacgcggaagagcgactgttctgcagtgtttgaaacttctccaggtcaatgtcgagcagttcaaattttgcactcggtttcagtcggacatgagaaagagtcgaatgaattgttgaggagtggtgacgagtggcggacagttcgaaagccaaccgggacagctaaagcattacaactaatgaaggcaacaatggcatggcacttgccttttccacaactgccttaatgtcattcaattggtgtgcttttttgccaccaccgcacgacaaagcaacgccagcgaaagatttgtcgaattctttttcagcattgggaagcagagaagtgacggaacaatttgagtcttttctggttgaagttgtctgcagtttgtgaggcattgtcgtgttcgacaaaaaattggacggaacatttgccgtcggcactttcccagacgaattcggcctaatcaatggacactcctcgccggaaataatgtcgtcatcgataaacttaacatgactgttttttatttcggttttttttgacggaacctcaaggttctccagcctgttctgccacccctcggccattgtgccggcaggcgaactttgtggtctttgagtcttcgggtcagaaatagttgaacaatttgttggagttttcgagttggcagaagaagcagcagtgactgaagtggaatagctgaaatgtgaggcggagaaagcgccagtcgttgtggcgggacgttgcgcaatttgcttttgtttgccgtaaaagaaattgcgcctcttttctttggtgctttcgggtgccaccaccggcggggactgttgttggctcgagtgagggagcaaagggacagcggaagacgaagaagacgacggggccgactgctgctccaactcggaggcgaactgcttcatcttctgaaataacaaaaaataacttcatttgacctccaccaaaccgtaatgtaattgttgacagtctgccgaagtccgtcaaactccgagatgacattctcgtacagttccctctccccactcatcaatccgtcggtgccttcctcctcctcttcttcttcctccccattttctgcttcttcaaacaattgttttgcgctgtctccgcctgttaatccctccgttcccttcccatttctgtccatttgctcctttctttgtcccctcctatttctgtcctccgttccttcttcgttgttgttcatttcttccaaaaggaatgatgccgtcgatgtcgcggcacccttttgctggtgatgatcggtccgattttcagtcgaatgccttcgctttgtcaataacatttctcggatgtcctcttcattcccgggcgatgctcttgtcctccatctgctttcaggccgtttttcgagaaaagcggctaaaggaacaaatgatgcaattatgcattaaatccttgaaactttcttaatattcttatttgcactttacctttaagtgccgcggattgtccgctgagttcgcgccgtcgcattgtcgccgttgcgattcgtccctcattttccatttccctcggcgtttctctcttcgcctcttccgtcaaactgtgtaaatcgctcaaccgtatggtcatttgccgaggttggaggtgcaaaacggaagttttgtagaacacttgggcgagtgtagccggcaattggccattgccttcggccgcggtgattttgaatttggtgcaccaaacgttggagctgacatggacgagagtgngaggcggcgcgcggctggcgacagcgccgacggacaatcgatgcggcattatgcgacgactgacgaaacggcggatttgacgcttactgcgccgccacatcgaattgcgttggttactctcacgacggaacccattctngtgggcaacatcctctga

SEQ ID NO: 18529 - DNA, 2116 bp, Heterodera glycines
tgtttaaaaaaagaaaaaataataattttcaagttgaaatattttttattaattaaatttcaattgaaataatgtaaagaaaatattaaaaattttctgttctgttggggggattgaacccattcagaaggtttagtcactacaccacataagtatttaaacacatgctttaaatggaataaataatttactttttttctcaaaaatttctccatctccactaattcccttctcttttctcacccagacccccattcttaccagtgcttattagtcccgccgggaccgggactggtaaaccgggaccgggatttctgtttttccaaaaatcgggaccgggacctgaaaaaaccgggatttcccgacccggtcccgtgcaactctaatttaaagcaatcatataaatttaaaaaggcattttaattgtaatatttcaaaatttgtctttatttttttatcgcttaccaaagaggtgatgaagcaacaatttgggttgttttcctagaaaaaaaaacgaaattttttcaccaaaaactatcttctatcatgccatgggaacatcgcaaagagaaatcgcattttttctttgatatccaaaaatccgtccatttcctcctaaaaaattaattaatattaattgattaatcaattaattaatagtcttggagcaacaagttctaaaaaccacatcttccagcgcatgtccgtacaacaaaatgctgatggatgaggccacaagcacattgatctgcttgatcaggtcaatacgagatggtccattcatttgaatgtcgcaacgaattttggcagacatttttcgaagaccaaagatcatcttaattgaaaatttttttatttaaaactgtttttatttaaatttttacttcttggctcattcggcttctgcccatgcccaggtctcgcaatgtttcgagcgtaaaccttctcaaaaacagccaaccctcaccatgagttctcgaaacaccatgaagtccatgagttcctaaaaaaacaattaaattcattaattaattaattatcggcataaacccgaaacaatttcggagatgccaaaaaagtgtcggcccgacgtttgttcattgtaattgagtagaaatgttgaacgaatcagctcatagtcggtcacgatcacataaggatcctaacaaaaattagtttacaattatttaaagggttaatttgagattaactaatcaattactctaataacccttttaattactttatcgaaagatttaaattggaaattatagattaaaggggttaattagagaataatttaagaaaagacaccctaattaaggatttaagatggttacttcgcccatccacaacgtgtatactgggccatactccttggcaaaatgggtgtacgcaccggcaccgccatggtccgggaaattggctaattggtgtaagttgcccattaatgggagtgggcttggcccgggcggcaattttcggcgtttccacacaaaattccagaacagaatggcgaacacattgagcagaagtaagccaatgaacatttttaagtttatttgaaacccaattattaaaaaaaatacgaatttaaatatttaaaaataatttataaattgaaaaatttaaattacattttccttttaacagtctttcccatcatttttatacaaaaatttattttgtaaattgttaatgatcaaaagcaaaagtcattttttacaaatttgtacttgccttcgctttttttcataattttattaattgcacttaatgggaagatggaagttaaaaaaaaacggaatttttatttacaaattaaaagaatcgaaatttgagataagtttttgccaaataattcccttaaaaaaattaaaatttattttaaaaacaaacacaagtctgccaaaaataccgtatatgctctaattatagcccagtctctattaatcccgcagtctccaattatcccccagtctacgaggtgttttgaaaaataatccctctatcataatcccccagtctctaattatccccccttttctgaggaggttgaaaaataatcccccatgggctataattagagcatatacggtaatgcaatttcgttact

SEQ ID NO: 18530 - DNA, 974 bp, Heterodera glycines
aaatttggccacaagggaaagaaaaaatagcagaaaacttttgaataaacatggaattttaataaaatttaattctaaacaaaaaaagcaaataaataaatgtaattttcatgaattacttattttttttaatttaaaaattaattatatgacataaaatagtaaaaattcttttaaaatggcgcatatttttattatttttcgtaaaaagaatatacattggaaataatgtaaaaaattgataatcaatattgtgacaacgtaaaatttgacaattgaatgaatttatttataaaaaaaatattttacagataaaataataaaatctataagcgaatgggtgcattagtgatgttcgagaccgaaaatttcccgagactcgagaccgagacttgaccccgagactcgtgaccgagacccaaaaacccgagactcgagacttttcaaaaaattttcctattctcttagaaatcgtttaaaaaatttttgagtcctttcttagctaatttttagtttttttttttaattttgattcaattaggtaccatatttatcaatccaaaacgcacaaaacaaaaaattcgttagtttttacgcggtttttgagtcaacttaaagaaataaagggaattttgcggcagtgcagataggcgccgccagggaaatttttgaaatttttagcgcgctttgttaatagatttagtccaaaaatgacaatatttcacgattttaattgttaaaattgggattgaattcttttagaaaaaaaaaaattaattttgaaaaatgagaagaaaatataaatacttggaggggaactgatcctgcgcaaaaataaggaacagaaacaagaacacaacccattggagactactttatgtttacaaaactgaacaaaaaaggacctaaaatttataaaaatagaagtttaacaaaagccaatcattaggggtgtaaaaagtctcggtcgcgag

SEQ ID NO: 18531 - DNA, 1500 bp, Heterodera glycines
  misc_feature (1480)..(1480): n is a, c, g, or t
aaaaaggacctaaaattataaaaatagaagtttacaaaagccaatcattaggggtgtaaaagtctcggtctcgagtctcgaaaatcgagaccgagacccaaaaaaacccaaaacccgagaccgagactcgagaccaaaaaaacccgagacttttctcgagtcgagagtcgagaccgagactctcgaacatcactagtgtacattgtggtaatatttttaatttgtattaaaattactttcgaaaaatataaacgaaaatatttattcataagtaaacagctaaaatttctacgtaaaaaatcgcaaatatgaagaaaaaaaatgggaaaatgtgtaaaaaagatttgtacaaaaatatgcaaataaattttttttttaataatgtctaggtatttaactaattaagcatttaataagggaaataggcttagaactatttttttttggatttttaagaatagttttttacacttttcatgaaaacatcagttattatagggcttatatttttaagctaaaaatttccaaaataggtaggctttaggctctaaaaaatccataaaacaggtacaaaaaaatggaaaataggctctaaaaaatcctcaaatttaggggtaaatgacaaaatcttagtcaaatcaatttcgtccctaacttttttgaaaatcagtaaaaatttttgaactttgactgaataatagagaaatccttgggctattaattatatataaaaaaaaaagttaaaattggttatttctgaaaaaaagttattagcgaattaattttctcatatttttagagtcatacaaaaatttaaggttgtttaaatgcatgataatttactcaaacttcaattaattcatacacccatgaaatgattatgtagcctaaggatttctctattagtcagtcaaattataaaaaatttattgagtttcaaaaaagtagggacaaatttagccactctaaaattttcgaacttttttggttacaactttttgtaaatttttgccagattttttaacaattattaaactccattccaataacaacattagagcctaagttatgcttttattatttagcaaaatgaagatacaatcgcgcatgtccctttgaatttgtttatttaataatgttttatttttattgttatttaacacagttaagaaaagcataaaacttcattaaattttttgttttaaatttcatttccctgggggtttaagtttcaatttttgctatttttttttatcttagtcgggcttatgattcggtttagttctatagaatgttgttgtattgcaatttcgatttgtttcgacaaatgaatataaaaaatgatttttgggatataaattaactaatttttggaaaaaattattttaatatttataaataaatttggtaaattgatttctgcctaaatagagtcagcttcaactgagaaaagtcttaaagacgaatttgtccaaaatgnaattattgaaataattttga

SEQ ID NO: 18532 - DNA, 1647 bp, Heterodera glycines
gtcatccctccccctccctttcttccctttgcctgttctgtcgtgccattcgctgtcgtttcgcgcccattcggcgtcccctgcccgtgccgaagttgtgctcctcctcgtcctcctccgtctcctcttcctcctcttcccggtgctttatcttccgcttttgccctccccttcctcctcttcctcctcctctttcctcctcttcttcctcctcctcttctccctcactttcattttgttgctgttctctttgactcaacggaatgtttcgcttcattcttcgctgttcgctgatcattttgccacccgttttttgatcggaagtgatcgcttaattgagggagggggatagagagggtttctttgtgtcttttttcctgtatattcaaatttggcttctcactcttttcagtttcgtcgatggcaccgattttggtaaaagtgaacagaaagaagagaggaatggagcacatcagaaacaaattcattgttagaagcaattttttggaaactgagaaaagcaaaaaaaaagagagaaaataaaaaaataataaaatgaaaattgatttatatcgatttaaatggcacgaggtaaagcgaaagagagaaaatccaatgattgacgagatgatatagattatgtcatgattgcaccatctcattagcgtcttaacaagttaattagtgttttcaaagcattccccttcgtgtcccttccattccctcccccctccctctcgttctcaattcttcccatttccccaattcccccggtcctcctcccctgcccaatcatccttcattagtcttcccttctccctccttcttctgtcatgaccaattttcccattccgttcatcccctgcggggagatcgcataaattggtctttgcagcgggaaatgagggagaagagctaaagacgaagacccaatttcttccggcacttctggggcaaggttaataacaccgcgtcccttcgctgatcttccggaagactgtgaagggattaacctcacagtcgacagcgggcagaaagaaattgacgctccccaaatgggaaaagcgagagaaacagcggaaggggggggggaagggggaaagggagggaatcagccccggggggagggagggagagtcatccccccgggggcaatgatcgttattctcatggaaaggaggtagcgtgatcagtgcccacttcggttattctccaatccccaattttccctctttcgtcggtcatttgtccagctgccgactcataagcgccttccggcgcttggaacggaagaaatacgcgggaaagaaagccttagggggggggggggagtcgtaaagggcgaaatgccaaatgtaaaagaatttcagaattaaccgccaaatttattccaaaaaatgaattcgggttccgattttgttcacttctttttgcacttctttcacctttttgtcgccattctttcttatgacatttcggcagttttggacaattttattattggtaagattaaaacaaataattatttgtattaattttcgggattgaccatttaaggcactccaaaagtcatttgcggggagtccgaagtggcattggacattatcacggcgaaaccattcattggtaatttgaatggcacttttt

SEQ ID NO: 18533 - DNA, 2201 bp, Heterodera glycines
  misc_feature (10)..(10): n is a, c, g, or t
  misc_feature (21)..(21): n is a, c, g, or t
atcgtttatntaattaacttntagccaattgccaacgcaagaattgagtgatcaaatgcaaatgccgacgtgccattactccgtgcacagcgaaagcattgacggagcgcaactgacgtcacaaacgcaaaatgttgcaaaagccatggccaatttccgctgtttttaggtgggccaatgtcggtgatgttgtgttccatgtatgggaatgccgaggcccggaaatgggcattctgatcaaaaaagtaacagctcaccaggaggggatgaattgtggaagcatttgtattcagtgctttgtcacggacggcgacggggaggaccacgcggtggtggacgaagacgggtaaaacaaaggggagggggctaattaattaattagggggataaaaattaaatgaatcatttatttaattaattagggatgcattgggagaagggatttttcaaaagcaacaataaaattgcattgattggctaatcagttgttcactggaccattctctgatcagtgaggtgacctacgagaaggagggaataatgcgagctcatgccaaaagtcaggtgggtcaaaaagacacttttccattggatttttcggaatttgtccttccctccctttgaaggtgttcaaatatgccgactccaaccagctgttcttcacctgtcagatcagaatgtgccaaagacagatggacatgtgccgcggagtgacggtgaatttgcgggcggacgaaccaatcgaaattcattttccgcaaacattcagccgccaaaatgcgaaggaggggaaaagcgaaagggcgccaatgagaagaaaatggcacacagtgaggacgaaaagcgggcgcaagagatcacgggggaggagagagtggcggcgaatggcacaaaagcgacgagggaaacggcggcggtaaaagtgggggaggaggggagagaatctcgggatttgagggcgagttaattggccgaacttcgagaatcatttgcacaatttattaaatcggatgaccaacatttttcattttaaagtccaatggaacgacgacggcactttcaaccgaagcacagcgtaagaaaaagcagcagagaccggccgaagtggcggaggaggaggacggagaagaggagggacaatgggtgctgaagagaatgccgttggcggaggggcgacacggaaggaaaagccgcgcattggtggagggtgattagtcactgattgaccatcactaattactgcaaatgccaatttagccgaaatgccattggagagaggggacaagcgaccgttggaagtggacgtggcatccccgcagatgttggtgctggaccaggaggaccgtgcccggatgactaccgcgcggtggcattcctcgtcgacaacagccgcgccttcgccgccacattctgagggacaaaatgccggaggggttatttccgcattggatgcctttcggggagtgccatcgcttcatccgccgctttgtctctcccgcgacattttcgtctttttcgtccccttcgccgttgcactgctcgtcggcctcggctctgtgctgactttatgcattttgcacgctttttcacgagttgcgcggccaaaagtgccaatgcgttggacaccgatgcttttttaagcattttggaaaataaaatggcattttgttttttcaaataaaaaaacagaaataaaacataaagaaatgaaaacatatggacaataaaatgaaaagaaaatacgaaagatgaactattttttgaaaattgaggtatgtataaaatttgaaattctaaaataatttaaaatttgcaattagtccacgtgaagaagtcctccatcggttttgacagttggcaatggcccacatttggtcgttttgattggcaatttgccaaaagattccgaatttggcatcaaacgatggtagcacagcagccaaagaacaatgccgaagaagaacagaacgatttcaaaaatccaaatgggctgagggccgaacattttataagcgacgctgtggggggaaaatttaaacggaaaatggacaaaacaaaacgccaaactgttgatgccactcacttcatcagcggtggaccgaaaaacatcattgactcgcctgtggcgaaaaacattccctgcatggtgccctgtttgatgggcccgagctaaacggacaatgacagtccatcagccgaca

SEQ ID NO: 18534 - DNA, 2707 bp, Heterodera glycines
  misc_feature (119)..(119): n is a, c, g, or t
gatgatggccaaatgcaacttctgctggccaagcgttgtccaaatgggtgcacacgccgacacccaaatggccaccgaaagcgattgttttgcgaaaatagcataagaacaaacttccnaatggatcaccagtttcaaagaggtgttgttgttgttgttgtgctcagattctcatcatatttgggtgtctcgggaccgatttttcatacaaaggtttttctccggcggcaactaactttttttgcggcgctttttccaacaaaaaaaacggtacttgtaggttttgtcacccccttgaaatttttctaggctgaattaatgtgctgatcacgaaaatggttttcgggttctgctcaataatatgccaagaaattattttaaaaaaaacaaattttgatcaaaaaaggcagatttttggcattttgaacccattgacgaccaccatttttacgttttcacatcccttttttgtggcacgcttttttctaaaaaaaaatttaaaaaaaatcggtatactaatgggaccggcggtgccgttaggcgccgtcgggaaattttttaaaaatagtttttaatgcgatttgtcaaccgatttcgtctaaaaatggctaaatttccgattttgagctatttttaaagggagtagatcgttcccccccccccccccccgaaaaattttgacgtgggggggaggggaaatgaagtgcacccattttaaaataaatacctacatatttagtttgcttttcaattttttttattttcatttgtttagaaatttatttgtgcccgcacttcttctgtcagttacaaaattcgttttggagttttctcgcctccatcatcaattgaggagccatttgaattggtgaacgaatggaccaaagaaaagttgacactaataaaggagaacgcttattattggctgttgaaacggtgcccaattagtgaaaaggcggcgattaaatggggaaacgacggaaattcggacaacaacaacaccaaatggaactttatccattttaatttagtttgctgcaaaaatagcattgggtgagcaaatccgtcctaaattgtgtataaaatttaaaaactgcgcatttaaaattattaccaaataggattttagttttcatttttactaaacatacgattttgtttttcgtacttctcttttttttcaccccccccccccctccccctgaaattctttttaaaataatttttagaattttttatgcgcggaacacgaatctaatcattttttgatgtttcaaaaaattgtgactaatttttgtttttagtcaattttagggcaatagtgaaaattttaaaaatttgaattttcaactttttattctaattcgggttctgaattaatataaatggatgtcagattcgtggtcagcgacctcgaaaaacccccaaggaaggcttttttcgggatcagcgcataaaatttccatagaaaaattattttttttaaaatttcaggggggtgacaaaaggataagtacctattttccaattccataaaatttttttacgaagagggacttgttcgtacttggatatgttttcgcgaaaataattcaattgttttgaattttttaggcctttgtctccaccataatcaccaacaaaaacgggtcaaagcagtgaaaagggcgtctgattatgtgggaatgactttttggaacttgacaaatggtcgatcatttcgaattattgcatgaaaattgttgctttgatatatatattttttgtctttggatgttcatttttaatgagataaaagtttatttccgagtttgggttagggattggtcaaaatttgtcagattcgtaatcaatcactaatcagagcgactcgaaatctctatgaactttttaccgttttgtaaataggtacctaaaatggataacaaaaaataataaatagaatttgtattcaaataattatttaattttaattaggtccctaatttagaaaaaaaattttaagttcaaaacattcgttaattacctacctaatttaaacaaaaaaaggaggcaacaataaactttttttccctttttttgggttggtccctctttcgttctttgcattttacgtcgtcgaaagggcgaaaaatcaccccatccatttctcccccattttccattttcttcctattgagtggtgggaacacccaaacacacattcctcaccttttcttcatcatttgctcgtcgtttttgcattcacttttcacaaaaccttattcgcccaattcattatatgaatgtacgttgccttgatttttgcaattttttgctcaaaaatctgttacaattacaacaaaatcagcgcaaaaagcattccagcgttatttttcaaccaaatttttctaaaatttctgcataaactcagaaaggacatacctattagctattagccaatgataagcctagggctaaattaaatccgaaaaattcgcattttttaacaaaaatcttaaaaattcaattataaccttgacagattggaaaatgacaatttctgtcgagatttttgacgccaagtcgccctcacgaccgggtttcaccatcgctgaggtgctttttggctattaaaatttcctatttttttttgtaaaaaattttaaaggttgagcctgattataagaagtgcgtcaattaaaacgcaaaattcgcaaaaaagttg

SEQ ID NO: 18535 - DNA, 2568 bp, Heterodera glycines
cagcaattttattgcctagtggttatttgttgtcgtattttattattaatgtaagtaagaataaaatagtagcaaatcgcattttatattttattatgccaatacaatcatatgcttacaattgactcactctcacttatcaaattggcattttaattggctcactgctcattaattggaaatttaattgtctcatttgctaattgccattttatgaggatttgttaattaattaattacattttgctcatttcccccctcaccgttctgttccgagtcgatgcgcaattcgcctgagaatgtgccggtgcctttgcttgtcgcggcggcaactcgaaaagcgtaactttttgctggctcaatgttaaaaagtgccgtttgcgagggaacctttgatttttaaaactataaatacaaaataaacggggagcaattgcaattttacattccgtcgtatgggcggcgcctctccgtggtccccgagtttgctcaattcaacttcgtaatggcttatgttcccgtttcgatgccgccaatgcggcgggtcccacaaaatggaaagcttaaattattaaaataagcgtaaataaaaaataaaaatttaaaatacattaaataattcaaatattttgaatttgatgttaaattaattttcaatgccttatttttgaataaaaacgtatattaaatggtgtaatggtttttggctaaacaaattggcccactctgttgttgaaaattgtgtagcgaatgttcagcggctctccgtccggcacccccgtgggcgtgatcaaatattccgtcgcgttttcactcgtgcccgcctcgttcaccgccgcgatgttcaattcgtattcatttccgctgtctaattaaattaatttatggagaaatttttaaaatatatgaattttaaattaaattaacttatggggaatttaaaattaattgattttaattacagagattgtccaacacaaagctttgctccatcgggccgacttcggccctttggtaattgtccagcgcagttggcctccaccacaaaacgtactttttcaacggcaaattgtacgagtgcctggaaatttgaaaataaaataagattattagatttttaatgaagcttatcatttaacctcggtggaagccattcgacttttgctctgacaggtctaaattcgttgatcagcgaaatcgattggggcctcgggggagagggggctaaaattgaaaatcttggatttaaaaatgattttaaaaatccgacgtttgcctcccgtcaaaattcggctttgttttgtcaacgcggacagttccccgtcccccttcatattaaaagccgcaattcgaatggcatattctgtgttcggctcgagatcgttcagataggcgtataatttctaaagattcaaaataatttttaattaaatttaaaaaatgaaaatgaaaaaaactcacatttttgtccacgatggccaccgatctgtgcaaattgttcacaaactgattgttgacaatttggaatttgtacacattgtatccgtacaaaagttgcgcgtcgccgtccgccggcggttcccaagtgacttttatggacgaactgttaatttgcacaacattcacattgcgaggcggagaaggcactgacaaaggaataataaatgatcattaattaattaaattttgttaattcataaaagtaaaaatggtaaggtaaaacttgttaaatttgaaaaaaaaaattattttaattaattattgtgttggtaaataataaagtttcaatggaaataaataatttataattatatttggtgatctaaattttaaaaagccaaatttttaccatggtttgaatcgccagtcactgcaattctgtgttggtcactaataaatgatacaagaacaaatgcataaagtacgttgataacgatcattttgatttctatttctaaaaaggtaacaaataaatagaaaatattttttgaaaaaattaattaattttttaattaataaatattaaaaataattatttttgtaaacgcccaaaatttacctttatcgctaacaaaaacaccataaatgttaaaaagagaacatgttgaataaaataagcaatttaagaaaacaaatattaggctgtaagaataaaaattaaataaatattttccaaaaatttaaatttaaaaaatgcaaaatttatttcgaattgggaacattctttttttcctaaattagtacctccgtcagccgagtcacttaaaattcccagtgccattgccgcttaattggattgcaaatttttgccgtccgccgtcgcggctgtccattccttcgctcccttttctttttgcatgaatggggggactaatgcccggggcaacggattaaggaggaaggaaaagcggaaaggcgagtggacagcgagcgcataaataaaattcgggggaaaagcacaaagagaagaagcacaaaatggacaagaggggaaggggggggggaggaagaaaaaagaaaatggcatgaaagaggcgccaaagatggcaaagccaaaggcaaaagcag

SEQ ID NO: 18536 - DNA, 2396 bp, Heterodera glycines
atgccagaaatttcccaatcacattttaaattgccaaaaatttcgcggaaattttctacgaattttaaacaaaatgatgctgaacagaatctgaaggacgcaacggaaggccaaagaacgtcaaattcagcttcacattttaaattgccaaaaatttcgccgaaattttctattaattttaaacgacgcaataaaaaagcggcaaatttcaaatataaattgaaaacatcgccgaagatgaaactgttcaaaaaatttggaaatatttcacaaaaattgaaagatttttttgttgaatttatattgcgaaaatttcggaaaaattctattggaagagaaaaaaacaatgtaaaattaacataaaattaattaaatatttatatattttaggaaatttatgaaaataataaaagaaaacaaaaaagcacagcaaagaggaggaaaaagcgtgaagcatttgaaaagggagcggcaattacagcacatattcgacctggtaactgttttgagtcaaaaattctcgacttttgtgtctctgtctcgattcttaagctacattctcatctcgagagtcgtgtgtcgtttatcatctcgcttctccaatctcaaaaaatttccgattcattagaagctctaatgatcaccactaaaataaatgccccataattctacgcagctcaatccggcgcaaaatgccattgaaaaaatttcaacgctaataattgccttgttttagaaaatggattcgttcattaaaaaggcgttttgttcatctgtttaggcaaaatgggctcgtccacggtgcgctctattatgttcaactcgcgcatcgtcgactccgccatccccggcctccacttgcattggctgcacgccaacgcagcgctgttgctcggcaagtacagcttgctgggccatctcccgtccgcgctgctcttcagcctcgtcattgtcagtgtgttgttctggtggcatgccgccaagttggccgtgtacttggccatgctttacggggatttggccggctgggccctccttctcattgcggctgcccttttcattggctttggtattttcttaatttgatcatcttctgattttcggaagtagcggcagtagaaaaccttttaaagcagcctcagttttataatgatcgatcattaattattttatattttaatttctaaattaggtaaactcttcaaacatttgcatttattttgtatagggatgttgtgaaagaaaaataaaaacgagacacgagaaggatttatcgccctaaaaacacgagaatccgaaatgtacactcggacaagagagagcaattcatcccagcagtcgtggatataaacgaaaaaacgaatttccgttagcagcggagcgttggcaaaagtcgcgtagtattgtacataggaccctaattattaattaatgtttttttcccttcatgctaatttaattttttaataaagctgctttattaaaaaatgcaagggttccacgccggcggggaattccctttcctttttttaattagtcattaattcgtccataaagcagtcgctgctgcttcatccattttcccacactttttgctcaacgattgtcaattgtcgttattcccccacttgtcaatgcctttttctttctttcccttttccccttcttttccccagcaatcaaaagcagtgacttcacttctgattcttgtgaaacgctgcaagctaattaataaatgatttattgagttttaattagtaatacgaatgggcacaacgacgaaacgataatctctcgattaattcgatcctttttaatgctcaaatattaaacacattttaatttttaatgattgccacattgttatgctttgatgactactaattagggatgatatttttaggcaaaagcctattttttcctgagctccccgtggcctgaaacgcacgaaaaacgttttttttgggctgttgttaagctacttttcgagttattagtgcctatttaggcttttatttttagagcctaaaaagcttaaaaaattttgaaagaacctatttttgcctattttggtgttttgtccaaaatttgttaacaaaaatgcaataaaaatgaaaaatgcacccctaagaatcggcctgaaaattttataaatactcccttaacgtattaaaattttctcaaaaattcatccccaaaataatttatttattttcttgacaagaatttttgattttaaaaattatttagctcaatgctgttttccctaatttttttttacttttttgaataaattttgtcattttacaccctaaatttgagactttttagagcctatttttgggggtttttagagcctaaagcctacctattttggcggttttagagcctaaaat

SEQ ID NO: 18537 - DNA, 2068 bp, Heterodera glycines
  misc_feature (1993)..(1993): n is a, c, g, or t
gacatttgcgccgctcagcatagtcgacacttgcgccgcggatatttgcgccgctccatttgcgccgcccagcaaaaatggacttttgcgccgcgctgtcaaaaatattatattcataaaaattccactattatcaataagttttactaaaactataagccatcgacaaaaataactaattgaaaattcgaaaaaattactagtcacaaagattggcattcaattttctaaccattaaaatcttaacattgaataggttcatcaaagatatgaaaaaatgattaagaatacaaactaacaaaaaactgaaaaaaaaagaattttctgtagaaaccccaattatttttttgcttcgaaaaaaagaatgaaattcaattcctttgtaattaattttctcaataagttattttcatcgattttaatttaatttcattgaaaaacgcactgattttcaaattttcgctcctattttaccatttttcgcattatttcgcaatttttatgcccttatttatttacctttttttttcgcttaaaatccaccgcttaatgatcaggcaatacgaaggctcgcatagtttttaattgatatatatatattttatcattttttaaatgaaatccgtacaaattgagcctaataatcccaaaaaaagaagccatttttgttgaaaatctgttaacaaatctcactcaaattttcacaatttccccggcggcgcctatcggcaccgccggacccctttcttccccaaaagttttctggaaaaacgcaccgaaaaaagtggtgtgataagtaaatgtaaatttcaaaaaatattcgaccatttggcccaaatgattaattgcttgaaataattgaagaaattttgatttgaaaattttctttaatttaatttagctttaactttttgattttattaaataaaaaaaataaaatttaattttgttattattttctcttggaataaattaaaatttgaattttttaaaatttttttgaatttttaaaatttcccggttggtcccggttccggtcccgaagaaaaatcgaggtgccggtcccggtcccggcttctcaggtcccggcaagtccacttttacagtaatgccggccaatcattcgttttgaaacaaaattcaaaaatcctcggcgtttggtttgcgcaaataattaatgcaaaaaaagagcagcgcgtccatttgcccctcttttgcccttcattattatgaccctcaaccaaaagtggaggggcattcaataaaactacaacaaaaaaagaaaataatgccataaaaatcacagcagaaatgccaaaaaagaaaatttcgcacaaattaaatgccgaaattgccgcgagaaaggaattggcgggtacccggcaaaaaaatgtggaacaaaataaaaattattaagaattcattaaaataaatgaataattaattaattaagcggcaaagccttctctgtgcgtgtgcgcttgccattgagcgggcgtgccaacttccgccgcgattgcgtgccaaaattcatgacggtaaatttttgggcgatgataattcttgatcattatattttaatatattttttataaaattcttaaacaaaaaatgcatataaaaatgaaaaccgatgcaaaaaacacaaattatttttaaaattatatttttattccaacaaatttgaaatttgtttttgacatttctttaaaaggtcaacattacaaattataataaatttaaatatttttcataaatttgctccaaaaaaattttaaaaacattttttaaataaaattccttaacaaaaaaatgcgtagaaaaagaaaatcaacgcaataaataacaaaaaaataatttctaaatatacttttattccaaaaatttatatttgagattattttccataattatttcataaatttatttatacaaacaaatttcaaaaaccttttaaatcacatttttattggtttttaattttattccccanaattttaaattttttaaatattttaaattagtcaaagaaatcgtttagcttaaagctaaaatattttaaaataat

SEQ ID NO: 18538 - DNA, 914 bp, Heterodera glycines
tacaaaaatatctttttgcataggttttttgtctgatgatgccttgcttttttaatccgttcgcttttacataaatgttttgactgtttttccaatgattgattgatgattggcatttccccccccccttttcattttttgccgacttttctcccattgcatccgtccatctgcgaagatgctttaggcccgactggcagaagaaaagcccggcccgcggaggagtgaaggcaatggcaatgagtgccccccccccccccccccccggtgaaaggcctttgcattgcccgggacaaacgacacaaatttccccgacaactgccgtcgccgcaggcgttttggtccccgtgggcgggggagggaaagggaaagggagggattctctccgctcgccgaatgtcaatttgttcatcattaaggaatggtctcgaaactttaattcttacatatgtcaatttaaaaaaacaactgcagttttaaaatacacaataataaaagaaaattcccaaaatttgcttacctaatttttactcattttacttttttattggtaatcccatgggaaaaaattttttacggaattcgttaggcacatttccttttacaacagatgtgccaagtgaaatttggcacaaatcatttctgtttaaagcaaaaataaatttaaaaaattaaaatatttagattaatgaaagattggatatattttctccaaattcgactacaattaatttgtttatgaagttaagagaaatttaattaaatgcttatttatcatttcccgtgtttttattggttcccctaatgctttatgatcgtcgcccttgtcagccattttgccgagcgccggacaaaagggatttcatggagtaatattttaattattgaaaatataattttcagactgatatttt

SEQ ID NO: 18539 - DNA, 1123 bp, Heterodera glycines
aattttcagactgatattttttaaaggtatgaaccggcaaaaacggccaatgatttctataaaagttacgacccaatgggtcggcgtcggcacggccgccattttatccgctttttatcactttgctcaccgcaaaatcgtttctgagacggacaattaagcagtggcggatgcgcaaatatatgagacggagggaaaaacaacagcaaaaagcggcaaaaaaggcgagcacagaaaaatttgttgactgaaaatgtaaattcaatttggacggatgaacgattggcatgaaagtgccatttcggaagatcgaaagccaaaaagtgccaaaagtgacgatgagtccaatttggcattcgccggtttcagttggtgaccattgttggcgaagcaaatgaattggcaaagccaatccaaccaattggacagcaaaggcacccgcccaacggaaacgtcgtttaacggattaaatgataagataatgatggtcagcagaagatatttattgcacttttatttatttgaatttaaatatttaattgttttaaaacattaaattaataaaataaactaaacggacgaaacagacagaaaagtaagaccagaaaacccaattctaaataaagcaacagccaattcattaattcgagagtaaattttatatttgaaaaatagtcataataatatgaattttattcaattgtcaccgagcccggcttttcccggcttcttctttcccgctttttcgactcccttttcccgacttttcttttgcttttgtgttgtccgcttctctgttgccctctcctctgcccctctttaattgatcgttcaatttgagtgatcacaatgactgagtggtgaatgtgctgctcgctgtcccattccgcgctggacagtgactgggccgaccaaagtcggcctaatccgccgatttggccaccgcatcagtcaatcatttagtcgtctcgtccgagggaggaatcggtcgcgtaccaatggccaagcggtgcttttccaccgcttgccactgaaaagagttacaccgaattatctgttgggaggaggggccttttctgtccactcatagactgctcaaaggacagaaaatggatttaattgt

SEQ ID NO: 18540 - DNA, 2250 bp, Heterodera glycines
  misc_feature (2210)..(2210): n is a, c, g, or t
tgtgatgccagaaggaagcggagtgtgggagaaagtgggataaaggacctgagagaacctctaaaggagcgctcgtagctcagttggttagagcacggcactaattgctggggtcatgggttcgagtcccgtcgggcgagttaattttatgtaacagtactcgttttttcgccagtatgtacgtgtcccgccgcaaaaagaattttaaatttcttaaattgctaaagaatttggagattggcaattggaaatgaacaaggaactatactattaatggttatcccccgtccattagtatctgtgactagctcttcttttaccatttccttttcgcattggcttttttggtggctttgtgatttgtaactgtggatatttgccatcggatagtaacaacaaatattgcttaaccgattccaattcgattaatgcactttctttcatttgacactcattagtggtctcgagaacaaatgcccaaccgatcacctaaacaatttcgattggtttttacagtaattttacttattttttgcaaataaatagtcgttaccaacctcaaaacaattcactttgttctcaaagcgcatttgtggcaattgctttttgattttacaatattcgatgcatttttgaataatctttttggatttgccaccaaaaattattttatgtgccgtcacaatttgtcgcatcgcttcctcaattgttaactctttaccacttttttcatcgataaattttggtttgagcgaaattttccccaacaaacgctcatctaaaaataaatttaaaaaacatcgataaaaaattaattattaagtcaccgtctttttttcagaaaatccctaccgatatttctatgctttccattctctaatgcgatacaaaaaatgaaaagccgttcaatagacaagtattgaaattgccattccgctaaggagtccaataaattctttggcactttttccgtaaaagtgccaagttttcgccatgcttctctgttacgataagtggatgcttttgccaaatctttgcatagaaatgcacgcagttttgtgatttgcttaaaatttaaaaaataaggaaatcagtggtaaaaataatatttttaaatatctttaacctcatattcagcagcaattgctgcaaaaacttggcttagaattagaagtaagcttaggtcaatcaataccatttttgctctgaattacaaagagttgagttaaatattcaataaaaatatagaaatatttttaaattttttattaaaacctgtataaaaagtcatattcttaatatattaatgaaataaaaataatgaaatgaattttaaaatggcatataatgatatcaatgaatgtataaaaaataaaaaaattatgtgcgtatgctccataatcaatataatgacgtatgaattaaaaaaattattcctagaaataaattattagggccttcaggaaattggacactataataaatatcataggaatttgaataattttgatcataaagtgattaaaaattgtcaatgtgccttgaaaaaaaacttttgtgcaattttgttcgagtaattcaattgtgattagcagggctacaagaaattacggattacggaaattacggcatatttggaccacgtaaatacgcgtattggttacgggttttgcgatttttccataattttgatccgtaacaggaatttgattatttttcaagacaatttcttgcataatttcttttaaacaattttttcatgtttaattacattttggtatttaattgtatttcatcaaattatttatgcctaatttggcaatttactaaattttacaaaaaattcacattatttggcgaactcttcccattctgttatttttttattgttgttttttttgatcaatgccttttttgggctgatcggaaattgaataaaactttcattcaattatttcttaaatgtgttttttctactttcttgcacaaaacaacacattcacaattttgttgtgcggcgttcattggtcgtatgatcgccgcgcaatttgggcgaccgaccgaccatcgaattttgtgcccgcaaaattaatggcccaatttgccgatcggcggagaaattccgcctaccccccactgattgattggttgattgattgggtatataaaggcggccaatttttgtaacgccacattcatctgaattattntatcattttgtggcacaaaagaaaaaggaatgatgctgaa

SEQ ID NO: 18541 - DNA, 1800 bp, Heterodera glycines
  misc_feature (1736)..(1736): n is a, c, g, or t
tgagtgaaatttgtgatgagataaatggaggcaaaattgacgacgaaatttacttttgacgcaattttttattgtggaatattttttgaaataaaatttttgtttattttttgtaagttaattatgtaataattatttgataataaaaaataattaatggatgattaatgctattgattttgaattaatgtgaattgggagaatacattttcttcgttcatcacatcataaatgtggccctggctgatgctgtgtgtcgtcttcgttaaatcaacaaattaattcccccccccaccctcacaaatgtttttttgtttgtttattattaaaaataaattcattatttcaaatttgtcagctgaaaagcttacaaattttctttttgggcaattggaaatcttatccaattaagttattcgatctaaattcattaaaatgtattaaaatattcaacagaatttattttctcttagatttcaaaatgttatccgccgatgaaaattattggcacaatgtgcaaaatatgccgtggcttgaggaagagcacaaaaagcgaattattatgcacaatgaacagcaaattagtggtggtgacgattttgatgatgatgagagagtcgaagccattcacaaaagtttggaaagtgcggaagagccggacgaagaacggtgccaaaaattggtgcatttgctcggcacggcgaacattaaccaagtcaattagcaaaacaaaatatttaattaaaaaaaatatgaaatttatatagcgacagaatttgaaacaaaaatatgcggcgaaatttgggggactgaatttgaaggatgagttgatgaagcgattgcctgcgagtgaactgatcaccaaagaattgttgcaagtcaattctataaaattattaatttttgaatgaattaataattttttttagaatttcatagcattaaaaattaatttttgggaaaaagaattattcagactttaacggacacaccagcggaacacgacgccaagtacttgcagaaagccatgcaggcaaattagttgctaaaaagcattttttaattctattttatatgctttctagggacttggcactaatgaggacatgctaattgaagtaatacataattaatttaaatgtttaagaattaaaaatatatcgatttttgaagattcttgtgacccgaagcaacaaacaattattggccattaaaagtgcttataaagcaatgtttaatcgtgaattggaaaaggaagtcagagcagagacaagcggcactttcaaagcacttttgctcgatttgcttgaggcaaaccgtgacgaaagtcatacggcggacgaaggaaaagccaaaaaagtagccaaaaaaataaataaataacgaaaataatttttaatttcaaaaattcattacgaataaaactattaactttctaaaaattatttatttttcatgacgcggaggctttgtacaaagcgggagaagctcgtttgggaacggatgagaaagtgttcatcaaaatgttggccaaccaaaaccttcgccaattgcgtcttgtctttgatgaggcaatgcaattaaaattaaataattaaaaataattgattaattaacaatttgcagtatgaaattgtcgccaaacatccgattgagaaaggcatccaagcggaattcagcggcgattcattgcgcgcatttttggcactcgtcgaatttgtacgcaatggccccgntgtacaggtgggccaactgatgcaaaatgcatttgaggtggcggacagattgatataatgaatc

SEQ ID NO: 18542 - DNA, 2187 bp, Heterodera glycines
  misc_feature (20)..(21): n is a, c, g, or t
gcatgcctgggcaggtcatnnttttaacatttgatgttaaacatatgaccactgttttttcaggggtgaaattttttgataattacttccttatagactaaggattatgatcatttttgaagtattagatagcttagtgaatgtattatcagatactaaataaagtaacaaggatcatttacatttcatttaaatttaagggtggtgtttaaacgattgtttcccaaaagctcgccgcagaaattcaaaatttttttataagaatcatttctgctgtactccccccgcccacctttttgctgccctccaattcattctccgtcaaactcgacatgcaatgctcaacccccgccattttgcatcgatgagccaacagccgaccaatgttataagcggcggagacatccgtctgactgacaggggacacacattttaattgacaacaaacaaaaattgggtatttaaccggcatcgtaactcgttaaggggttttcgagtggttactttgtgaaatgacacgggaaaacaacggaggaacgatcccaaggtcccccctcgcccactcttccgcattttaaggcaaatagaagccaagccaaaattctgagaccgtccttggaacaattccgtgccatccaatttcaagtgtcatcggaccccttgacaatgaatgacctgtatagttgactttggacagtcttctcacgagttgacgcttcgatcacaattccatcttcgtaatggacgactcgggcagcaattgcattttttgtcggacaaaagtcgaccctgtgttactcgtttgttgtaatgcaaaaaaaaaacccggaaaacacatcgacagtatgccatcaaattcacctgtaaatgaagttatgttgcgctcgattcttctcaaattcccacccgctgggcttccgctggaggcgcgctctttccaaattgcgcggattgttgttgacgaaacgctgcagaaaacggactccgttcatcttgccaactgcagtgaatgggcagtagcaaatttagacagaaagcacgacgaaaataaacgattcaacaaattatggagataagatttttgacaagagcagtctcaagcgatttatttgcattaaattcatacatccctagcagagaccgtgtcgacaatttcgtcattattatcatcatcttcgtcatcactgtcattcccatgaccattttctacgtccatttcttcgtcgtcttccgactcttcctcctcgagattgtgcaagcttttggatcctaaaccatttgtaattttggaatagtaaccctctaacagttcatttttttcttacgttttatctcttgcaaaaattccaccgcgtcccccgcctcatcgtcgtcggagtcgtcctccaaagtgaccattgaggaagaagtcgcttgtgcatttgatgatggccctggttggtgggcgaaggtgcccacatgagacgaagaagactgtcggagttgcgcggcattgctggcactttgtacgcttggcccattcgcctcggcttctcctcccattcgcggcgaatttacccaagaaggcaagtccaactgattcctttgctgctcatcccgcgacacaggaaagatgggcgtgtagaaataagtgtagagacgttgtaacatgctaaaacacgcataaaataaaatagctaaaaaattgggtagtttagtctctgagaaggggggggggggtaattcgcacctcccaaaaccaatcccgtaatttatcggtgcacattataacaaacagccaacaggatatagcggatatttgcagggtcgggtcaacataaaacctcgaatgtctgtcctgtgtattgtgctgttcccgtccatgcccgtgttcaacgcgttctcccctttcatgtacacttggccgagctaagcgtcgccgtcgttcgccgacaacttcgacatcgccgcccgctccgccgtcgttcaacaccaaaacgtcgtcgtcatcgcccatcaaaatgccagagcgacgtgagctgcaacagtcagatgaaaggtcgatgagattaaaaagaactgcttgtttacctgtactccgaattttggtcataaacttccaatgtttggcccgtcgaagcgaaatgggttaagttattcaaaaaatgatgcgggttttgaatgccgcgctgtttaaggaaaatcaca

SEQ ID NO: 18543 - DNA, 1241 bp, Heterodera glycines
ttaattaattcgctaattcaaaaatagggttctataactctgaaatcaaatttaaaaaattccaaatttaatataatcgtttctctaatcctaattaaactgaatgactttgtgctgttcttctccaaatgatcagccaaatcagcgcatagcacacaaattcggcacaatatgaaattaaggcattgatgtcagtgtaataagcagtttcgggctgatgggctgggtcaccgagatggcacatcaccggtctaaatgatccgaaaacaaaatttaaattcaaatttaattgcccattttgtgtccacttttcccaatgggctgcgcttccactgtaagtgacaaaacagaaaaatgccaatttaatacaacaaaatgcgatgatccctttgaaggatgtgtattttccacgtgatgtatacctaaaagtaaaaaataaattaattaaaaatggaatgatttattaatagatatctattacgttaattttagttaaaaaggtgggaaaattgaaaaaatatttttaaagtaaattttggaagacaaaaaccaattacttttggataaatgcctgaaatccttctaaaaactcataaaaatcattatttaagatgtatctttcgattttagtgtgttttatttgaattttgtaagtgcctaaatacgactaaaaatgccgcgccacttagcaaaaacatacaaaaaaatggaaatccatacacaaccgttctatttctccaattattactagggctaatatttttaggtttttacctatttttttcatgagctccctagggtctgaaatgcacgaaaaacatgttttttaggggttgttaagctacttttcgagttattagtgcctattttctaggtttttatttttagcgcctaaaaaactaaaaaaatttttaaaaacttattttcacctattttggcgttttgcccaaaatttgttaacaaaaatgcaataaaaaagaaaaatacacccctatgaattgacccgaaaatttctcaaaaattcacctccaaaatttatttattttattttcttgacgataatttttgattttgaaaattatgtatattttaatgacttggcaaaatatttttgctttttgatgaaaattttcaattttacacccctaaatttggaactttttggcacctattttctcatttttagcacctattttggagttttttaggacctaaaacctacctatttcggcagtttttag

SEQ ID NO: 18544 - DNA, 853 bp, Heterodera glycines
atcccaaattaataacgagaatgtttattttatgagacaatgggaaaagaatgaaagtttttccttccgaatgcaaggaatcggctaaaacaacaacgatattttgggttacgccggaatccctccccccccccctctttttttgatctcactcagtccaaagggtttaattttcaggtgtttgaaatggactgtatgacattgcgcatccaatttaatataataccaatcgctatctgttttttttgttttgtttattaaatcatcaacactatcaaattgtgcatttattcctttgccattttgaaatcgtggatcaattccaaaagttttcatgattatattttaaaaaatgtctctattcattgttttgtcgaatgacttcgtccgctcgtggcaatgggtcggcgtttaatttgcaaaaagacactgtgataattagcaggtaaaacattaattggctttttccttcctcaaatgataatccttttcttttctcctttcgtcttgcacaaattttgcgttttccgttggaattcgaaaggcactcattggagaagggagatcatcccgaaatccgagagggaattgcccacgcgcgacaatggttcgatcgtcgattagaacaaattcgaattgtggagacggtgagagaagagggcggggaggaaatagtgggacaatgagtcctttaggaggaaaagggcatcatttgcagggagtacgaggaaggggttgcccaactcgagcaggaacatgtcaaggtgggctaacaagggaacatatcgaactgtatgtgtccaaatcactttaaaaccacgtctatcatgtagagcatagtctattttatttt

SEQ ID NO: 18545 - DNA, 2094 bp, Heterodera glycines
ttttgcagggatcactcctcagtacaggattaaattgtcttgaaaatatccaatgcaatctataagggcgattttttgaaaaaatatgttcaataattagacaaattttttaggcttaattttaaaaaaattttagaacagtcagtcagattcgggaggaagaatccctcgggaatagatttgatattccgtatactgtatatctccccgataggtctgtcacgcccaaaatctgcatagtgtcgcaaatggtcgatctttagaaaatctgtctacaataatgaccgattcccttatgcgagtgatggttacgaatcggcgcagcactagggtgccatggaactgacagatgcagcaggcacagcgaagaggcgttctcagacgaagaaaagcggctcccctttcggattccttggcttcggcagaaccgaaggcgctgtcggtggttttgctggtgccatcggtggagggccgaccatcggaggaacgtccacttcttcgctgatgctcccttatcttttgtcggaatcggccatttcggaggacgtccattcgttgggcagcgactcggccaaccattgccatttggcggaacgttcgtcagcaggatgcggcggactgagtcaagacggagcgattggggatggagtggcactgtcgggcattgcatgccattccaccgcaggcgaaatggccgaggaagaggggggcgagaaagcagcgggcgccagcggaagacaccaccggcgagtgcttttggagcagaacaaactcattttggatgggaaaacgtgagcaaatcagtgggaaaatcaccaaaaagcccaccgtttatgcagttttcatcggtttcaaaatgtgtacattggtaagtgagtgagtgcctatggtcagcaaaacgttgctttttccgaattgacttcgtccggtcgaatgcccgccaccattcgctcgatcagcgagggtcgttacgtcgaatttcgcaggtgccgtcccttgttcccttggtagtccttaaatttccattttcagtggcatccccggcgatacgcgcacattcacggccaccaaagacgacttggagagcggccgcgtttttgtgcggaagcgatattaatgggtggggggcggggttggcatggcattttaattgtttaattttatctctacattaaaataaatgtttattacatattgtgtgtttgggtaccaatgctattttagtaacgtttatttatttctgtttttaaaatttaccaatattttttaaatttatttttcgatgggcagtaaacgccgtttcttacttcattttagtcaggctcaccagacttttagacgtgcggagttcgatgccatttgtcagattaagggaatttctgtggtgcccaactctccttcggatggggttttatttatttcttttttgggtcaatatgttcgttctgtccgcagatacacattcaatcgtttgagtttcaaaacgacgaatttgacgtctttcggctgttggaaagggctgtgttagtgaaagcggcgtacgaacccccccccccccgcccttcaaaattttgaaaaataaataaaataataggagactcagaattttgaaaattttttataaaaactgatgacaagctaatgtgataaaacaggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatagaattttaacgaaaaaagttaagcctacattttttggcatattaaaaag

SEQ ID NO: 18546 - DNA, 1340 bp, Heterodera glycines
  misc_feature (17)..(17): n is a, c, g, or t
  misc_feature (1263)..(1263): n is a, c, g, or t
tgctaggcaaaattttntgctatactaaaattccttaactactataaatgtttattaaattaagtgtttgaaatcaaaattaatttttatttaactttatttaattaaatatattaaataaaattagcaaatagaatataatttaaatcttttcattatacgtaactaattaattgtaatcaccgatatgttcaaaatataaaaaagcaatatttatataaataataaatttaataaaatactccacacttatgaataactttcgataattttattactataatttttataaaataaccaaagaaaataaattttaaaaaatattctaacggcaaaagaataccaattaatatttgaacaaaattaaaaaatatttgaaagtaatgtcacttaaacttttctcccatgaaagatgtggcttattcatttgggttaaaatatttaaaattagaaaaagtaaacattttcattttaaaaatcaatgattttatcgcatatttgtttcaaaattatttcaattttaatagataaatattatcacaaaacaatcgatataacacaaaggttttttaaaaatcattattttcatatcgttcgtaagtattttattttatttaatctgaataatttattttaatatttatccatcaaatatgtaatgtattaaaataaaaaaatttaaatactaaagtaagataaataatcttaactaatcatttatttcaaattgtagtaataatcaattcttgttttaaaattgtttattttttatgcttattcttaaaaatatattgtatgaataataaattaactaaaatgattttaattctttattttttaacaaagtaattatataaaaaagtcatttaaataaatgcaaattaaaagaaaatcgtttcttatgattgataaggaaaaaatgtaaaatatggttttaaaaaccatccatttaactaataattatagacaaataaaaaaaatttcttattgaatacatttttgtgaataatattaatatttatttgtaattttagaaaaatgtgaatttttaaaacattatggtaaaaattattttttaaatttatttttgtatttttatatataaataaataaaaattattaagcaacccacacagaatataattttttaatgaaaacaaattttctcaattaaaggaaaattaatcaaatgattattaagtagcgatatatttttttattattattaatttacattagatattttagacttgcaattttttncaaaaacttatcttaagattatatccataggttctcattttttaaattaatgttttttttttttgaaattttgcaaa

SEQ ID NO: 18547 - DNA, 1952 bp, Heterodera glycines
ccaattttgttttgttcattttttgtattgtcatgccttccccgtcctggctgggactgacccggttaggtggtcgattggcacatgagttacagcaaagacaaatcgatatttcgggttttcgtaaacgttccgctttgattttctaaaaaaatgagtgtagtgaagtaagactattctaaattacccatccccgatgcatatgtaagaggggaggagggaataccgtagtaaaatgcggtcgggtcacttcggcgtggactgctcagcgtcgccaagtttgaaatgcctaactttttcgttgttcgttaagttattaaatcttgcaaatttgaagctctttttgtgtccacaacaccgaaaaagtccgaattgaggttatgacgaaattttttaaaattttgtagattaatatagaaaccaaaagaactaatcgaatgttaccaaaaatatggttgataatgagaacagttgttagcaacgacaaaacgatcgggacggaccacgagtcgggatcccgactgaatccagatcaatcccgaacattttggaaaaacgatcgggacggaccacgagtcgggatcccgactgaatccagatcaatcccgaacattttggaaaaacgatcgggacggaccacgagtcgggatcccgactgaatcccgatcaatcccgaacattttggaaaaacgatcgggacggaccacgagtcgggatcccgactgaatccagatcaatcccgaacattttggaaaaacgatcgggacggatcccgagtcgggattccgaccgaatcccgattccgaaaaaaggatgggaaacagggttgcacgaaaactctaaaaaaaactttcgtatacgaaaacgaaacgaaaaaattttggcggacgaaaacgaaacccgaaaaaataaccgttttcgtacgaaacgaacgaaaaaaccgaaaatttttttaacttatttcattcagaattaagaaacgtaaatctttaaaattatatcctcaaactgagtgtatgcagatcatagtaggtggataagcggatatggctctagtacaggggtgtgtgattgaaaatttttcgaaaaaataacaccaaggaaaaaataaaattttgagtcaaaaataaggaatttttcaaaattgcttcaactcagttattttataattgatccatcaaaatgcacataatattatattttcacctcccattatccattttaaacaattttggggaagaaattaaaaataatacatttcagagcaatagggttaaataaatcagattttaaacaattttttttgcggcgcattttttcagaaaacttggggaacgtgggtgggctcggcggtgccgataggcgccgctggggaaaatttctaaaattttagtgtaatttgttaacagattttgtaattaaaatagtaaattaaatgaaaaaaacggtaaaataaagtgctggcatatgggatcgaacccatattaaaaaaacaacaaaaatctgaaggtgcacgactaaactacaacagttcaatgaaaaaacttatttttttactaaaaaagtcattcttaagggtgtaaatattttcgtctttttcgtcaaaattccgtctgacgaaaacgaaaagaaacgaaaatttaaaattttaaaactcgaaaacgaaacacgaaatgaaaaatgaaattttgaaaatcgaaaacgaaaacgaaatgaaaaaattttaacggacgaaaacgaaacacgaaaacgaaactcaaaaagtgccgaacatattaaaataaataaatataaatatcttaaatgtggttttgtgtattttaaaatttttatatattatttagtccataagtaaattttgtactaatttggaatgagagcaaagtcggagtaacatttttatttacatttaaaaatcgagtaaataaaaaaaatcaaatcaaattgatgga

SEQ ID NO: 18548 - DNA, 2330 bp, Heterodera glycines
  misc_feature (2232)..(2232): n is a, c, g, or t
cagctacgtccaatgcactgttacagtcgccgggttcccgtggaacaacaatgatgaccggactgaacaacagcgacgttggcaaggagttcagggtaagaatcataacgaaagcaacatattaattttaaattccaacgccaaattacaaagaaacattttctctgtcttcaatttcttcatttcctttcgccaggggcggagcaaaagcagtcaaaatagctaaatttcaaaatccattgtgtaaacgaaggaaaaaatgctaatttatcgtttcaaatacacccctattttcccagcgtcgctggtatgagcaaaaaaaaaggtcgttcgggcgaaagtttttcaaaaatacacccctaagaatcgggcgaagaattttcaaaaatacacccctaagaattgacttttcggatcggtacccccccccccccaagcccaaatcctggatacgtccctgtcccgaaccatgcggggccgaactgaggtaaaccgccctcccgcccggtaccccagcccccaccctgggaccaccgttcctgcccaaaacccataagtgccgccgcgaaccctcccttttgttttacatttgcattttcccattgttcagacatttcttcgtgccaccacttcttctgctgctgcccgctacacaattcaatttgacgtgaacaaatcgttgccaattgtgccatttgagttggtgaacgaacggacccaagaacggctgacactgtggaaaggacgcgattatgaacacgttcgtcagtgggtgatgaagcgatgtccaattggggagacggcgatcattcagtgggaagcgcccccaaactcatcggcaaccaatttgaacaatgtcaacatttatttgtgttgtgtcagctgcactggttgagcaccagctcatatgtactttgtcaaaatttgatgattttttttttctagaaaatacactattttattctgtaaacgtgaaaagatcatgctcattttcggtagttcaaattaggttctcgacgatttgccgtccgggccgagtgtggtgatcagaaacagcagaagaaatgaattgattggttgatttatgcgattatttgatctaaatgttgagcgttgttatttaggtaggtaaatgttgatcgttgttgtagttgatttttgctcattcacaaatcaataaatagggtcttaaaattagcaatacatattttccgtggtgagccgaaggttttctaattatcgctcattatcgcaaccaaaaaagtcatgaaaattgggaaaaagtcgaaatcaaatggttgaccgaggaggaaattgagcgcaaatggaggacaccaattgaacaaacgaaagaacaaaaaatgatcggaatgtgttgtgatcagagaaacagaaatcaaacaaataaatacatttatttggctccaatacgcacagtgtcgggagatccattccaaacccagatttgaacaaaaagtcgagaaagatcaacaaaacaaacaaattaaatgcattcaaactaacgaagcaacaatacataaatatgaggagcaattatccaacagcagatcaatttccattcctaatgatcaatcatttccaaataattcattcactttttcttccgctgggcccggcactcattcatttttgcacgtcctttgcgttcatctgctgatccgcatttggtggagacaatcgcctataaatgaagtgtgaaaattaaatgtgaccgacatcaattaaagcaaaaaggggggggggctctattacagtctacacgaccattaaataatttggcactttatttgtcatgtttccccacaaaagtggttttctaaacttttggcaataaattaagttgtcaacttattttatttatggtcgtgtaaaccagggatggcatggaattccgacacttttggggtcggaattccgatttccgaaaaatggtggcccccggaattccgatttccgaaaaatggtggcccccggaattccgatttccgaaaaatggtggcccccggaattccgatttccgaaaaatggtggctcccggaattccgatttccgaaaaatggtggcccccggaattccgatttccgaaaaatggtggcccccggaattccgatttccgaaaaaatggtggcccccggaattccgatttccgaaaaatggtggcccccggaattccgatttccgaaaatttttggggccttggaatgccagcanaagctgctttcactctctctctcacccatgcaagaagcttcataaaacgtaaagtggacattatttcaattgtccgaattttcgtcctcccattgaac

SEQ ID NO: 18549 - DNA, 1461 bp, Heterodera glycines
  misc_feature (1373)..(1373): n is a, c, g, or t
  misc_feature (1438)..(1438): n is a, c, g, or t
aggaagttttttgatttttttaaaccatcagctgatataaagaaaagcattgttgtctgtctttttccaattatattgccatttcggcatcggtctaacaaagctgcgcatggctttgggaaattcctcaggaattaattttcgttgtctaaagaaatgcgctagtgtcgggcattttgacattaaaatgccattaaggcaccgttgtagcaatgatgcacgtggtccttggaaattcctcaggaattaatccctgaatttcttctattttcttatcactcacaaatcactgggggaaaattaagatgattctgatgattagcgttcttgttcgattttggcgctagtgcgatatttattctcatggttcttggaaagtactcaggaagtatttcgatttttgtaaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaaagccattaaggcaccgttgtagcaatgatgcacgtggtccttggaaattcctcaggaattaatccctgaatttcttctattttcttatcactcacaaatcactgggggaaaattaagatgatactgatgattagcgttcttgttcgattttggcgctagtgcgatatttattctcatggttcttggaaagtactcaggaagtatttcgatttttgtaaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaaagccattaaggcaccgttgtagcaatgatgcacgtggtccttggaaattcctcaggaattaatccctgaatttcttctattttcttatcactcacaaatcactgggggaaaattaagatgatactgatgattagcgttcttgttcgattttggcgctagtgcgatatttattctcatggttcttggaaagtactcaggaagtatttcgatttttgtaaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaaagccattagggcaccgttgtagcatgatgcacgtgntccttggaaatcctcaggaataatcccctgattcttctatttcttatactcacaatcactggggnaaaattagatgatctgatgatta

SEQ ID NO: 18550 - DNA, 281 bp, Heterodera glycines
atctttctttactttttccgctaaccgataaaaatccttcacatttttagtccaaaaaacaaaaattataaaaaaaggattattcgcatttttctacggtatcttctcgcctacggtattttccggtgtttttccgtgtcagaatcactccgttgttttcacttttcctgctaattaaccaactccttttttgtcgaattgctctattgtccgtcgtgatctgatgttatctcttccgtgccccggggctgcccaccctttagttcccaagggtcggtccc

SEQ ID NO: 18551 - DNA, 1689 bp, Heterodera glycines
cattctgttggggtatttgtacagattgagccggcaccgcgcgagattggaaatggcggggaagcaaagcctttagcgcgaacaaagcgattggtacaaaaaaaggaggaaaattgttgattttagtcagcttagtgcaaaagtgccaaagaatgcatttccgtcgcaattaatgccaccgaacgacttgaaaatcttcggccccttctctccgcttggccagtattcccgactgagtgccgccgcctctccatcctcgtggggctcaaccggcagcaatcgatggactgacgaagaggaggatgggggagggacatggaagaagcggacgaggggggaggaggaggaggaggacgaaccgtggagaaggaggaggagccgagaaagtacgggggaggatgaaaaagtgcgaagaatggacgaagagttggccaggctcagggaggcgccggtgacggtactgaagagacgggactgaattgggcggggttgaatagtggagagcagcgggagactaaagcgggggtgggggacagggctgtaagagcgatggggacaattgttgggactaaaaagaacaaagtgccaataaagataaataaaaggcatgggaagagacccaaggggtcaaactgtgctaactgttacatccgtcgaggtgaagacggtcagtgggccgggcaagttcgcgctcagcatcgacatgaacatcttccgcccggaggacattgaggtggtcactggccaagcactgcttcagcttcacctcctttttggcatttccaggtgctgatgagtgagggtcggcttgtggtcaatgccgaaagggaagtgcttttagacgagcgcacttcggtgatccgccgttttcgacggactgtggccattccggacgatgtcggcacagacgcagttgcagtgcacatgagcgggtccaaaaggcatagggacagcaaaatgagccgagactcacaatcagtctcgacattgtgtttatttattgcagctttttgcgttttagacgcggcattttgactataacggcgcttagacgcgagaggcgaatatttggcggaagatgaccaaagaaccgggcaaattaattggttaatttgcgggagattaatcggaatgatcagctgaggcgggcttcctctgaatttgtctgttttcttatcaatcattcttctctaattgccttttttgttcccatccgtcccttttcaattcatcaatatttaattattcattttcccattttcccccaattgcccctctctttcccccccccattcccacgcttttaatttctttgctaattcccgtcaatttatagtttttgcaaaacattttcacataaaatgaatgccccctctttttcctcttttttcgtcgttattggcaaccaaatttcactttaaactcagtccgtccgtctgtttgtgtccccaatttcaatctgtccctccctctctctgtgattttattttctccatttttgctacaatttttaaccattctcacaaacaaatggatttttttcattttttccaatgttaattatttttaactttatatttacgagtcgtttgatgttgggcttatgaaagaattggcaatgatttgtctttgggtgacaaatgtcaaagccccccccccttaccccttcccggcttcacccctctctcc

SEQ ID NO: 18552 - DNA, 2836 bp, Heterodera glycines
ctctctctctctctcgatctctctctctctcgatctctttctctctctctctcgctctctctctctctctctctctctgttgttgctgtcgtacgatttcccctcgtcggctgtcgctttccctcattacccattttaaggtgtccctcattacccattttaaggtgtccctcattacccattttaaggtgtccctcattacccatttaatgagtccctttccctcattacccatttgactctcctaattacctttttaatttgcacccgaaaagacataccatcgaactgactgttctgttcctcctcctcctcttctgttgccttttcggatgatcgcaatctctccaaaccgttcctcccaaattaattgaattcgttccgcttatccttacgttgttaattaattgcttctgttgctgttcgtttgttcatcatttctcctttaaaatgctgtaattcgtcactgcctttccaccaaatgcttcccaaattccccaattgcccctctcatttccactccctgccgttttggcaatttttccccaattttcaaaaaattccccctgtgcgttggtggtgcttttcccgtgccccttatcggttagggttcgacaaagccgagaatgacacgggcatttccatcccgtcaattgccttcccccatttgtctttgcttccccaaattaccccttttaatttgttttgtttttcccattttatctcttttcaccatactttcttccaaaatgttgtccgcacagcggctgatcagcttgtccaaacccgagcgtgtgttgcccggccatttgttcccgctgaacaacaaccgtggcctcttggacttggaggatgtgtacgccgccactgttttcgccgattcgtcggtggacggcagcgacaaagaggcaaaagtggtcagcaaattgcttatgatcctaatggctcggacaattaattcataggtttcgcccggctctgacggtacacagacaatggaagaagcaaaggggctggaaattgttggcttcggactgttccacaaatgcacgcccaatcaggtggggatgaccaaatggacaaatgctgatgatcagaaaaagctgatcagttgcgccgatggcaaaatgccaatttaataccgccgtttttcagttttactgctctttgttgtccgtatcgaagcacattgaaccgttgttcgtcaacgtggaaagagtggccgaactgaaaaagtcagaaacggaaaaggaggaaaatgccaacaaagggacgggacggcacattttgttgagggtgagacgaaaatggcacatttgggcgataattatgcttattggccttcatcaaccgcactttaagctcaccgatgtgcaccaatcgttgcccaatctctcctccctcccccaatatttttcggcatttgctgaacccattggccgtccgttgctccaatgtttgttaagcattttctaatttccccgagggcattttgtcatttttaaaatttccttaggcattttggacgaatttgtgagggttcacgttggcattcacgaggttgacgagttatttttcaatttttggcattttcatgcgttttattcttcatcagatggaaacgcgacgtaatttcacggtggatctttacgacgccgactcggggtaatttggccagtttttcataaatcggctcctttcacagaatcgacgaacaccccgacacccaatggcgcgactttgctggttttgttgtcgccgaccgtttccgctactgcgaaattgagttggacaggtgggcaaatgcggtcgaatcagatctgctgatgattcgagagtcggtctcgagtttctttaattaattcgttaatcctccctaattaattcgttaatttctcccccccccctttcagtggcgcctttctgtcctcatttgacgacaattccctctcggtcaatgctcctgttgttctccattccctttcgccttcaaatagggcacttttccatgactacgatcagtccgtttcggtgatgggccgtgaagaatatttggactttttgttgaatttggcgggggtaaaaaggaaagaattgaaagtaaaagcaaaacactcccaattaacagatggaaggagtaattgcaattgacgagcagaagaaacagccgatcggatacattttggcatatggggggagagtgttgcaatgctacgcggacgaggagaaagtggccgggtgagaagcacaaatttggggggaaggagggaccaattagcgttgggtaattggggcgcggaacagaagaaattggcgtaattgggcgagggtcaaaatgagggacaaaatcattctatttacctcccctccaccacacataataaatccctgcttatcaaccctattcccgacgaagttcttgaccccaaaagccatctcccgccccctccgtcctgggcacactcccaaaattgcccgatcctaacagaattttctttccccttaaatcccccccccctccgcttttagtgcgctgttttgtgccacttctcgtgcacttcgttcgcccgcctctctgtcgctgtttcctccgtctcttccacgacgagtttccgcttctgtccgcccgtctctttggcaccgactcgcgcgtccgtcgccgtcgccgttttccccgctcgcgctcaatgaccgcggcggtgaaatgggtcgaagctttggcgccggccaccggattgcgtttgttttgatttgtgagggaatggacacaaaacgattcgataggaaaaaacgaaatttaattttaaatgaaattctaattttaattgttggaaat

SEQ ID NO: 18553 - DNA, 1434 bp, Heterodera glycines
tcttttgatgggctgatttcttggagtaagaattgtgctatttagcgaattttgagggtttatgtcaaaaatatcttccaattgttcttttttgttttgccgtgcgaatatcataatggaaaagttgacgcaaatacatgtagtcgggtgcctcgtcaaagcgtaaaccacggcagtaattcaaatacattgaaaactcggaagggaatcccttgcacagcatttccaccggggttgacattttctaacaataagacaaaatgaaagaatgcacagccaaagtattattagatttaaggcatcggctttttcaaataaatttaagtctgtataatgatcaccttttcactgattttctcatatttctgctttttgttagccgctttcaggccttgccatctgaaacgcataatggaatgaagaatgcttttcaatcagattaatctctcacggcaaatttccacgattgaaatacatgagcacatagccgagcgactccatatcgtcccttcgcgactgctcgatacctaaacattacgaaattcaaaaatttgatgctgattgagagacagaggttttgttaaagaggcacatttatttacctaattgaggggggggggggggataattcaaaccgttggtcctaaaactgatatatggatagattgagtaaaagaaactctggacttcaatttaagatacttattaatcctattgccaaaatttatcacacatacacatgaaggtcaggcgattccaaacaccacgaggaaaatgttttttagagtattttaaattactaaacagtacactagcaaccaaaaaatgaattaacatgccatcctgcttacccatgtgagcattgatggacgcatagcgagcggtgcccgtcagatttttgttgtctcggtaaggaatgtgtatgcgcgtgcgcgagtcacggtatttttttgccaatccaaaatcgatgatgaagagtttgttgcaatgccgaccgatacccatcagaaaattgtcaggtctaacagaaaatgggatgtcagtggtgcatgtaaagcaatttcaatgctaacttgatgtcccgatgaataaagttcttcacatgcatgtactcaatccgtccgatcatttggtcggcaagcatcagaacagtctaaaccgaaggagataagactttggaatttttactccacaatgtttaaaaatgatgaatgaataccacttttgtttactaacaaaggaaaaataaataaaccttcatcgtgaagcgccggcaacaaaagttgaacaagtcttcgagagaaggacccagcaaatccatcaccaggcagtggtagtcgcgctcgatgccgtagtaacgaatgtgcggaatgccaacccctccttgcagaaggaaggacaccttgctctcgtagagaagctgcgggtggcgag

SEQ ID NO: 18554 - DNA, 709 bp, Heterodera glycines
tgactgactcaagtttaaccgccacttcttcaccattctgaatattgatggcgaggtaaatgtcgccaaaagatccgctaccgattttgcgcttgagcttgtatttcacaccaacgatgaattccttaagcgaaattttcagagaatgcctcaagacatttttataatcattttcggaaataaaaaattgtgaatttatagtctaaaaacttttagaacaatattatcaaagttaaaaacgggcacacaccttgctattgtttgtgactacagcagccatcaaaaaatttgtcgttttttaaacaggagaaggtttgaggttcaagatgtcaattagcaggcttaaggccttaaacctgaaaagcgtgaatacgaatagcgattactcatccatggacatcagtaccaaagtacgacacacaaattgtaaataatattacacacaccctttattttgattaactactaaacacattcattgatacttatgtaaaatggctcactgtcccttctcttctcgtcaaattttctaatttcttatataatttcttttcttttaaattgcattgcccttttctgagaaagcattgtacaccataaaatcaaaacgcggcttggtcagaaggttggaggtagaggaattaagagaaaagaagaccggaaaatataagggaaaaggaaataagacgattaaaaaggaagaaagaaa

SEQ ID NO: 18555 - DNA, 1138 bp, Heterodera glycines
gggaataccttcccttatagcctggtacttttaattctgcgttgggatttttcttccccataattgtttgagtaccccaaacggacacttgaaaaaatcgatttttttatttcataaatatttttttagaaagtgctctaaagcgcaccaaattttatttacaagttaattttagcactcggatgctttagtatcaaaaaggaagatgaataaaatttttaattgctttttaaacatgccaaaaagtttaggcttaaattaaaaaaattttcttcggttctagctctttcaataagcaataaaatcgtaccaaattttataggcatactccccggtacaggactaacttaacctgaaaaaatgacaattgtaattggttttaaattttttagaaattctgagtttttactgtttattattttttgcaaaattaattcataaatattttttcagaaaatgctctgaaacgcatcaaattttatgtacaagttaaataaggctctctgatgctttcactatcaaaaagggagatgaataaaatttgtaatttgctttttaaacatgccaaaaagtttaggcttaaattaaaaaattttcttcggctctagctctttcatttttaaatgtttggatttttttttggcttaccaaaacttcatcgaatctggctctttctattctaattcaaatcgccccaaattttttttacagcttaactaggccctattaagcttatttccagaaaatctcgcatgaattctcatttttaaattttttatagatttttaaatgtttggatatttttttggcttaccaaagcttcatcgaacctggctctttctattctcattcaaatcgctccaaattttttttacagcttaactaggccctattaagcttatttccagaaaatctcgcatgaattctcatttttaaattttttatagatttttaaatgtttggatatttttttggcttaccaaaacttcatcgaacctggctctttctattctcattcaaatcgctccaaattttttttacagcttaactaggccctattaagcttatttccagaaaatctcgcatgaattctcatttttaaattttttatagatttttaaatgtttggatttttttt

SEQ ID NO: 18556 - DNA, 2395 bp, Heterodera glycines
ttgccattgatttcccaattaatcatcctcattatcatgatcatcttcatccgttcgccatctccgtccatttttcatcccaccattcgtcttcaaactcatcattcgtccccgaatttctgctggtgacggctcttccgcggtgcatttgcgcaacagtgccaccgcttggtcccgtagggatgggaggcggaaaaattcggcctcctgagtcaacaaagccagtctaaagagatagcaaaatgcaattaaatgccttttaaatttaattaaaaataaaatttcgattttctttttaaaaaaaattacatttattgattggatttataggccataaaaaataatatcaaagaaaagttctccaaatatggatgaatatggacaattaatgatataaaatacctagaaaaattttcaaaatatgggcataaatttacaaaatttggaaaatttaccaaaatttcaacaaaaaaaaatgcgaagcgaaataaaacattacaaattaaatgaaagccaattttaaattcgaattttttaattttccggatatttattatctttaaagtgaaatttttaaatatccaaaattttttaatttaatttaatttaaagaattattaaaataagtagtttttcatttaaaaacgtacctgtccggttccttgggcaagcagacttcccacaactgtttggcattatgaagacgtaaatagttcaaaattatgccgaaacttgtcgggtccctgtcgatgaaaaaacggcctgaaattggcagtaaaaattaaaaattttctaaaaatatttttaaaaattaattttcggacaaaaataaatttttgattggcaaatttttatttaaattatttatttttttattaattctaaagccaagctataccttttttgtcaagcattgtatgtgccgaacctttgcgctcaaaataccactgaaaattgcaaaaaaaaaaaaaaaaaatttaattacagtaaattaccgtaaaaattacacttacagtgtaaagaagtgattctttgtcgaaactaattgtttgataagtgcttgcaaaaatttgtccaccaacattaaattcaattatgtctgtcataatattttctaaaaggtggaagaaaattaaaaagaaaatattttttaatggaaaaatgcggcgaaaatattttttaaataatattattctcgaaaaaataatatgagtgtcaaagatgtgaaagctgtgaaataattaatctaaatagccaatttttaaataattttgtgtaaatttttttaagaagttgatcaatacaaaacagagtttttaaaattattttttcatttattttttaatttatggtataatttaaattattcttttatatatttgctattaagtcgagtgtaaaaataattaccagttttttaccaactttgggagtaaaattttaaccagagtcataattattaattagtccatgataattaagtaaaaaatacagagttattttaaatacattttttaccattttctcaaaaccggaaaatgtataatttggcatccctcatttgtgccgcatcagcgacagcagcagcagcagaaatgccaacaatttggcatgttttgccgccggcggcacaaatcgatataagcgatagttttggagcggatttcatggggggaaaatgaatgcataagcacattttgagtgccataatgaggcgtacaaatccccacacttttcaaatatttatgatggggagagagcatttgggaaggggcgggggatgaaacttcagcgggcgggcggcagagcaattgagaaaagtgtggtgggtgaagtgggggaagaaaattaaaagttttgaaattttaacgcgccaaaatagggaaaatttggcgaaaagtaatagacaaataaaacaaaaccaattaaaaaggaaaagtttgttgcaggacgagcgagaagcagaggagcgagcggttccgtctctaatgagccaaattttttgggctataaatttgggtcggcgtcaaattttagaaacttgtggcattattcgatagaatctttttcaagctctattatatctatattttataaaattaaattggtaaatagtgaaaaaagtttactttttagagatcaattccgtctaatgagccaaagtttttgggctataaatttggatcggcgccaaactttggcattattcagtagaattagaatcgagaaaatttcttagattatcatctctttttaatctgtcttttatctgtaggatttttattctttatttagtatttttcataatgaaaaatgcactttcatttggtgtatcttttgcatcataatcttaaagtgaaaagagtaataataaatgcatctatatacaaaatta

SEQ ID NO: 18557 - DNA, 2010 bp, Heterodera glycines
aaacgatgtgaaacaaatgatgaaattgactgagctagtggcactcagaaattcctggaaattgaaatgaatgccaaaatcattctgccaactgaaagtttttttacagtcactttctcccactctcactcactctcttcatctctttatcttccttaccctccctattttctctcccactctctatctgttatctttctccctctcttgtctctgtcgcttaatctctctttttctctgtgtgtgttcttctctgtatcgatcgctgtgtcactcaacgaattagataattattttatttataaattttaatttaacttttatcctactaattaacatttattggtttgctttcccgtcgcttgcctgcttgtattcgtcacttatatcgtaccaaaaggagcggtacaacactttcggacggccatccgcgcgtggccacagaagccattcccgcacttttgtggtggcgtcaaagggttcatggctgtgctaaaagtattaaagaaaccaaaccatatatatataaacgcttttttttgcggcgtgctttttccaaaaaacttttcgagtacaggggacagaacagcatgaggtgccaattagagacaggaaatttcaaatttgcgaatcccgctgcgggacgggaactcaaaattttttgcgggacgggatgccgcgggattattccggcattttcaaaaaaatgcgggattgcggactgggatcccgcaaaatcccgcgcgggatcccgtcccgcgccggtaatttcctgttttcgtctcaataaaaattcgttatataaattgctaatcacggatcaaaatcacggaaaaattgaaaaaatcggtgacccatgatcacggcaccccagaatccccggatttccgtgagccgtgatcacgaccccagccctggtttatggccaacatcatcaatgctatcatagtaaattaatcggagatttgggcattcgatcagaaaagttgttgaagtgcttgcgagcagtccacgcagtcgtacagcgccactaaaaattgggaataattgttgctagggaagcatattttaggtatttaaaacacgtcgattcaattttgggatccaagcacaattaagttggatttttcgtcttagtggtctgtgagttagtcaccaaaaaggggatcgcaggttcaagtcctccttgtgttagtgtataaatttcaattttttaaaacaaataaaaaataataataaataattatagaatgccaaaagaaaaaatacaaacacaaagagttacactatgttttactgcagatttttttgaaattttttttagcttataacttggtcaatattagaccaaataaaactattttatgctcattttgaagggaaaattctgaagaatgcttctaagttagtcattaaaaaaatgtttattggcaaataattgattcatgtgtaattttatatgtatgttagagacatggaaatagtacgccaaaatgagagaaaaagaaaaaactttgtcctggtaaaaatttttttcctattgtcgtgcccattatctcactctagcgattccaagtttattttgtgaaagttaagtttttaacacaagatcgattcttccattttacaaggaaaagcacaaaaaaaattaagttttgcaaagttttggcgttatgattactaaataaataataaacttatttacactgggagccccaaattgaaacgccgtgaaaacgtacaaaaagagaaaattcttacaaggttttcaggtaaaaaaaacactcaaaaaagatttcatttgtttgcaaaatcttagaaattttttaggtatattcgtataaatgcttttttcgtctttaaattcatttttgttaagggtttttctaaaaacacgtaccaaaaatgccgaaatagataggaaaatagatcagatctttttgatcaatattttcttaaatatttcggaatgtttttgtaatctaatttcctaccctactgatctattta

SEQ ID NO: 18558 - DNA, 1766 bp, Heterodera glycines
  misc_feature (1653)..(1654): n is a, c, g, or t
tttcggatatttgtgccttttttggaagaaaaggagacttttaatgtcgtccaatttttgcggccatccttgtttggtgaaggcactgatttgttgtagaatttcgtcttttgctgattcctccgctattatttttgcggtgatcggaagttgctcaattttggcctcaaaaacaaaattaacacagcaatcagtgtcattgcagatgtttgcgatgagaatgtcttccgatggcctcggataatttgcgatgagcctcgaaagtacgtcggcatttccgaatgcctttgtgttgacgtatttaatatcaaattcgtaatttgacaaaattaacgcccagcgctgaagtcggctggctgaatatattggaatgcctttttttgatccgaagatggccagtaggggcttgtgatcggtcaacagagtgaattttctgccgtagagcatgcggtgaaatttttgtaccgcaaaaaccaatcctaaagcctctttttcgatttggctgtaattttgttgcgcagccgtgaaagtgcatgatgcgtgttcaatgacacgttcacttttgtcgggaaattgatggctgattgttgcaccaattcctccttttgaagcatcagcggccacaatgattggcaatttggggtcgaaatgcgttaacaataaatccgaaagcataatttctttggctttctcgaaggatttttgttgttcatcttcccaattccacggtacatcctttttaagcaattcatctaatgggcttcttatttcgcgcatttgtttgatgaatttgccgtagtatgtgagcgctccaaggaaagaccgtagagttgacttgtcgtgcggcgctggcatttttcgaatagcctcggctcttgatgggtccgggcggatgccattttcagaaattatgtggccaaggaaaacggtttctttttgaagaaaactgcacttttccagttgaattcggagaccgaattgtttgattttgtcgaaaactttggtaatcgttttgacgtgttggtcgagagtcgtgttggcgataatcacatcatcgagatagacgaatgcgccattgatgggtgtaatgattttgtccatcaaactttgaaaaattgcgggcgctgattttacgccgaacggtaaacgctggcattggaagagtccgcggtgtgtgttgattgtacacagctttttagactcatcagacaattccaattgcagataagcgtcgcgcaaatcgaggcgtgagaaatatttagagcctgcgattgcattgtaaatgtcctctggacgtggcagcggatggcggtgtagctcaagtgcgtcgtttaatcccgtggaaaaatcgatacacactcgtgttttgccattcctctttttgactaccaaaattggagcggcccagtggctaaattcgatgggctttattgcctccattttcagtagacgatcgatttcggcatttacgtcgttcaaagcgccatgtggaactggtcttgccttgcagtagataggcttagcaccgtttttcagaatgagattggccttgaatttggtgcagtgacctaattctgggctgaagacatcggaatgtgttgatttgagcgccgaaattaatgtctccgtgtctttgatttggttaactttcgnntgaattgtattgatttttggatgaaagattgggtgcataatctccttttgggatcacttccaaaggcttctatccatggcatgcccataaattatgactgatttcggggcta

SEQ ID NO: 18559 - DNA, 2046 bp, Heterodera glycines
gtttaattaattgttcaattaactcaatttggcttaatttgtttgactgttccgatcaacaacaaatgttccgagtgcgcgaaagaccacgtggatttgtcggaggaggcgttcaattggttggagccgggcggcggatcggtgggagtggcgaaaagtgaaaaagcaaaaacaaaattggcattaattttcatcttaatcattttagatgctacaataacctatgtgaagtgttaaccatggggatatgattggtctatggatgctcttaagtgatattcttctattttatttcacattttttgttaaaataattattaaatattattattcaacaattcttttgtttttattataattgcttaatttaattatgaatggttggttagttttgctgactatttaattattttaatacattttaaaaagttttgttttttcattgatcaaaaaagttatgtggccaaaaatatccaaaaaaacaaggggttttttgtgttccttagtcataaccttttttaaacaacaaaattttttgaaattttgcaaactgatagagaacactttgggctatcagatgatatcaacaattaaaaattggttgattttgagcaaaattataaataatttttcatcaaaaattttcatattgatggttttttaattaacgccctttatttatgatgttttttgttatattattttttaaccaatttaatgtatatggtgaaggaaaaaaatcttgagttaataatttcgagacggagagcatataattacaaattagcatatgatataatatggattaaatttattaataaaaataaaaaccatttattttttattatttttatcaattttttttttgtcacattttccgttcgtttcgttttccatgtgattgcatttgttatcgccagcagaaacaatgaaaacaaactacgaatatattcttgcccagcagcaagtttaagctacagcagcacacaacattatttcgcgcatttcggatgatcaatcaaagaaagaaatcgttgtttaatctttttcattaatgttgtggctattaatggcggacattactaattacctaatattgtaatattttcaaacaaaaactatgaaaagataaacgaaaatcaatttaaaagggaattaatgccatgtgaataattcattcattaatacattaataatatttgaaaatcacttctctcttaatcctcttctcaaaaatggtcctgctttttctccaattggcactgattttgctctgttcggtgtttgcttttattgtgtaagttttaaaatttgaataaaattttcatcactttttggctttgctatgttattaaagcattttccaattcctaattctttatttaattggggccaatagcagttcgtacaataacaatttataaaacaaagcctaagatcaggcttaggcctaagtccaagcaagtagaagcttagggcgctaaggctaggctcaagcctaagcttaatccgaaggcttatgctgattctaagcctttataaaaatgcctattgtacgaacggtctttgtacgactgccatgaccccatttaattgtatcaaattggccatagaatgatgcgcaaacatcgcaagtactggtccaaccgtggcattccgtccccaaccccgcagctgatcagtggcaatttcggctcgctgtacggcgattatccgagcatgttccagctgcgggattggaccagacagtacggcaagcagtacggtatccaatacggttggcgcaacgcgttggtgatttctgacccggcaatggtccacgagttgcttgtcaccaaatttgaatatttccacgcaagaaatgttggcactttttatttttgacaattcttttttggtttcactgctttttgtcctttggattagctttcgcccatctttggcaatttggacacaaacaaatggatcagcatgttcttggccaggggaggccggtggacaaggaagggaacgattgcgaacccggcattttcggtagcgaatctg

SEQ ID NO: 18560 - DNA, 1077 bp, Heterodera glycines
  misc_feature (962)..(962): n is a, c, g, or t
  misc_feature (982)..(982): n is a, c, g, or t
  misc_feature (1000)..(1000): n is a, c, g, or t
  misc_feature (1063)..(1063): n is a, c, g, or t
tttttaacgtttttttggtcaatttgtcgtcaacttattcaaaaaatttttttaccgaaataccagtacaccacctccctgaactaactggatacagtaagtagtatcaacattgtataaatgagaattctgtttttcctttctttgcttacggtgtgcggatagtatgcggaattcgtcttcatcatcatcatcgtcgtcatcctcgtcttcctgctgctgcagttcatcggtgatggtgtcgtcctgctgctgctccgtgccgtcgccgccggtgacaaacattttcttcattttggcacggccgcccgcgttggcggcacaaaatgagccgccactgctgttgtcgctgaaatcgaccacaacacgggagcagcgcccaacacgaaggcgatgcgactcgcacacagtgccaccgaccaccaaactgaccaactgttgcgcaccagacacctgttgatgttggggatttggaattaaaaaactggccatatattcagtcacgtcccctcccccatcacattggggacgggacaaaatatcgccgcataaattttctgataaattacagtttttttttgaaaaaatttccaaaataattttcaataatttttttcttcaaattttcttataaaaattttcgaaaatttttttttctagaaaaatttctcagtttgaaaaggcggcaatattttgaggtgcacccatcaaattaatttttaaatctgaaaatgttttgaaggaaaacttaagattttttaaaatttttcagtgattttttcaaaaatttagaaaaaaacttattaattcatcataaaattaaaaaaaaatcgctagaaaaattttcgcaatttcacaaactctgccaaaagattttcaagttttgagcaaaaaatccatcataaaactggccatgggcagagaacgactaaagtttaccatacgtattagccggctgctcngagattgtcggtctcgagcnggaaatttttcgagactncgaaaaaattcgactgtcaagcagagcagcccagcccttttgcttataaatacatgaaaattncaactcacatttga

SEQ ID NO: 18561 - DNA, 937 bp, Heterodera glycines
ggcacaaatgccgagtcaatcagcgcacgttctcccaacagatggtttacacccgccaaaactgagcgttttgagggtggtgccacagcgtcgaataatgcaactcaaatgcatgtgccgcaggggacgacgagtgccaaagaaacgaacctggcgaaggcaataatttaaaaaaatataatcatcatcccctgctttttagtatcattaattgatagaaagaatttttttagtttcaaaaatatgtccaaatgggagccccgacatttgcgcctatgtcaaaaattgcgttcaaatttgaattttttttcaagccctgatagcctaaacagtagctattaattgctccacatttaaagggtccctccaccctaccaaatcagtgtcttcgccaaacataagccgatcagttttaagccaagcgctggcgcaagcctccagccaacccttggagacctaaatttttgttttttttcttttataacgacattttccaaactctttcaagccgaatccgatcaatgggcccaacatggtgaagcagcagaaccaacgcacgttcaggcagttcggacaaattgaaaacgcattgagtggaagccaaagtcttgaaatttcaaattttaaaaccaaattcaaaggaaaaccggagaaattttttttttgggtttatggcaaaaaaaaagtatttttcaagaaaaacgagtacagtggaataaattaaccatgacagaagagttggacactgtagagttgagtgaacttcccgacgaagtgcgcgacaatgtgttgctggcaccagcttaaccaacaatattttttaaattttggtctcttgcgttattagagccagtaattttttttttgacaaaattccttttttttggcacaacctgccagttccgcggtcgttgaacgctgctgaacttgctgcaat

SEQ ID NO: 18562 - DNA, 2269 bp, Heterodera glycines
  misc_feature (26)..(26): n is a, c, g, or t
  misc_feature (85)..(86): n is a, c, g, or t
agaatggacaatgtgtgaaatgtgcncagggacagtgctgtgtgaatggaaaatgtggccaatgccaacagggaacacaacacanncagaagcacacaaaagttcaagcagtacagcaacaagcgcagcagcagcagcagaaacatcgattttggcacagaatgttgagaaagaagcgcggagcggacgacgaaataaacatttgaaaataaaattaaaaaacgacaaaatgccaatgtttcgctttatttttgaacattattttttcttgaataaactaaagtggaattggacggtgacaattcatataaaaatggttaaatcaaatgaggaaaatctgagcaatcttcgatcagttcaaatttgaactgctgatcggtgtcttattttgaaagtaacggttatttgtcgctcattccatttgcaacattgacaattccattcatagtgcatatttagtaccggttagtaccggtaccgccgatactcaaaaaccgggaccgagacttgacttttttcaaaaaccgggaccgagaccggtaccggtacctgaaaaaaccggtaattaccggatcggtatcggtaccggtctcggtctcgtgctaccctaattgtaattattagagcccggatttttatgtttttacatattttttctgcggtttaattatgacgagagaaacccaaaatagcattttccacttacaattttgctttagagcgtcttataaaaacataaaaataaatattttgatgttttgcaaataaaaacatatcgcacatatttcggggttttggtacatacagtattttgcacatattttggcatttttgagaaaaatctataagaaaaatacaagaaaattgaaaaatttccctaaaatcaatttttttgcaatttttcaaacaaaattttttttcgaaagatgccaaattgaacttttcataatcgtcattggttttcgaagttctctgctgaaacttcttcaactgacagcttttaatttacaaaacaattttatcagaaaaagaacaattttaccccaaacacctccgaattatttggtttgcaattgtgcgggcgaaaatgataaaaaaatgatacttaattagaatttttatgcataaagataccggatttttccaatttatagcacatattttttggtttttagcacatatttcagcattttttagcacatattttttttttattaaatttacaggatttttaaaacataaaaacctgagctctagtaattatgcaagaaatctcccaagaaaaatgtttgcataaacttttaaatttgggcacttaggtaggtccatactacgttgagaaaagtcctgttttttgggacaacaaattccggcaatgtttggccaattgtgtgaatggtcgttttcacatttactgtcccccccccttccctcatccgttcaattaatcaaataatatgtgacaaattgttacaataattgggtcatttggaagtgatccgggtcatttgcgggcctgatctgctgatttgtgctctacatctctgctcagtgctcgcgtgtaatatctcgataaaagttgcaatatttacatgatccagatcattttcaggtcattagcccaacctcctgatggtattagctagaccaatttgatggtaaaaaaaaaggaaaaaaatcaaaggacggatacgttaatttctacggtgggaaccgccgtctccacctaataaatcacattaaatttttaaaaaattaaattaaaaatttcataattacctttttcgaaattgcaggcccctatttcttataaattttaaatatttaatcaaaatttagtaaattgcctttcgtgaccaaccaaacatttgtcatttgcaaaaatatttggattaccaatggcacaccgaaattgttgttgggccctgctcattctgctcacggtgttgtgttgcttgaccgttttggtgccgtcaattttggcctgctgttgcgactgttgctgctgttgcggcggtggtggcggtggcggcaatagtgccaataatattgcaactgccacagcgcttgccactgctctcaacggctcgttgctggtgttgccgggttcaagttctggtaatgtttattgtctcgattttatgacaaaaaaggcctaattttgatagggaatgaatttgcttttccaatttttgctttttaacgctaaaattgattaaaacaaaaaagattaaaaatctaagaaacgataaaaacaaaaagaacataa

SEQ ID NO: 18563 - DNA, 1578 bp, Heterodera glycines
  misc_feature (26)..(26): n is a, c, g, or t
  misc_feature (50)..(50): n is a, c, g, or t
  misc_feature (55)..(55): n is a, c, g, or t
  misc_feature (59)..(60): n is a, c, g, or t
  misc_feature (68)..(68): n is a, c, g, or t
  misc_feature (72)..(74): n is a, c, g, or t
  misc_feature (80)..(80): n is a, c, g, or t
  misc_feature (96)..(98): n is a, c, g, or t
  misc_feature (101)..(105): n is a, c, g, or t
  misc_feature (124)..(127): n is a, c, g, or t
  misc_feature (134)..(134): n is a, c, g, or t
  misc_feature (151)..(152): n is a, c, g, or t
  misc_feature (157)..(157): n is a, c, g, or t
  misc_feature (174)..(174): n is a, c, g, or t
  misc_feature (179)..(179): n is a, c, g, or t
  misc_feature (196)..(196): n is a, c, g, or t
aatcgtagaaccactattccaataancaattcggtaccctacataatgtnggtgnttgnnatgtgggnttgnnnattttntcccttaaaaaatttnnnaannnnntagggattttgaaaatttnnnngattttnagtgtattttgggtgtnnagttnattaaaaaggagtgatntgatnaagttgatgtaagaganttttttgagcagcaacaaaagttgggcaagcatgaattatttcaagtatttaaatgaactataagatagtttttcaggtttgagccaagaatttttggggcacagtatttctctcgtaaaactgtaactttgtttgggaaatattaaataatatattgaaattataattatggtcagaaaataattaatagattaaaataattatattattaattaattaaattaatttcgtccgtactgaaatgacgccacacctctgaaagtctctcactgatatttttgtcacttcgactccaccaagaatctgtaaaaggggatgttaaagcgtgtagatggattgaaaatagaaaaagtttcagatctgttcggccataaacaattttatgcgccatgaacagatcaaatcaaacagctttcgcctattctcaagtgttggcatttgcaggtgttctaatcgattttggtatggaattggcggaaggctgcatttaaaaaatacccttttggtgttttgccgtgtttctttttgttgcgtgcttttgttgtgctaatttattcataaaaacggtgaaaaccagaaagcaaaagccctttcgttaatttatttagtatgaatgaagatttttcaattctacgctccatttgtcgactttttaaaattcaaaatttaagccacaaaacggaaaactaacaaaatttgaactaaaaaccttcaaaaatagcgttattttgttgttgttggcagactttgggggtttatttatggagttcctcaacctggattttgcgtgactggattttcaattacggaaatccgtaattgcatccaaccccgaccgcgttatttggttatagtttccaaagattttgatatttaggcgaatgtcttataataactgatcaaatcagattaccaaataacttactaacgggactttttcttcgtgtccccccccccccatcgttggcagattcacaaaaaatacaaaaatcaagctcttggtttctgcacatgatttctaataattagaaaagtcaaaaatcactttttcttaaaaaattaaaaatttataaaagtaaaaataattttttctatttttaaatgaatcaaaaatagaaacaaagttttattagttaaatattaaattttgtaaatgacggagcattccgtattagcaacttttgcaaaaataattttccaccaaaattcataaggaactgataacgaggtagtcagacagtaggatatctggttattttaaatgattgcttgacttaaaagttgatcaaaatttattttttaacttaaccaaaatgatcaaaaaaaaattacttttcatttgattttagaaatatattttgacggatttgtattttttttc

SEQ ID NO: 18564 - DNA, 1068 bp, Heterodera glycines
aaaaaaaattacttttcactggatttaagaaatatattttgacggatttgtattttgtttccaagtctcagtatcgtgatgcagatggttgtattcttggtttcattctacggtataacgacatcaatttacaatttcatcgcttagaatgatcacaattatgtatatgccaatgcaaatgtggatctggaaatctttattgagtttttttgtttattcttttctttagtgaccgttggatttagggttttttaattttataaaactttttttttggttaaaaaaagattttttatttttttctttttatttttttttgtgtacataaaaacgctgcgccagaaatctatataaaaagtgactttttacatattttttttttttgcaattttttttggaggttttgttaggctcgccaggaaaaattttgacaaaattcttaacgattttgcgtcaaaaaggcaaagttgtggatttttatgtaaagtttaaaaaaactcaggaaaaatatttactataattcaagttacaaaaacctactagcaacattaaatttaattaaattaaaattgtaaaataaatctaatattccagtcaggggattggactaaggtgtaaacttataaaagaatgtaaacttaaccactagaccatatccccacttgcgcttgatcaattttttttctatgattttcccccttcccaaggttattcattttttagtactcaatcagctataccaacttaatttggacgcactaaggcgggagtccgcaataagcctttctaatccttaaaacacgaaagtatctttagtcatttgagattttggtagattaaatgccaaaataattttatgacagaagacagataaattaaatttagaatgatacatagaaccgaaaaagacggtaaaaagaggtgaaagggggacggtggaataatatcaacaagaaacagaaaataccaatgcttcgcttgagaatttgaaaaataaaacccagggttaccagagtgagaagttaaaccatcttttttgggttttgagaggcctaatagtgctaaatt

SEQ ID NO: 18565 - DNA, 2512 bp, Heterodera glycines
  misc_feature (78)..(78): n is a, c, g, or t
gaagaataatttagagcgaaaagaaatttcatacttaatttttttgattttttattggacattgttttctgaattggnccaagagagatttttgagaaagggggctttttcagaatttctttcctattgtttcaaaaatttttaaaaattcagtgtatgtaaagtttaggtctgatcataacaatagcatgaaattttgggaatcggtctcttattgaaaaagttatgccatccaaacactttttggagtttgctgattcaacaatttatgatgactcgtgggaatttttttaagaaaatcagaatgggccatgagataaataacaaatagcccttacaaaatatacataattggttttttaatttggcggagtctcggaaagaaaattcatttaaaaaattttgaaaaaattgcatttttggaggttgaatttaaaaaatcataaaagttcacaaactcaaaataaaaatcataaataatgcttattaaaaagcccagagttttctccttagaataacatatccaaattaataataatttgtttgaccgatttttaaaaaatccgtaaacaaatcaattcacagctatgcaaagacttatttttttacaccccaataaatgccttttataacttttagagactaaattcactccgtcaaatttattagtttatccaggaatttccattaaaattaatttttttttaaatacttatgatgaagtatttaaaaaaacatgctcacagaaactccatggatgaagaacaatttgggaaatgatgaaagggaatattgtttacgtcttatgatgcttagttatcaataggatacaatttcgtgccctaattatcatcctacggactatttttattatcataaaaattaaattttcttaaatttttgaaagtaatctctaaatattttaattttttaaatagggatggcagttttaagaaacgcgtcagcacgaatataaaaccaaaattggttgaattttataacaggtccaaaaataattatcaaaaaattaaagacgaaatgggtttttttaatcaaattttctatatttatatgtattaacaacaatcaaactttctatgaagtagtgacccctgggcgcgtgttacaatttttggcgctaaattcaaatttgaattttcgcgtcaatacattgtgggtggagggacgcttgctggggatgtgggggcaagccgtagggtgtagggcttattttaattatgttttaaatttttattttaaattaaattttaattattattttaaattaaataatgccaaataattatttgccataatttggagggggcgcgctttggggggatgagatgcaaatttatttgaaaagtgtgaaaataaattaaaaataagaacaaacatggggggattaacaacgggggcaattagggacacatttttgcttccagtattcgacaatcatgcgcattttcttgtctcgttccgtgtgtttggcgctggaggatgcacgagacaaagcgaaagacgaagcagacgaagaagacgaagcggaagcggaagagcaggaggacacgtttgatccaggtctgctgtttccaaacagaatttggccggccgctttgatctgatcagctgacagcagtttgtacgctgcccgtgtgcattctcgcggcacccgtcgggaacaagaaggagcctttttttgggggaaattttacatttttattatagtgtaaaaaaaggaggcaaccatcggcaccacatcgcacaacggttgaggcgtcggggcatcgtcgaccggggcaatttggagtgccggtgcaaatgcatgttggttctgctgctgaccgaattgaagaggagggagttccaaggcgccctgaagccgaggaaacggcgagttgatgaaaaatggcggaaaagcgggccgcagaggagacatgttgtgaaaatgcatttggagcacgctaacggcacggtcgacaatctgcgaaatcagcggccgaggcggcagcagcagttgttgttggtgttgtgccgggaacaattgctgcggttgttgttgtaccgggaacaattgttgcgggtgttgttgtaccgggaacaattgttgcgggtgctgttgtgccgggaacaattgttgcgggtgctgttgtgccgggaagtttgtcaattgttcgccgtcaatgtccaattcgatctccacgtctgccggagggacttcggcgggtgccggtaggacaacggctggcggggcaatggcggcagccggtgggacagcagctggtgccggcgggacatccgcgagacgctccttaaagcgaatgcattttgttttttttgctacacttattaaaattatgttaccaacggcacacattgcccgtcgataaggccttgaagggcaaagtcttgctcgccggccctcgcaaaaacgctaaatttacaaaaaacaaacaaatttgtgctgatagacacggtttcttacactcttctggccttttgaacattgagt

SEQ ID NO: 18566 - DNA, 1747 bp, Heterodera glycines
  misc_feature (28)..(28): n is a, c, g, or t
caacagatatagatcatagataatgacnatatgagattgtatttatgatcagcgattcatatcactaggaacattttgagggtgctaaaatattagtagtttgtcgtctgaaatttgacgtttcataaaaaacaataattttagaaaataaaagacaaatgccttatttagacgacaaatgacaaattttggaagacatacgactaatttttttaaatagatttatgataaacgacaaatgacgtaaactgacgacaatatatcttttgtcggttgtctctgtcgtaagtaagcgccgccttttgcattctctaattactcaagacctacataatttacagccccccaccctctcccacacctgctcgctgttagcaatttcggtgtgctgtgcgttcggcttattgatcaggttctgcaagccgaccaaattgctgccgtttgtgggagtcgcgatttgttccttctctcgaatccatgtcttgttggaaacaaatttttttttaaacaaaaagatcggttcccaaaataatctcagatctcgataaaacgaaatcaagggtctagattatcacaaacactttttagtatcctcttattttttaattgatcgatgaggtgattaaattcaaaaaaaatttacaaaaaaaaattgtgaaaatcgcaataaaatttttcggagaaccagagtggaattgataagcgtgggaaaatgaattattttcattctcaccagaaaacggcgtcggatgcggggccaagtgtgcagaaagatcactttgagagcggcgatcacgcttacgcaaaacaatccggtcaacatttttgttcttgtctgctctccatccgtttccgtctcgcaatcctttcccgtgcgcggttgccacgccttcttgatgaaccgcgtcagaggctattaaggaacagcagaacaatatactaattttaagtaatataacattgattgtcagttgtttgtcaaaaataatttaggaatttgggtaaaaagttaaagcaatttgggtgcagttttactgtattaagaaattggtgataacccaaatcgtaatactagtagcataaattttgttaatgcaaggtatgattgtaactgctcgaatttttgagatggaaagctgctgaacacggacaaacaatgaaaatatttaattatctttttcaaataaaaaatgccgaagttaaaaaaccctttttcacccttaataatttatttaaaaaattacgtcgttggagaaccattcactttgtcctggttgaagagccccagcaaaattaagacaagttgtgaaggcaattaaacgaagtggcagcggcaattgtgcctgaaggatcaaataccatatatttttattaaaaacttcctttggatatgatatggggtgggtaggggggggggggtggccggcgagggtgcagctcgtttccgcccccgagaaattcttttaaaaaatttactaacagatatttttcaagaaaaaaaaaattttttaagaaaattttaagaaaaaaatttgaaaatttttatggtcaactactaaggtgtttcaaaaaaattttccaaaaaatctctgaaaagctctcgagattttttaaataattttcttacaaaaaactttttaaggtttttttttcttgaaaatttctaagttggtaaattttttaaaagaatttctctggggcggaaacgatgcaaagggaaaaggcgggggggggggggggggggggg

SEQ ID NO: 18567 - DNA, 2189 bp, Heterodera glycines
tttatcaaagtataaaatattatttaattaataattaccaatttgtagtattttccctttaaaaatgggaaatgccacaatatcttttcattattctccagcctacgaaaaataaattgccgtttctatgacaggtgaacacgacgaggaccgatttggcacagcaagtcatttgcccaattgcttgtgttgagtaaaaaatgcagctgtcatttgctcacagaccattcattcatttgttttcgaaaagctctatttacaaataaaattaaaaaaatagaaaaataaaatatattttggtgtattattaaattaaatttaactatcgtctccttctaattatttttaaaaatgttttaagccattttccattcgcaatattttccttttccaaatgccgcgcaattttctgctttgggtcaatgtcattgaatatttcgtctgtttggctttacaattgcctgctttgcttctgcttatggccattaccatttcagtgcaatttcgaaaaaagttttttatttttattttctttatttttttataaatttttctccgtcagaaatcactcccaaaatgagaaaccgctgtgtcccactctgatctattatttgctctttctgctgatcagtctcatctccgcagttgcttatcactgttatatggtttccaatttcgtgcaaaatggtgccgaaaaagccgacccctattggatgttctggttggcactgtgctacgaatgtgccaacgttgcagttccagtggctatcctcggcctcacaattgaccggtatggcatcggcaacagagttgccgccgagtcactcaaccggaagcattagcatcggaattttggacaaaaatacaccccctaaaaatgggcttaaacgcaatggaattgacattttttcttcttttctattatagaaaaagtcaatatttattttttccttttttaaattttatctttacaaaaaatagccctaacaaataagacattttttcgttattttcgaggttataaaaaatcagtaaaattttaataatatctacaaaattgttcatcatcctccaaaattgcttttttggtgcaaatctgctgttaacaaatggattttgttagcttaattttcgacctgactcaaacattttgccaatttgcttaaccattccccaccgtttttaagctgtttgaccatcacttttccgctttcctacggccgtcgtgccaaacgaatgcttctttttgcggatgttcttttcagtgtgttgcttttccttgtgactttccgcatttattttgtggaattgccattggatgcttcgcaatgttcgtttttccatttaaaaatttgtttttcttttggtagtcataaaaaacaattgaattttcttaattaatctcccaaattggccccattagtgtccgagttgtgtctgaatgcgtcgtgcgttaatatgcgaaatcgcaatttgtaccgacttggcgccaaaagtctgtttggcttcatcaacattatcgccagcttaatttttatggttttactgagggcaaatcgggtgttgatgaagaacagtacggcacgacaaaaagcatcggtaattgatctttttttgtttttttaatttttgaggaatatacggcggaatataaagcaatttgccttaattaatatccatttcaattaatgttgaagtttaagcgtaatcgaatggtcgccatcactttgatctgtgaaacggtgttcaatattttgccaaatatggttgctttttttgcgaacattgtgcgtttcgttccttaataattttcttggctataataattaaaaattattaagttgttgggcattattttgtccaattatttgggttggataacaatggtcggctattctttggattccttcgtaatggtaagagatttccaaacagattttaaatttccagaattttaattttgattatcaattaattcttcagtcaattttttatttcattattttgtttggccgacaacaaaaattaattgtggccaaaaatgtggcaaaagtggcacctgccaacccgcggcaaaatgccatccgttgattaaacccgttttggtggtggggaaatgggcgcatgccaactaagcgcgggccgagtgagcgtgacgcgaggcaaaaaatgcagaataagaacagaaa

SEQ ID NO: 18568 - DNA, 2492 bp, Heterodera glycines
actcagacgggagggaccggtgggatgcgcaaccatcgcaaaatgttcatctcggcagacgcgcgcggacttttctcttatgcatttgtggacttgggcgacgaattcgttgtgaacgattccgacggggagacgtgcaaagaggtggaaattggaataattaatttaattgcgaattgaatggttccgattttcaggtgctcgttgagtacatcgactgcgaaagcggcgacatgatgacactcgaaggcgcatttcaccagttggaggacggggaccacgttgtgttcaccgactttgagcacgccgaactgaacgaacttccaccagtgccagtcactttgaagggaagtgagtgccaccactgaacatttgttggttcatctacagtcctcccatttttaggcaatgtcttcaacattggaaatgctctcgcggccttttctggcgcagttcaaggccccgtttcgcgtggacgtgttcagcaagtcaaagtgcccaagaaaatgtccttcaagccattgtctctcgcactcgccgagcccgactttatgatttgggactttgccaagttcgacgaacctgcacaacttcacgccctttggcaggctttgtacagttttgaggcgacggttcgtcattctggccactttccatttgtttgggttttcctttcagaaaaactacagccctttgccccgttccgatgccgacgcaaaattgttaaaggaaatgctgccaaaagatgcgcccgaaatgccggactcactgctcttcaacttctcttaccaggtcccttttgtgcctttttcaacttcgaattcctcccccgtcttaaggcgtgcggaaatctccaacccatcgcttcgctcatcggcggtttggtggcccaagaggcgatgaaggcagtgacgcaccacacgacgcccctcaagcagtttctgtacaccgattctcttgaggcgttgccgggcgccgattcgacctttgacgccgccaagttggagaagaacgattgtgcaccggtgagtttttggacggacaactaattgctgttggagtgttcaaaaactgtccatttgcagcgcaacaatcgctacgacggacaggcggccgttttcgggtgggcctttcaggaggcgctgcagcaacagaaatggttcattgttggcgccggagcgattggctgtgagctgctgaagaacatggtcagtcatttgctgccaattgtaataaaagtacgttttgccaggcgatgatgggcttgggctgtggcaacaatggctcgctgaccatcaccgaccccgacaccatcgaagtgtccaatttgaaccgccagtttctgtttcgtcgtcctgatgttggggtcagttgcgagtcttaaatgttaccaaattcttgtcatcgcctttctgtagaaaaagaagtccgaagtcgccgcccgttccgtcaaagcgtttaactcgaccattcacatcaatccgatgtctgagatcgtcgccgagtcgaccgagcacatcttcggcgacgacttcttcgcccgtctgaacggcgtcagtaatgcgctggacaatgtcgaagcacgtaagaaattaggagaagggggggggcagactcaaattggcacttttgcccattttgccaggccgttacgttgaccgccgctgcgtgtactatcagcttccgctgctcgagtccggcacaatgggcgcaaagggcaacacgcaagtggtcttcccgcacttgacggagtcttacggctccacgtccgacccgcccgagaaggagacgcccatctgcacgctgcgcaatttcccctaccaaatccatcacaccattcaatgggcgcgagctgtgaaatttattgacctaatttcagttgtaggaaaagtcccgtttaagaagttcaccgactatttcacttcggttgcggagacggtcaaccaatacttggacaatgtgaacgactttttgcaccgagtgaaccaaatgactttttctcagcgggtcctttctttttccatcttttatctttttttatccgagttcttttgcagatcgaagtgctcagtacgcttgagcgtgcgttggtcgtcgaatacccgaaaaatgcggaagaatgtgtgagttgggcccgtgaactgttcgacacgctttaccacaacgacattgcccaaatgctgcacaatttcccttccagcatggtcgttttcctttccatccatccatttttttcttttttatataaatttgcttttagcttactgcccaaggcgacaaattttggagtggaaccaaacgctgtccgcacactttgaacttcgacgttaacaacgtgactgcccaatttaagccaatgaacccgttgtccatttttagcctgaacacttcgagttcgtcttctccgcttccattttgcgtgcccaatcttacagtttggctccgatcactgagcgcaaaaaagtggcacaattggccatggcgtactgctc

SEQ ID NO: 18569 - DNA, 2104 bp, Heterodera glycines
  misc_feature (56)..(56): n is a, c, g, or t
  misc_feature (94)..(94): n is a, c, g, or t
atcaatcagtgtgtaattaaattaataaactgatatattgggtgaaaaaaatattngaagttagtttcccatccctcagatgttgatggggatnttccatctcgactttttgtcctgctacttttctgaccaagtgatgagtggctttgtgcttggtggctgtgttcatggtaaagcatttgtagaagtttttaacaagcttctttctgctgttaattcagtgtttttttctcaaattggcgatttgctcggcattcaacatttgttgccgaaacgctcgggcagaggctatctttatgaagtgatttttaagctcaaatgcaattaatattttttgcataatttagcgaattttggacatcagcttcaacttgagcaacactcacatccccacaacaataatcagccttagttccatcgcatttttgatgttcactcagcaaattttggaagtacaattttcaatttaatttttccatttttatattttttaaagccatggctcggcacagcttttcaatttccgattccgtacgaattgttgttggtgagcaaatgaatttatgcttaatttggttggtcatttgctttttgttaataatctcaggttattattggcataacttcgacgaatttcgcggacctttcaactcggcactctgttacggttgtcggcaacattccaacaaagtaaaatatatttaatattcaaaaagggaaacgctttacctaattgaaattatttgcccagctttccgcccccttcgatggtccgttacgaattgttcccttttgtattctttgacgccattggcatcgcagtcactgcggtggcaatgcatttgaccgtggcaaaaatagtggaaaaccgatatcattataaaattaacagttgccaggtgattgggaattaaattaattaaatatttaataattattgttaatattttaccccacttttcgtctctttgtttcccaaaataccccccccccctccccttttaggaattgtactccctcggattgtccggcatttgctcttccgcttttcccgtctttccgatcacttccattttcgcgcgaactttgatcggtgacgcggacgaaaacagcacacaggtccgtcagttcccgaatgatggcacttttaaacggcattgcttttgccagatgaccacctgtttctcgacactttcgctgctcactgtcattttatatattggcccaattttggaatatttgcccaaagtatgaatttataaaatgccaaaacacttaatatgcccgatttgctttagtgcattttggcttcgattgtggtccgtttgttgtctctttcctttcattttttatttatttatttttgttttccttttttaaattgcctttttcagatggtttcaatttgcgcttctttcaccaaatttcgcgaattgcgcgaactttggccgctttttaaaattgattttgtaattcgaaatttcattttttaattaactaattcctaatttaggtgattttcctagttagttttttgctcactgtttgctatgatattgccgaaggattgactttttccgcgcttttcagtgcctttacaattgtcgttcgcgaccaatggtcacatttcatttaatgtttggcagtttattgcttagtttcttttcaaattaggcctaaatggcattttctgacacacgacgaagaattgggcgagtacaaagaaatgccgaaggaattgctgcagcaaattgcggacgaagggcacgcgtttatcatccgatacgatgcgccgctgatttttacgagtgtccacaaatttatgaaagtaaatggaaaaaaatgaggaaactaagtgaatttgggtgtgcttttaggtgctcatccaatgcgtgaagcgatgggaacagcgaactttcgacaaaaagcacgaggcaaaagcggacaatgggcggcgggaaaaggcggagattggccccggggcaaacaacgcattaatcatcgattgctccggctttccctacgtcgactttttgggcctaaaaacgttgaaaaaagttttggtcttccgttcatttgaaaaagagcaaatattttaggttta

SEQ ID NO: 18570 - DNA, 1304 bp, Heterodera glycines
cattcttccgacgaatttgcgcatttgcattaggaaaacggggaaagtgagcagaagagtttaattgtgagcataaataacttaatttgttttaaaagtgagtaaaaaaataattaagcgaatgatttgaagggatttgtcatgggcaaaatggacaacagacaacgcacgaagaacgaaccgaaattcggactatgacggcgaaaatttaaaagcaaaaattataaaaatataatttaaggcaatggaaaagacggacaatgaagaaaaatacactttcattctctaatgttcaattgtacgaataggctttttgagttcaaagcacaaaagacagaactcaaaaattattaaaagaaagtcggtgtaaagcaaaggatgctaaaactgcaaaagaataaaaatgcaaaaaattacggggtagtctgggaattgaacccaggacctctcgcaccctaagcgagaatcataccactagaccaactaccctataaaatgccactatttataatttcttataagcaccttcctttcgttgattcatcgcaatttcattcctcattaattaattgcttccagcgcaacttattttcttaaccccttgcaacttcatatcattaattaattaaaatgaaaaaatgtggtgttttaaaaaaaattgacttttctcgttttttcgagagaatttacataaaaaacgcaaaataagttaagaaaaacagttaagacaattagtcgtccatttcctgtccataaactgtttaaggaaaaatggtaaattctgcactagaaataagaataaaaatctgaaggcagcaaaaattgcttaaaaattttgttaagttttgacctttgggtttttgccattttcggcttcatcccaaaattcaatcgcttctgagtgtgacttgcgaatgaatcattcgctaatgacattctcaagaatgtgtgctgtgcaatcaattcattgtgctaatcatttgacattttttggttatgctcattctcaattaaaggcttttcgatagacaaaagccttggcggaacgctatttttgctccttttgttcattctctctatctctcccccactccgttctctctctctcgctctctggcattgtcttttctgtactgatcatttgtccgtctttgttcccctccccctccctatctccccctcattcaccgcttgtgatcagatatgtagctagaatgaataatctgaatgaatatgcatgaaatcatactaatcaaaatgccaattcaaattaaaaaatgggagggggcggaggggccgcggct

SEQ ID NO: 18571 - DNA, 2687 bp, Heterodera glycines
atgtttttgtttgtttttacctggggttattcccacactctcatagtgaaaccattcaaatggacactaaaaagattaaatgaattttataattaaaagtaaccgacatttttgttgtcacatgcgaccattttcccatgtgatcgctgtaaaaagcacgtctggttaaattttagaaagatgccatctccactgacctgcttgcaaatgcaccatgttttgttgtcgtccgcctcctctcccgcctcttcatcttctgcttcttcctcctcttcgtcttggtaactgtaattgtcctcgtcctccactgtctcttcgagttcgtctgccattccctcctctccatgcattttcctgcgtcgtctccgtcgtttaatgcccgtttgataagttcgagtgcgagtaagtgactgaaatatcgctaattaatgcttgttctcgagtgtcgtccatacgtttgctcttgatggcgttcggcccgttccttccccccgaattggccctgtcacccgcgcagtcccttcgtttaacatttgctccacttttttcgttagcctataaatgtttttatttgccttttcgccatgcgtatttatcgaatgccactttcttggccttccatgtctgcttgcatgtacgccggccaacaacggcattcgggcaagtgatggttgtcgtgcgtggaaaggactcaaaagggggccaccaattgagcccaattcggtgccatcgaaatcaatttttgcgaacgaagtgcttgggtatgaagtcgatattgtcgaaacagatgacgccgaaccctgaaaatacgaccatttttaattgaaaattaaccgaaataccattccaaatcactaccgttaaaaagaatttaacctaatttaaccaattttattcggtctgttacccatctgtctgaaccaaacagtccatcatttcattacctctcctaaagaaatgataaattttacaccgttcccattgtttttactttgttgttcgactgcaattatttcctgttgttgaactgctccaatatgtggaaaaaaatgttgagttgcgataggcttctgcttctgttcagaaatgccttaatttgcacggacaaaatcaccaccttcaaagggggtgccacttcggcatcgaaaatatcctcatcataaggcatcaatgtggcactgctgctgctggtcgttggaccatcggcaagtgatggacgccgctaaaaatgaccaaaattgaaactaaacatctgtttctttgttagcccatttgccacgccaacattcaaaagagtggcgggaattcggaattcgtcaaattgttgtgttcgatggcccttcggagtcaagtccatttctgttgatgttctgctgaatcgctggttccttttctctttattttgccaattaattacctttcttcgtcaccgtttaagttttccgccgacaccgaaacaaaaggccttaacgggtggatgatttgctgctcgaggttgtcacttccaatattcaaattgtccaacaaatcggcgaattgtccagcagatgaagaagacattgccaacattgtttgcataaaatctgggtactttatattatattgctcacaattaatattaccgttaaaaaatgccacaaaaattctaaaaccctgccctcgtttattaacaactcactcttttctatcaactccgtctccccggggttctccgcctccaagtcggctttgaattcggccaagtccttcgccaccctttcctggtacttctctaaaatcaattgcaggtattcggccactcgcacttttgcctctccaatttcgcgaaccgattggaatttctgttgggaaaattcggtagattaattcaattttgatttttcaataacctcaagtaattcgctgtttttctgctcggctccaatcggagtcatttggtcgatggtttcaaagaagtgtcgagagtccctttgcaatttatcgaacgcaactgaaaatattcgataacgcaaagcaaaactaaaaaataataatgggaaacgacctgaatactgggcatccaattgttgcaattccttgcacttccgtctaagctcctcaggaaggtgttcaagcacttaaattcggtaaattatatccacaatatttaaaaaaccttcggtacttttctagtttatgtggcagtatttcacatacctttttcaatatccactaattcatacttttttatattgtcaaaactttgtctgtggttttcatggggtacatgtacagtttacaccccatagaattttttttaatgatataaacgtgtttctaggtgtattcggggtctctgattacgaatatgacatccatttcgactagttctcgaagcccggacccgaattccaagaaaaaaagaaaccaaaaccggagtccgaaccgccagaatatatgagtttcatttcaacggattttaaacccaagtaaaaatacgattcgccttttaaactatgtcatcgaacccgtatttcgaaatggttgcttgatccgcaaaaaatatgtgaaatctggcctctaaactaggaactaggtaccaacatttctaacataaacgaaacgaacattcgagtgaatcctccaagtaatgcatttctcagagcgcaaagtttgaaaaaagaataactttcccttttctcccaatt

SEQ ID NO: 18572 - DNA, 2883 bp, Heterodera glycines
atttgtagctcatttcgttgccacagtcacaaaaaccattggtgtgtagaagcttaagttctctgagccattctgcgaattcttcgtctggtagagccaaaattttgaataaagcatcaagttttaaatttttaagtgtttccattaatctaaaagcaattgtgacaataaaaaaggaaaaaaaattgaaaaatttgaaaaaaaaaaaaatggggatacaaagtaaattagtacctattgtttgaggatttttgacatcccttcccgtcgatttctcgaacccttgacccaattttgggtccacaacaaaagtttaacatggaaaaattgcccaaaatacaacagcaaactccaaattaatcattccttctgttttagaccaaacgggccaaagactttttggcctatgcccattatatggccgaccaaattggcaccatcggggaacggcggcgtcagctcaaatttttgcatcgctacgaccaaattgagcggccactgaagcgcaaatgtgcattcattcatcgaatctgttctcatcgctgcaaggtttttgattttttttaaatttagaaatttttcatagattttttcaaatttgaaaaaaaattttcaaaacactttttggccaatcccgaaaaaaccctttcggattggtttgaggaaacaaaaattgaattcctttaggttttgattcaagaatcggacaacattccaccaactcgtttttggccaattcattttttaccctactcgttttttgtctataaatttatgtagaagtgcagacagcgacaagttcgacagttcatatactcataacacgtaaaaaacgagttggtttcttttttaccaaaaaagcatgtttttccctttttattccattttttcgttgtgtcaaacaattcatttttcctttaagaaaatcgtttattaccgtgaagaaattgcttttctgcgccatgccaacatgttcaagcagtgcagccaggcgtacactcggctgttgaatgtatgaagattatttgcaccaaatcgttaaaaaaattttcttttattgaaatttcttataaaaatttcgatttttgaaatttgtctgagaaaaattttcaatgacattttaattttttgtattatatgatacctatttcgttaacaggtgcatggaaacttggtgagcaaccatgacgaggcagcacgctttgaattctttgacaacaaccacagtgcggacaggtgaatttttggtttgggaggtgtaaatttgcgctttttgtgggtctgtcaatgctttaccctctaaaattttgttttttcagtgcccgtgacattctgcagaaggctttgcgcaaatttcccaccgcccctcgcctttggctcacttattttgagattgaaattcgcttcgttgaattgtgagtttattacgggaaaaatatcgatgaatttaaccattttttgctgtaccattaaaaaattttcaagttttaccctcttattccaatttaaaacccccaaaaattgttaaatttccatgaattttgttaaaaattgtttcattttcagtcttcaccagcgtcgaatgttccttttgcaacaacacaaaagcaatgagatgaaaaacaaatggcaaaagaaaaacaacagcagcaaaaggaaaagcaatggacaacaaaaaaatgaagagacggcacaaataactgatgaagaagccgagaagttcaagcagttcaacagcagcagtaacaacaatgatgacgaagacgaagtgcttggacttaaattggccaccattgtgtacgaaatggccatgaaaagtgtggaggagcacccggcggagaagacgagtgagtgaaagtgaaaaatatgccataaaacggaattctaaaaattcttacgaattttcccataaaatttacgataatcacacggatccaatgtctaaaattttgttgttttaatagttagtcttaatttaagaattgcttcgtgattttctccgtgttgcgcgtgattgtgcccattttgcggacgttttggtgcagaaactgacggaccatttgcatgcgttgggtgaacacgctgaagaggaggaagagaatgccgttgagggacaggtgaggagctaagttcaagaaatttgattttgaagaaatccaaacttgaaaaaatttgccaaaacctggcatgactgctattgtcagagatgccattcttacacccgagacttgcgtttttatgtgccatttcagttgatccctgacgagcaactgtttgctgttgacacggagggcgatgatgatcagcaacagaagcacaatgccgaggacgatgacatggaggagaacgaggcggaggaagggacgaaacagggcatcagtggtggcaacaaaacggacaacaatggcattggcatcgccacaaaaagcactggcgatggtggtggtggcggcaacaacagtgtgctggacggattcaacccggacgatcccgagcttaaactggttggtcttctgttctcacaatactagcagaactattctcttggagggagtctaatcgttcatgaccatgcctgtgaattagaaaaattaaaaaaaaatttagttgggggatgcaatttgccagcaccatcagagacgctcattcaagagtcccaaattttcaagactatggcctcctagccacaccaacagtcatattagaaaaaactccaattatcatgattggttcagaatttccttttaaaaattttgctttattgggggtggggttatccctttcccctgccattgttcaaaatgttgagacaaaaaaaatgcctcccgaaattgttagtaaattatttccccaaattgctcacagctgttgtcgcgggcaaca

SEQ ID NO: 18573 - DNA, 1921 bp, Heterodera glycines
cattcgctcattcatccacggaaacttgaagaaaggtgctttggttgtcaaaccctattagagcaaaaatagattttttcattacatagtaaaggaatatgcaaaatcaaatcattcgttatggttgggctaattgtaaggatatcaaataatcggcatcctcccattacatattttaaatacaatagaaaatgcatttaatccgttttgttctttcagctcctatttggcttcgtttcatttgcaaagatgggactgagtcggacacttactatttccgaggcggtggttatgaatcgcttgtgaattgtttgcaaaggtataatcgtaaaacattacgttcaatgtttttatccttcattattttgtagatacgtttttcttactcgttcggccaagtcagacaatctcattttgatttcggacagtcgcaccgatgccttggagaaatcagtgggcatgctcaacttagacaaaaaggacatcgtttcggttatttttctttttttaattttttgaggaagttcagttgggttttcatttaggttatctttacagtaatagttagcattaatctgtatatttagcggtttttctcaaatccttatgcaacgacaatgactttggcctccaaagtcacctcttcccttgcaccactacttgatcctgaggcggttatcagtgaaaatcagctccgagttctaagccaacagcaacctgctgcagacgaagacgaaagttccaaattgaggtgaaggctctgtttttttgaagcagttcgcgctcccctctcaattataatgaatattggtccgaggggtgggggaaacgtagtacattcctgttttttaatttactaatcttagacaattttgtgactctgggtttgaacacatcttccaattggatttgccacatcgtccacaaattttacaccgtgatccgcctgttgataagactattttcgacaaattccgatcactttctgggaatgatggacgaattttggactcgcatggattgaaaagtctgatttttcgcggtgggatttctccagaaatgcgaccgattttgtggaagtatatgctgggtttctttaaatgggatcgttccgacgccgaaaatgaacacgtattaatttcatattttttaaatattccaattcactgtttagcatcgaaaaaaattagaggaggactattacagaatgaagttgcaatggatgagcatcggcgaagaccaggaaagtcgatttggcgcatttcgagacagaaaagcccttgtcggtgagatgcattcgcttttgtcaattactttttgacttcactcatgccatcgcatttcagaaaaggatgttgcccgcaccgatcgatctcatccgttttttagcagaacaaaccctgaaaatttgcatttgctccgagacttgctcatgacttattgcatgtacgactttgaccttggtcagtttggttatccttcgttaccgtatttaattgttgtttttaggatacgttcaaggaatgagcgactttctcagtgttttgtgcgttgttttggagagggaagtcgacattttctggtgttttgtcggtctcatggaatttgtggtcagttttaatttgacattactgtaatcagtttaagaaacgtcttatagcacaaaaactttgaattggaccaagtgcacatcaaacagcaattgtccaatctgaaaagtcttgtcgaaattgtcaatccacgactggccaattatttaggtaattattgtctcattttgttttgctgtacccaattctcaacagaaagtcacgattctgaccatatgtatttctgtttccgctggattttggtggcttttaaacgcgatattgaactaaaaggacacgcaatatttgtgggaggtgctttggactgggat

SEQ ID NO: 18574 - DNA, 366 bp, Heterodera glycines
  misc_feature (71)..(71): n is a, c, g, or t
attcacacacatataattttcctcgtgataaacgagtctctcactagaggggacttttcctcccgtggggnattcctccccttttctctcccctctttcctctccctccctctctcccctatttcctctctctctaaaggctggttcgtttgttcattgggcaccttttcattagcgtgcgtctttctttttatatattgcgctgcgcgtaagctttcgctcgcgtcgaaatgtctccgctctcccctccttgtcccaataaaaccccctctctcccccgtttctcgtcgtctgtgcttgtcgtctttgccccgcgtgagcggcaaaagaaaatcctccccattttcacagttttcactgtttctg

SEQ ID NO: 18575 - DNA, 1787 bp, Heterodera glycines
taaaagatgtacagtgttgtgtggctaatcaaagctgctccataaaaagtcatatcctttttcaccattcactcatttaaacctacacattttttggcgtccaattttaaattaaaaaaaaagtaataaaaaagtcaaaaacaattgtaccggtggaaattaattggacataaataccacccaaatgtaccacaattgaaacacttttataaaattaactttctactagtacgaatctctgcgcgttttaatgtttttttttgttgtcaaaataagccccggaaaggaagaatttcatcatttacattggcaaaacaaaggcaaaacatttgtgcaaatatttagcgacaaatttattacaatgataaattgcgcttttcctacaaaccttataaaaaaacaacctaaattaggtagatactttgtggttttttgaccaacttcagtgatattttgtgtgccttttccatcagataattatggcccgttttcgtattttttcgtttaacacagtcagaaatttcattgaccttcttaaacaattaattggaaagtgtgctaccccttaaaatcgttcacattttacccattgtccatttgcaaatatgcaaatttttgcctaaacaaaaacccgtgctgggaatgtgaaaaatttcggcggtcccttcgcgtgcgtcccaccagacaacacacccacccgttttttcttattttttggctttgcataattctttattctcactaaataaacaaatacacaataaaatgcaattttgcacattaatcaaatgcaaaatatattgctttatttcaaagtttaagaaaatgcttattaaaaatagttttagactaatcattcgcgtgtttttcattgtgactctatctttagattattgaacatttcttgttgtgtacatttcaccgattgcctttgtcgaagaaatgtccgatgctgaaacgtccattgccgaactgcccgtacccaaagtaattgcacacagagtttactggtacaacaccaaacttaactcaaagcttccgggccaaattttcaaacgctatttttctgcttaatttgtttttgctaatttcgttgtttcttctttagttgaacggcagcaactctgccaccagcggcagtgacggcgaagtgccgtcctcgtccgcgtccaaagttatgcctccgaacactcacagtcaaccgcctcagcagcaccaccacgtcactccgtcacagcccatgccggtgccgatctcttacgcggcgagtgccgcagacttttccacgatggtcggtacgcccgagttcatccaggtttgagtttgtttttaaagtcagtgcgaaataagaaatggctttgcctttttgttttcttttcccatttttgtctaaatttaagtagggtcaagtttttcatatattattgtgtgcacataaaaagacatcttttaaattttgtgggcattccattcctaatttcgtttatctttcctaacgcctttatttcctcgccaggatttgctttacacacccaccggcagcgccaacggtggtccgtccgcgccggcggcggtgttcggctccacgcccaccaacaattacgggttcggctcgttcggttcggtgtatccgccgccatcattggcagcgcatccaccgctttcgcatcaccaacacaatggcacagccacgggagatccattggaacaccatcaccaccgcatcatccatggcacgccgccgtaaacagccgctgcagcagcgtatgcaacttttgttttatgaa

SEQ ID NO: 18576 - DNA, 2157 bp, Heterodera glycines
  misc_feature (2146)..(2146): n is a, c, g, or t
aaatgctcaaaaatggcttttacaaattccatttttatttttcgcgtcgccattttctcctttcttttcacttttaattttgccgctgcgacgcaaaagcgaaaaaaagacggcacctttttttggcggcataatttaactgagaagcacttgacaaagtgccaagagagaattcatgtgggttttggcttggacatggtcaatcccgagacaccaattccctcccgtctcgccatttcactgccccccctcttcagttcccctgcttttgctcctttgcatcatcagcagcgggtgaatccgtcgtcagtttggcattgtcagtgcgttgttcgggtgccaattcattggagcacattttgtccgcgcttggcccattgtcgcgatggccaaacgcgcggttggacctcttccgaatggagcactcgccaatgcccgtggtcagtcggtagtgccaatgtgccaaatgccaaagtgtccgtcgtctttcagctttacctcgactctctgcgcgtgctgcccccaattcggcgtcttcagttacacaacaattccctggcacaccttctgctccaccaccgtccgctcaattcggctcagcgacaaaccaatggcatttttgacactttggaggaattggccatcacttccaacgaattggcgaattttgggtacttttcttccgcaattgccccgctccgatcactccgatcgctttcattgagtgccaatcggctaagggaagtgccggcccacatttttcttcactttcactcgcgcaatttaatcgaaaagtaagtgaatcataatgaaaagaatatcggtttatttttaaaaattaattttttgtttttttaattaccccccccccccctccaaagtttggatttgagtgccaattccctgcacgacaattccattccgccagaagcctttcttggtctgggctccctgcagaagctgtcattggatagaaatcagttgcaaactgtgccagtgaaggcaatcaatgaattgggcgactcattggaggaacttttccttggaaaaaatcaaatcgatgggttaatgccggcgggggacggattggcattggcacggctaaaaacactcagtttggaagggaacaaagtgagacaaattttgaaaatgatcaatcgctgaacatttcatctgctgattgattgttctcatttctcagatcactgctatcgacggggaattctttcgtggcattccgtcacttttttatttgaatctcagcgacaatcgcttctccgccgtcacttctcaaatgtttgcatttataagaaggttgaaagtgttggaaatgaataggaacccgatcagccgattggacgcgcaaagtaaggccaaatgatcagacaaagagaggcggagggagggctgatcagatgaaaggaaaaattattggaccaaagggcaatcattgatcagagtgatcgatgcggggtagggactgatcagataaactgaagacaagcaaaatgagcaaactgaaatagtttgtgtttttagtgactgatcgtacatctgacaatttagtccacttcaatgcctttggggccgatcgattcattttttaatttgcttaaaaattagcatttcaattggttccttctcttctgcgattggaactcgcgcaatgtcacattttgcaaatcgacgccgacactttcggcaccgtgccaaaattgcaattcattcatttgggaggcaacagaatgagcaggtaaagtatttgatcaacagaacggaaaaatattaatgccataaaatatggaaacatattggggaaatttaaaatttaattactgaccaatgaaaatgcccaatcagcaaaatttataattttattttattagtgtcaaaataaaagaaaacttaattgtttatttaagcatcgaatggcatcattttgcagggaaattgccctttttggtgtcgttggatctcagcaacaatttggtcagtcaaatgatgaaatggcccattttgttctctcgcttgtccttttcttgtcaatccctctttccctttgatcagtgccctttcattctcagatcagtcacactgatcagttcgcatttgccaattttggccccacttcagtcgctgaatttgngcggaatcgca

SEQ ID NO: 18577 - DNA, 1075 bp, Heterodera glycines
ttacattttgaagtccttcggaaattaggtgcttgtgcaggttgtgcactagatgaaaaaggcaccctagaagttgtgcgcccggaaagactgctgccgccgcgtccatcgccgcttgttcgaagtccattgtgatggacgctggtgaaaatgctggccatgcttcgacaatcatccgaaacattcgctcgtaaatcagacgagattttcccgtcagaaggcatgtggcaaccgggaaagtccattttccttttctggaattaaattttgtagcacaaattcaaaaaaaaacaaacaaactttgcaagaaggacgtacacttgcgaaaatggatgaggtgcaatggaaaatgttccatctgcgaacacttcagtcattgcatgcgcccaatttgcgtaagagttcttggcaaaaatcagaatcctgaatttaagggagttcaaaattttcatatactaaattggtactggtgttgtgattcgccattgggtgaaaaaacgccagaatcagatagtatgggcggcggcgagaaagcacgcggcgagttggcccggcggcgagtttctcgcggcgagatggccgcggcgagttggccgcgacgaagtgaccccgaccccgaatctgacattcactttgaccaatttcgaatcccggatcggaacgcgaacaaaaagtaaaaaattcaaaattttcgaaattcacttttatgtttcgtatctgtacataatgaccattttttgatgttggaatgatttttgactaaatttagtttattttggtcaatttaggaacaaaagaaagaaatcgaaaattttgaattttttactctgttcgaattcctgttgtccgggattcgaaattggtcaaaatgaatgtcagattcatgatcagcgaccctgaaaatcccataaaatgtgttttcactacactttagaacagaataaatttttcagaaaaggcgtggtaccatctaaactatattacccgttggtcttctacacatcgtcaaatggacaaaaaaaaagttcatttacatcattagccttgttttatttacctaattttcttcattaat

SEQ ID NO: 18578 - DNA, 638 bp, Heterodera glycines
cgaaatgaccctacccctctaaactgcataagagccgattttttttctgaaaatttcccgatttcaagccatttaagggttttctcactttggtgcaattgacttttttgatcaaaacaaaaagtttgattacatgaattttctagattcgtttattgccctacaaaaaaagttacctgtcttcaaagttttgaccttataatttcttaacggagcatatcatttcgtttttgccaaaatgcaattggcctttgaggtacataattcttttctttttgcatgatcaaagtcaaaaatttatttagccgtatctatctttccaatgtgttgggtcgcttcaggatcaccgagcccgattggaaaatatcggggctgacattctctctgctatccgcgcccttcgacgcaacggtatcggccttctaattaccatcatcaatgtcttgttcagcattgtcttttcgttgcattcatcgactgtggctacgacactcgtcatcatgatgccctggtttagattttagttttattttgacgatttgtatcgcattttttagaagttttctgtgacatcactcgaccaagtcacaacaatcaccaaacatgttctacggtgacaggaaaaatgaataggcatg

SEQ ID NO: 18579 - DNA, 2249 bp, Heterodera glycines
aatgtccctgcgtcataatgtccctgcgtcataatgtccccgcgtcataatatccccgcatcataatgtccctgcgtcataatatccccgcatcataatgtccccatgtcataatatccccgtgtcataatgtccttgcgtcataatgtccccgcgtcataatgtccccgcatcataatatccccgtgtcataatgtccctgcgtcataatgtccctgcgtcataatgtccctgcgtcataatgtccccgcgtcataatatccccgcatcataatacccccgcatcataatgtccccatgtcataatatccccgtgtcataatgtccctgcgtcataatgtccccgcgtcataatgtccctgcgtcataatgtccccgcgtcataatatccccgcatcataatgtccctgcgtcataatgtccccgcgtcataatttcccccaagctaaaatcagtcaaaatgtccccaattaatagggctgctaattttaggtaagaaaaatcgcagaataggtactaaaaaggttaaaaaatatatcaaaataggcatcaaataggtataaaaattccaaaataggtaaataaaaatttttattaacgattttttagtggaaaaaagcaaacaaagagcgaaaattttggttctacatatctctttgtaaacgaaaatttaaatatattaatattttcttagataatattgacattttaaattaaaaattttgtcaatagaaaaaaaaaaaattttgggataaatttttgagaaatttttccaattcttagggtgcatttttgaaattttttttggtcgattcttatgggtatattttttgattttattgcatttttgttaagaattttttgaaaatccttaaaataggtaacaaaaatgccgaaataggtataaaaataggtacctaggtaataggtagaaaaatcccgaaataggtaaaaataagtattataaaagtgggtgtagaagctccaaaccaagctaaaaactcgtttttcgcgcctatctacgtgtattaagtgtgcaaaaattttaggtatttacctaaaattagcagccctaccaattaaaattggagaaaaaatcgaaaattacataattttaaggttcaaaaatacgaaatacattagaaaatttatcaaaatcatattaaaaaaaacaataaaacgtggtaaagacaaagaatatttccaattaattgaaaggataacaaaaaacagaaatgtacaaattttaaaggacatgcacggttgaagctaatttttcatggtcctttatttttcgtgggtgtccttcgatatgatgacgaagagggcaataaatttcggcatcgtttttgtctccgacaaaacgcttaaaacacaaataactgaaaaaattacagatgtaattgtttaaacatacatagaaagtttgtgtgctgcgaatgaacatcctcatggctggcgatgccttgaacttgccgtccaaatgccaagttccactatttttgctcaaaatgtccagtctaaaaaaagaaaatttaaatcacagctcatttgttagtgcgaaaacgaaatccttgcaattaaaaaaaatttccattggcgattaaaaattccctaccttcggaccaaagacaaatgcctctcttctgattatcgtattcttcaaaatcgtcgtcgcggtcgttgttttcgtcgtttggttcatggtttcaagaatttacttcgtttcattgtcgttgttgttcaaaaacatttcgcttacgacttttttttttggataatttcaatctttttacgattaatattgagcctaaatgagtaaattttacaataacaaatagtatgaaaagataaaaatatgtaattttgggttttttcgctaatttcaattggggacattttgactggttttagcttgggggacattatgacgcagggacattatgacgcggggacattatgacgcagggacattttgacgcagggacattttgacagcgcgcctatacatatagagagagagagagagaaagaaaataaaagaaagttataaaaagagggagagaattttatggaataaacttttataatcatatatattcctggtattttttagcatacattatatttacattctttacaacaacaaaaaatattaattcaaaaaagattgtaaatacatgttgagatgaattgcggcaaatattgataattacttaaatttgctaaataatgtaggttttataaat

SEQ ID NO: 18580 - DNA, 675 bp, Heterodera glycines
ttgtctatgactttgggcacttgtacagtttacaccccttagaaatttttttatatttttaaaggaaaaacgtgtttccaaggatattcggggttgctaatcacgaatatgacatccatttgttgacttacgaaggtcctgagctgacgttgacggcttactttcggcggcttgggtcgatgtcccctctccatctgctgttggcgcggcttcggtctgctttggcactgaaaaatgcagtgttttaataaaattaatttaatcaattttctcactttttggtgttgaaccaaccctgcaaccgtgctcctggcgccattccttccgctttcgtcttgcttctgcactagaagcccaaaacggctttggttgatttggcattattaaaaaacaataataaaatttctggtaaatgagttaaatgttcgtccctttcaaaaaaattttctagcttttaaaatttcttcaaattttgtataggcccatatttcgaccccctctatcgaattctcttttgttttttaaaagtttcttttctatctcgagatcggctcttgcatttttacaagggaaattcccaaaaaaaattttaagatttgcaaagttttggcgttttgattactaaataaataataaacttatttgcactgggagcccaaaattgactcgccgtgt

SEQ ID NO: 18581 - DNA, 2011 bp, Heterodera glycines
ttcctccgccctccgtctcgccccactacttgctccgtcttcgcatgcccttttttgttaagttttttttaaaacaattttgtttatcaattattttttggtactgaagtgactgtttttactgagactctgttatccgggtgcagcgatctgactgtattcttaggtttttaaacataactcatcaagagctgtcaaatgatacctaatttgtccaggtttgattattttcggtttaaagtttaagcgatttttgattgcttgatcgttttcagtgcataagaaaacctataaaaatggttttgtgtgtttttgagtctgagccctatggtcaatcaatgtataccaaaatttggtaaaagtcaataacactgacaccactcagtttgacaacatttatatgtcgatcgattcctcaatgaaaagtcgcatgacatcacttttaaggagttataaattttaacaagagttatagcctgagcatgcggtgaccgaacaataagtggggcgtcagacgagcggagggctcctaaggcgtgagaagcccggaacatgcgaacgaacaaccttcagtgttaggtctgtaactctgtttaagttatcgtgtcgcattttttaccacaaattattggaagaaaaaaatctttaaatttttaaaatccatgaaaatatatttccagtggtatttggggtcgctgatcatgaatccagcatctatttcgatcaattcggaattccggacccgaactcgaacaaaaagtcgaaaattcaaacgttcgaattttatatttttggttcaaattttgtttgaatacacggaaacgaagtggaaagtcatcattagggctgggatttttatgttttaacatattttttttttgcagcttagttatggcgagagaagcccaaaaatagcattttctccgaacaatttttgatttagagcgagttataaaaacataaaaacacatattttggcgttttggcacataaaaacatatggcacatatttcggggttttggcacatattttggcatttttgagaaaaatcgtaaaaaaaatacaagaaaatctgaaaatgcaccctaaaaattgactactttacgtttcttaagcatttagaaaatttctttatatatttaaatgcctaaagcagccaaatcaaacgctgtgttaaatcgtcactggatttcaaagttcccggaaggaacttattcaactgatggaaaaattaatccgggactttacaaattgattgatatcgccaaaattttgattggaggtcgggcgaaaattgataaagactgatattaaatatgattttttttttgcgtaaatacacttggtttttccaatttttagcacatatttttgcattttttaacacatatttaggcctttttttggtttttagcacatattttgggtttttttagcacatattttattacatatttcaggatttttagcacataaaaatcccagccctagtcatcattgattcaataaaagatcaaactattttcagaacaaaaatatgaaatttgaaaaatttaaatttcgacttttttttgattttgggtccgggtttcggaattgatcgaaatggatgtcatattcgtgattagcaaccccgaatatccttggaaacacgtttttcctttaaaaatataaaaaaatttctatggggtgtaaactgtacaagtgcccaaagtcatagacaaaatcatatattttgcaaaatctaagctcagattcgtaatcagcgcattttttagcctagaaaatctggggttatgaatattcttgattttgccactagccttccaatatatattaatgaatacattttagggtgctcgggtactcaaagtttgagaaggtcaatccggagatgaaagactatatcgacgaagtcagtgctgaggatgaaagtgaagaggaggagagagatgatgctgagagtgatgaggaggaggaggaggaagaacggaagaaagggagaaagaa

SEQ ID NO: 18582 - DNA, 1855 bp, Heterodera glycines
ataataaaccccccacaaatattattgtggtccaaaaaatcgacattaataatgaccgaagaaaagcatggatttatatttgcaaggcaaaaccaaaccgacggaaattcaaattcaaaaaaatttttgaaaattttttgaattccaaccaaaaaagaggaacagagacagcatcagacagacacagcagacgaggcacacaaacggttcagcgtccggcgacacaaaacaccgatgccccgcccggctcatcgactgggctttgctgacgcagcggaggcgccatcgccgcaccaatgctaaattattatttttttacggcacgatacgatgcaattttattaaaaatgccaaatttgagcccccccccagaagattccaaaaagaagcatttttttgaatttcgccagaattttcaaacattccgacaaaagcaatataggtttttcaagtaaataaaattttatgtattttttcagggttcccaagtgtccttatttctaagatttgtccttatttttaggctttcccaaactttttaaatttttatgcttaaatgatttatttcgctgatataaatgctaccaaaactcccaattttcaaaattttttcccgcgggcggcgcctatcgagcaccgccgagccccaaaaacttctttttaaaaaattggctcaaaatcataagaattggtaatttttggtgaaaatctgttaacaaataatgtaattgcccaaaatgccttaaagaacagtcacaattttacaattatctgaaatttttttgctaagtcacaaaatttgtataatttttgggcaaaatctgttaacaattttggaaaaaagcgacgcaaaaaagtgcatatgcggcaaaatgagaaaaatggtctgcggaaaaaaaaattcaattgtttcacgctaaaaaatgttgttttatgtcggttttcatgtattttattgcgtttccttcgcgctactattagttgtagaaaaaaatcttatttttggggtcaaaatcttagttttagcctcgtttgtccttattttgaaagacaaaaacttgggaactctgatttttttgtttatttttctcatatttcacatgattttaaggctcggaatcggatggttttgttttgatgaattgattaaaatgtcagaattggtcaaataaatattaaatgagtggtaaatggtgaacctgaaatggcccctttttccgctgttggcgacgattccttccgtttccttcgctttgaggccattctcttttctgttcccttatttgttctcattttagacaattttttatgtatttaattttttgttacccctgaaaattgatattattgaaatttatttattgtcacattgtcagacatgaggacatgactcggaaaatatcattattaaaataaaatttaaaaaataaacaaacactatgccatatttataaattttttgaactaaaaaacggtggacgatcattttgtcactgatcgtttcgtcactgacaaatgagaaaaaaattttaaaaaatttcaataaatattgaaaataattgccatttgctttctcgcaaattgcggacttaagtcatcgttttattttttaaatgactgatatacttaatttcttatttctctctctttctctctcttatcctctgatcattttgttcgcccatcaatgtcatcccaatcgagactctttataagtagggttcggaattatatggaaatccatattttttcctggttgtgggaggcctgaaacgcacgaaaaacatatttttagcttggtttgcagcttctagtatggagttctatatccatattttccatatttcgcgattta

SEQ ID NO: 18583 - DNA, 1993 bp, Heterodera glycines
aaaatgaatcgacggtaaggaatttttttaattcaataaattttcatttatccacccatttttacgaatttcagttggatttgtagcgacgtgtggatggatattctcccatcttttgaccatgctcaacttggactcaaaatggcattgctttccgaccgtttcgatgttttggtggacaaacattttgatggaaaagcaacggaattgacattttggagaattatcagaattggaaaggaaaatggaccaaatgcaaacgataatggaccaaaaccgaaactgtctgtactgatcgatgacaaatgggtggcatttccattgccggaccattcgctggctttatatagagtaatttgaactttggatatattaaagcattttaataatttgtgatgatggaccaaatgcaactgctgaccaagtgttgtcaaaatggttgcacacaccgggaaaagatggccaaccgaagcgattgtttcgcaataattattttggtccactgaatctcgaatgggtcaacgacttcaaagaggtggtccgttccgccatattttgttttatcaattttttgtttagacatttctccgttccatcacttctgtcagttacacaattcgatttcatttattttcgaacacaatgccaattgagccatttgaattggtgaacaaacggactaatgagaagctgacattgatgaaggatgaaaatgacgatggaaaattcaaggattggctgttgaagcggtgcccaattattggggagacgatggcggttcagcatgaccaaaatttggaccattcaaacagattcttcagtctttgtggtgccattgggtaagcagaaaggaggccttatttttgtataaagcacagacggacaaggacagtatcccctgtacagtactttctcagaatcttcatggcaggccggcaggggttccaattaaaacgggacttaagtccttgtcttgtccctcccgttctggtccatctcggaaaccctggtcctctctggttcgagtttttttcttcaaatttcgagctctactttcacaaaaagtgttctcatccaattcaaattttggcttaatttaggccgatgtctctaccaccaacagatcaaagcgatgaaaaagtgttctcgactcccgggccaagtgatcagcagaagaaggaaaagtgatcatttttgagcaatgtcctgatcaaaagaaaaggctattgatgaatcatgttaattgatgatattttgttgctctttgaactgtcaaatttaaggctaattgtgaacgcatagaaatctttgattgcttaatcgttttcatcgcataagaaaacgtacaaaagtggttgttttgtatgttttttgagtctgggtcctatgattaatatttaccgaaaattggtttttttgacgaaaaaattctaaaatttgctttgaaaattcaaatcctttttgaaattatcttttttttttgttgccggtagcaaatgccaacgttttttctcattcactttgtatttattaaattttgccgattcgactgtccatcatcatcatcatcatccatccaaattcaagagattactaagtttacctctttgccttaccccaattgttccacaatttgtgcttttcctttgccccaggctaattgtaagtttttttttgccgataatcgcctcaaatcggcgaaatgcactttcattcctcttctttccactttttatcattcaatatttttaagtgccttggtattaccttccgaaaaattgcgacatcagacggtcgctattgcgctccgtttcttaattttgttgggcttggacgggcgctttgcaccgcgatttaaattttgttggggtcaaacgggcgcttcgcgcccgtttctaaattttgtggggaacattcggccgcttcgcggcctcagaacggggcttcgcgcttaatggtaattctatggggaacattcggccgcttcgcggca

SEQ ID NO: 18584 - DNA, 1735 bp, Heterodera glycines
gctaataacaacaacaacaacgcatttcgaacacttccggccatttggagtgtgcgtcgacgatgatcagatacatctttccaaagaagggaccggcgtagtccatgaggacacgtttccatggcccttcggcttttggccaagaatgtagctccgttttctttggcgccttcgcttcggtgacacacggctcacattttctcaacacttcttcgatttgttggtcaattcctggccagtaaacatgctggcgggcgaggcttttcatgcgcttcatgcccgggtgtccacgatgtagcattttaagcacttccgtctgcagcgatgcagggacgacaatccggtcggcgtacatgatgcatccgttttcgaatgacagcgcttctcgccttcgatggaattgtaaaatgtcatctgacatatccattttgtttggccattggttcatgatgaatcccttcacttcctgaagcaaattatcggctttagtggcattgacaatgtcctcgtggacaattggaaattgtgccgtaaaggcattcacagttgccaaattagggctttccgttattgttgccacaataaattcatcttcgggcactggcgcttttgcaattaagcgcgaaagagcatcggcttgaccaaaatcggcagtgttttggtattcgatctcaaaatcatacgccaaaagtatgagtgcccagcgctgtaagcgatttgctgtacacgctttaatgccctttttgttaccaaaaatggtcaacaatggcttatggtcggtttgcaggacgaagtgtcttccgaaaagatatttgtggaacttctgaactgcaaagacaagagctaatccctctttttcgatttgggagtagttcatttcggcaggcgacaaagagcaagaagcatgtgcaattgctttcaagctgccatccggaaaacgatgggagatcactgctccgattccataattagaggcatcggcagatacaatgatgtccttttccgggtcgtaatgggtcaagagttggtccgacttcagcacttcgatcattttgttgaaggcattttgacagtccgttgaccagacccacgaaacatcctgtttcagcagttcatccaacggttgtcgaagaaatcgcatattcttcacaaactgctggtaatgattgatcattccctagaatgatcgaagctcagaaacattggtagggacgggcatttctgcaatcgccttaatcttcgatggatccggtcgtcttccatttttgtcgatgacgaacccgagatatttaatctgtctctgattgaaagagcacttttcgggtttaatccgaaattcaaaatttccgattcgcttgaaaacttcatacaaatgtttttgatgctcctcatgtgaacaactgaccacaatcatgtcgttaaggtaagcaaacgcgaatggacaatcggccaaaatcgaatccatgatagattggaaaattcctggcgctgattttaccccaaatggttagcgcaaaaattggaaatttcctctgtgtgtggcgattgtacacaattctttggacttcttgttgtccaattcaacctggagatacgcatcctttaggtcgatttgagaaaaatttgcctccattcaattttcgtgaagatgtcttcgggcaacggcaaatgagctgattcaaacagcaatgcgttgttcaagcccgttgaaaaatctacacaaacgcgtgctgct

SEQ ID NO: 18585 - DNA, 2049 bp, Heterodera glycines
tttttcattttatgaaaatttgcttctgtacgattttccttaagcgaatcgattttaaataataaatgaaaaaatatattaattattaactattttcaaataaattattcaattcaaatatggtaaatttataatataataatccaaatattaaactttaaaatacaaataactcaaaaataatacataaaactaaagatgcacacgttatcaaatcaaaatatacattaatactaaaatttttaattaaacaaattatcaacaatttattgtttgaatgttaatttttataattctcttaaataggccaatattagaaatcatccgtgcccacaacaatcaaacagttgtgactgtggttacacggaaacaaattataagccatcaatactgcaaaaagaggtgttaaaagtgaagaagtatttctaaaattcaataagaaaattaaatcgaaaaacatgaaattgatattttcttaaaataaaaacgaaattttgatatcggactaatagaatgtcaagctctgaattaatttcgaaggaataatatcaatcaatttaatcttacgcacaatttttttaatcgtttatgtttaaaaaaaattataaaaagctctgcaataaaagaattgcattttaaagataactaagaaacctattttataagtaatttctctaaatacactaaagaatctaatatataataaaaattggtttaaattacagctggttaagagaaactataaaaaatttaaaaaaaaagatttaaaaagttaaatttcaagaaacagtaaaaaaattgaaaaacttgtgctgatttttatttttaaaaatgtttgtaaaatattattgaaattaaaaacaattcttttatacaaaaaagattttccctgtcgaactgaacaaaataatctaaaaaattaattgtacaaacatatgaaatataaataactaaatcccttataactttaaaaaatgtttataaattagaaactaattaagaaaatagccgaaataaatacaaaatacataatgaaactcatattatgcatgaacatgtgcaatcacttgccttcgttttgctaattttacactaatccttaaattatcaagttagttaaaagatacaaatatattttatataaataacaatctaaaattctaaaaaatttaaccaattcaaaacaaatatgtgctatttacataattttcattaaataaataacgataaaaaaatttagtccgcgttaataaatattatcaattacaactaagtgaggaattttcaacggtggctggtaatttcgacactgggtaaattcgacactgagtattttcgacactaagtaatttcgacactacgttttcgacatagagaaatttcgacactgaactatttcaaaaactttcactgttttcctgcattttcgacactggaccatttcgacagtgagtaaattcgacactattgagaatttttaaaaattaataagaaattttggtgttagtattaggtatgataaattttcctatttcattttctaattcgtactttttaaaaggttaggttggtataactgagtaaaacgtcaaacccagtgtcagtgttagacaatgactcataatgccaaatagcgatattttggggcgataattcaaaaaaacctgatcagtcagtgatcactgatcattgcaatttttaattgatttcaaagcgctttgtagggcttctagggcccgaaaaccgaaaatcaccctaaaacatgttttcatgacttttgaagacggaactgacccgcttcgacccattccacggtcggggtcgttttcgcgtggccgttttcgcgtgagggccgttttcgcgtggccattttcgcgtgagggccatttttgcaaaattttttaattaatgttataaaaatccagaattttgggactcaagattcccccccccccgaaatgaaaattttttaaaaattttcttccaattcgtcccccaaaacgaaactacaatatttatgggaacttttttgaaaattggcaattttcg

SEQ ID NO: 18586 - DNA, 1221 bp, Heterodera glycines
aaaaaagagatagccattttctggaatatctattaaatataaaattattgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctgggatatctattaaatataaaaaattatttgaaaaataaaaatggccatggcgcactgcacttcgtt

SEQ ID NO: 18587 - DNA, 1225 bp, Heterodera glycines
  misc_feature (56)..(56): n is a, c, g, or t
accgagaagtagtattttaagttttttgtgttatctatcaagatggtttgataaangagagaggggaggagagaacctttaaagttaaatattaaaaaaatattaaattaattaattaacaagaaaaataatgctaaagaagcaaattttgtttttcgtcaacaaagagttatacaatgttaacaattgctcaatctatgaatttattacaaaaaacaaaggtttcttgtaaaatttcaaatgggcagacatttaacaaacgagcgttttaataaaaacaaaagcagatcaatcttattcaaaaataaaaggtaaacattaataaataataaatttaagaaatattttcaattaaaagaaaaacagaaaaatttaaaatatggtgcttctttaaatatttgaactttctatcagtatttaatattttaatattatactctattttttctaccatttaatttgaagatcaatctaatctccgcaaaattgaccagaaaaataagaaaataaaaataaattcacaagttacattaaaaaaaacatagttttaattttgatattattcaatattttaagtattgtgaagtaaaaacgacatggtaaatttagctgaaagatgcaaataaagaatattaatattaagatttttactgactttgaaatggaagaattttaatttaaaaaatataataaaattaaaaattttccaatgaaagcctacgaggacttgcgcaaaaaaaaccatgagaaaaagtcaattaattaaggaacaagccagggtcaaattttggaactcaaatttgtcacacactaaaagataagaacaatgtcatatcaaattatgaccaaagatatgaaaaaaggaggatattctttaatgatcaagaaaatataattattgtacaattaaaaactctcaacagtttcaaattatattaaataaaaatttaaacagatcgagtaaaataattaccccccctctctctctctatgattttttatctctctctctctatgctctctctccttttctctctccatctgtctctctccctccctctttctctctttctttctttctgtttgaccccccctctctctttaacgctctctctttctgaccccgctccttactcgctgcattcttagaaaacaaacacaaaatgacgctggctcgccgcaccaatggcatgcctaagcacaccatttggcatcgccccatcta

SEQ ID NO: 18588 - DNA, 1618 bp, Heterodera glycines
  misc_feature (1492)..(1492): n is a, c, g, or t
  misc_feature (1604)..(1604): n is a, c, g, or t
atttattcactgattgaagttgcaaatgaggtacattttctttctatattttatttgcaaatattgacattttttaaaccaaaaattttgtcaaaaaaaattgggggatgaatttttgagaaaattttccaattcttaggggtatatttttgaaaaaatttaggatgtcttcttaggggtattaactgaaactttttaggtcgattcttagggtttattttttggttttattgcatttttttaaaaattttccaaaaaatgtcgaaatatgaaaagatagtgatttttaactattttatgtgacgaaacgccaaaataatgatttctaatgacgaaagtgaaaaataaacgaaaaaatgtcaacgtagaaatgcgttttttgagcttctttcttcaaaacaattaagcaaaaataatttttttaactaaaagttgctgccctagtaataaactttttaaattttttatggtcattaaaatgtcaagggccttttatattatgtaattagaattattcaaaagaatttagcacatcaaagaaagcttaaaatatgctgtaaggaaaaaagtattatttgtgctaaaaaatgctaaaatagatgccaaaaaattaaaaataccaaaaggtatgtaatagctgccaaaaacaaaattaatgcgaattgcaaaaatatcatcattctttatccatttcggcctcaacttcagattaaaatcttaaaataatttttgatgtaatcttttctattgctcatttaaaattgagtcgtaaacaaaataaaaatgcgaagaaaatatatggttttatctctattctatatgtaaaaaaaggttaaaaccaatatatcaaacagttattatatctaacccattattttaaaaaagcaaataaaaaagcttttaatctgaaagctaaaagagcaaagaaaaagttcaacttatgagaggaaatgcgtttgtctatggaacaagagtagttatctctttaaataaaattcaatgtttaataaaatattattcatttactaaaattcttatgaacatattaaaaacccatttcaaaaatattaaataatattgaaagataattaaagaaattattttcatatcttacaatcatccgacggttcgctcagtcgagagtttataaaaattaaaagacgtaattgaaataagatgaattcataaaaatatgaaacacttttataattaatgtaaatgaaacatacagaaaataaataataattaattcaaatagccctaaaacattaaatttctgcacgaaacctagataaaaaaaatactatgaagctgaaatagaaatggcattgtgttcaaaagaaaccacttcttatattgaaatcataaaacacctaaaatggtatttaaattaataatgaaaattaaaagcatatatgaaaagaaacaaaaaaacgaaagcctatgcaagcgaaacaaaatggtatatatttcttaaaaaaaggatgcttanattttctttaattatctcatatgctaataaattagttcaaaccgagcaattaagcggaaaaatgggactacaagaataatttatttcaaaataaatttgtataaatattaanaatgatgaaatata

SEQ ID NO: 18589 - DNA, 1122 bp, Heterodera glycines
aaagagatagtgtagacagagggtcaaaggaatattgtaggcagaaggccaaagagatagtgtagacagagggtcaaaggaatattgtaggcaaaaggccaaaggaatactgtagccagagagtcaaaggaatattgtaggcaaaaggccaaaggaatactgtagccagagagtcaaaggaatattgtaggcagaaggccaaagagatagtgtagacagagggtcaaaggaatattgtaggcagaaggccaaagagatagtgtagacagagggtcaaaggaatattgtaggcaaaaggccaaaggaatactgtagccagagagtcaaaggaatattgtaggcagaaggccaaagagatagtgtagacagagggtcaaaggaatattgtaggcaaaaggccaaaggaatactgtagccagagagtcaaaggaatattgtaggcagaaggccaaagagatagtgtgggcgaaagctaaagggatactttgagcagaaggcaaaagggatactgtagggaaagggaaacgggccaaaggaaacggaatgttttcagggccaattgtggactgatttggtgagagcgaagcgccaacttgttccttcggcggcaggaagcattgtcaattacggcataaatgggcaaagaaagcggcgtcaggcggagccgcgctgcgattgcattagcaccggtaattgggcgtatttttttacgtgatcacttgttttacaaccaacacgccaatttagcactttgccccgcgggaccgcccggccccccgggcattccgggcgcggatggcgagcctgggagagcgggcgaagcaggcaccgtcggactgcccggaccattaccgcaaattcaaaaaactgttgacgcggagtcttgccgagtgtgcccgccagggcctcccgggcagcctggatatacgggaccacctgggccaccgggagcagttgtaaggacaagctatgattggttattggagaaattatctttttagggcccatctggagagaggggcgttttcggaatgccaggaaatcccggagccatgggacagcccggcgattcgggcaatccgggagaagccgggcaagaggtacaagcgacaacgttaattg

SEQ ID NO: 18590 - DNA, 1081 bp, Heterodera glycines
cctctttctcactctctctctctctcgctctcttactttccttcttgttttcctcactttctctttttttcctttactcttcctcctcttcatcttcatcctcctttccttttcctctctctctttttcctttattcttcatcttcatcctcctttccttttcctctctctctttttcctttattcgtcctcttcatcctcctttccttttcctctctctctttttcctttactcttcctcttcatcctcctctccctttctcctcttcttcgtcgtctccctccccccccatagtcaagactagagttttacaggaccgggactgttactgaaaaaaatgtacaaatgagtacctaagtcccggttttttctcgggtttccctgccaaaaagccccggttttttaacccggaaaatcccggtcccggtttttctcaaaattctcggtcccgtacaaccctagtcaagaccattcaccatgagttatcaaccacatttggcctgtcttggttccgcgcgtggttaagtcgtcgggttgtcctccctccggatggaagacgatgtctgtggctgctcggatttgctatttttgcttttttcacagtccctttcctctccccaaaggtcgcttccttttccgagggtctctttttctctgtccctccgtggcaatgtccgtttcttctgtgctctctctcccccttctcttttgtgtttgtattcttcaaataatcgccacagccgaaacagaagtgcccagtgatccgcccgaattgacaaaaagtgagtgatcggacgacgacgcccttttgatcactcatttgaggaatgttctcttatgccgatctgatgaacaattttggggggccgagcccattggattttgtcagtggcaacagttttttcattttggacgaagaaaggcccaaaagggagggtaagcgaacggagcatcgatcggaggctttcctgatgactcaccttttgtttagacgaagccgtcgaactgctgtccgcttggaagagatcgtcgccctttcagcggggctttctcaacggcgtacagcgcaactatctgacg

SEQ ID NO: 18591 - DNA, 2344 bp, Heterodera glycines
tttagtgaattttccgttttagttaagttaaacaaatgttagtaagctttctctcctcagttttgtacattggtttttctttcagttcactgttcgtgccgagtatcatttttatttcgtggatgagcagggcattgccaaattcagcaacgtgaacactggtgatttcaaagtgaagccatccaaaggctcacactcttggggactgcgcaacattccgcgcacaaaggtgaagagttgcattcgtcccgacttgtcgctgcacatcgtctgccaaatcgaactggtccccgacttcagcaaagtgcaatctcagtgctttcgcaaccgccgttacgatcagtcgcaggtttttaaaatttcattaaattaattcatactttcctttatgtacagttgaccaaggaatatttggaccgcatccaccaaatgtttctgtcgggagagggctcggattgtgtcatcgaatgcggaaatgagcagttccatgtgcacaaatttgtgttgatgacacattccgaagtgtttcgcgctatgttcagtcataaggagacgatggaaagtgtcgagtcgcgcgttcggatcaccgattgtacgcctattgccgtgcatcagatgcttacttacatgtgagtgattggtgatcaatgacgaacttgcagatcagcttattcaatgacgtttattgaaggtattctggtggattgcccgacaaatttgacaacgatcacgcccaggggctcattgaaatctcagagaaatacggacttgagccactcaagattatttgtcaggacaaacttatttctcggtaagtattaaaaacaaataaattcactagtatttagatttttttgaatgcaacgcctctgcaaaattagattataatccaattttttattttaattacctaattaatttcaacaccatttctttttcacttgaattcagcctctctctgtccaatgtgtgctccatgcttatggtggcggacacacacaacgcggacctgctcatgtcggcctgtattcctttggtttgttgcgcttacattgctttatcctcttcaaaatcattttcaaatttaggccagaagtcacatcaaacagttgttgaccagtccggagtggacagaaatgaagaccaattgtcccgcgttggtcaacaccgttcttgaaaggtggtcacttacgagagcacggccattccgccgccgcagaagcgccttcgccttcaggacatgtactgtcgcccgtgatgtcttaagggaggaggggaggggttccttttccatttactaatatttgtgatgtgtgccaagtcaataagacacagacaaaaggcgtagccaaaactcacggaatttaatgcatatatttttgtgactaattaatttgacataaatttccatttggctacgcctattaaaatttgaaattttctacttcaattttctctcgcaatcagtcatttaattgtcttatctggtattttgtttacttttggacatttttgggtgcctaaatttatcaaagaaaattttctaacctttttttaacttggttccaaaaacacattcccttcctcagctgacttaaaattgggaaaacttcaaaaagacgacaagactttctggatagtttcttactgttcagctgatttcgtctcccgccgtgctcttctcatccacgtcataattcactcatccattttgtgcgcctgtacccattgactcacccattgtttggtctttcgacaaatgcgctacctacataaattacaaatatatggatctattcgaacaccaaatatttagatcatttatgtgaattctattctctcctccctctttaccttcgtttgtttattttgtgtgttcatttgcttctattaaatgtgtaacacgcatatgacagcaattccagtccatcacacttattgataattattgtaacatcaatgaattaagaaaaaatgaaatacgaatttacaagccgttatgcatagctatgttaattatccgactattgaaaagcgaaaattaaaaaaagacaaaatttggttgttagttaagagaaaattgcattggaattgtaacaacggaaggatgggcaaattcaatgttcaagcgatgcgttttttggatgcgcaacatttcagaattttaacagccatcgaaatgggcatgaaaaatcacgaattggtcagtttatcagttatttattgtgtgtgttttactccttaaaagagtcgaatgccgggccacgaattctcttacatgggcaaagtcatggataaatgccagcttttgcaggtccctcttccactatctcctcaatatcgg

SEQ ID NO: 18592 - DNA, 2581 bp, Heterodera glycines
tctctctctctcactccttaattacctttgaattaaactaattgttgcctttgggggcggtcccccctttgatttaatccaccattttcccttccattttcccttcttccgactgcgaatttaggaaggatcggtccttcaattgttaaggaattgttagtaaaattgctaccaatttgggaaggttattttaaaggggtgtaaagaatgagttgtgtgttttaaactttgaccgataaagaaatattatggcaaataaacaaacaaaaaaagtataaaagtgattaattcgtttgatcggactcataaaattaaagaaaagcgaaagaaaaacattttttctttgaaaattccctttttcttttcaaattcgcattatttttttaaatcggtttaaaaggaagggatgcgtcacaaaaaacaaaagtgacggcgaagcccccagcaaaagtgccgtggcccaccatcccaccgctttctctcccttcgctttttccaaaacattaatttgttggccttaggtgcttttttcgcacataattcaatttgaaatgtgaaaatgccaatcggaaggtcatgagagccaaaacaaaagtacaaaaagagaaattattgtaataaaacaatctgagaaaaagcaatttcaatttgaaataattaattattaataaaataaaagtgaatccaaaacaaagctaaaaagaacggtaaaagaacagcagattaacgagtgtttttctcagtttatgaattacgtttgataattttaattaaataaacacaaaacaagtgccgtcagattcaatttacgctaatcgccggggcgaaagaaatggcgtcaaattgttttgtccggggaaaagtaaacgtcaaaaggaaataataattgggcaaaattcaattggcaaaggtaaaaatgaccaaaaattccaaatgaaaaaatgtacctattaattacatttgcatattatgtaatttggtgcctatgaaaagggacagtttttggcatttgccattcgccgacattaaatttgaaaatgttttcttttgaatgaattccgtccaatttttacttttccattcttttcatccgtcccttttttgctgccatttaattttcgcgttttgtccaaattccttcgcctttttcccattttcacttccgttccgccaattttagcggcgtcggtgcctgcaaaactttggcacttatgtctttcttttttctgcttaggtatcggtttcattttgtgcgctccgctcgccgtgccattccccgtacaaccggggaaaccccgcggggagtgactgacttttgggtgccatccattgcattaaatacgtctcgtcttttttcttttttgtaatggaataccaaaaacagatttggcactttctctcaaccaatttcggctaaattcacagagtttaacttataatcacacaatttgctttttgcgcttcgtttgccttgggttcgttttgttcatcttccgtcgtcattttcctttgcttttttttgtttttcctttgttttcgttgccatttcgacttcgcttattaattggaatcatttctttccgagttccttttgaattttctttcatcattgagtctttgccacatgctccgattttttggacatttttagcgccatttgaacaatctttgggagacaatggccacggcaccaaaggggggggggcgccggaagttggcaaattggaatttggcaggcgagcgctaaaaggggcatcttttcaaattgggtggcgtaatgttcaaacaatgcgtaagaaaaaacaatgccgatttgtttaaattaaatggaaaagcgttgggaagtgaaaatttgtacattttctcaaagtgtcgccgtcaaatttccattttggccggcggatgtttgcaccagcaaaacaaatccgattgaattttgaggtcatttcgctcgtgccatcatttggtaattggatattgctcaccgccttttgcttcctaatggccctttggcatatttccaccgaatgatggcacatttctttggcatttcttccaaaattgggaggaatttcgatcaaaagatgctgacgcgcaacaaatgcatagtcatttatttatccaatttgtaaagaaaaatgccagcaattccacgggttgaaagacttttaagaggccaatggaccggcggttcagcagaagggacggcaacggccgaggccaaaggatgccaaaggctgaagggaccgtcgcgatggggtcaaaggcatcccaaaattattaaaattcttttttaaaacaattgaaaaatattttatgcattgaaatctgaaagtttcctgatagcctaacttttacaacaaaagtcttacgacgatttgaccaattggtccgatctccttcatattaacaactgtacaccagagaatggaacggattccaacctccgaaattctttaaggcctcggaattccaatcgcttttacaccctaagacaaactgaaaaatcggtgaaaaatttctagaagggttataaaaatttgaggaaaaatgaaaaaaatttaattaggttttaaaattg

SEQ ID NO: 18593 - DNA, 2357 bp, Heterodera glycines
  misc_feature (2313)..(2314): n is a, c, g, or t
ttttttgaaaaatctccaaggatttttgggttccggaaacatacataggtaagttaattaaaatgctgaatccaatcctccaaacttttgtgcccatttaaaaaaagttttccccattatccagggatggtgatgtgccttctctcctacggtgccggcctcgacggcaggcggacacataaaatgacggcactacattttgcggtgtccaagcgaaacttgcagttcacacgcttgctgctctgcatgggcgccgacccgaacttggccaatgcgcacggggacacgccacggcatttggccgccaaattgaacgagtaaatttttttgggtggtggttaaatttacattattcttcgcccaaaaataggaccccaaattccaactctcgtttttatccgcttaaatatgtcaaaattttcagggttgatttgctgaaaagtctgatcaaatgcggtgctcggcgttgtccactcaccaaggtacaaacacaaaaatgttgcactattagtaaaaaaaaaaatttctgccttccaaaattcttttcatgatttaaaattggataaacacatccatatctaacgttttacgaatccacaaatacgcttttttgtattacaaaaatccgtttttccccccgtattttaggttggctgtgtatccggttgtgtcaacgagaaatagacaatactcaaagaatgagaagaagaagaaaataaaagattaattgagaaaaagttaagtaaaaataaagtataaaaaatttttaataaacgatttaaaagtaaaacttttcggaattctataacgaaaaaaaaatacttgaaatttttgccttgtcaaaaaaagcatgcatttttgggccaaaaaatgagtgaaaattttaaataatgtttttcattatcttaacctagaaattttggaataatttctattggactttatagagaacacaatgaacttcaaaatgagtataaagcgacttcatgtggttatagttgaaaatagttataacaaattaaatgtcgtgcaaagacttttggaacaccctgtatttcaaaataatttataaaatattatactaatgaaattagtttcatcgtgtcacaatatttacaaaagaaaaaatatttttattcatatagagaagcaaaaagggaccgaatttagaaaatttacaacaaaaaaactaaaaaaaaaataaatgaataattttaaagaagtttaaaattataattatgtttataaagccatggctttcgtcagagaatgcatcgttttatttgtttcgcaatttaaaaaaaattaagtcattttttaataatttgtaattaaacatgatcaaaaaaagatatttgacattcattaaaagaggcaatattttatatttttgttcatttaagtatgtaaataaaataggtttttaaatgaaaagcgttaaaaagaaatttaaaaataataatgactgtcaaaacaaaaaataatgatcgtttttttcatttataacacaactaactgtaaaataaatgattattttccgtaaaaatttattaaataaaaaactccctttttattttgtatgaaataacaaaggcataaaaacagacaatcaattaaccctggaattaagccaaaaatttgttcgttatatttgattttgtatcacaaagaaacaaaaataactttaattaaaaaatatataattataaattaaaaaatttctaaaattttactatgaaaaattccagaaaatctgtaaataaaaaacgaaggattattttaaattaatttacattatgttttatattttaaaaaattatatattttttaatctatgtttgtttattttaacgcattttttgaaaaaaaaattggcttctaatcaaatggaattaatttaattgtaaaaaaataaatataatatagtgttataaattgaaatacaaaagaaaagcacaatcaaacaacttttaccataatcaagcatttttatcacttttattaataagcttaaaatactacattacaaataagaaatgattaatgaaaaacatttcatcaaactgtggttactcaaagtaacaatctaatttttaaacttttgaattatacattatgaaaattcactgattataaaaataattttcatatttcccaaacttttcctaccggtcatattccattttcgcttaaaattcattaatttcataaacaaaaagataaaatattataagaataaattaaaatgttttgcataattaccatacaatagcgaataattgccttataagtcaatgtttaatattaattctnngaataatacataatgaaaatagagcaaatgcttgagcgcaccc

SEQ ID NO: 18594 - DNA, 2397 bp, Heterodera glycines
atgctcctcttcacgatttttttgaatgccaaagaatcgtttaaatccaaatttacaggacaaaaaaaatcaatatcctacccctgtctctaataatggctaatgctgattcgccgatactaatttctgatgaggaactaagcgacgacgaaatacatttgagaaaattactattgtcggaacaacagcaacaacaactacgtgagcaacaattcaatcccgatcggccctactcgtcgacagtgcattccctgcccatcaaccaggtccaaattgtgaccccagcacaaggacaacagctaaagcgtgaccaacagctagccctgattaatcagaaaataaaagagatggaagccgcaaaaagacaaattgaagaagaagaaactgccgaagaagaagcacgaattttaagagaaaaggcatggaaagcggaagaacagaagaaaaggacaaagagggaattggatgaaaaggtgaagaaaagggaagaagaaaagaaagcggaagaaaaggcaaaaaaagacaaggaggaggtcaaagcggcatttaagaaaattggaatgagtaccgaagtggggggaaaagaagatgaaaacaaaccaaaaaagaaaaaatcgaagaacaacaaaggaaaggacacggaaaatggaaatttgaaggccgaaaaactcaatgatggacatagggaagctaagaaagatgcagaagaaaaggcgacgagagaagcagaagcgaagaaagatgcagaagaaaaggcaagagagaagcagaagcgaagaaagatgcagaagaaaaggcgagagaagcagaagcgaagaaggatgcagaagaaaaggcgagagaagcagaagcgaagaaggatgcagaagaaaaggcgaggagagaagcagaagcaaagaaagatgcagaagaaaaggcgagagaagcagaagcgaagaaagatgcagaagaaaaggcgagagaagcagaagtgaagaaagatgcggaagaaaaggctaacagagaagcagaggagaagagagacgctgaagaaagggcgaagagagaggaagaggaaaaggaagcggcagtagaaacaaaaagagacgcagaagcaacggaaaaaatacacagtgaaaaagaaaaaaagggaaaaagagaagggaatgtctcaatcgatgtggagggcgcaaagaagaaaattatggagacaattagcgaaaaatggacacccaaaattgtgggaagcatttttgacccgcgaggtgaagaattgggggacgattggacgatcaaaaagtgccaagaaaaccgggaaaaagaggaccgactgagagagggaaaaagcgaagagcgaatgaaggcgtggaaggaatggacgcagccaaaaaatcaatgggaaagtggtggcacggcacaaggagggaaaagattttttgagaacacgctgaaatccgcagtgatctcggcgaatgagacacgagccatcccaccggaaggaatgggctggaaacggcatgtaccatgcttccaagcagcgccgcctggccccggcttcaagcgccgacaccacgacgtgagcccaatcagaagaatggacagcacgggacaagggacatcggcggcgagcggaacggaagaaaggatcgtgaaaattcgaaaactgttgctgcaggccgccgacttattgggagaaatggcggacgaattgttcccgtataagaaatagggggacagcaaaaggaatatcaaaataacaaaaaacatatataaacaaaacaaaaaaccaccaaaatcaaacaaaatacaaaaaataattaattacatacattaaccattatttttgctgccccccttttaattgattgcaaatgaaatgtttgggtaaatgactgccctttgccttcagtcattttctctctcccttttcacatctcacacgttaaaatgtctcgccctctctttttctctcattctattttttcgttccatttccttttctttaactctatctctctctctctcttcatctgtctttcgttttcgcttgcctgaggaaatgccaatactcaccaatcacggcggacggcacaacaaagcacggcacaatcaaaattccaaccaccaaaacaacggacatcagaagtgcagcagccatttattcggaatttaaatctacaaaattttgagagaaggaaaagccaaaaagatgaaaaatgacgaaaaagttggatgaacaaaaaatgacggttcgctgctgcacatctgtccaaaaatcctcccatctcttcctattcattattcttcactaatttgcattttcaatttacgcaccattttccacgacaacttttgaatgcaattgaatggaacgccgagagcggcgttcagcagagagcggagaatattgtgcggcaa

SEQ ID NO: 18595 - DNA, 690 bp, Heterodera glycines
  misc_feature (579)..(579): n is a, c, g, or t
aggccgacgcttttcttgttttggcgtattgctgtctccccagtcggaattaaaacttgaggactggcgattatgcgccactggccgaccctgttgcttcttgacgaatgctggttgatcttctgccatgcgaaaagaccggccttgttgcttcttcactggtagtagttggtcctcttcaacgccattttgggcttgtcgattgctcggcatcggtcgactctgttgcttcgtcattggtcgtgtttggtcttcagtcgcctcataatgggcttgtcgaatgctcggcaccggccggccctgttgcttcttcattggtggtgaatggtctggtttgtcttttgccgtcccattttgggggggtcgattgcttggcaccgaccgaccctgttgtttcttcacgggtgatggttggtctggttgatcttctgccgtcccattttgattctgtcgattgcccagcttcactggtgatgggtggtcttctgccgtcccattttgaggctgtcgattgctcgggaccgggcggccctgttgtttattcactagtagtggttggtcatattcaaccgaatttgngggctgctgtcgattgcttggcaccggccgactctgttgtttctggactggtgctggttgatcttcactcgtaactgtagacattggcttgacaaacgatcttttatgaaa

SEQ ID NO: 18596 - DNA, 1131 bp, Heterodera glycines
cgaaagaaaattatgctgtttgatgacccgggaaaggggggggggggtgaactgaatttaaatggccaactgtgcaggaaattgagcatttagtttccgttaatcaaaatctatggagaatgatagcaagagatggttaaaagccaaagccgcttagagaaaggagggataaagaacaaagagaaacgggatttgggaaaggagaagaaaatatttttattcaaactggaacaaagaacgccataaaaaattaaaatacaactgcaaaaataaaatttacaatgtctacctaatttttcgagagcccgaatccgggaaatgggaaaacgaaaggaaagaacggcatggattgcgaacgggaattccgcttttcccaatccctgtaaaaatctcatccgggcaaaaaggacgggaaacgagagaatgggatttccgggttttccgcgggaatcgcattcccaccgggctctaatttttttcacttttctcttgtgacaatgagaaggagttttaaaattttacaatttttagtaaaaaaatttttatgtttgagatgttggaaaaacctattttgtaccgaaattatctttcttcaatctcttccgctctgctaatgagcttccaacgagcacaactacaaaaggttgctgtgcattgtgaagggacaattagaagttgtagcaacagcagcagcagttcatctgatggtttgtcgaagaattttgtattttttccaaaaaaaattttccattttttttgttgacactcatccaacgtcgaagaaaatgccgccatggcaaaaaactgcgaattttgtagacagcgcacagactttcgactattggacagtaaggggtcgggaacagttaaatattacattttgcgagaaaatttttttatagtcggacttacatgaaatcaactcctatcatatgatgttattgtgagaccaggagtgatgctctgatcagacaaatgaacaaacggtcggcaacgccgtcgcccataaatatgctgacaaaatgtaaagaaattaattttcttcccgcccacataacactaaaattaatatatatttaaatttaaaaatttttattaaattttaacatataatgaaaactttgctcattt

SEQ ID NO: 18597 - DNA, 2067 bp, Heterodera glycines
  misc_feature (2012)..(2012): n is a, c, g, or t
  misc_feature (2027)..(2027): n is a, c, g, or t
  misc_feature (2038)..(2038): n is a, c, g, or t
ttttaattaatgatgtacaatgcttttaagcccccccgtgaggcggctcctttttgtgcactattttggtttttaaaaattggatccggatttttgggcttttttaaataaattgggaaaaattcaaaacaaaaaaacttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatcactccctttttgtggagtcgggggcgtttgggccccagtttttgggcccccgcgtttgggcccccgtttttgggccccaagtacagaaaaatttctgtttttcaaaaaatcaatgaaatcctgccggatcctgcacaaaaatcagatttgcggatcctgttgcaggatttgaattcaaaatcttttgccggaccggatccggccggattaatcctgcaaatcctgcattttcaaaaaaacgcaggattgcggattgggatcctgcaaaatcctgcgcaggatccggtcctgctccggtatctaataattaacaaagattttggtgcaaaaccgaacgtgtctgtacgtgttgatgacaaatttgtggcttttccgttgccggaccgtccgctgcccaacaatattcgctttaacggactttacattcagtaattttaaacttgtgtgtgtattaaacagggctctcaactctgctgatttatcagctttttgtctgtgctgattgtgaaacgaacaacgaaaaattcaaatgataaaatgaaaagcgaataattattttaaatattaaaagtaaaataatttaataaaatgtaatatacaaaagcggatctcaaaatcgtggttggtgaagtgcagcgacgcaaattgttcaaagcatcgccaccggcaaacctcaaatgccgaatgtttgtcgcaaaaatgtgccaaatttgacggacaaaaacatcccaattgttctgttttgtgtttgtcgctggcaaacaaagacatattcaattccaatttggtgccatttatgtcccaaatttgcttgttggaacggataaatgtgagcacagaatagtcaatgtagctgaaaatgggaaaaaatgaagaagacagccaaccatattaattggttttttgtataatttttgatttactcaatctgaaggtccttaataaagcggattttgttgggcagcggatggtccggcagcggaaatgctacgcatttgtcatcgatcagtaaaaagacagtctcggttctggtcctttgttcttgcgaattgcgtgcgacacttctccaaattgtcaattccgtttttccatcaaaatgtttgtccaccaaaacatcgaaacggtcggaaagcaatgccatttgagatcaataattaaattaaattgtgtgagctgaaatcattaagaaaacaaaaaaaaagattgcttccgaggtttacagaattcatcactttagctaagaaaatcaccgataacataaaaaagataaaaaagcattttgaaaatcccaatttttgttggtaaacacaaaaaagaagttagttttttcctacttttaagggcacagataatttaggaaaaaaacatattaaatttaaacatcctttaattaatagtaattaattaaataatttttaaaaaaagtgattgcttgtgatgttcacagaattcatcatatacttcacgccatttgctcatttcaccggctgtttctcagtttctctttccgccgctctttcctccaaaattccgtctaaattttcaatttattaaatttaatttgctcatctgatagccaaaaacaatttgagcggacggaataagccaaagcaaaaagaaaattgttataatttcgtgcatttttctataattgatttttanacggctgaaaattgngaagaaattgngaagtgttgtgaccgcacacagcagctca

SEQ ID NO: 18598 - DNA, 2476 bp, Heterodera glycines
  misc_feature (1308)..(1308): n is a, c, g, or t
tcactaaaaatttcttattccattcccgaattttatgcgacatttttgtattttttgggataaagaaaaaatttatggaaatcttaaaataatagatatttaaataaaattttttttattattattattaaattagttaagcttaattagtatatttgttatatagttaaatccttaccaattccagagttcttttttggtttatgctcatggcttttaggtcccattcttccgttattccgcccgtcaagtcggacaagcactcccggattttgccacccacaagttcttgataccctccgtagactttggcatacgccttttctaataacacagaccaaaatacgtcactaaaaaataaattaaataattaaattaatttaatttaatttaatcactcatccggtggacgactataaagtaagcggccatcagttcggcacggaagccggtcatcgattatcacttccgtccaccttccatagtgccagaaatgaaaatggaaaatgcctgaaaatcaggaacaaaaatagacaaaatttctttgcccattataaaaaaatcttctaatattttgtagctcaaaaatccatttctaaatctttggtaaatatatcattgaatttcaagctttttctccctttttattattttaatcttaaaaaataacttattatataatttattttgttttatttatatttccagacacattttttttgtttttttttgccctcaagaagggcaatatttgcttttactgacaaaatattttttttttgcaaaatgtcaaaaaaagatgtatatatgtagtgattaaaaataaaataagttgttcctggaaactttcgcatatttatgtgttgtaaaatggggataacatcatactgtttttaaaatttactaaatttttatgataaattcaggaactttttccaaaatggaaaaggggtgaaatattttttaaaatttttttacatttgcaaacttttctttttacatacataacattttaaaagaaaaaaagaataatgacaaaaaacgaagaaaaattagtaaaatctatggggaaaacgataaaataaaaagataaattgaaaaagtgtgcgtttttctattgtcagcaaattcctataaataccaaaatagtggcaataaaaattaaaagttaattacaaaaattattaaaatgaaaaataattttgctttttcattaaatagagccatgcatatgccatcatcgatacaaaggaattcgtcaattcacgtgaccggcaaatcattgccttattgataaggaatccatgngggcgggccaattggcaaggtggtttctctgaaaactcgttggattggacaacagtaccgactaatattaaaccggcaatgcaaaaaaggctggaggagaacagcggagaattttggtaattaatcagtagagaccggatttttcaccatcaaaaaatgataattaagcacataattcagcataaaaaaatactaaaataagcacaaaatcagcatgaaaatggtaaaattattttaaatgtatttttcaagaaaaaaaaattttggggattaattttcgagaaaattttccatttttaggagtgtattttttgaaattttgaagtccattataggggtgtatttttcgtttttattgttgggagacagtgttttagtcaaaattttataataccaatcaagcaaaaaataagcacgaaaatgctaaattcagcacaaaaattacatgcgcaacattaagcatgaaaatactatttaagcaaaaaccagcatgaaaaagttggaccaagaagcttcaaaccaagttttaaatacttttttcatacttattagcacgccccgggttagcaaaaaatttcagaaaatgctgcaaaatccgggttctagtaatctgtttcacattttaaacttaaattattaaatgctatcattttaccatatttatatgcatttaacaatgttttttaagtcgctagggtttttgggaaaatttgggtttacatttttgtcagtttaataattttttaaatgattttaaaagatcataactttgaaaaagtggtcaggtttaaatttttggaccatatttaaaagagattaggtttatttttttgcaaatgccataaatgtggtaaaatagcaggttacattaaatgtcatcttttgccaattggattttattaaaaaattaaatggaacaatttgctagggtttcattggacgacttgatccgatggtttgcaagaattcatatttgctttttggagccttcggcaatttgggaagtgaataagatgttaccgaacagtaacattcaaaatgaatggggatgcaataatgtatgatggaaaatggacaaaagacacagccaggagggggtccacaaaaccccagcatgtaagttaaaacgggaaaaaaacatttttttttacgaaaaatatgatttttt

SEQ ID NO: 18599 - DNA, 942 bp, Heterodera glycines
  misc_feature (918)..(918): n is a, c, g, or t
ttgaccatcgaagtcgattttgagcgtagtttaagccaacggctccgaaaggactcgtcaatgcgcgcgaacaatcggttcgacttcagttgggtggtcggctgttcgcttgccgaggaaattggtcggtgtgcccgagggaacagtccacgcaaatcgcgcggtctcctggccacccgagcgttatttggtggcgcctttttctttggcgactggtgatttacggtggactcttcctaaagggaaaacattccgtgggttccaatggtcacccgttgttttcattgctccttttcggcccacctgctgcagtgtgtcgtctccgttccgttcgtcctcttcgccctgtgaggcgagcagtgtccgttccgtgtggtacgactgctgccgcgtgtcgtcgtgcccattttccacggtttccattaagaaaacctcctcgtcgtcagcgccaaaatgaaggcgttcatgggaggagcaagcggagcaagacgaaggcggagttgtggcgactgtgaaggcattcacccgctggtggtgctggctgacacgtcttcttgcaagcgcctcgaaattttctgaaaattgatcaagtggaagagtgaaaagacggacgtttttaaattcaaataaaattggtttaaaaaaaataacttgaaaatatgtatttttgagactcgggaatcccgtgcctcgttgttacaataattgaaaatgcgctaaaaacatgccttgttccgactcaaattccaattgttggttataaatcatctcataagatgggttcaccgccatttccacttcaatttgcaattgctcgtttccgtcagttgcatttgtttggtaaaaatgttcagggtgattcacccggtcgagcagttcacgtgtgagtcgtgcgctcaacgccccggaaacgaatgngtcagcctttttttggttgtttat

SEQ ID NO: 18600 - DNA, 2360 bp, Heterodera glycines
  misc_feature (2348)..(2348): n is a, c, g, or t
aaaaaaaaaattgaaaaatttgccataaatagtaaaataaacataaaaaattatctaaaaaatacttactcacaaataaaagttgaatttttttgaccaaatttaagattgtaaaaacggaatttcttgctatttactaatcatttgatttttaatttacaattaagatgaacaatttgcacgagctctaatgtatgttgatgatgatgatgatgatgatacaattacacatggtaataatccaacggcaaatgacgcagcaatggcacaacggatgcaaaaacagctgcaggagcaacaggaagaagcggatgccgaattagctaggcgtttggctgatcaactttagggtaataatttgggctggcaatttttaattactaacaataacaagttattcaaattaataattaattaataaatagtgaagaattaaaaaaaagccaaaatacgaatttaaattctgtgccttcaacaaatcatattaattgtgagtcgatgtgtaaaaagtaaaaagatggggagagagtctggcaaagcaagacaaagcaaaaggatggaatattggtggatggatattattttttttggattgggggggggggggacgagacgaaggaagggagggctgtgcagttgccattggctaatgttgaagagagaaggaaaggaaggcttaaatggaataaattaagcgatggctaatcaaagccaagcacaacattgacaaaacgccgtcatttaaattattggatgctgaaagtggccatcccaacaaaaatttaaattttacaatttttagcatattttttattttctaaaaaacatcgtccccatatggccggtggaacaactttgcaactctcttcacaacaagcctggtcacagcgcgcactgaatttgttgttttgtgccagtggaataataatttgttatggcgcatttagtgtttttcaggaaaaaatgtgggacctttcaaaaacgtaaaataataaagacttttcattcattcagcacccaaaggctttttggtgaaaagaaggagcgttttgtgtacatgcaagccttagtgttcttccaatgtgccaccaatttggttggcttttgtttaacaattacttgctgattcgcttctccttgtttagcttgttgcttggtatgttttgagaagaaataaacagaaatcgctggacaatgtgccgattcacttgtactcaatgtgctcaaccagctacttcctggccatgctcttcagcagttacgccttggaatgggtcaattacccgacccaagtcagtcactcccctcccattgaactgttccattttcgaatctctgcaggtccttggcaagtcgtgcaaacccatccccatcatgctgttcggtgtcctttttgctcacaaacggtacggacttcgcaaatacttttacgtgcttctcatcgtcaccggaatggccatctttttgtacaaaccccagaagggcagtgtcggctttcagtttggcagtggcgaattgtttctgtgtctgtcgttggcaatggacggattcactggcgccgtccaaggtgccctcctttccttccccacaaatgcatttctcacccccctttttcagacagaattcgccattaccacaccaccgacaaatggaccatgatgttctcgatgaacgccttctcttccgccttcctcgccttaattcttctcgccagcggcgaactctttcagtttttccgattcgtcgccgcttaccctttcattcttcagcaaatgcttctcttctcgctgtccggtgcggttggccaggtcctctcgtcccatcccttttttccattctcctttaattaatttgctcgttttcagtgttttatcttcaaaacggtcaccgatttcggccctctcacctgttccatcatcacaactcttcgaaaactcttcagtctcgttttttcgatcatcatcttttcccacccttacacaaatcgacacgtgctcggcattatttttgtgtttgccgcgttgattttggatgccattgacagtcggaaaagccatggaaaagcaaaaggggacgaaaagccaccagcaaaggacgggcttctccaagaagcgactgcgcaggagaaagaaaactgatgaatttacctcatcatccaccgattgaccaatcggacaaattttaaactctggggaaactgtttagtctgtttttatatttcagtaaattaatttgatggatttctaaattccaaaaactaaccattatgattgtataaacattgttatttgagcttctttggacatgtccaactttctatttattgatttcacgttctttaatttatncggaaatttatt

SEQ ID NO: 18601 - DNA, 1266 bp, Heterodera glycines
ttttatttaagctaattaaatctaaatcagttagaatttggtccttagtttataaaacatatataaagatccttattagaatatgcaacagaaatatgggatcctaagtcagttaatgcacttaacagaatcgaaaattgtcaaaaatactttaccagagtagccctaaaaaaatgtaatctcccttacatttcatataccaaacgtcttgaacttttcaaacttgatagacttgatgttcgtagacaagttattgatttaactacggcttttaaaataattaatagtttttcacatttagaccctaaaaacctttatactttttctaaaagaataaatagattcaattgcaaacaacttgtttctaaacacaaaacaaacaagacaaacattctttcattaacagaacaaccaaattatggaacaaacttaactcagaaattacaacatctccctctataaatatttttaaaaacagagtccttaattgggttaaaacccctaaataccataaaaatatttacattgcatgagaaaattatttaattgttttataattatatattttacaatgttgatgtgactttattttgtgtgatcttttactcctgtattatttgatcttcatctattcatttttgtacctcgagctgcagtgtaagtggcctatgcccttctgtggtagtttttatttcacattaaataaataaatatattatgctggtcagttcatatttttgaagaacgttttaaagaaggataaaaataattattttattttaccgtcactagatatgcatatgtattttaaattttttattgttatgtaaacttctaatatatatatatatatatatatatttatatacataatcatatgagttggcggttttaagaaacgccctggcggttttaagaaacgcccttgcggttttaagaaacgcccaaagtggcggttttaagaaacgccctggcggttttaagaaacgccctggcggttttaagaaacgcccaaagtggcggttttaagaaacgcccacctggcggttttaagaaacgcccaaagtggcggttttaagaaacgcccacctggcggttttaagaaacgccctggcggttttaaaaaacgcccaaagtggcggttttaagaaacgcccacctggcggttttaagagacgccctggcggttttaagaaacgccctggcggttttaagaaacgccctggcggttttaagaaacgccccctggcggtttaagaaacgccc

SEQ ID NO: 18602 - DNA, 1250 bp, Heterodera glycines
  misc_feature (1198)..(1198): n is a, c, g, or t
aaaaggtcatttaagttctgtcgttcagttgttttgagtttttatatctatttttaggctttatttttcaaagtttattgttgacaaaaaagaacaatacgatttttggctttgcttttttaaatttggaataaagctttttaaaatgagggtttttgacgacctaaatgaggcttcaaatattttttttcatgttttcttccatatttcgccagtttaaaagtaataatatttggattttgtttttgcaagataactcgagctttagttactacggttaagagagttatttcttcaaatacatcgttggcttttctacttaaggcttatccaagatatcggctaaaaatttccaaaaaatacattgcggatctagagagatcccctcacacaaaaccaaagctgctgatcaggctgcgggattgggactcaaaaattttgcgggacggaatttcgcgggctaatcccacaaaatctagcaatctcacaaattccaaaaattactaaaaatattctgggacccacaaaatctcggaccgttctctagataaaatggaaacctcagtatttggccgaaagcggcggattggagaaaaaataaaacattttaatgtcaaaaaaaattgttttattttaaaacagaatactatttaataattaggaataggaattttatgtaaagacatatttattttcgggtttttctacatattacatacgtatgcatatttttatatacatattttgaactttttcgtatatacagggtgcggcaaaacttctgcaactcgcttttccatggaaaatacagtctaaatgaaaagaaaaacaccaaaccagctaacattgcaatttcattcaataggaactaatttatgagaagattacagcaaatgttcaaagtggccaccatgggttgagagatacgtgcgtccaaaaacttccgaaaattggcacatttctacggtaatttcgtcccaggcacgctgtaaagcctccttcagcgcttcagttgatgcgaatcgcttgttcagcttctgctggtccatgatcgaccaagcggaactaagtcaagtggattcaaatccggcgaatttgagggccagacgactttgcccccaaagtcctggaaacagctcctcctcacagagctgaatagtttgcccaatcctgttaaatgacgaattggatttctccnaaagtgcccttgtgtccaaggatacaacacatcccttaggatggtgttctga

SEQ ID NO: 18603 - DNA, 1837 bp, Heterodera glycines
aatttaatcgctaccttgcgaccgtctgctgtgctactaacatggaaagtaatctcttcattgtcgcccacccaacttggccatttactagttgcaatgtccaaatattgtttcgattcagcacctttcgtggttgctccaagttcaatgcttaacccgggacatctagcttcaacttcaaccggattaccatatacaaaataaactctctttgtgtctgctgcctgcgcattttggggaaaatgggccaaaaaaacgaagcaaaccgtgaacagcagaagaataagggacgtgttcatctgctgaaaaatgttatttttaattccaatcctcaaaataagggtcattgattactgactaattaagtggatttttaattgaacaaaacacagggttaagctgagagaaaaatgtgaaaaaattcaattagcgtaacgttttgacgcaaaaaaaaaagaaagaagcaattacgccaatttgatcagaatgagactggaaaataagaatattgtgattttggaaaaatcagaaaagcctattaataaatattcttaaaaattatggcaaaattaaaatgaatattttaataaaaacgaaaaatattataaatgatcattaatagaaaaagacaaaatatgtacataaatatgtaagaaaatcacgaaatatgtacaaaaaacccaaaatatgtaatatgtaccaaatatttatataaaatttttaaatggttatttttggaaaaaatggaggctgctgaaaatataatatttgatcatttttaactaggcgggaccgtgacttttgaccaaaacggggaccgggacttaccaggaccggaaaagccgggaccgggaccaagtttttcgcccgggaccgagaccgcgagaaatgccgggaccaaccgggactattcccaagaggaaattttttgaaaaaatttagaaaatttgagtgcactttgttacgaaaattgcctatattcaaaaatgtaccaataaaatttttttaattttcggttggggggggggggggggtgaattcgaaaaaattttctattaaaatgaaataaataatttaattttttttttctcaaaaatttctacttctcaccaatttccttctcttttctcaccagacccccattcttaccagtgcttatttattcccgccgggaccgggactagcaaagccgggaccgggatttccattttttcaaaaaccggaaccgtgacggggacctgaaaaacccgggaattcccgtcacggtcccggtcccgtgcagctctaataaaaatcaattttgtaaatttattaaaaattttagtgccccgtcggatgggaactgaaattctgtcttctgtttgacggtgaatccgaaggcaatagaactgaaaaataataacggaatataacttgcgattgatggttcaattgcaattgtttttgctcgattcagttcagcaattcaggcgattaaaacaatacacccattaaaaaatgaaaaaattttctcaaaaattcatctccaaaatttatttaatttattttctttttgtttattataaattatgcaatcttgaagaatgggggtttctaatttatttattttgtgcttacaattagtttttgggggttatcagaggtgctgattacgaatctgaacttggatttcaacaaatttcgaaccccggacccgaattcaaacaaaaaaaaacaaattttttttcaaaaatacacgttaaaatcgaccaaattttcgagaaaattgcgtattttctattcagttaataattgaagcattgttttgcatcaaaataaatagttgtcaaattaattc

SEQ ID NO: 18604 - DNA, 2501 bp, Heterodera glycines
  misc_feature (20)..(20): n is a, c, g, or t
ccaaagggtgcagcactacngttttctaaaacatttttcatttttttgaaaatttgaaaaaatcggctgattttttttaaatccttcagaaatttctaacaataagattttttgaaaaaataaaaaattctaagttttaaattattatttttttttaaattttcgaacgtgaaacgatacgggggcggtaatgagctgctcccgaattcaagtccatgaatgaatttaaacaataaaattaaaaaaatcttttacaattttagattttggtcgatccatggcaattggttcaactgctccaacttggccaagccgaatttgaacgggtcgtggtcggattgtacgtagtcattagggtgcgttttgaaaacacagtcatttgggagcattaattagtttaaaaatttttttttaaaagttttcaattttctaagatttttttcttggaaatttctaaatttaaatattttttaaaatttcggcggcgagattttatcccatcacctttatgctttatctttgactgctgtcccaccctatattttccttcaagaagccatggtcactcgaacgaattgaaggcgtcgcatggaatgccgtgccgacgtacaaaatttgtggccaagggcccctgaacgttttgctgtgcttcaacggtttcagctacaaactgtgcaaagtggattattcaaggccgaactctaaccacgaaatattgaagaatgagacgatggtcagtcagccatcgtctaccattttgtttttaggaaaaattaatttgttattcaatgcaaaaatggggagcaggacaaaacgtctccgccgaaatgtcgccggacataatgtcaaacgcaaaacaaaaaacatttagtaaaatatttctataaattttcttgaaaaagattgtgtttcttttgtgcttccgtttttgagttctgagttgtttggagcggatttttattatttcaattaaattgtaagatgccaatttatacattattttcgacagattgcacaattttgcattattccccgacactttcaaaggttgccaatttcatcgctccgtccgccgagcacattaatcgtaaggctcaagaattgggggaagcgctgcgtaacaccaaacgaattaagcgcaaggagggaaagaataggaggaggaataagaagaagccgaagcttgaaatttgatcatttgttttgctcattaggttccaaacgacgcgtggtttagcacttgcagaagaaagacccaattaattaatgatatattgtaattggaaagattcgatatttattgactttcacgcagtatttaaatgcaatggtaaaaattgggaatattaaatttaaacgacgtgtgcgcaaaaagttcccgcatttttcaaatcattttttacaattagttaattaccaattttaattgatttatactcttgtcaaatttgtcgcataactcacagcagcatgtggacatggaaaatttgtgcattcgcaaatgctggatttattttatgactgaaaccctgttcggcccggacagaattgattttggtcggggtgacacctgaaaaaaaaacatgttaaaaataaaaattaaattattatttttttttgcttttcacccaaagtaattgtggcagaggaactccaaaagttccaatttcggatcaagatcaaattatgataaaatctaagctcttgtttcagttgtttcgcgagtcccacgagcggattcaatcttttggtgtcctcgtcccgccatttccttaacagaaaatatttcaagaattttgagaaaaaaaaacaaaattttgagtaatgaaacaaagtaaacccagcagaattttgaaccttacacacagcggcccaattttgggctccaagtacaaatatgctggatttttcgtcttagtggtctgtgagttagtcaccaaaaggggggggggtctcaggttcgagtcccatgcacgctgtaactgtattttgaggtttttaaagcaaataaatataagtgaaatgataacacagtttttaatgaagctcaaaaattaaaaaaaaattttatttcctgtaaaaacgaataaaaacctttatcgaactgtgtctattcaaaatcgaattgttttctccattgttttcttcgtccgtctcccgtcgaccaccaatttcttcttgctaaatcaccaatcaatgacattgataagcgaaatttcgtcagtttcttcttccgtttgatcgaactcatcatgctcttccctctgatcactttgtctctgaattattatatataaatttttaaataaaacaagattaacgcaattaccccctccaaacatacatacctgcttcagttcatcaattttgccagagtcgaggagccaattgttgacaaaatggtgctccagttgctgcaaaatttggtctgcgtccggcatacacttccacagttgctcaagtcggcgccaaacggaatggagcgcctcatcacctttaaa

SEQ ID NO: 18605 - DNA, 2516 bp, Heterodera glycines
tcatgtgttatttgcaaagaaccattgccagtgtgcaacaaagaaaaaattgagttaaaggagccctttcctcccttcaatgatggccatccccatcgatggtttgtgtagtaaaaaagttttataaaattaaaacacatcaaaaaacaatttattctaaataggtgtttttagcttcttttcgatggtcggcatgctctacacctttttgttctattttggaatgtaaggcgttgaatgtaaggcgttgaaagtgatggagcacgcgtaacacgacctgacactgtcgcatggcaactttggcttgaaaaagagaagaataataaatatttaaaatgattttcatttaatttttgttcatcggtttattttgaaatttgtcatcctcaacccaattacacgttgagaccacgaaaatatacccactaatcggcaccgcatcgaaaatttcaaattttcgccgatttttcatattctttaaaaaggcatattttttcagaacgtttcccattttaggtttaaaaaatttttcattgggaggaaggaaaaaattttcctccctccaataatgcgcgcaatcaccgatggtttgtgaagattttttataaaaataaaacaccaaaaaacaatttattctaaatagctgttttacattgttttaaacgattttgcacaaataaaaactttttttagacgataattgtgcgcttgccgtgcggaacaaaggcgcggcatctaaagacatcaagtggcttattgctacttataagatcaaagccacagaagaagacgacataatcgatgttgttgattgtcctggcaatgtcttcatggggtaccagacattctcttgtttggatggttgtttcatttttcaatttaaatatttattaatttgatatattttttcaattcatgccaacttcagaacaaaataatgatatatttgtcttgaatggatgcgccgaaacaaatagttgttcatctaaattggagaaaatctggaaaaatatgatggatttgcgtcatgtgttagttgcaaagaaccattgccagtgtgcaacaaagaaaaaattgagttaaaggagccctttcctcccttcaatgatggccatccccatcgatggtttgtgtagtaaaaaagttttataaaattaaaacacatcaaaaaacaatttattctaaataggtgtttttagcttcttttcgatggtcggcatgctctacacctttttgttctattttggaatgtaaggcgttgaaagtgatggagcacgcgtaacacgaagcttcttttcgatggtcggcatgctctacacctttttgttctattttggaatgtaaggcgttgaaagtgatggagcacgcgtaacacgacctgacactgtcgcatggcaactttggcttgaaaaagagaagaataataaatatttaaaatgattttcatttaatttttgttcatcggtttattttgaaatttgtcatcctcaacccaattacacgttgagaccacgaaaatataccccctaatcggcaccgcatcgaaaatttcaaattttcgccgatttttcatattctttaaaaaggcatattttttcagaacgtttcccattttaggtttaaaaaatttttcattgggaggaaggaaaaaattttcctccctccaataatgcgcgcaatcaccgatggtttgtgaagattttttataaaaataaaacaccaaaaaacaatttattctaaatagctgttttacattgttttaaacgattttgcacaaataaaaacttttttagacgataattgtgcgcttgccgtgcggaacaaaggcgcggcatctaaagacatcaagtggcttattgctacttataagatcaaagccacagaagaagacgacataatcgatgttgttgattgtcctggcaatgtcttcatggggtaccagacattctcttgtttggatggttgtttcatttttcaatttaaatatttattaatttgatatattttttcaattcatgccaacttcagaacaaaataatgatatatttgtcttgaatggatgcgccgaaaaaaaaagttgttcatctaaattggagaaaatctgtaaaaaatatgatggatttgcgtcatgtgttatttgcaaagaaccattgccagtgtgcaacaaagaaaaaattgagttaaaggagccctttcctcccttcaatgatggccatccccatcgatggtttgtgtagtaaaaaagttttataaaattaaaacacatcaaaaaacaatttattctaaataggtgcttcttttcgatggtcggcatgctctacacctttttgttctattttggaatgtaaggcgttgaaagtgatggagcacgcgtaacacgaagcttcttttcgatggtcggcatgctctacacctttttgttctattttggaatataaggcgttgaaagtgatggagcacgcgtaacacgacctgacactgtcgcatggcaactttggcttaaaaaagagaagaat

SEQ ID NO: 18606 - DNA, 1922 bp, Heterodera glycines
  misc_feature (1826)..(1826): n is a, c, g, or t
  misc_feature (1830)..(1830): n is a, c, g, or t
tggcaattggcacttatggggaagaggagacgacaagcgaattttagagaaatattggcaaatatgagaaaaggacgaagaaaactaagaaaagtgcaaaatgtgggcaaagtaagccgcaatttccaaatttcactgctttttaaatgccttcggccgatttttcaggtgagcgattttaagaaaaataacaaaaaagccgagtcgattctcccacacatattttttgttttggccctctccactcgcatttcatcaattattaaggaggaatcgttgagttattagtcgcgggacggacaatggcaatgggcaacaaacactccgtgggaaaagcaaaaaggggccaaggaaatgagagacaggaaaagccaaaaacagccctaattggtgggcaactgatcactcactcactgatcatcgtgtggcaataatttcggggtttgaaatggcggtcaaatcggggcgggggggggggagcgaacccaaccgaattatctaagataaatgtcatcagtcgctaatggcgaacattgttaaaacaaattttaaattgagaattcgcattgttgaatatgtttcatttatgtaaattgttataataaaaaaattaaaggttttagaaaagttttagtaggcgaaacgtccgactttgccttagtaggcgaaatattgagtaggcgaaatgtcagtaggcgaaatgtcagtagacgaaacgtctgcacactcccctccccccccccccgcttttttttttggttttttacggcttttctggtctcggcaagtttcggtccatttcttactcgaaattccttttcacatgtaacgctaattaaatgtcaaagaattttttttatttaaaaaattgcactgttttcaaattcaaatttaaatttttatttctgaatagaaacttaaatttcaaaaacgttcgggacgtggtcccgcggaattaatcccacaaatcccccgatcgctccggttctctactgctgaacaaattaatttataaaatttatcaaggacaagtgctcaaattattctaatttataggtatatttgctatttacattatttttcaccaatagacaaatgctgagacattgcaaaaagagaggggagaaggaaagaggtggaaaaaggcccaagttggacttggaaatggtttcggcactgcaaacgccgctttcgtctcccttccgcgtgccctttctgaacggtgccattggccatcccttcgttcactgtttcatcgttccgttcttcagacagtccttccacctcgcgtactccccgcactgttctgccgctttgtcggcgttcggtcagtgtcgtgccaatgccaacagtcacagactgtgcccacgaaaatgtaatcaaaaagcttttggctcgtcccttccgcgtcccaatccccggctacacaggtccgtgtggtgggcctttcattttcgcgccctcccacttttgttcaggcggttgcagcaaccgtttgctcggccttcgcatgtccggggtgcgtctttcgctgcacgacccttacgcggagaatgcgctggtcgttttcgcaccaccggaattatctgcacacgaacagttgaaagtgtggtgttatactatttaaaaaggcatcttttgaaaagcgggacatttgctgcttctctctttttttattttaatttaaaaaattccctttgccattttcctcatttgtcagatcgacgataccaaacgtgaagtccatgtcgtcgtggacccccttttgtgcgctgtgctgcggccccaccagcgcgagggcgtcaagtttatgtacgattgtgtgngtgngaagcgtgtcgaagggcacaacgggtgcataatggcagatgaaatgggacttggcaaacattgcaatgcatcgcactgatgtggacactgct

SEQ ID NO: 18607 - DNA, 274 bp, Heterodera glycines
cccccccaggcccctccgcactcgaaatttttaaggaaacattcgtatttttgctgaaaattttagattttccttgctggtacccccccccagacttagcctcacccaattttccaaaaaaattcgataaatttttcaaaaaatgcacaatttgttgatgaaaatctgctaaaaagtggctcaaaatcgcaaaatttctaattttttggacaaaattcgttaacaaatcgcattataaaatgcaaaaattttcccggcggcgcctatcgacacc

SEQ ID NO: 18608 - DNA, 2315 bp, Heterodera glycines
actaccgtagctgcagaagcagaaactaccgtaacatcagaagctgaaactacagtaacaccagaagctgaaactacagtaacaccagaagctgaaactacagtaacaccagaagctgaaactaccgcgaaaaatgaagatgaaacaacagcaacaaaagaagcggaagagactaccgtaaccaaagaagctgaagcgactaccgaaacaagagaagcggaagagactaccgtaacaaaagaacaggaagagactaccgtaaccaaagaagctgaagcggctacagaaacaaaagaagcggaagagactaccgtaacaaaagaagcggaagagactaccgtaacaaaagaaactgaagaaagtaccgtaacaccaacagccgttcagtcgagtgaaaatgcaacatcggaagagtcaaaagcagccgaaaattccaatgccccgtcgtctggcggtgaaattggagcagtgcccgcagaggaagaacaacaaacaacggtaaaacaaagagaaagcatcaaaaaataattatttaattaagtattttttgatttttaggagggatcaacaatctctgcagttttaactgaacaaacgaatactgccgatgcaagaaatattaataaatttaatttattgtaattatttttcccaattttaaaattttgtagggtgccacaaacggacaattgacaaatggaacaacagcagaagcagaaactgcaaccactgcttcaactgctgctccaccgactgagcaaacgacacttataaatgcaccaccggaaacgaatgagcaatcgaacggcacaaacacagcaaatgcgatgaattcggcaccactgacagaccaagcaaatgctgaacagacaaaaggcgatgccaatcagacaatgacggacaaagcaccagacggcacaaatgcaacttctgctggtcaacaaatggcgggagagaaaacagaaaatgcgacaaattcaacgagtgcagcggtccaacgcaattctgatcagacaaaaggcaatgctgatcagttgactcagcccagcaaagaagacagtgccaattcaaccgctactgatcagcaagcgatgctaacgaattcgtcggatggcattgcagcgaacacgacaaatccggcgcaaaacactgatcagaaaacagcaccgggaacaatgcaaaacagcgaaaatccaacaaaccaatcagcatcacctgaagcagagaagaccaatgttaaccaaataaatccgcaaaagtcggatggaaacgcaacattcacaactgcaaaccagacaaccatgactgatcaaggcaatgctaatttttcaatttccgcacaaaatgccgaactaagcaatgttggaccaacgccggaaaaatcaggcaacaacagcaacgcaaattcaacacaaaatgctgcagatatgggaaatgccactcagaaaacaacgagtacggagaagtctaatgggaatacgaacttgacaaatgccgacccccaaaaaagcaatgctcaacaaaaacaaaatactgaccaaaaatcaaatgctgatcaaatggcaccaacagcgaaggctgagaccagcgtcgccaatgcgacaactgttgatcagaagacagcgccgacaaaggcagaaaacagcagcgccgcaacagcgaactcggcacagaataatgcgtcgaacaatggcacttccgtcagcggagcaccggcggagatgcaaaatgtggacgatgagacgaagctgaagatgatgatcatgtcgtcgcttgcttcccagacggcgcctcattctgcgccgaatccgtccaattcttccgctgccgaacagcgacagggtgcgcccaaaggcgccggcgtcacaaacaattcgacagcgccagaaagtgctgagaaaaagccgtcactgcccgcggctaaattggcaaatgaaaggccccaaaaggcgtaattaggacgtagcctaatgatgtgcaatttaacagttttcaatcaatcgatcaattgtagagtaatgagatatgacattgtgtaaaataatacattttatagcgcatttgtgtatttgtttttttttcttcttcgatgatagtgaaataaaaaaaattaaattaaattttataattaaagtattaaaaacattaattagcttcaaatttatgaaaggacacaatttctttttaataatgtcaaaattaaattttagaaacaataaaactctttaaaatgaaatgatatatattttttatcaatttcctcacctaataaaggcaaccccattaaacaccattgccagaatttttatatttgt

SEQ ID NO: 18609 - DNA, 3084 bp, Heterodera glycines
attccttaacgaaaaagagcttgccatcgtgcctgaaggcggttacgagcggaacgacagggctagcgtcttcgccatcaaatatttggactggcgctccaaacgagacggggttcgcatacagcacgctggaaatggtctcgaaaagagatggcggcagttcaaacttgatgggtggattgcggagcagaacaaatgcatagaagttctcggctgctactggcatggatgtgagagctgcttcaaacctgacgacgaactggttgacggaaaaacatgccgagaactcaacgatgctaccaaactgcgcttgctaaaactacaggagcctgttccggctgaggatgcttacggtggagaagatgaacaaggccttgacgtggaagagatttgggagtgtcagatcagagaacagctcaaaagagatgatgaaatgcgagattttttcgacgacttggggaccgatcgggggcccatcgacccacgtcaaacattctacggaggcagaactgggccgcttcagctgattgctgagccaaaggaggatgagaagatttcggtcttcgatatcgtcagcctctacccgtgggtcaactatgccaccgactacccgaccggaatacccacagtcatccaccccactgttgaagagatgatcgtcgactggactcggcccgaacatttgcaataccaagggatatatcgtgtgcgggttattcctccaaaagggctccgaattccggttcttccactaaaaatcgacgaacgcctcctgttctgctgctgccatcgatgtgctgcaaaatttcggaagttgaacacacgacgagtgcacaaatgcccacacacggatgagcagcgggcttttacaggaaacttcacacatattgagctagaaagagccttggaaactggctatcgagtggacagattctggagagcttggcactacgatgaatggtatgagttagttaaagaatcttattattttattgcaatttaggagtgacggaatattcaaggactatgtacgtctgttgattaaattaaaggtctgaatatttttttttaaagttaaataatgtccaaattgcaggtggaggccagcggttttcctgatggtgccaacactgtggaacaacagcagcagttcgctgatgagtacagaagaatctacagtgtaaatttggacctggaaaatgtgcggagaaatcctgggctgcgcttcatctctaagctgatgctgaacagtctttggttggtatcaaaaattttagtcaaaataaataacaaatttaggggaaaattcggcatgcgaaatgaattaggcgcgaacaaagtgctaacaaggccgcaggaatttttcagcctcatcatggatcataaaattgtaaaccaaaatgtgtaaatgaattttcaattttgtacactgtttaggaagtgtcggctgtcatccctttgtcagacaccgccgtccgtgtcatgtacaagagcaaaaagaatttcgtcagcgaacacacgtcaagcaacattgtgataagtctgtggacgaccagccgtgctcgcctcaagctactcgattttatgacacaaatcgatcgaacagagggagccaaactgctatatacggtaaaaaaagctctaatattgtcaagtaaatataccccaacctttaggacaccgacagcgttgctgtgctccataaacgtgacatcgtgcccatccagacaggagaatacttggggcaaatgagcgaggagtatcttgactacgagatcaaaacttttgtctgcggaggtaaaaaatatttaatctttttaattttttattctaaaatttcaggcgcaaaacaatacggctttcgaatgttgaacaaaaggacaggagaagttgaatacgtacaaaagattcgtggcattacattcgacgtgaacaacagtaaggcgctgcagtttgatcacttcctgcaaaaggtgaaaaattacggacggaacactggtgacgacaacgatgatgctcctgccgtgttttcctacgacaaaataatgccaacacgagacagccgaatcatcacacgtgagctacgtaaaaaatacatgccaatatgtcaaaaaggaatcatcaacgagcaatacgaagtctacccatttggaaattaattttaaatcatattgtattattagtcaaaaaagaaaagccaatataattaacacacacatttattcgtcttcaaaatgtagcaatacaacaattgtttcagtgaaaaatgaaaatgcttccgttttaatgggtttcagttttggagacacgtaacaattcaatggggaaaatatcgcggtggtgaccaccaccaaattgaacaacacacggaagggttggatactttaacataacacgatggcgagtgtaaaggtgttgctgaaccgtgattcctaggaatccacggtatgcaaacacctgatttgcaccgatggggcacaaagcatcagggataatcttaacattttttctaagatggacagtttcaatgtccaattggctcagataggcaaggttctcagtccgttgtttctgtagttgcttcgtcaatcggtatgggccacagttgttgaaccggcacagcactctcaccaggttgtagtctcgttttcgcgttcgttgtcgctccaatagttgatcagatccaactcgtccacgatcaggttcatgctgttgctgctgctgttcggttgttcgcaatggcgtgaaagacacagcggcgagtctccctggcaaatcttcaagtccttcaactccacatatagaggttcgctccttaaaaaatgcaaaatgaaaatattaatatttttttatttagaaaacttaccacactattccctcgtacttcttcttcggataacatgttgagtagagttcaacgtcagcaatcaattcgagcgacccgtcgatatgcacaggttggttcggatggtcagcgtttgcgaatgtgtacccagtccaccggaacaaagagggttgggatagagacaattcccaccttcaggcccacttttattttttgtctttcaaacaggtgtacagatc

SEQ ID NO: 18610 - DNA, 3914 bp, Heterodera glycines
gagacagggcatgcgcggtcttgtagaagaaacagggacttcaagtaaattagctttgtcaggaacataactcgaggcggggatcggacgcagacaaatgtttttcagataactaccgcggcagacgtatcggtaaaggagatttgtaaagtgctctccgtgcactgggaaaactgtcgtagtagtgcgtggaagctgcaacagatctcaaattctcgtatttgtggtgtatgtgtgtggtaaatgagttaacgtagactgcttatagtgaagttatctagtggaaggatcaacctctggtgaacagttgcaaaagttaaacaagcatgtattaggtatggagtgcaacagacatattgcgcgtttttcagtgttctgagtaaagacttttttccgccctttttttgagtaaagagtgatcaaacgactcatgcactcagaaatgaatgagtggatcaaaataattatctaggtgcataaaaagcacatatataggggtaaataaaaacacataaacaaaaaataatcaattaaattttctagtcgaaattttaattttttaaaatttgatcggcttgagtaaagactcttttccaccagtgtatcaagtgtgtagagatggccatcgtgctgtagctttggcctatttcttttggtatcaatttgctgttgcatacgtacggaataatatttatatctattaaattttaaaatggaatttatagtcgcaataaaacatttttaataaaaaaaaacaaattaaaaattgttggaatatttgcgcccaaacgtatcgcgcccaaacgtgctggcgcccaaccgtgagcgcccaactgagcggttccggcccagaacttttttttttttatttcaaaaacacattatcttttctttttatattgtaaatgccattatttaacaaatgtaatattttgatggaagtgactgattttgttaggatattataatatttatcgcatcgtttaaaagtacccaaataaaatgaacaaaaaaaaatcaattaaaatggtattacaaatttgagatgtgcttataaattagaggaagattattaaataaattttataacgagttttggaccaaaatcattaaacattacttttttattttaatttacttaaaactttatcctttgaatgaatgtgatcctaaaacaattttagaatttttttggaagaatttaattttttaaattatttatgaaaatagttcaatgaaaaaagtttaaaacgactaaaaaatgttggaattgcacttttatgggaaaaatataaacagggggcatataaccatcttcgccaccgcttcacggaattgatagaaattgtgaacgatttaatgaaaaaaaattactatcaaatcttggcaataaataagtccactctttttttaaattaaatccaactgagaattcttaaacaaagctttttaaaaattccctttggctgtctcattgctcacataattatactgaaaatataataatttgccaatttatttgcaaatttgattaataattctgatgtgccctgctggccatctgcaactctctgttgtgcaaccggaattttggtctcctgaaaatcgtatgccggatgaaattgaccacggcattatggtagtcatcgactcagaaaactgagtccagcggattcagtactggcatccaatgcaaaggaagagtgacgcacatttgaatgattggcctacatttgcggcgctgacatttgctgcgctgacatttgctgcgctgacatttgcggcgcagacatttgcggcgcccagtcaaagcgacattcgcgcgctgacatttacggcgtgacacttgcggcgacgacacttgcggcgccggcaaatgcggcgcccagtcaaaaggacttttgcggcgccgacacttgcggcgcccagtcaaaacaacatttgcgcacagaattaaatggtcccaaaaaatttcaacaatttatttaagttaacagaattgttattttaatagtttattttttaacaatgactaatttaactataacaataacagaaaacgtttcacttcgccacacacatcattttcaaagtataaatgggtactgtaataaaataatttcaataaggttcattatcgccatcaaaaatgaggaagaacaccaacaaaaccgtctgagaccttacgaaattgacccaactcgtggaattgctgaaaggccacgcttaaaaaaatatttgagaaatgatgaagcgatccgacgattagtcatcatcgcctagggatgaaaggctttgaagaatgggactgagagagtcattatcaatgtttttaatggaaataaattgttgaaatatttttggggtcgttgaattttgcgccgccgcaaatgtccttttgactgggcgccgcaagtgtcggcgccgcaagtgtccttttgactgggcgccggaagtgtcggcgccgcaagtgtcgtcgccgcaagtgtcggcgccgcaagtgtcacgccgcaaatgtctgcgccgcaagtgtcgctttgaatgagcgccgcaactgtctgcgccgcaagtgtcagcgccgcaaatgtcagcgccgcaaatgtcgcatcacccaatggaaggggaggagaagcagctgtcaaaattagaagggcaccactttttacaataattagttcatcattcgtttttggttaatttagcagcacaacgacaagaactgctacagaaggagggggaagagggcatgcagagaagaaggaggacaaatggaaaacagggggagcaagaggaggtacggaagataaggaaacagacgagagggtgggaagagaaggatagggaggaggagggaatagagagagagaagaggaagagtattgagtaggagggaacagagagaggaggaagagtagtcgagaggagggaaaagggagagagaggaatagtagggaggaggagggaaaaggagagagagaggaggaagagtaaggaggaggagagaaaaaagagagaggaggaaagaaggaggaggtagaaagagaaggagggagtgctaattgcccatgtgccaaaaagaatcatttttaaaattattttttcatttaagtttaaccttattagttgcaacaaaattaactcgttagcaaatgagaataatatatcaaaaatgccgaaaaataaatgggctaagacacaaatttgaaaagaaaataggcaaacataaactgaaaatgattaaagagtgaaaattgtaaaatgaaaagattataattaggtaactttaagtatttataaaagttaatatgatttagatgaattaacaaaggaatgttcaacagacaagcttaggaagccacaaattagtttaaaaaattgaccatttaactacaaaatgttgccacaaaagaatggcaatttaaagtaatttctcgccgataatttcttccaattgttcgatggccgttttgtagtcgtcgtcctttagctaatcaaccgaatttgcaagaaatgccaaaagtgttatttctgttacccaaatgcttcgtattccgaccgcttcggcacctttgcaattttcttcgaggtcgtcgatgaaaacgcactctgccgcggacagtcccattttaagcagagccatctgaagaaagggactcactaaaagtttatcaaaacaaaagaattgctaattatatgctaattgcctcgtagaaatccgcatttggctttctcgcgccgattttgcacgattcgatgacaaaatcgaagtcggaagtgtcaatggtcaacttcgactccgatctgtcgcgcacccaaaatccattgttggtcaaaaggccaaccaaatatttgcccgaggaacgaagtgagcgaagggcattttcaacgaaaggattctaagagaaattatcaaa

SEQ ID NO: 18611 - DNA, 1990 bp, Heterodera glycines
  misc_feature (121)..(121): n is a, c, g, or t
aaatggatgaaattcaagaaatttaatggaaaaaattgatgaaaaaattttcgtttaatacccgagaaaagcttgcaattacccaccaaattcaaaaaccaccaaaatgattcaatttttncaaaatttctggcttacactcagaattatgttccgagcgcaacataacacgattaactccttggcgaagcactgctgttgagataatagatctagtattgttttccttttcacctaaatacaaacagctggagcacggaatgtagatatcatttttcttatcattaatctgaatgtattttctccaatttgatccatttccaattatataaatagtgttagtcagctttttggagaagcatttttccacttcaagcttaggtgatgaatcaacattatcttttgtgggcgcaaaaacaatttttatcttatgcaggtagcgtttcaaagtgcatacagaaatctgtatgcctttatgcataagttgtccatgtagttcatcaagtgtctttatttcctttttttcatagcttttgacaagtgatattgcttgaggattttttacgaatccttcaaatccggatttatggccttccaaataatcaagtaaaattaagggaaaaataaaactaataaaaaatattttcattttttagtcaatctaaagaatgaatttaacactgaagggaaatatatttttaaattaaaaatttgttattatatggcaaaaaaatattgacatacattgattatcgtttccgacgtaataatattttatgtagaaaacaatttttattacttgcaaaatatttgtttcattgaataataattattttaattaattattatcattgatattattttaggatcgcccacattgatacttttttaggaacgccccattgatactattttaggaacgccccattgatactattttaggatcgcccacattgatacttttttaggatcgcccacattgatactattttaggaacgcccacattgatactattttaggaacgccccattgatactattttaggatcgtctcagcacggaggtacaacagtgataagaaagtgggcattcaaatagagcatttacggaaattaaggaattgtttttattcaaaatagataaaaaatcgatgtgttatatttttcattttttaaaatataatacactttttattaatgaaaaacaaattatgaaatgtataataattgaatagttatttaaattgaaatgaaaaaaattttacaattaaattttaaaataaaagctgaaattctttaattaaatataataaataatttaaatgaaaatcattattcatcaaaaaataattaaattaaactaaaaaaatttattattaataaaaccaaacatttaaatttattaaaagtaatgaaaattaacccaaaaaatacaaagaaaaataatgtacaccgcccggcttcgaacttcgcccccccccccaaaaatgatgcctcagaatccccaatcacacagggattctgaggtctaaacgatgtcaaaagtaaaatctgatcacgtattcgtgatcagcggcccgaataacccctaaagacatgtttttggaagatttttgtcgaaaaaattttttcactcaaaaaccatgtgcacccccctttggtcccgaatgccataatcacttttatttttatatcttttttttaaaaagggataaaaatgtaaaataaaatttatttggtagagcaaaaaattgcggatttttatagtattttactcttccctaatgacttttcagaaccgaggtataaatttttttctgaaaaatcgaaaatttccaaaaattctggaataactttttttcttttgaacattataaaaccaaataaatctcataaaattctcccgattttttgctatttttaaagctttaattcacttaaaattgagcagtccttcattgaggtatgaattttcatattttaacccaaat

SEQ ID NO: 18612 - DNA, 2501 bp, Heterodera glycines
  misc_feature (1491)..(1491): n is a, c, g, or t
aatcgatgactcgtgccgatttttctgacttttaaatttgatagagcaccacaaagaaatggaaatgcttatcacagaagctagccgtgaatttaatgagcgttatcatcaactttttcctgaagctaaaaaggatgacaaaaataaaaagcaaaaagttggccaaatggacatcgatgtgccaatgattgatgagtaaagaatagtttaaaaaactgttcgtgccgtgaactacctgagaaaatttaggtgccgtgtcttttcgtaaaaaaatgccaattttttttttacagattttccaagaaaaactcgttaaacttttcctaaacgcaaccatatatgtaagcttatgtatcatacggtaactcttgaatttttatatttgcatgaaaaatttcggaaaattttattcagttttcaaaaatttatggcaatttattcagcatttttggtcacaactttttgaaaacaaaaagaaatttttgaaattttttgcgctaataaggcaatccacgagctttcgtataataccaagatttttttaattttgttgcttttaagcacggaaaatctgtaataattgcacttttttccgaaaatatcctagcaaaccaaaaattcttatcccaaattttggtatttttttgtacagtcatggtcatatttgtgccaaaaaatgaaatgggacaacacttttgaccacctatattttgatcaaattgtgaatatggtaaaataaatcaaataaatgtttatgtcacaaatgcaaatatggtatcattggaaagcccataaaaaatgctatccaatggtatgctacttatctgttgaaattggaaaatgacaattttatacgcaattatttttttcaaagcatgatgggacaacacttatgaccatgactgtatatttcaaaatgattaaatgtttttttaacaaaaaaagtaacaatatacattttctccaacccaactatcgaatttgagagactttttggagtataaaaatatattggcataatttttgcataaattttctcctttagaaaaatgcacattaaaacattaattaatttttgcaataaaataaactcgatatttcgcctttctttttgccgtttcagcttttactttttcaaatttaatttatcattttcggcaatttttatgggaaatttttaccaactaataaagaattttttggcattttcatggaggaattcaggcacttttaagcatttttcacaccaatattttgtaaattgtcacgaaaaaaatttgttcattctgctgtctgctctgatcagtttgtaattattttcctgcccacaatgggcgattgttgagattataataattttgagcattgtatggaataattggcgtagccggcaccgttggatgtcttcgtaacaaaatgttatggcatcgatatgcacggttcacgcgtttcagatcaccttacaaattagcaaaaaataaattaggtatntaattaaaataaaattttcaaatcgtttgatttaatttaatttttgctttttcttaatttttatttaaaatatttagcttcgcatttttgttttaataaatgaaaactttgagaattaaacagttttaatttcttatatcttttttattttataataaataaatttaaaatatgccattgaaatatggtgatattcaaagttttcgatatttattaatattttaaaatttacattgctgaaaatttaatagacattaaattaattaaataataaaaataaaatatattttcaatgcttttccaaccttcagtaaaatccgttgatttgcccattaaatttgtatatgctggtgcatttgctgtaattgttggatttccatttttgctgccttccgtactttcatctatggtttatttttaattttatttatttattttattttttaattcaattttggaataaaaattacgaaattaaaagaaattttatattttctaaaattattacagtgcataattgagaaataatcgtatggctcgtcatagttgcttaatccaatggcacttagcttttcaaaatcggcacttgcaccttaaaataaaatattttttttaaatgaagcggcatttaacatgtttaaaattttgtatttatttatttttcaactttttacaataatttaatattttatgcaaaaaagaattagtgatttttaaaaaattgtgttaaataaaatcgtttaattgaacggcacacgatccccctccaaaaaataataataataataatatataatttaaatattaaaaaaatttattttatttatataaaatttcttaccatcgatcacattctcccaccgaatttgtacaaaaccatcccgatcttcccgttgatgttcatggatactaaaaaaaaaatatattttttaaatttatttattttaaatttatttttacaatccaacgacgtgcataaattcatgaattattgttgagtattcaataca

SEQ ID NO: 18613 - DNA, 627 bp, Heterodera glycines
  misc_feature (21)..(21): n is a, c, g, or t
aattattttgtgaaattatanttgtacaacacacactctccgtcttttcgatgcttctcaatgctttagcgattaatttttaaatcaaaaaaatgcgaaatgcttcgctgtcgtcccgtcagcccgtcaccatggccccaaagcagcacccacccacccaccgcccttgccttccttccttgccccgcttttgcccaccgctaatcgccctaatggtcctaaatcgttttgtcatggcccctcccccgcccggcggggctccgatttcgtttcactaattaatcttttgtgtcgcgttgtgctgcatgtctcacactgtctctatgttttgctctcacatttatttcctctaaaattagctcccatttctcttacccttctgttcatctgttactctctataattctctctatctctctcactctctctctatctccccccactctttcattcatactctccttctctctatctctctcccccatctctctctctctccctctctcactctctctttctcactctctcttcctatgttcgtctactactctcaatctttctcatctctctttttttctctgcttgtctggctgctttcatttcccggtctatttctctctaattctg

SEQ ID NO: 18614 - DNA, 993 bp, Heterodera glycines
attagctaattaaattaccataccccattactcattaaggaattgtttgaagactgtcgccgaggtcaaacacattcagtgcaactttggattgcgcagaaaagcaagaagcatcggtctccattaaagtgagaggaaaacttagttaccgtaaccttatttatatgtatgtaacaaaaacagtaatgccatgaatgggaaagagttaccgtaacagtatttgtatgtcttaccttaatcaatcttaccgtcttacgcctttaacaaaaacattccagggatggcagggaattaccgtaaccatactttttccattttaccatctacacttgatcatacttaccgttttatgtttaacgatattacagtaattcgcttaccataattcaaaattttttatttatccatgtccaactttttattttttgctaagttttcttcgctccggaaatgccagcgccggtgccggtgccgtcggttggcttgccgacttgcgcgagccgagcacatcgcacacgctgctccatctggccgcattacatggccacagggagctgacccgtgtgctgatgcagcgggatgtacagcttgcaaccgcgcgtgatcgcaagggatgtttgccgctgcatttggccgcatggaatgggcacgaagaagtgatcgcggtgagaaatatttatttttaaaagtttgaaaaaatcagagattgattttttagacacttttggcagctgaaccagcctcagtggtagatcaattttaattttatcaactgaatttttaaaattgtaaatgatcataataattttaattgttattttttttattaattgttaaaacatttaatataaattttaattaatttaaattattaaaagaattttttaaattttgctaaaatataaaatatgtaataataaattcattttctattatttttattgattattaaataattaaactaaattatattttaagattaattttaattac

SEQ ID NO: 18615 - DNA, 978 bp, Heterodera glycines
tagatgcattgttgatgaaatgcgccctttcgttggacgcatgcacaaaatgccgtcctgatcacagcgaagatattgttcgatgccactgcaaggaagtgtacatcgaaagatggcggaacgatccgtctaaacgattgccactctcattcggccttttaactcttaattatagtaaacggcagtttgggctgcgtgaatatgtacccgttcaaatgaccttaaaaatggagggtttgactctaagcattaggagagatatggccaaatgtataatcacaccagggggcttaacaggctgctatggatgtcggatgggaagtcgttttaacttcacttgtaaggcatccctcggcaatcccctggcggatataatttgtgataatggtgccctttgggttacacattgtccagaaaaatcaataaaaatgaatgtgtcattatccctaaatgaaggggaggtaaaaaccgttcgtcatgtatcttgcctcgggggcagtaccaactttaccatggaaggacttttgcattatttgcctactattagaggcgaatagaagatttctggaaataaagtcgaaaggggttctcaatggcccgacttttcgatcctagaacatttttatcgagtttttagttgggtcctaggcggacctcaacttttcatccttataagcgttttttgtgtaggaattatcgggttgtacgtttgtttgaaatgtaacccactttttcatgcctaactatcgccgattggttcgagtagtcattctgatcaccattttgctgatcactgcatcattggctacatgtgatgaagacatcaaagatgaagagaagatcatcgaccggtcatggtcacaactcaaatttgtgcttttcaaattcgaggcagaattagtacgattttaattgttaaattgataaagagattgatcagtaccaaaatttgaagtggcaagtaagcatttcaccatt

SEQ ID NO: 18616 - DNA, 824 bp, Heterodera glycines
aaatatttagaaattaaaaaaccgtttttaatattaagtaaattaaagggtattattgttttagttttggtcgcatttcttttcaataattctattggatttacttaataagaatgcattagaacttttttaaatagctccgcaaaacatttgttgtttggcatttaaagagaggttttttaaataagcgttaattttattggttcctttataagttttcgacaattttaattaattcaaattatttactttagaactggaaaggataaaaagtagattggaaattttttgtattgcaattgcatataaatgatcattgttattaaataaaattcaataatatgattgtgcagtttattccactagagttcttttgagcgcgtagcagactcattaatgttatatttcagaagaaagagtcagtctttgtaatataagttagtgtatcgaataaaatcaagttcttataaatgtgtctaataagttctgagtaccacatatgtctagagatttgaaattacaatgaaaatttactgatcataaatccgggtccgggttcgaaattggtcgaaatgaatgtcatattcgtgatcagcggccccgaaaacccccggaaatgtattttcatgacttttttaaaaaattttcaaaaaggccaacttttacactagcgccgaaaaaaccatacaaaggcacaaaatattaaaaaattattcaattgattggctttttctctcttaatgcgctcccttctattcctcgctttcgtggcacttctcttcgtcaaatgttcggccgacgaatcaatgcaaaatgatgataat

SEQ ID NO: 18617 - DNA, 2167 bp, Heterodera glycines
attcaaattactaatatgtattttttgaattactttggatttgatttagagactcattggctatcgacccactgaacttccaatgttggcacgacttgggaaaactaatggccgagttcgaccgcaacagtgacgcattggaagcgtttcaaaccgccgcatctctcgtcgtgaacacgccgttaattccattccaaagcattccccgggttttcggtccttagtctttcgatttgtttacccattccattcccttattcattcattcattgttgagaaaagggtatcaagcagatgaagctagtaactttcaactacaggttttaggtatacagaaaaacaatagtgcatttttttatttgtttaatttaatttagaataaatgtaacacaaattgtgagacttggcaaataataatagtgagaaaacacagaaacatgggtacttaaaggttcggatatgagcatcttacattaatgtacatacaaagctgaaatttgggagaatatatcacattgaataattcacttcgcgattgtttgtccggtacatcgccctcattcggtccgcctgtgtctttgccctcaattcctttgtcccccctccccgcggtgtttccgccgttgctgacatggccactttgcttctgctgttccccctttccagtgtctgtgatttctttgtttttaattggttcttatcatttgcaattccctcacttctttctctccgccgtttctccgcgtttcgtccagcaaaggccgagcatccgccggttggacttcgcaacggaaccgattgaactgcttgaacttcgcgctcaaccgttccatctgttcttcgtatttactttctcccttcgcttaatttgtacattctgtttccaatcattccctctttttccattacttccgctccccgtgtcggatgaattgcgctctttgatttgcgggtggtgtaaaaagtgtctgctcgcatcaacgcctttcgttctgctgattggcgccgacaccgtggcacggaagccgcgctcgccccggtggaagtgttggtggtcgcgagaaggcgcaaaaatgggcaccattttgctaaaatgaatagtggttgaaaaggcagcatcaaaaggggattttgaacattcattcaaggcgctaaacatttgtaatttacaacgaattcaatgcaagaaagtcccattaattttctcaaacccaaaatcgttgggacagtcactgatcagattcaattcaatgaatgatcgcacgtaaactattcaaaataagtaaattagtgaaaaatgatcggaaaaaggaccaatattttgccctttgccgaatgattgactatttcgtattgttcgggacagaccgttcaaaaacggcggtccagtcaatgcgcgacatgtacggatgggcacggaaagcggcgaaggaggcgatcctccgggccgggtccggattgatcattgaacggagaaaagagatcaaatcggagggccaacgggcgggcatcaccacgggacgagtgaagacgatgtccaagacctggaaaaagcataaaaatacatttaaacaatggaattaagtgcctgaagcgatgaaaaagccgacggatattcgtgaggaattcgaccgcgcaacatttcgtagaaacaagtgcctaaaaaggaccaaaatgtgccgaaagtgttgggaaaatggcaaaggaaacagacggacccaatgcccaccagtcgacttcaaacgaatagccgtcctttctgccaagtgcggtgagcagaatttcgggtgccatgtaaggacgagtgcctacagggcaaaaaaggaaagaataaagtggcaaaatgcgacagagcaccggagaaagagtgcacaagttgcccttggggcagtcgtttggacagaccgaagtcactcaaatgggcatgcccttcgtcgtctaaagcgaaggaaaactgtgcaaaatcagccgatacagtactcagccgtaaccgagtactgtactgtcgcaaaaagatccgagaattatgttggccgctttcacatagaaacgcccaattataaagaagcagagacaattcgagagaaatattgcggagaacacaaatgacctaaataaaccctagaagacagcacccttgcctgagacaggtactccaaacccaagg

SEQ ID NO: 18618 - DNA, 2862 bp, Heterodera glycines
aaaaatggcaacaaaaaaaaattcggttttatcctttttggcataaactctgcaatattatacaaaatgtatttattgggacggctcaactgttcatagaccaatgttagattatatgtagaggccatttcaaacttcagtcatagagtaaacggcaaatttaaattttttttttaaattttgtctcctgcttaattttgagtttttcatgaaaaatttcacataaattagaagttagctttaaataaattgtcagattccggtttcagcgaaaaaaaataataataaaaaatatttttttaggggggcacaaaaaggataagaaccaaaaaatcgtgaaaaattttttttgtcgaatcaaagtcacagaacaaaaacatactttttttatctaaacaattgttcgagaaattaattattttataaagaaaaaaaaattttttttcctattttttaaaaatttaaaagttaaaattcaaaaaattagcttccaaataaaattataataatcattgcccggatttttaggtgctaaaattcccgaaaaaggtacctaacctaaaaatccgggccctggtaattaaatatatatttgatttctcatagaactgatgcatttttacaataatttaattaatgaggttaggaatttcattaaaaaatagaattaatctgtaatatgaaatttgagaacatgtttttatgaatgtttaaagtgtatatttttaatttaaatttattttatttaatattaaaaaaacagaataattttcttcataaagaatttttgtcgacattagggctccaatttttaggctctaaataccgccaaaataattaggctttaggctcttaaaaaccccaaaaataggctctaaaaagtctcaaatttaggggtgtaaaatgacaaaatttattcaaaaaagtaaaaaaaaaattaggccaagtcagtattgagctaaatattttttaacaaaaaatcttgtctagaaaaaaaaataaataaatttcggagatgaatttatgaaaagtttttcatttcttaggggtatattttttgaaaaagttttcagtctattcaaagggatgtatttttcgtttttattgagttattacttaaaattttggtcaaaacgccaaaataggttttttcaaaatctttttggttttttaggctctaaaaaagaaaaacctcaaaataggccctaataactcgaaaatgtagcttaacaaccacctaaaaaaacttgtttttcgtgggtttcaggccactggagctcaggaaaaaataggaaaaaacctaaaaattggagccctagtcggcaccattgacttaaaaaccgacttgatcatccaattcgagcaacataaatgccggcaccgattggaaaatgtgcagcaatgcaaacaggtccatgtggatgatgttgagcaggatttgctccctttcaccacatggtggggctgtgtatttgtgctgatcactgaaaatggatctgtgccatccgagcaattcccgcggagtgccaaatcgcatcacaatttccactcgagagtcgcgctccccgcgggcgtaaaacgtgtcgtatttcgcttggttcaactccagttccctgactgttgcatgggtctccgccgttttgcagctgctgatcagtgatcgcttctccaatggccaagtgtcgaccccgatcagttcttggctcctaatttggccatcaaattgccaattttctgctgggtgtgagccgatcgcctgctttcgcttcttggcccaaccgccgatcatcttcggcgtcaaatttttccggtttctaaaaaaatgctattttctctcgccataactaagcggcagaaaaaatatgtaaaaacataaaaatcccagccctaattatagacataaaaatttaatgttggatgagaataaattagagaaatacaaaacaggatgaggaaaaaaaaattaaaatgcttcggtaactaaattataatccaatgtttggactattttattaatttcaaataaataaaaatattttattcccaagtccatcccttccaacaaaaaaatcaatttaaaataaaaaaagaatatttttacaaaaagaaatttgagcttgcccctttttaagagcatgtgagcaaacaatttgttttgccacaaagatagattcttcaataatgcccaactactaaaaaaaagaatgaaaaagccacgaaaatgatgaagaaaatcggcaaattgggtccggtctcaaaagatggcactgacaaagatggcacagagtctgcccaaaattgtaggacaaacaaacagaggccccataaagtgctcacacattggttttaaatctataagatgaggttggacaaattaacaatgaaacgcccggaggggttgttatggaaactgaaaaagacaaaaaaaaatagaaattttattttgtaaattgaaaacaaaaaatggctaaaacattgccttcaataatttctttggtactgaaatatctatcttcacttggactcatttgtcgtagttcttagatggcgcctttttttactttattctttgatttttgaacggaaaattcgttaagagctttcgaatgaaaccaaatttgtccgggtttgaccattttaaaggcgagtttttgtggctggtagactatagtacagccatataggtatctgcgactctcgggtctccaagtttcggtatctccaactgtatggtccccgaaggccggaatcgcaagcgtagggtctacaaatgtcggtaatccgcgactgtcggctcccaaaatgtgcgaccccaactgtcaaaagccccgaatgtcggaatctccaagtgtcggatccaca

SEQ ID NO: 18619 - DNA, 1448 bp, Heterodera glycines
ttttatttattttttgcaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctgccccataaatgtttgagtaccccaaacggacacttgaa

SEQ ID NO: 18620 - DNA, 2391 bp, Heterodera glycines
atgcacgaggggcgcgaaaaagtcaaaagtgagattgaacaaacagcggaactatgagggaaaattgtgccgaccgatcagcaacagattgtcatgtcagtgcccgagcgaagccaagtctccatacagctccaacagctcggactggaagacgcagatgtgccaatcattcttgaacaacttcaaaaagcttcgccgacgcctgaggcaacactaaaagctttgcagacggtgcaagagcatttggcgaccaaacattttgcggaaaaggaagccaaaatgtggacagaactgggcattgaccagcaacaacagcagtcacaggcaatgctcacgttgagttcggcattggaggaagtggccaaacttgaagcgaaagcagcacgagaagagataatggagctaattgcttcattggaggggccggaaaagcgggcggagatcagagagatgaagccgactcaggaggaagtgcagagggaggaaagactgctccgaattgagcgacaggagcacgttcttgcgttggtaaagcacgtgcttagcgaatctgcacaacgacgcgccgttacgctgagcgactcgcagttggcccaagtctcggagcagttcagacagttcggcatgacggagatgggcacgaatgttgcactggaccgtctccaacagacaagcgacattacgggcattgcgcaaacaattttggctgattggaatcggctggaagagcggttgttgaccaaaagtgccatcgaagatgaagccatggtacaagcaacaatgtaccggattgatttggttaagccggaagcgaaaataaagctgaaaagtgaactgaacgaagcggcgaaaagggatttaaaagaggccaaagaggagttgaagacgttcatcagctcactgatgggcaccgaacaatgggagacagtgctaacccttcagagggctcagcgaattggagaagcaactgccatcacggcaagggccccgatcgagctgaacaccgagacagtcgctgaactgcttcaacttgatgaacaagcattggctggcgtcattcgaccaattgaattggcaagaaaggctgaagaaattcggttacaaattgaaaaggaagaatatgcagaagagatgaccagaaaattgatgagagatgaattcagagaggtcaaactgggcgagaaggaattcgaaaaggtggccgagaagttcaagcagttcgggctgaaagagacgaccgcaacagcagtcattgaacaactccaacgaatctccaaaacggaaaaggcattgaaactgaaacaggaggaaagggcggaactgttcatcaaaaagttggagaaggaggtgaaggagttcatcagaattcggaaagggtacggaaatgtgcagaaggaaaaggaacggaagcacgatgaacaacaaaaagtcatggaaattgtggcaaaactgatcaatgaggagttcaaggaggtcaaactggacgagaaggagcttttgcaaatagccgagaagttcaagcagttaggcttcgaggaaatgaccatcaccgccgttcttgaacgtcttcaacaacttgctgcacccgctctgctcaaagttgctaccggagaacaacagaaactggaggttgagctgttcttacaaaaactgatggaagagatccgagagtttgcacgcctgcgtataagctacgctaatgcacagcgcgctaaataccaagcacagcggttgagaggtgcagtcgtgcaagtgactgtgccgttgagagaacgtactatgccaatggtggacacggcacgtccggcagctgcagaagcggaggaactgtttattgaagagcagaaatgggaacgcctcgtctattggttcgtcaatgtcacgcgtcgctatgcggaagagcggttgcgcagagacttgcatgatgcgcgtcagcgagcggaggttgcgcaatacatcgcatttgaagggcctgtgagtgcggtgcagcgcgcacttttcactcccaccaccactgcaccgatattgcacacagaaatgacgatggacaaagttgcaggcactgaggaaatagttgcggaagttccatcgctgcatgtgccacaacaaatcgttataaaacacgctgaacccgttggaatggctgaacagcaaatttcgagtccaacaacatggcatgaagagctgaagatcaaagaaagcaccgcagcggaatggcacacaaagaccgagctgtacaagcacgaaattccaagacaagacgaggagacgacgcgtgttttgacggcaccgcatgagcagaaagcggaaatgcgagtacccgaagttggcaccgaaagcgcacaagccagtgacccaagtgagcaatgtggcgcgtgtcgctgatgcaaa

SEQ ID NO: 18621 - DNA, 3074 bp, Heterodera glycines
aagagaagaaaatggattttgatgaaataaattctttgaaatttagtcaaagcgcattaatttgtgaccaatcagcagaatttgtcaattgttttctcttcccctcgtcagcagtgatttttctgtctgtctgttcgtctgccgttctctcccttttcacagtgtctcgtcccctccactctctcatctcttcctttttcctcttacattttgtccgttcactcctctccctgcatctcttccgctctcttcccaaaccgtacccacttgcccccttcgattgccattttccgctgttaattatcttgcaaattatttgcttttccccgatgcttttcctcacctttccgaatcgcatccatttgccctggggcgtccttttcccaaagcgcatccatttgacgccgcccgcgggttgccgaattgcgcgttcgaatgccaattgatcgtcgctcaaaaattcctaaagggccaatttatcgcactttttttcttttgctttttgccgccttttcgcccttttgccattttctgttttccctataaaatttcttttcggtattttccgttttttttgtcatttgttcggattaattaataattttttggtcgctcatattccaaaatgaccaaaaaagcccatgggaattaaacggtggcatgtccaccgaaaggaaatgaaatgataaattagtggcggtgtttattaaattaattataagcaagtagcgttcgttggctgtggacatttgtcattgtcaccaatgccaattcgaatgaatgaaaacgaatttactaaatgacagaaagtggcgacaaaaacattcctatcacagaacgatgataaaatattcaaatttataaattttgaactgaattatccaattaaaataatgcgagaaaaacaaatgattgccctttttacccgaattggcagaagtcgtcgcaattttgtggggtcaaatgccattaaagacggcacggaatgacaattggtgaagtcggcggagaagcaaactgtaagcagaatgaacaccagcaaaaatgagagggaatgccaacgcagtgaaaaatgagggggaaaagtgccggaggaaagtgccgacagaacgacgaccattttatgggggaagcgatggatggaaaaagggacgaataacggacaatctgagagggattagggaaacattacgaatatgagctaatgtttgtttaaaatagggtcaagaaagaatcggtagaacaaatttggactggggggggggggcggcaatgaatggcaacggcgaatgttcaacttggaagttatgaagttacattgagcatcaaatttgtgttttgatccattgcaaaattgggtcttaccctccccgaccccttttttaatgtgtgaaagaaattaagacaaaggggcaaattgcgatgggttggccgagaggaggaggaggaagagggagtgacggcgatggcggaaggaatgggcggacggagggaaggcaaagcacagagaataagccaatttgaggaggcattcattagcggagcttatcgaccaaaatatttattcatttttctgcttggacatgacctcagaacactttcaatgagccaacggacaaattaatgcgtttttgaagtccgacaattgtccaagtgcaactacagtagtcccgccccccccccctcccattacgattgtccccccattagcactcatgggaacattgacagccctttgccaattgtgctccaatttctccgccaaataggtacgtaatttgatgggtttttgtgataaatggagtcgatgcctttgggtatgtccccgcgccgttttgtccatcaaaatgcgggacaacacgcaattcttggcaatgaatgaatgcccgcgaggattgtcgttgaaatttgggaattttagcgacaaaaacaaaggaataaaaatggagggaaagcaaagacagaaacaatccacggaaattgaacatttggtaaatttgagggtgacggcgggctttgtctgccgacggacttctcacaatcagtgaaaggagcagaggtggaagcggaaaggaaattggaagggacgacgaatggaaggaattggggggaaaggggaaggcaatgggaagagcagtaggaaagggaggggagggcaatgggacggaaaatgccatttttgcttccgctaaaaaatgctaaatgatcaaaactcaaatttaattcgcgaaatacaaaactcattaatatgagtaattttgctgctgcataattaggaaaattaatgggaattgcgattgaaatcttttttttgtctgtgaaaaatacgaaaaaaaaggaaaaacgatggactaaaattggcatttcgcaagaattgcgtggaaaatattaatctgcaaaacctagcagaagccatcagaaagggacgcaaatgcattaattttatttaccgaccgaattccttctcaattggacaaagtccgtccaattctgaggatattcgggcagattaataacaaacgacaaattgcttttggaagggtacgcagtcgcaaatctaccggcataatgagtccgaaaggcaaaaaaaaaattagtggatttaatcaaattttatgctcctcgatagcagcaccatttgtggcatgcagttcattagagaataactccagcgggcctttgttcttcagccactggccaaaagacgaatccaaaaaagcgtaaaataggggggggggaggagagaaaaaagaaaaaaaggacgacttaaaacggacgattggacacacgaacaataaaacctaatcaaattggaagaagcaaatccttttttggacccaagaaaagtccctaattagttaaatgcaccaaaagtttattcaattatttattggaattttatgggaggcatttccatcgataaaatttgtttggccatacaaaaaaggaaaaatcagtgaatttgtgtgagcatttcaaattgtgtgtatgcgtaaggaaactgagagccgaaaagggaaattcagcagcaaaaaatgcaattcccatgccaaattgaattttcaattgtaaaa

SEQ ID NO: 18622 - DNA, 2286 bp, Heterodera glycines
  misc_feature (1744)..(1744): n is a, c, g, or t
ttttccaactgtaccgaaaacatgaacaatgggtgtgtcctttatgccaacctaattaagggcaattaagaaattaaattttcaaacggatacattttagtaattatgtttttcaactttttttactaagaattttaattgaaaagatttgattagttcaaattttatataaatcaaaatgtttttatattttttattccttaatattttgtaatgcaagaaatttattggaatttagtttttttttattatagaactcttattagtagtgcttatatttttagggttttaccttttttcctgagcttccaatgacctgaaaagcatgaaaaacatgattattttggttgttgttaattgtaagctactttcgagttattagcacctattttttaggctttaatttttagaacctaaaaaacctaaaaaatttgaaaaactaattttaacctattttggcgttttgcccaaatgtattaacaaaaatgcaataaaaatgtcccaaaaatttcagaaaaattcacccctaagaattgaccataaaattttatcaaaaattcctcttcaaatattctttatttttttgacaagaatttttaatatttatctcaatactgatttggctaaattttattgcttttttgggtaaaataataaatattaaaattattttttagtgaccaacaatgttccttcaactgttcaccatgtcattcgatgagaaaagtgattaaatactcaaatgtgaatacaacatagtcttgctttttcgcgcaaatattccattttaattgctttcgctaaatgtcatcattataaatgatttatttttaataaattttttttttctagagattgactaaaaacataaaaaaattttaaaatatggcattcaaaacaggcatagataagcctgttttttgttacacctattttggcatttttagttaatattgaacgcacattgttggagtttttagccccataaatccggacataatttttatttatttaattatatttaaatatttcaataaatattattagtaatgcaagtggtttattttattagacgccatgtttttggtgtgtgacgttttttatcacatgattttggtgggcgtaatgggtgctagcgcgtttgttaaaaactgccagcgcgtttgttaaaactgccaatgggtttgaaaacaaaaaatgggtaaaataattaaattaatagcttggctcaaattcaaccaaattaatatttcgtggtatcattcaatagctttaattgttctctttcagaatataattttcctaaatttttaacttaagtataaaagaagttataaagcattgaacaggctatgttttttgcaatggtaatgcatatataataataaacatttaaaattttaaagtctttaaaatgaaatttaaccaaaattaatttatatttcgatagccctaagaattctctatttatatttaaaattttagaaaatttcattgagtttcaaaaaagttctgaacaaaaaatgctgacttaagattttttgcaattttgtgacaataactttttttatacttaagttaaaaatttaggaaaattatattctgaaagagaacaattaaagctattgaatgataccacgaaatattaatttggttgaatttgagccaagctattaatttaattattttacccattttttgttttcaaacccattggcagttttaacaaacgcgccacacgccncgaagaattctttgtgatgtttactcaattgtcaatgccaatatgtttatataacatttgcaaaaaatggaaaattttaaatttttcttaaattcaactcagggtcggagttcgaattgagctgaaagaaggcaagacccgtccgtgctcacaaatcagcacctcaaattacccttagaaataattttgaaaatttcgaggctggatttatgaaaagacgattcagtcacttgaaagaagaaggtggttgcctggcgtcaattggataatgtcgccttgggacgataaatggaaattcatttgtcagggaatggcattccgcagaatttgaatcaattaattaaccgaaaagaacggatacaattacaaatggtttcaatttcttttgcgcctttccggttttgaccttttcaatgagtgcttctttattaaatttttgaatattttcttttttacttcgttacatttaattttttttttcgattttaattaatttttatatctttcgaatttatttgtaattattttcatctatcgtttaa

SEQ ID NO: 18623 - DNA, 1239 bp, Heterodera glycines
cggctcccggacttttcgacagcaaagggcatttcgacagtaaaacaaaaaataatggacttttcgacagtaaacataaaaacaaataatttttattaaaataaattatattgcttgtcaattttattgaatttcttttaaattaacatactataatatgtattgctaaatcagaattacaatactagagatacgttttttacctaggaaaatttttagaaaaatacacccttaagcaccggtccttaaaattttcaaaaatacactcctaagaagaatgcaaaaattttctcaaaaattcatctccaaattttttatttattttcttggtaaaggaatttagattttaaaaattatttattcccatactggtttggcttcgttttgttattttggagaaaattttacgcttttacaccattatatttgaaatttaattaccttttctgtcgaaaagtcccctcctcaaatttataatatttctgtcgaaatgtcctttgctgtcgaaaagtccttctgtcgaaaagtcctctgtcgaaaagtccgtcgcccctttaaattaccaaaatttaattaaaattcaaaaacgaatgattttcttgatatatagatagatagtatatgggagacggaatatttttgaatttataagagtcagttttctagggcaactaatttttgcatcaaaaacctgggttacatatataccctttttctgattcttaactagacgaagactataatcacaatgaaatataaattttcagggcttccataagggattaagatttgattttgatcctcacttcgtttccgaattcaccgaagaaaatgattggccaaagttggacgtaaaagccagtggaaaatttggcaaagattttctgcgtgacattgtcacctctttaaatccatattcggcacggtaagttgacattattatatatgtatgcaaatataaacctataattaaatataatatgatacgattatatatgtacgaatgaatggatggaatttaaacctttaaccgtttttgaaataatggtcatatctttctttataacttaaatcgcttctcactcataaattccttcaaaattttattaccattaatattataaagccaagggtagatccaagttagatggagtaagagtgggtgagtcacaccccatcaccattatatgtggtccgaatgacggtaaagcaattgcatattttagtctacagcaaaac

SEQ ID NO: 18624 - DNA, 953 bp, Heterodera glycines
aaaatgacgaatccaacgattataaggattcaagaccaaagttcaaaaagagaaagagcagatacgggagaaagtgctgggtacgagcgaacgcagtgggaaccgcagtagcaagctgtcacgcagcagttcagagacacgacagcgtagcagaggcccaacggtgggcgctataaatttgtgctagccaattctgtaaaaaccaacacatgtgcaattatgtcgaaaaattttgtcagaagaaatgcttattattgtttgtgctaggtcatttcgtaaaagtgccaattttacattgtctatataaaaactcgtcaaaacttttcttaaaaacaaccgaatcaaatattcttggtaataaatgatgattcataattttgttctataagcatgaaaaatttcagaaaacttcattcagtttaaagaaagttatggaaattttttgaacatttttggtcacagcttcttgaaaactgaataacattttttgaatttttcatgctaatagaacaatcaaatagtagtatgatgccaagattattaagttgggttttgaaaagttaatgcgagtttctctcgaaatctgtaaaattggcacttttaagaaacgacctaacaaaattattgtgtacattatctttttggtggaattgaataaatttcagttgtcgaggaacgtgtccatttcatcaacaacatcgtcagcaagtggggtatgtaaattttttagcttacttttttatttaaatgtagagtgcgccgggaccgggacttgccgggacctgagaagccgggaccgggacctcgatttttttcgggaccgggaaccgggaccaaccgggaatttttaaaaattcaaaaatttttttaaaattcaaattttaattttttttcaactgaaaataatacaaaatataaatttttattttgttttttatttaataaaatccaaa

SEQ ID NO: 18625 - DNA, 1050 bp, Heterodera glycines
tctcaaacattatggggagcaaaatcccacgcagaataagtacagctatagggagctatccggaaggatcggtctccccataaatctggcgcatcggtcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggtcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacccaaaaaaaaatttattttataaaaattatttaaatgaactgactagataatattttttcaagtgtccgtttggggtactcaaacaattatggggagcaaaaatccaacgca

SEQ ID NO: 18626 - DNA, 2586 bp, Heterodera glycines
  misc_feature (2519)..(2519): n is a, c, g, or t
  misc_feature (2530)..(2532): n is a, c, g, or t
  misc_feature (2534)..(2534): n is a, c, g, or t
ttgtcgaggtcattctcgttctgtttttgcccgccattggcattccattgtgatcaccttacacttaattgatattttgatttgaaatttaatttaaaaaacctgcgttttcaatgtcccaaaccttcatgcatcttgtcgaatgaaccggaaatgacacgatttcctaaaaaagataagaaagaaaattgatggccgagcaaatcaagaggattcaattgctaattccatcaattctatgtaaattgcttggcagtgccaatccaaagcgaaggattgtttttcctacaaggtccaaattttacctcgagcatttatcgcaacacattcgacagaacctaaatgaacagaaaataaataattatagcggaatgaggaagcaagaaaaaaataattttaatcaaaaagtcaattttagtgttgtttaaaaaaattacgctggtggcccctgaaaattgccgtcggctccgcgcgccatttccctttgcctcggctgctttgggcctcattttcgtcttcgtcgtccgccctattctgcgcccgcagtcgcaccaaaatcaaagtttggttttggcctccactcaaagcgaaagttgctaaaattttgatttttttacagctacaaaacattaaaaatgagagaaacaaagggcgcggaatgtaagaaaacgcgatgacaaaataatatactttgatggcataaatgcaaatgccattaattttcccaccgtccattcaaaatgccaataaaagtggttttatgaattattcgagaaagattaggggattaattttgaaccccgcaaaaaatgtttacttccgtcgtcccgagtgaatgtgtccacgcatttcaacggttcgtcgtccaattgtttgacgacggctctggtccattcaccggccaattcccacacattcagcagaccggcaaaattcacggacaaaacactaaaataatgttttatacaatgtccaaaacacttggaaagcaattaaaaagttccattcattcgttttagtaatttgctcaccaattgtggctcaatgttctaagatcggccacccattgcgcttcgttcagttcggcggtcggccgcggggcgggtgactggcgaatgcattcgatgcgcagcacattctccagggacaactgttgctgctcgaccaactcgagcagagagcagcgcaacagcacggaatggagcagaaagtcgaattggacgggcttccaactgtctgaaagaggaggaagagaatcaaagctcacaattgaaaagtcggcgctagttacaaagcgtagtattttgaaaatgttttcactttttttttacataatttgtttttaatttaaaaagtcctgaaaccaagtacccgggggttttagaggtcgctgatcatggatatgacaattatttgggcctattaagcaaatttggcgctagttataaagtgacagatttttaattttatcaaaaacaataggggggacccttttgttttgcaaaatttttttgagataaaaaatcgtgaatatactttttagtcgccataattgtcttgttaatgcttaatattcatcataatgtgtaaataaatttaaaaaaaaattatgtcaaaaaaaagtgaaaaaattttcaaaatactacgctttgtaactaggggtccctgtgccgtttcggcgctcccgtttcggcgccagcatgtttttggctataacttttttctttgtaaaccaaatccgacattggtggagtcgttcgaaagcttaatctatttaaaagctttttctaagctattgctttgcgatgaaagctgtatcaaaactgttatgcgtggaagttgggtaaagtcgaagtgtgttaacgatgttctttgttgaatatttactgggttaacgatgattactgctgagcaaaaagtgggatagcgatgatgaatgctgagcaaaacgtgggatagcgatgatgaatgctgagcaaaacgtgggatagcgatgatgaatgctgagcaaaaagtgggatagcgatgatgggtgctgagcaaaaagtgggatagcgatgatgggtgctgagcaaaaagtgggatagcgatgatgggtgctgagcaaaaagtgggatagcgatgatgggtgctgagcaaaaagtgggatagcgatgatgggtgctgagcaaaaagtgggatagcgatgatgggtgctgagcaaaaagtgggatagcgatgatgggtgctgagcaaaaagtgggatagcgacgatgaatgcttagcaaaaagtgggatagcgacgatgaatgctgagcaaaaagtgggatagcgacgatgaatgctgagcaaaaagtgggatagcgacgatgaatgcttagcaaaaagtgggatagcgatgatgaatgctgagcaaaaagtgggatagcgatgatgggtgctgagcaaaaagtgggatagcgatgatgggtgctgagcaaaaagtgggatagcgatgatgggtgctgagcaaaaagtgggatagcgatgatgagggcttncccccccctcnnntnccgatcatgaatccctttatggaagtgggatagcgacgatgaatgctgagca

SEQ ID NO: 18627 - DNA, 2074 bp, Heterodera glycines
ttctgtaagcaatagcgcgaagatatcccaatggctgtcgctgtgcacggctattaaaaatcgcaagtaatgccgcatcctgttcaacataaacactttttcgacccattcctttgcccctaattccattgtttggggcattgttaaaatcctccacaacatgttgccagtgcaggtcttcttgagacatcactttgacgaatgtactaagaggagggtgtggcgctcgaaacaaagcattgaaagagcgatgccacccctcagttgaattattagtcctgcagctttggttctcaactcttggatgaaataaaatatatattaattattttcaagtaattaccgatcacacatgttccacatttcttgtggaaaaattgcatcagtattttgcaatccagcattttcaatccaatgcctgatccatgcatcggctccaccgtaatcttcctcttcaataggtacagcagcaatttgcataacacgcgaacaaccaacccaacttctcacaaaatatttgacgatttctttattaattatttttttaaatattaatcttaggaaactttttttaccgtaccttcgacttcctcttcttgagggaactgtctaataagaacacacagataattatatagtggttcgcctgggggagtgaaagcgagactgatcagtgatttaatcagggtttttgtatcatccggatcatgcgggtttaaaaaccgctcgttgagtcccggcaaattttgaacctatatttttatgaaatttagcaaaaaaaaaactctgataacccttcggtagattgattgcgcataatggaaaagacagccactatgcacggcaagagggaaaatttgattgaccgcattaattgctgatctttcaaaatccgtcatcactgtttcaggatgccaattttgtaaaagctggcgaactgatgttaaaaccttaaaaaataaaaattttttattaatatttgagtgtaaattattttttaaatttatatttatgtactcgtgcgtattgcgcagtgctctttgactgtagtaaagcataaacggcaggaaccgcaacgaaatcgataaggacactaatattatatagctgagtgaatgggctcggcgcaaccttttaattacttttaaatattatgataattaatttttttattactttaaaagtgccatccattgctatatgagatccgtagtttgcgatcaaatttcggccaaactcagacataaaaacaattagtcgtcggccttcctcatgaccgtcaaaaattgttatttgacgaagccgatcaggaataatcactccaggagaatcaagcaaatcatctcccacttcagcccgtgcctgtgctacgtaattccgaaatgatcttcccattgctgaggaagattgagcttgcgttgcccgaatatccggtgggatgttggttcggacatcgtcaatggcttgtctggtcggaggaggattttgcgcttctgcaaatcggcgcaactccatttgtccccttcgtacagacacatgtacaggagggtgattatcccgggaattgcatataaccccgactttgtattgcccgccatcatcatccctattaattgctccagcgacatgaactcttccaggacaatagggacggcgtttaacacatttccaatactcaattcctaggcaaaatttaaatcaattaggcaaaaattttgggcttttaccctgttcagttctactgtaagcttcaaaatggtactcatatccgtttgcacttagaatatccctttggctactcgatttaagcaggtcaaatcgctgttgctgaataattggctgattttcttcggcaacatcttcgtccaattccccttcctcaggcgctgacgatgatgatgaggacaacattttatttctcaaaaaggcaaacattacatagaaacaaacaataaaatttaaaaacactatgtactttaaatggttaattctaggacgaaattaaatgaataaatgaaaaaaagcaatccgtttaatattcataaacaataacaatgatttgcttgaataaatc

SEQ ID NO: 18628 - DNA, 3193 bp, Heterodera glycines
  misc_feature (3079)..(3079): n is a, c, g, or t
ctctagcattaagtaagtatgcttacatgaatttttcacatttaaatttggcattttgaattgagtttttgaaaagttcaataaaatacttattttgcaaggctccactaaaacactatttgttaaatatatagactattattattcactatataaaaaaacaacaataaataacaaatatgagaacaaacaatacaatttgcatttctactgtaatatattgtaataattgaataatgatgagatcacaattccctcgggtcgttttgactccgtttgcccaaggcatgccaaaagcagcttttactcgacgcatttacaccttcgaaatgagcgccgtgtgcaattcgcgcgcctttcgctcaatttcatcggaggagggattctgtgagaaaggagaaacaattgcaaagaggtcatgggacagaaaattgtcagaatattggataaactctcgggcagggatttattccacggggagaggaggggatgggtacacggcaagggcgtacaaaaggagggcctgacaatgaggggataacccacccccgcccctaaatccaaaaaaataaaattttaacaaattttttgaaattttagtcaattttctaacaaattgcattaaaattttcaaaataattttccggcggcgcccaacagtacacgggagaatttccgggtaaacttttctccaacggagtccccgagtccccagccaacgactcggaagcctagcagacttttgccgaactgtgcggtaaaatttttgatatatttaaaagtaaaattttgtgaaaattcgcacctcaaaccctccccgcccctttgttccgtttcctcacattcacaccccataatgtaaaatatgcgcaccagtggcagtgcaaacgagctactgtccgtgccggttccgtgggtattgccaaagtccaaaaggaagggaaaacggcactgattaagcggcgactgacactgggcaatggtgagcacgtcgccgcgcgagacgtgcagacgcacgcgctgccactcgcgtgcttcggtctctgtttttgcaagtgccattccatcaacgcgggacggcgcctgctgctcgacaaggctgatgcattggacgcgcgcaattgtcacgcgcggttttggacagtcgaaacgctgaaaagagaacaataataagacaaaaaatataagtaaaaaggaaaagcgacgaagtttcttagattaaaacattatcaaaatggattctgtaacagattttgtccaaaaaaatgacctaattttgcgattttgagccaatttggtcgaccccctctaaaaatgtaagaacaatgcccaaactatacaaaaacggcaacagaaagtgatgggtagaaaaaagaacttgcctcatattgtacgtacagtccggtgaccactcgtgtaaattcgtccacagagtgccgcctgaacagctgcatcaaatagttcggtgacacgagcactcgcgcaagccgccgccgcacggcggacacttccgcgcctggagtgattgtgtcgtcctgagcagtgaaagtacaggtgcggttagaaatcgatgggatgcgtttttgtgtcgacttattgggaaaaaatttcgaagggggaaatccgtttttttatcttctggccaaaaatcccaaaaaattttctccagtgttatttaaaaaaaagttcgcgccggggtgaaaaaaaacaagaatttacagcctttttcaccagattgtgacaatttgttttacaattaaaattcgcaaaaatttgttctttttcttgaaaattttcaattttgggggagggaatccccccgccccgttcctcccctggcttggtctgttgccacactttttgtttctctgccaccgtttggcagtgtgctaccaccgccgttgttgctccgtcgtcgttgctgcttttgtgccgtcgttgatcgccgtttggtgctgaaatggtggcactattcgcattggcatcatcgccggcgacaaaagcattcgcaatttggcgttgcttctccaattgcatcagttgctcacggattttgtatggaagcggcttttctgttaactgaaatggaaagaaaaggatttcacagggttttaatcatcaaatcccttcaagaatttactttaaatattaaaaataatttatttgtaaaaaatggagttttgtacaaaatttcaattccggaaaaaatcgaccgaaagaagcagaaaatgtactttaaatgcactttttttggtaagcgaattaaaaaaatcaaaaaaaaacggactcgttttcgcgtctttctttgggacagtgtgtccaacttcggcaccaatgcgttcatgaccccttgagacagcgccagtgggccccaactgcgcaaaaagcgctctctgcgggacatcgtctgggagtgcaagtcgaccaggcgcatccaataagcaatgtttttggagttgaagtgctacgggaaaagaaactttatttttttggaatgggaaaatttttgtttgagccaacttttgtttttccaaggcgcccttcggcacagccgagaattttatgtgctttcttcaaaatggatacattgtttttatgtaaaaaacccagtttttgattcggtgaagcttaaaattcacattttttgaagctagagcaaaaaaaatcgccggattttttggttaaagcctgtcaaaattaaaacccattccagcaaaagttcaaaacctgaatgacttgtctggaaaacagctggttgatccaactgagcatgttcagctccgcctctttgtacgccaactgtttttcatttgcgcgttgagcagcgatggccaagaaaacattgtcggctaaagcaaattaattttgcaaatgattggctattctgataaagtggaaattctaaacagagtgccgacaataatagaaattacactgaaatttctttgattaaaatatcatttacaccgagccattttcgcacattttgatgacattttggacaaacagagctgttgagtgaaagtacaaagctgaagtagcaaatacaaattaaaatatgttaatgttaattccttanaaaactcaatatttacgtaacatctcataacttatgcttacacgtccagcagaggtacaaacaagaaaaccatggattcattcctggatcattctttctttttatggcagaaat

SEQ ID NO: 18629 - DNA, 776 bp, Heterodera glycines
  misc_feature (10)..(10): n is a, c, g, or t
  misc_feature (12)..(12): n is a, c, g, or t
  misc_feature (14)..(14): n is a, c, g, or t
  misc_feature (38)..(38): n is a, c, g, or t
  misc_feature (44)..(44): n is a, c, g, or t
gaaggcaccncnanacgaaaacgccagcacaaacgaanagagcnatgaatatagccctatgatgaatgcacttttgtgaaggcatatttttacgaatatgccatcacaaatgaatatatttatgaatatagccctatgatgaatgcacttttgtgaaggcatatttttacgaatatgccatcacaaatgaatatatttatgaatatagccctatgatgaatgcacttttgtgagggcatctttttacaaatatgccatcacaaatgaatatatttatgaatatagccctatgatgaatgcacttttgtgaaggcatatttttacgaatatgccatcacaaatgaatatatttatgaatatagccatatgatgaatgcacttttgtgaaggcatctttttacgaatatgccatcacaaatgaatatatttatgaatatagccctatgatgaatgcacttttgtgagggcatctttttacaaatatgccatcacaaatgaatatatttatgaatatagccctatgatgaatgcacttttgtgaaggcatatttttacgaatatgccatcacaaatgaatatatttatgaatatagccatatggtgaatgcacttttgtgaaggcatctttttacgaatatgccatcacaaatgaatatatttatgaatatagccctatgatgaatgcacttttgtgaaggcatctttttacgaatatgccatcacaaatgaatatatttatgaatatagccctatgataaatgcactttggtgaaggc

SEQ ID NO: 18630 - DNA, 1385 bp, Heterodera glycines
tcatcttgtttattttttaaaaaacaatctttatcttaacctttagaatgtacttattttaatgccagatcagacttatgaaaattcaatttacctagatattcttaaaatattttttttattgctgctaagccatttttaatagtaaaaaaattcagtctctgtcgtattgtccactgtccaattgtccggttctgtcaaatgacttcactgtccaaatgtccactgtcgaaatgtccactgtccaaatgtccgggagcccccccccccccgctccctgggaccgtacctgcgccggaccccaaaaacctttttttcaaaaaacataaaaatattttttattgtgtgccaattctcacctaaaaagcaaaaaaagtcgtcaaatccaatgttgagacccttggcaatcggcactacccctgccctacccctaccactcgaccccgcagaccctttggtaaaaattttggctgcccccccccttccatgtaacaactttcagtccctacccgatcggggtccgcgacccacgacagtgcccccgatggtcgccggccctcgacttgagaatatgatgaataagaaatacaaggaaaaatcgtttaaattgattttcccctcccaatcaattcattcgctttggtgctaggtcatttcgtaaaaactgccaattttacagaatttttgagaaaattcattcataacttttcttaaatacaacctaaaaaaataaggtatcatacgataaactggctagctctataagcatagaaaatttcagaatatttgattaggttttaagaaacttatgtctatttttaacattgtttgttagaactttatgaaaacttaataaaatattctgaaatttttcatgcttatagagcaagccaagtgctatcgtttaatattttttaggtttatttaagaaaagttatgactaatttttctcaaaaattctgtaaatttcgcagttttacgaagcgcccatgtaaaaaatttaattgtaggctgtgccacctccatccaactcatttgacgccgggcgagcccaattggtggtactgaaagatgaacatgtgtaaagcaaagagaaatattaatgagtgaaaaacggtcattaacaaaaatgatattaattatactaaccgagaacgattaggagaagccagaaattctccgtccgaaaattggccaatttatttttgattgtattgtacatgcttctgcatactgtagtattgtacaacacaaaataaatgctaattgatttttatttgataaattagtaattaaagtttcaagtgagaaaaaatgtttaaataaacatttgagaattgaatttttattaagctcgtatttgcatggactaaaaaaagacaaaa

SEQ ID NO: 18631 - DNA, 2667 bp, Heterodera glycines
tcgcccgcgttgacagagaccaaaaattgcattcttcgacccatcgtccggaacattcgtcgtccttagcccccaatcggcaaataaaagttgggcttgactcggcgagatggaggcgacaattgaccaatttggacccggcttatggcttttccggtatgcaattttactttattttaaacactttcaactgaaatttcaggttattttcaaccggtttcgctgaagatcaatggcaccggtggaatttcacccctcgaaatctttttgatcagctttttcttgttgacctttttggcactcagcacaacgattgtcatttactttatgcacaagtgaattttgtttcaaatttaaattcataatttaattttaggaggggcatcatcaaacagttttgtccttccaagaatggctctcatgatctgttgagaccgggcattcccccggcgcccattcgatcggacgatcttccggccgaatacattctgaagcacagggactcggattatcaatttgcacaggaattcgaggcacttttttggatatttatctgagtgtgcatttctcttttgtcagatgttaccacgtgggaaaaacctcgaccacacaatcagtgaacggaaggaaaacgcgcgcaaaaatcggtacaacgatatcaaggcatgcgatgccacgcgagtgcgacttcgccgtgttcccggcgacccgaactcctccgattatatcaatgcaaattttatcaaggcaattctacattacataacgattctgatcagcatttaacaattttagggatacaaagggaaaaaatgttttattgccacgcagggccctctggtaaatacctttttggcggtatccactttttataatccgtttaaaatctcaaggaatgcaccatcggcgacttttggcgaatgatttgggagcaggggtcaagaatgataatcatggtgaacaggtttattacaatcaatgctaatattaaattttatggcaggtgaccaatttgcgggagcgtggtcgtgaacaatgtgtgaaatattggcctgacgacgacgagccaccgttagtttttcgtactttggaagtggcgtcggttgactcgtcgtatttcgccgattatacggttaatttaattttgcgatattttatgaaaatgctttaaaatccaatgcattgttgttgagtgtaaggcaattcatcccattttttctgatggtccaccaacattggctaattttagctccgcgtcttcgaaatgtccgacactgaacccccgccccaaccggcgagaagcaatggtcgtgtgatttcggcaggggaaaagactttattcaacggcacagctaacactcccttcgacgaaaaagcacggctcgcgagcagcagtccgtcccctcctcccagccttcctctgatccaggccatcaaggccgacccactaaacagctcggcattttcaatccattccaagtcctctcacgagtgagtcgattgtttgaacattgcttaccgcgcccttttagtgttcattcgaccattcaacgacggaggcacgattcggaatatgccaacattgcgagcataattcggccccagtcgaagagcagtggtcgaatgtctgcgatggaaggacgaggtcagaaaattgttttatttattaactataaaaaaaatttaagaaaaacgtcgcgtccttcaattccatttcactagttggaatgattacaaggcgcccgaatgcaccgttgcgttgcttaaagttatgtacaaattgcgcaagatggacgagtacaatcactcgcccgtcgtggtccattgcaggttcgcatttgactatgattctctttgtttgggtgtttcaccgaaaaagaatgtcctctaataatgccccttcgtttagtgcgggtgttggtcgtacgggcactttggtagcgattgactttgtcatggatcaaatgctcgacaccggaattgccgatgtttacaattgcgttgccgacatgcgtcagcagcgcaatttgatggtccaatcggtggttggttcattccacctacatcactttttctctcactcttgttattttctacaggaacagtacgtgttcatctacaaggcccttgccgagttccaattgtttggcgacaccgatttgacaatcgccgccttccgtcgtcatttcggccgactgcgtcagcctttgcaaacccttcgggaacggcatttgtcccttggctgtgtctccagccgttcaagctcggtgcagctgggtgatgagcagcaccctcgccagaggacagtcagtctcgctcaacgagaaagggaaggcattggcggcgcactgaggacacggctgcgactattacgggacggaaatggcatcaatgccatgggcggacaatcggtgccaatgcaaaatggcgtagtgggattatgtacgagggtacaccgaccgaaaaaccaattggaactggaattccaggtaaaaaatagagctttttctgtctcctccctcattgccagccatattttctattgtcaggacctttcgattacactggaaaaaccgaaatcgacagaatgggcgcacaaggaagagaatttggtgctgaaccgcctctttgaagctgttccttacaactttaacagagtggtgctcc

SEQ ID NO: 18632 - DNA, 2710 bp, Heterodera glycines
  misc_feature (2691)..(2691): n is a, c, g, or t
tataatttgaaagttataattattatttttttgttagaatatcagtgaatgtgaaacggatggtgatgatggtgatcattcatattgtgacacagaattagtgatcagtgctgatcaaattgatcagctccaaaaattgccagacagaaacattcacaaaaacactgttatccaaattaatgaaaccggtcagagttttcatgggcgaaaattgttgcagcaacagccgccaggtaaaaatgtaaaaatttattaaaaaaacggatttattttttatctttgaacataaatctataatatgtatgagattaaataaaattttaattttttttcaatgattttggcaactttagcaggtttaggtgccgaatttttaaaatatagtttctatcaaaagtcttgaaaacatatttccgacagggccaattggacggaaaacttttttgaccatgcatattttttcaaatcaattcaaatttttgataaatatggtcaaaacagatgcgtctaaaactcataaattttcttaaaaaatggcttaaatagcaaaaattggtcattttgggtgaaatatagtacaattcacaacctaattccaaaaaattttctcggcgctttcgccgcagtcataaaattcactttatatgctgaattgactcagataccggaaagcattaaggattgacaaaatttgaattaaaaaaataggtgggaaacgtttttcaaaaatttcggcttcgaaaatttcgtttttttgtgcttcgaacttcaaagttcgaataaaatttgggctttgccctcggctgcggcttcgagagctaagccgagcttcgttcaccctctgctgctcccgattaaatttgattttctcaacaaattttacagtatgtccgtcgggatatgtgctatttaattacatgaacgcatgcaattatccattgtctgtgaccgcagcgagcagagaatatcccccagcaacaacatccgttgctgctaacaaacaagtgtctgtatgtgcacaagctgtgatgtcatcgggacgagtatgggccagcaccgactgtactgtacaggtagaacacatacagtatacggatgcgggaagatggatgccaaacatttgtacattttaaataaatagattaagaagcgttaaattctgtaaacaaaaaaatcggtataaaaaaaattccaaatttccttccggcgacgctgtcggcgttggcatcacacagaacaaacctaaatatttttttagattagggcttcttttggttagaatatcttaaaacctgacgatgttttttttgaaattttgcagaatactactcatagagaacattaggactattaaatgattcgtaagcaattttttaaaattttggcaaaaataaaattaagacattcatttttgtactgtatttaaggattcatgtgtagcggcacagccacctgtgtcgctgtttgagatgacttttaacgccgatggcagtcagtttatggatgttagctatgtggacggaattagtgatccgatcggtgtccgtgttaaaaactgtcagcagggacaggatcagacggtcacatttgacccacaggcggtggccaatttgcgggcaatgtttccacaaatggctgaaacggacaccgaaactggcgtatgtctcaaaaaatatatataataatggccagaaatggcacagataatagtggaaacccttttttaatagctcaaagaatttaaaatatttttttttaaaaattaaaaataataatggcatttttgaatactaaatgtttttgtttacatttttacaggaattttgtgcaaaattagtcattttttatttgtctgtttggaataaaaaagaaaacattttatgaaaattgaaccctactcatagtggatgattccgtgccaaaaatatcggatttgaattgaatttaaaatacacctcctggaatcaaagcctgaatttcgattgcaaaaattctatttttgaaaagtgatttatgaaagaagaaaaagcgctaaatatgtaaaaatatatttgacaaaaaatctcccgaaatatttctaaaaagccaaaaatatttgccaaaaattaaaacaaaatattcgtcttatcattcgatagtccctaaatgttctctaaaatttaaaaaagttatgactaaaagaactcaaaaaccttctgtttcgaccatttttggctataactttttttaaaattaacaaaaaattaaacaaaattttttatttagatggttttttttaaataactaacgcccattatgacttaccactgatgataatcatccgttaaaaatgtttttcatattcccttgaaaaaaaagttagtgttttacccagggctcccagattaaaagtttcaaaagcctcatttggtgtgcaaaaaagcctcattttgagtcaaaaagcctcatttttacaactttattcaaaacacgcttattccaaaaaacttttggggaacaaagggggccggcggtgccgataggcgtcgccgggggaaaaattaagaattttgaccatatttttagtagattttcattgaaaaaattcttaattttgtgaactttggaaaaattggttattttctggtttttatgaaaaatttaacaattttttttttagaaaatttagaagggattttcgtttttccccanaaagcctcaaaaatcctca

SEQ ID NO: 18633 - DNA, 2432 bp, Heterodera glycines
atcccttaccccccccccccctcctttcctttcccatttcttgtttccctcctcttccagcaccaactcttcctcctccgccttgcgtctcttcctcttcaacaaatgcttctcgtcttcctcctcctcctcctattgtccctcctctgacaacaacgcccctttcttcctcctcctctccccctttctcttcacctctctcaacagcaaatttatttggcctttttgaacggatcgcaaatggatcattcgttgacgcgaatttcggaatcagtggctttttgccttcggctgaaagcattgcgcaaacgcagaatttcaaaaagaattcagcggcgatgacaatggacgaagtgacggcgttttccttgggcataaatggcggacaaaaacaacaaaatctacggacaccggcgacaattgacaaacttttacaactttcgcagcaatttttaaatgacacaaatgaaatgaatgaggaaataggcaaaaagaacggacaaaaaaagacgacgaacggagcaaacggagggacgacgccgcgaggcgaagagaacggcacggaaagggaggagacggccaaagggagcgggggagggccgaggggagccaacgcaggcggagacggtagaaaaagggtaagcgaagcgagggacggcaccacccccgggggcatttcatgttttatcttcttgtcatttactcccccaaaacattcaaaaaaataaatcattttcatttgtacgattcccaatttttgaaatgcattaaatttattacgttcatttcataattttgtagcaaattttacaaaatgctcttttgccggtcattttcaagaaaattttttgaaaccgtctaaaaaatgtcaatttagttatttttttagatatttatgtatgtggtttttccgattttttatagcaatatcggcacccctgtaaataactaaatgttgagtatcaaaaaatagcgcaaggaaaaactcgcttgtcatgtttcagcatttttcataaaattgaatttgaaccggtttttagaccggttcaaaaatcggtcaagcgagtttttctttgcgctattttttttatattcaacatttagttatttacaggggtaccgatattgttataaaaaatcagaaaaaacttttgggacaccctagtatttaaataattcacaaatatttatgaaatagtacaaacgccgctttgatgtgataacccgcaggcataagcttaaattagacatagtaataattcaaatacaaaatataaaaaatattgcaaatcttacttgaaaataatcgattatataaaataatttttttatttaaataaattgcggatatataaaaacgactctaaatgcattttattaaatcaataaaatattataaaaaatatacaaatgaaccatcaaaagaattttttaatttgtatgaattaaataattttcgctgttcaaggataaaaatgaaacatttttattaaaatttaatggaaaatcggccaagaaaaggatttttgtcgcttgaatttaataaaaatgaatttcaaattttgcattcgaggtaaatcgataataacaattaatgaatctattaaaaacttgcggcgcaagcttataattagttatttattcttatagttaaaaacttaataatacatttagacttaaaaaatagtttttataccaactacaatcgtaccataaataagtgtggacacaaaatttatttaaccagaaactttttgaaacccaatgaatttttttaaaatttgaattcttaggcctattgaaagatattaattattagcttaattgaattttaatacttgaaattttaaatgtttataaaatttaaacagctatacgtgattgattgagacacacataattcaacacaagaaaaataatgattatttttattattgtcacaaatatttaaaagtctatcaagattgaaaataaaagctattttcaatgaaatgaagctttatttatttgaataataagaataaacgataaaaataaaacagaaattaaataatttattagcgaaattactatatcattttgtctattaaaatttaaaatattatattatattttatgtataattcgagtaacttaagccatggacacaaacgatcgtcgttggtcttttcttgtaaatagataattattagaatgaatcaaaaaagttgaaaattaaaaaagtgatcacctttttttaaattatttatttttcgcatcaattattttttaaattaatttgttaaacaattaattataaaaagaagatacaataattctaatgtatacgaagaaaaaaggtaatggaatgtggtggaaaatgatgaaaagacatgagaatcgtattgtgcagtatttgtaattgaacaacattttttagtgcgaaaaattct

SEQ ID NO: 18634 - DNA, 215 bp, Heterodera glycines
tataataacgctgcggacatctacatttttgaattgaaaaaaaattggtaattactctttctttttctccatattgaccatcatactcatactcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 18635 - DNA, 1254 bp, Heterodera glycines
tttaaacttactcaaaaatgagtaatttatctcaaaaaaaaatccaaaaaatagaaactttccatttatgtcgctttttgctaaattgttgttggccagaacaattaacggtcaaatcaccctaatttttataaataaaaaagatgagatgttttcttgcttccgtcatcatcatcatctcgatgatggcagagcaattatccattcgcttgcaacgacattctcccggacagcccccaggcagcagaatgtggtcccctcggggggcttaggaattcgccaccgcccctgggggggggggggggaggggaacaaagtagcaatgaaagagtgtggcgttgtgttgagtgaggccacagcagcacaagccgagggctgggcatctccaccaccaccagcagcaacagcagaagcacataagacaaatgattatttgttccgtggcgaccgatttcctcccctcggcggggcaaaaattgtggccccaaaaactgcaaaaaaaaaacatcaccgtagaggggtggcaaagggctggctgaggctattttccttcatttccctttcctgtccctccacaagtctgttttgtttgagaaaaaaatcgtggaaataaaaaccggcaaaatggggccccacaatccaccatcaccagcagcagcagaaaaaagccccatgggaaatgtgtgatggaccgaccggccaagcgggagagaaagaagcccaacattatccaaccacaaagcatattatcatcaattttcttttatcggttagtctagtctcttttgcttggcactttttttggaaggtccaaaaatggcatttgacttagtttcgtttttgatgtttccgaaatgcaaggctctaaatttgaaaatttgaattttctacaaataaaattggacttgtgtgtgttttttataatttcttttctcatgggactctcaaatgaagagagaggtacaatcggtttttttttcatagactggtcaattctcacaattttcacagttttatctatgctttaaaaaattatttaaaatttgttcaagagtaaccaaatttttaattcttggtgacctctgttagcctgtaaactttcaaaaaatttcatcaactttaaaaagttattgccaaaggaactcaacaaaccaaatttttttttggataactttttgggaacataacgatatttttgaaatttgacaggataatagagaacatttagggctatcgaatgatttcaagaattaa

SEQ ID NO: 18636 - DNA, 2126 bp, Heterodera glycines
  misc_feature (110)..(110): n is a, c, g, or t
attcaatgtaatcaagcaattgagcacttgagagggcagggtcggtagttcagtgggtagaacactgatcccggataagccgaggcgccggttcagactcggctcgcccnacagtttttcactgaaaagcctcccaattgttaaaataatcaaaagaaatgattttttcttttactgataagtgagttttttggcttactgatcagcaatggcattttattaggttttggtcttttctctgatcatttcctttccaattagccgatttctctctcagttcgtccatcttttgctgccccatctgtgccttcttctgatcaccgcactttttgtttctttcattgctctgatcattcgctttgtcgaagcacaaaatgagcgagaagtaagcggttaaaaacgaaattaaacaaagaaatgaacaaaaatttttttaggaacaaatgcaaatgttggccgaccttgagcagatgagggccgaatttattgtgcacttccgcaacaaaccgatcattctcggcggcgatttggatgcccaaactcgcgcttttgtcctgcgcgtgctccgcgtcgggtggactcgcggaagggcgggcattccgttgccggaattcgacgtggacaccaccaccaacaacaacaacaataacagcctcagcagccttccgacggtatggacactgccaaattcgctgctgtttgccacttcgcttgtctctcgcattggttttgccgcctccctcccaaatttagcattaattttacaaaatatttccaaggctatggccacattgtgccaagaacgccggaaggcaaaatgttatgccaactgttcgcgctcatcggatgccctctttttctgcttctgatcgccgacattgacaaagcaatcgccaatttgtttcaatttttattgcaaggattcaccgagttgacaaggaaaatatgccggaagagaaccgcgaaaaagagtcccattaccaatggggaaaatggggtaaaatgtgttgaggacggaccacaacagcaaaaagggtgcgccggtgccgaaaatgggtgccatttgggcacaacggcgacggatgagagagtgtcggcattggcagcagtgccatttctgttcgccttctgcgcattgactgcctttgcctacgcacatttggagggttggcattggttggactgcttctacttttccttcatctccttttttgccattggttcgtctcttccccttcgatttgttctttatgtaacgggtgccaaaatcattcctcccccccccaccttcttgggactgtttttaaccattttcctactgtaggttacggtgattttgcgccgtccaattgcgcttctgttctgttcacaatttgctctgttgtcatcggaatgtccatgtgagtttttgagcagtcctttccaaattcgcttctctttctttttcagtgccactcttttgctcgattttattggcatcgaatacatccgaaacattcatcgaattgagagaacggcgaggggaaaatgttgtgggagagaacggaaaaagggcagcagagggaaacggaaaaggacgagcagaagccggaagaaatgaagaacagggggaaccattgagcaactgctgatcagtcacccggccatcaatcgataagtgatcacttattttgcccaccactaccctgacctatgaccattttttagcctaccattaaccgccgatcactctttgatcagtcggtgggtcagtttatttaaccattcactgtgatcacttaccatccctacgccttattatgccaattaaatttggtgttagtgatcacttattttcaaccaccgtccctttgccagaccaatttttgatcagtgatcactgtttgctgataaatcaataaagtgtacaaaattaataaccctttttatcaatctctgtttgttttgttgctgacgatttttgagaagagatttatgaggatttgggtaatttgaaggggacaatgtgatgaatggatggaaggtgagtgattggtaataacacgtataatcaaaaaggaaaaaagcaaagcaatttgtaagaggaatgaatgaacgaacaaaaacagaggaagaagcatcaataa

SEQ ID NO: 18637 - DNA, 2110 bp, Heterodera glycines
aaatgcctcgcaaaagggtgatttccaatccaaggccaaggtgtgcccagacagtcagcggggagacatcactgatcaattaaattgtaattgacgctaccataagagaagattttccgtcgtcacgtgacactttcctcggccagcagcccgtgggacagttcggtcttttctatggtccttcgattgcacgtctctctgagctgcggcatctcctcctggtcctccgcttcgctatgtagctgctcttacgttggcattgtgtccgtgccatagtttgttggttcgccctcctcttgaaagcgttcgttcgcttggaccattttcgatcataaaattatggccgaggttttgacacgcccccccctccccccccccttttttctcctttcattttgttgtcctcttttctattttcagcatttcgttgtcctcatgcacatttcgttttcctttcttttattttttccttgttttttttctaaaaaaaatattttccaagaattttcatgccaaaaccctcaataaaataaattttttctataatctttgacaatgaatgataatgatcaaagcgacgccacaaaggtgttaaatatttaaatttattaaaatgcaattattttccaaaatatttcaatttatttaatttattcaattgtcatgtcctttttaggtgcgttgtcgaagtgagtcctatcgcatggcaacgaccgccggcggcggagggggacaaattgtcgtggacaaatcgacgactttcaccgaaacgacaattgtactgacaccggtcgaagaaaatgttggcggaatttcaccgatggaaaacggaccaatggtggccgaggtcgaaccaaaaattgaccactcaaagccctaaaatgggttgataatccacatggattagccgaagagcaattaaaaccgaagggataaaaatgagcaaaatcagtcgaaggaattgggcgatcagagattttgtacgtttaggtcaaatcaccggcaaaatcggagtcaaaaacgaatggaaaagcgaaaaatatgaagaaaaagttacgcatcaaaaaaagggagaagaaaaaggaggacttggaggagttgaagaaggaaatgaaaatggtgaggcgaacaaaaacagaaaatgattattgtttttgggcggctttttcaggacgaacatcgcgtgccattggacgaactttgcgaattgtatggcacaagtttggagaaggtgccgattcgcgtttcaattgagcattgttttgttgaaccttttgccccagggcatgccctcttctcaagccgactgcgttttggcccgcgacggccccaattcgctgtcgcccccgcggaccacgcccgagtgggtgaagttctgcaagaacttgttcggcggcttcgcccttctgctgtgggtcggtgccattctctgttacgtcgcttattccgtcgatgcgctgactttggagcggccctcaaaagacaacgtaaggcaaagggaacgaattgacaattaatcagtgattgattttgatcactttcagctctatttgggcattgtgcttatgagtgtggtgatcatcaccggctgcttccaatatttccaagagcgcaaaagttcaaagattatggaatcgttcaaaaatttggtgcccacttatgcactggtgatcagagacggcgaaaaacggcaggcatggcggagtgacagaatgccaaaacgcgggaaatcaattttcagattccaagcagccaattggtggtgggcgatattgttgaagtgaaagggggcgacagagtgccggccgacattcgcattacccaggcccatgggtttaaggtgggtcaaacgcggacacaaactcatttaaagcaattagggcactgtaaccgttgcgttatacagcaaactcatcatcattcattaaattaaaagattattgtcaatataaatttatggccaatctatcgtatatctttatttctcgaaaatcactgattatttgataaaattggtcattttgatacatttacaatgacttaaccatttaggtggacaactcatcgctgaccggtgaatccgagcctcagtcgcgctcacccgactgca

SEQ ID NO: 18638 - DNA, 1454 bp, Heterodera glycines
  misc_feature (88)..(89): n is a, c, g, or t
  misc_feature (1391)..(1391): n is a, c, g, or t
gaaaagaatggcgcagaaaaattgtctggtgaaaaattgggaggcggtggaaacgctcgggtcaacgtccacaatttgttcagacaanncaggaacactcacgcagaacaggtggtcgagaacagtgaataaataaccaattaaatggagcggcaattagctaattgaaggatgacagtcgcgcacacgtggcaagaccttcgaattgaaagcatcggaacgtcggaagacgcgcgcgggagggaagacatgggcacggcaatggacaccgacactgggcaggtgctactccgcgtggccgccttgtgcaaccgagccgagttcaagccggggcaggtgataagagcaaaagcacacaaattggcaaaaaatacggaattttaatttattcttacggtaaaattattccaaaatgcataatcattagcatgcaattagcgacattagcagcattttcattactcgatgctcactttttgttagcacgacgtgcccgttctgaagcgtgaatgcaccggcgacgcctcagaaattgccctgcttaaatttgcgcagctttcgcttcccggggaagacggagtcaaagaatttcgccgccaaaaccaaaaagttgtcgaaattccgttcaattccaccaacaaataccaagtcaagcgtttgcatcttaacttaattttaggaaatacaaagttcaggtttcggttcattacaccgcggcgaacgaaggcaatttgctggtgatgaaaggtgccccggagcgagtgctgtgccgttgcgatcggatgctaatcgaaggcgaagagcgacccattgacgaagatttacgcgcggcttttgagaaggcttatttggagctgggcggaatgggcgaacgcgtgctgggattttgcgactgcgcacttgacaaggaccgatacaccaaggtgaaaaataaagaaaaatgaatttaaatgaatggggggaggaaaagccttaggggagggaaacaatcgacacaattaacaaaacggaaaggctagaattggcatcgtttccagcaattccccttcaacgcggatgagcccaacttcccgttggaaggcttccgtttcctgggactcatttcgatgattgacccgccccgcgcggctgtccccgacgccgtggccaaatgtcgaagtgccggcattaaagtgaactcacaaaacttactaatacgtacgcccacggcattaatgtgtgaacaggtggtcatggtgacaggagaccatccaatcaccgcaaaagcaatcgcaaaatcagttgggataatttcggaaggaagcgaaacgatggaagacatcgctttgagaaaaggcattacggtggccgaagttgacccgaagtgagaaggaagagggtcggacaaaagncgaatcatttggatttaacttgtaaggggcaaaggcaatcgttgtgcacgggtcggacttgcg

SEQ ID NO: 18639 - DNA, 1409 bp, Heterodera glycines
  misc_feature (15)..(15): n is a, c, g, or t
aattgttatcctcgntggtctaaaatttatatgagaccctatatacctttcctattgatttggcaaaacgcataggatggaaaacggagtgggtaaactgagtttgcgatggtaaggagcaataatgaccgaatatgtgttggagaggaagggcagagctgaggaaaccaaataagtgaaggagaggggggtgaggtcacggcgtcatcttatcctgtaaatcgattcctctaaaaggaacaaatggaaagaggctaacgccaactgctttcttaacaaaatccaatatttagattttggtttcgggtttatttgaattattttccttttctctgtaatacactttctctactcttctatatctgtttactttcactgttattccttattaatttcagacctacatattgtctaaataatcgtttcctttagctatttttcaatatcttttcttccaacactatgttttattctcgaaccgttatcttccaagtgttcgtattcttgttctttatcaaactattctcttctctatacattacctaatgtttgccttactaactcacattaaattctcactatttaatattgactctcttcaaccacatttctgagttctctatctctatctcttacacccattattaattgtcattgattctatggtgcactacaatatcctcatatgatttcttcatttattcctattacaagacctgcttcacgcatacatttagcccttatctaccctttctcgtctgttccttattataattagaattattttacgttgaattaggcaaggagcattgtttgtgtttatgattaaaattaactagttttatataagttaataaatattatgcagaactttcaaacacacttatcctcaccctcgaaaaaacatacaatacacacacatacgcacacgcatagacacgcacacacgcgcacatgcatacatacgcatacacacacacacacacaaacacacacatacacacacacacacacacacacacacacacacacttacacatatacacatgcacacacacataccccatgtgtaatttttacagatttttgagtaattccttcatttaatcattatttttcttaatttttgttaaattgtatattctattccttaataatttacaaattgtgtcttctttctcttaattctgcatatttctacctaaaaacgacgttcccaaatgcttaataatttacaaattgtaacttccattgcttaattctgtatgcatgttcactccttaattatgcacttttctacctaaaaacgacatgctcgtgcatattttaaaattgtatcttctattccttaataatttacaaattgtaacttctttctcttaattctgcacttttctacctaaaaatga

SEQ ID NO: 18640 - DNA, 3479 bp, Heterodera glycines
  misc_feature (3401)..(3401): n is a, c, g, or t
tacaattgagaatctactgagccaattgaagtcatttatgtaagcaatctcgacgaggcatatgcaaatgtttttgaacaaaacgaggcttgaaatgttgcgaattttatggaaaaatatttattgtattattcatttgaatttacccaataaacattttgtcagacacatatgtaacattttaatgtagtggtgcaattcatacttattgattttgctattgttttgttttgtcatttctttcacgagaaaaaaaacaagaacgagagagaagagaaagaaagagagttgttcattctcattgacttgaagttttttcacgtgaagtaaaaaagaggagggttggccgaccgatagattctcctttatcacaaaaatgttcaactttacttaacaataaaccccaactttttgttaattgctacagatgaacttttttaaaaattcatttttgaccatagctttgcatattcccttttcaggtagtgtaataattcttattgtaataaaaatgtccgaaaagaagtccgaaggttgtgctgaaaagaagagcggtggattcaacacgcagaagtttatgttggacctcgcatccggcggaactgctgctgccgcctcaaaagatcgaacggtatcgcaacgagaaaaagtggcgcagaaattgtttacgcaattcgttttccaatttcctttccgtctgtccattgtcagatttactttctattcggtgttgtggctcggttggttgtttcgttgatgttcgcccttttccttgtccatgtctatccaaaaatcctgagcattatcagtgattattgcttattacttttcattttaagtcctttagactgatcggaagcaaaagtcggcggacacaaagcacgcaaaacggagaaaggtttgcatttgcgtgtgtttggcagttggactgcttgagagttaaggtttttgagtcccggaaatcccgaggggatttgcatgggaaacccattttggaaaagtatttaaacagctaagacttcctcaaatggatttatgccaatgggaaacgaaacatttctggcgccctgtgttggttttaaaaaattcaaatctaggccataaaacggaaaagtacccattttcgaatgaattcttagatttgtcactatccgctaatatataaaacccggacttacccatgattgctgcttctttcattttttctgccaatttgcctttctttcagactgatcggaagcgaaagtcggcggaagagacggaaactgcgctggaggccaactatccgtcggcacagttggtggcagaaaagcgtgccaaaatggaggcggacattcgccgcgtggcggtgccgccccatcgctaccaaaatctgaagcgccaatgggcaaaagtgacggcaccgattgtcaacgaactgaagctgcaaatccggtcagttttgccggaatcggtgtccattccccgcgcgttgtctttaattaatgccatttttgaccttctaattgtaggtttattttcaggttcaacttgaggacccgttgtgtcgagatccgttgtccggacgaaaaagcggccggtaggtaaaacaaaaagtattaaccaaacaataggcagatgatcatttttcaatgatttctgattaatattattttgttttaatcaattttagacagttttcaactttttgttctattcgcgtttgggattcggaattaataggaatggatgtcagattcatattcaacgacctcgaaaacttcctagaagacgaattttacacgacatttttaaatttttattattttcgaaaaatgggagagacaaagaaagcactattaccgacaacaacaaagtagtttactggtcaaaaattttacttacaattaactcacgtaaagcgtatgagctaaaaatgaacgtaataattgtattcagcgcataaaattaccctagaaaaattatgttaattttcaaagggatcacaaaaaggataagtagcagcattgaaataattgggtcactaatgtttcagatttttgtgcacgcttttctgctcggatttgaggtggacgatgccattgcgctgattcgccttgaccatttattcttggaaagcttcgaagtcaatgacggtatggtaaacgcgtgtcaaaaaaatacgaatagttcggagtcccgaccaaaaatactcgacaaaacccgaaccgactcatatgtttattataatattgtaccttttttccgggtcaactaagggcttatcagttcatttctattctcccctgtgcgcttttcttgccccaatttgttcgtacttcttttcccgcacagtgaaacggctcagtggcgaccatttgagccgtgcgattggccgaattgcgggcaaagacggacgagtgaaaatgaccattgagaacgtgacgaagacacgcgtagtgctggccaacgacaaaatccatttgctgggcgcctacagcaatttgcgcgtggcacggcacacgatttgaactcggaattcagcatttttcgagtatattcaaaattaatttttgtctattgcctttaacctcaaattgtattagataaaacttccagattcaagctttggacttagaattttaaaaattcatcaatctgtctcggccatcaatagtaaacaaatttattttgatttttgaccaatatgcgtctacttaattaggcgaagtcgcgggggtcttaccacactcaaattatcattaacgcaattttttatcaacataaaataacgaacagaacaaacaaaaaacaaccctccaatgactgctcgtaaattcctcttcgccattcagtcgagttttttgaatccaatgtcggaggcatattcacggaagcagcgacgacaaacgttcagtgaatatttacgaatcagtccatggtggttgaagcagacgcgacacgaacgcgagccgggcccaaatttgcgcggccgggaccagtggatgttttcgtgaaccattttcaaacggaatcggcaattgaagcgtctttttgaactaaaattagtataaggcaagaaattaacgaactgaaaaaatggtattgaagcaaaacaattgaattatgaagtggagaaaacaattcgccaatttatcgcaaagaattatcattgcaaaacaacaaaacaataacagccaaacatagacgaaaagagcgcatatcggaagtcaattcgcactttctttctcctcctcagccttgagagtgcgaagcggaagagtggcgacgagcgaccttttccgcctgcttttcctaaattacaaaaagttagcccccgtgaaagaaatgtatcggttggttccatctcgccatccgcttttgccccggctttacctttgcgtatttagcaagtgtttggntggtaaagagcggcttcctcgcgtcgcttaacacggccggttgtttttcagcgcaatgcgcctgcgcttccgttgcac

SEQ ID NO: 18641 - DNA, 979 bp, Heterodera glycines
gggcccgtagaataagaaggtggttaaatgaccgggtcaaacgaccatggttatttgacctggtcaaatgaccacgaagttggtggtaaacccgtagaataagaaaatgaccacgaagtgacgtttttaccaccaacctccgtcaaacgaccatgaactatgttcctattctaccgggttacttaaccacgtgcacttttgggacaatttgtttacacattttttatggaaaaataacttttgttttttaggtctatcgcataacaaatcgttgccaataatcaattttatgttttacccaccaaatgttacatatatttttcaacaccaatatattatttatttgtgagttgaaaaagaaatgatcaatcaataaattatattttttaattaaatcaaatcaaataaatttaggatgtcaatttttaccaaggaaatgtcaagcgctttggcgcaaaaagttcgcgacaattacgaagaattgtttccgcaaagcaaaaaggcagcgttttcgcgccgttcgcaaattgcttgggccaacattacttcagaaattaatgccgaatttggcagcagcatttctgaaaaacagtgcaaggaaaaatggcacaacttaaagaaaatagcaaaaagagaaaacgcaaacgaacaaaagtgaagcacacaataattattttttaagttacattttacaggcatccccgtggcacgggcggaggaccaaaacgacttgaatctaaggacccggctctgcaaattattacggacactatgggcgagagcgcctcattcaaaggcattcccggtgggcggagttcggtgaaagccgacgaagcatacagtgatgttagtactccaacatcagtagagaaagaagtgggttactattgtgttatattagtactgtaaaaatataacaatttttaggaagacgaagatggttacaccacgagcgaaaaaaattccacgttgggaaaaa

SEQ ID NO: 18642 - DNA, 2241 bp, Heterodera glycines
tttgcatattttgccattttttcaaatattttccgatttgaatatgtcttaggaaaaattttgattatgcctaaaattaaatccaaatctgaatggatgcgcgagtaggcaacagtgagcttcactgccgaaaaccttgagaaatttttgatttgcaattacaaaaacaactgataaaatttatgaggaatatatttttaaaattattttgcatccctaattttcaaatttttttgtgcatatttggcaattttatttgcatatttaggtgcatattttggtcatttttcgtgcatattttttgcagccctgccgattattcttgttatatgtggtgcgatatttgaggatttgacatttgaggacccgacatttgaggatcgacatttcaggatcccgacatttgaggacatgacttttgaggacccgaatttggaggacccgagatttgaggacatagacaattccaaaaaaaaataaatggaaattttgttttgtatcattatgaaaaaagaaaaagcctttcccaagggtcaacgagaacgaatatgtcaaaaatttcagggacaaccgaataattccaatctttcgtctccacgtatagcgtataacatcataattccaagatctgcctttgaatttttcacttttcttgttgccttgtttttggtttaataatttataacagtttaaaaacatttttgtaaatataaagaaacatactagtaagacaaattttgtcaattctgcgccccatttgctttgatattttgttgaaaaaatattggggcgtatattccttcgcggcaatgttaaattcgtaattgtccaacacgaagcttaaggggaaaagtcttgcaaaaattcttgataatgatttgaagttgaaataaaatgaaataatcattttaataattttcatttatcagactcatcactgttctgaagagagaggagcgaattgcggccgataagctacggcagtatgagttgaacccactcaggggataagaataaaagtgattctagactatttaagtaattttatgacattttgtgcctatttcatactttacgaggattttttttcaaaaaataaccattttaaaacattttatttacatatttgggttttttgtacatattttgggatttttcacatatttatgtacagatttggaccgatttttgtacatatttttgacagccctagtcaccacttataaaagtttttccaccaaatgcaaaatgtttttcatcctttcttttagcttacgatcagttatatcaagaataaaacgggattggagcttcatccctatataaaaaaatcagttttttaaatttattcggttgactgttacactcaatgcccgatgtagaaatttgttgatatttagcggtaatttgaagcgattatgcaacgtcccccctttatgaaaatagttgcgggcgccgaacttttcgacagcgaacttttcgacagcaaaggacatttcgacagaaatataataaattttatgtgggtacttttcggcagtgaagaataattaagtccaaaaaatcctaaactcttggatattttcttgaaaaatagcttgcttcttccataaacttatgccattcatcatcatcacgaattaatccatggactaagcgggcttttgcataacatattcaatcccattacatgttcttaaatcacggaaactctttctataaatatttaacaataaaaaacgcaaataatatttcattctatatgttggatttaccggtaccaaacgtcctattttttaacatttccttccttcgggtatttccaagttcggtcttttcagccacgtgcaaaatttggacatgtcgatatatttaattataagagagggaaattttacgcaaaatttaaaatacgcagttaaagtcgtttctctttttgatgcttcatttatttcttcttccgttgcacatttttataaaaacactgctcagtttctaaatgtaatatctaacaaatccacagaatgactttccctgcattggaaacttaaattttcgccaacacgcttcacaaggacccaaattttacgccccgaggtatttaccaacttcatcataatttaatgtttttaaactccatcttcgcttaaaaaagaacattcaacattcaatcactgcagcatatcctttataaatataatcataaatgtgttttacagcagatatatcagcgactctcta

SEQ ID NO: 18643 - DNA, 2288 bp, Heterodera glycines
aatatttcatttaaaaataacgtttaaattacaattagtttttaaatcctcattaaacaatatgtattgaaataaaataaactttaaaataaagatatatacattatataaggcattaattatgctatataagaaaaatatcaaatgaaatgaacaaatttacctattaaattattatgcaaatcatattagtgatgaagctttaaataaaataaataaatttcagcatagatgcacaaaataaaatgaataattcaaattttttgtgctagtatataaatatataagtgaatccatagaaaataaattcaaataataaaaatattaaaatgtttttttattaaaacttgtcatcaaataaaattcgtatggatatataacactataataatttacaagtataattgacataaaaaattttattaattttttttttacaatactcaatgtttgaagttaactttgaaagatgaaccgcttgccaagaataacagactattaataaaaaatttgattagaattacaacaaaacaaatatattaagtcagaaataacaaatttagttcatgaaatatataattaaatgaattttacaattaataaagaaaaaacatatataaatttaaaatatggaaaaagacggattcattaaaattacaaataaacaaagtaaaaaaatgtatcaaaaagtaaaaattattgttttggattaataacagcaattagattgaaaaaatattggatattaatcctctataagatatattcagtaatatcgcgattaatttctgaaatcaaaaatttttattctttcctatttttattctaattcaaatttaaaacttattaataagaggtttcaaatacttaatattttcattttcatttcattaaattcatttgtcttcatttaactcactatgtttttctcaatttataaattatgtatgataatggaaatgatgttaattaaattttcattgctttattaacttataataaaatttattcattttttctttcaatttttaaacatttccatggtgcgctattggttttttggttctctcaaatatctaattctttttttcccgaattcttataagagtatattatatatttaaaaaaataataatttttgaattattttgttttttatttgtgcaaataacatttttctataattaaagattatgtaaaaaaagaatttgttgctatatttttattaaaatatatacttatattgttatatccacacttaccttaacataaaataatattgttgttacattttctttgttttaaataaaaaaagataatagatacatgaattaacattttgactctgaacaaattgattgagtgctatttaaaaaaacgtaaaacgataaattaatatatttatgaatattataacacattttttttatttttcgatgaatttttatttcggcaaaggtacaatgacgccttcgtttgttgatactggttatgatagcgaagaacgtcgcgatgagtatattgacgagtttgagcgattttagaaattgctggccaattccctttggggcaagtttgcccaacgcgtaggaagaaccgaagttcgctacgcttcatcaccatctgagttccactgtttgctctataactcttcgatagaagtactcgcctttcaccatgtttcacctcatcttgaccgtgttgttgtgaagacaaaagctgatttttcaaaagcaccagcgatcaactgtttgccgattgcaatttatgttacttcatacgcaagacttcatctttattcctacattgagaaagttgtacaacttggtcataaacttctctattgtggtccgcttttgatcttattttgttattttaccttgttgccattcaatgatttgtttttacctttaaaatttagataaattaaatttatttatgcagaaatggaaaaaaaccggtttttgaaccggtttaatgctcgaaaaattgagtgaaaagggggctcctgaccctttaaaacggtcaaattcggacaaatttagtatcattcgaaagcttttgacgagctgagtctaaaaatcaaggaattaagtcaaaccgacgccatctgagcacctggacaactgagtcccagtgaaaacaaacatttcagtacagaaaaataataaacggaaagtaacaatttaaaagccattcgcaaaagggagcatgcgaagacggagcaagtagtgggacgagacggagggcggaggaagacgtctgacgagcgccacaagcggttgact

SEQ ID NO: 18644 - DNA, 2277 bp, Heterodera glycines
tgaaggcaacgcccattgccacagcaatctgtaggaaaaagcacaaattgaagcatattttgccgaattccgagagtgagtagtgaatgcatcaattgtcaaaattatacaattgtagcccaaataatagcccacaatttgtaaatagctaacaaataagtcttgaaaagttcaaagggctctggaaacgcactcagaccggattttctggatttaaatccggcgtttatggttccagcttagaaatgttaattttcaatgaaaaaatgtcctgctggtcttggtctgtgtctatcaaaattaaataaagtcccgatccggggctcggctctatttcagattttttggggaaaatatttgagtaacaaaaattcgggaaaaattatgctatcttccttttttaattggactttgttaaataaatctgcttttaattgggttacctatcatttcgtcactgagacataattttttaaaaatattgacaaatttcaataaaattatcccataaaattattaattggtttaaaattctctaaaaattattcctgggtaagagtactaccagtagtagcccttttcgaaaattttttttgagattttaaaaaatcgaaaaatgagtttataaggttttcaaggtcgctgatcacgatccctctaatgccattcgcaggcgctttttcatactcagcaacgaaatattacaatcgctgaaattctttatcccatttaacagattttttgatgtgatccataaagctctgttgaagatgactcaaattagtccttttaaaaaaataaacgaaaacttaagtccgcaatttgcgagaaagcaaatgtcaattataaaaaagttttaaagcaaaaaatttttcaatatttaactaaaatttttttttaattatttctcagtgacgaactgaacagtgacgaaacgatcagtgacgaaatgatcggccatcttttaattgggttgtttattaaatgaaaattcttatacagctctccgccggcgtttgcctcgagaagcattggtcgcgcgggatgcattgtccgcgtgcgtttctcaatctgtccaactgacaaaaacagcgcgggaccaacgagcagaaaaagccacaaaacggcaccgggaaacggcacgtgccatcgcagaaactgcaaaggcgcaactcttcgcccggcggacagccaaacagaaacggaggagaagctgaaaaaaaggaaaataaaataaataaatattaaataataagtacgaattgattatccttccgtaattttttaaatttagtacatatttttaatagtacgtaattgttaaattaattggcagttgaaaataaattttccaattaagctatgaaatccaggccaaaaaagtgcttttatcggtcgaacttgttgatgaggaatttgtcaacacattattataggcttttggctcctctgtggatgaattcagctgttcattttgagcggttgccaaattaaagaaaataaaaagaaaataggaggccatcaacattttaatgacagtcatttggtgtctaaaataaaatatatttcaagcaaatttattactatttttatttctataaaaacaaacactttgaaagaattatgtattgaacatgcgccgaaaataataaaaaaacaaaaataatcgtattaattgcacagaaaaacatggacaacacgccgaaatttgcatatggcgaaaatatttttttgtttgtaataacattaaaacaaaaaacaaacaaaattatttatcgcactttaactgtttgtttttaaactaaagtcctccttgttcggttaggccggtttttcgacttttcgggtttttcccaaaaattcgacttcctttagttcggttaattggtggatctctccttaccatatgattaaaattttgcattattactttatcaccatttattcagattagattacctgactttttgctcattattttatcagcgaaatttatgcattgatttatcagccaaagaaatttttcttttccatcaatttgtactccattctcatatgaatatcttttaggacaatccatcataaaattggattttccttttttattactaaatttatttaaattaatttctaatataaattttttttattgcgattatgccatggtttgccgattcgtttgcctcccaaattgacggcctttcgcgtgccatttccctctccgtccaatggcttatcgtccactggtggcttctgctgctgcttctgctcactgtt

SEQ ID NO: 18645 - DNA, 3517 bp, Heterodera glycines
ttctgtgtatccatttttttattcacctttctttgcaccgccgccgcctaaaaagattattcttaaaagctttgaatgctcccgtcttaccccttctgccgctttggtctttaaaaattatgtatcaagatgataaaacattaattgtcccatttacggtaaaagatcaatgatcatatcgtccctcccaacattctttccttccctcacacacaaaaagggaagggcttatttattttgttcttgggtttcccttccttgccacccatcatcacttggctctctcttttctctccgtccatttgttgacacaattttgttttcgaaaacaatttagcattgctctcccgcccctcccccttccccactaggcaatgattataataatgtgctcatttggacgtgcatggacttaaaactcacctccattttgcaaagaaaatttaatcattccaaattaagccaaaaaattctttactctattaaataaactcacttattttgccatggaattaatcagaggcgtgaccgacagaatgtctgcaatgttttcggtgtggtaattgttttatgcaacataatacagaatataatattgattattagggccgcaacttttagtgacgaaaaatcccaaaatagttaactaaaatagtgagtaaaaatgccaaaatagtggcaaaaagtccgaaatagtgacataattttcagccaaaaattgagcaaaaataatttttattaactgattgcagttgcaaatgagtagtagggctgggatttttaagagcaaaaaacccaaaatagttacctaaaaaaatttttgccaagaaagtaattttttgagaaaattttttttcatttcataggagtatattttgaaaaattttagctcgattcttaggggtgtattctttggttttattgcatttttgttaaggaattttccaaaaaatgtcgaaatagtgacaaaacgccaaaatagtgatttcttaatgaccgataatgacatcagaatcgaaaatttttaatgcagaaatgcgttttctgagctcctttcttcaaaacaattgagcaaaaaaaaagttttttcactaaaagttgcggccctattgattatgcttacctaattgatttttaaatccaaacattagccctatggatattaaaaaaagaaataaatgactttttattaatgggaccaaaaaagtcaattccttttcatttttttattgtaaagggatcacaatgattcactttctatttctgaccacttgggcaccgaaatataaaatgttgatggcagcatatgggcttggcatatgcatatgcttgcatatccacctttgttttgtcttctcttctgctggtgtttatttgtttttcgcccgccccctctttccctcctcatttgtcactgctctttctcacccctttcattcactttcgaatacagtccaatgttcattgtatggcatgccctcccatcatcctccaccccacatatccttcccttcccaatcattcaattcactcatcatcatttttacatacatatgtataggtcatttaaatttaatccctctgccataaattgggatggacccataaaatgttttaaaaattattgaaacaaattgaattctttctagccttaaacattcaatctttcatcttctcagaaagtcatgcaaaagcgttcggctgtctgtgtgcttgttggtgatgaggacccgaatgtgaaggggaagattaacttcatccaggtcataaatctaacagaaaatttcttagcatttttgtagcttctagaatctcggaatttaaggttcaatttttgcaattgcgaaaaaatttaccattactaatgctattccttccataatcttttaaagttattctaatttatgaattaaggagaaggatgactctccggtgaccatccagggtgagatcactggcctttcgcccggaaaacacggcttccacgtccacggtcatcgaccaacccatttatccattttaaaataggatttgttttagctttcggtgacctgtccagcgggtgtatgtctgctgggccccacttcaatccgacgaacaaaacccatggtggaccggaggtggttaagggagagggcggaattaaaggatgatatttgataaaatcgcgcttccttttttgattagggatatatttttatataaaattaaggatgagacgcgccatgtgggcgatctcggcaacgtgttggccgggcaggacggagtggcaaaactcgatttcacggacaaagtgatttcactggtcggtccgcacaacatcatcggccgcgcgcttgtcgtgcacaagctcgaggacgacttgggttcgagaattcattaaataatctaataaaattaaatcttactctcaatttgctaacaaattgactttttttaggccgtggtgaaggactcaagaagccggagagcatggagactggcaatgcgggtccccgtttggcgtgcggagtgatcggaattgctcagtgatgggggaatgacgaccataagaggaagagagatctgattattgacctatctcattttgtcgatacgacagttattcaatttgtaagacatgtttaaacattcaaataaatatggatttgatgatggtaaatactagtaaaactagttgtatttctattatatatctagaacccaatggatttaaggtttgttccttgaattaaaaccagtataagccatagcgagtgtcaaaaacagttttttgtgaccaattaattagaaattggaaaagttaggtaactgttccatttttaaatttatggtaaacgccaaaaaacaattagccagagaaatgaagggtattttaaatttgaaaatgtttttttcgcttttccttttttttcattttccttttacgcaaaatcatcttctcattcacatctaatctgcttgttataaactcccatgtttattttgaagaaacaaatgggttttaggctgatgattttatgaatacgaaaaactttagccgtagctagtatgaaaaattattttctacgaacgattataaaatcctaaaatttaaattgaaagatttactttttcgatttttaaaattaatggtaacgccaacaaataattcgccagaaaatgaaggggattttagttttgaaaatgtttattcggtttttcctttgatttcttttacgcccaattacatacatatcttcggattcccacctaggtaatcactaatcagtcatatcataatcagcagtcacatttaaagacttccttaaaattttcataaatgctttggggctgctatccccgcttggtcatgcccttactaggcgtccatcgttctcattcaacattattaacctcattcatttccccattttttcaaatcaataaagttctttattctcttgcattttccgtggaccttcaacacttaacccacaaaaacaaatgaaccgaattcgaaaagcattgacagtac

SEQ ID NO: 18646 - DNA, 2029 bp, Heterodera glycines
  misc_feature (36)..(36): n is a, c, g, or t
  misc_feature (71)..(71): n is a, c, g, or t
  misc_feature (85)..(85): n is a, c, g, or t
ccaattgagcggctgccgagcgcaggcacaattctncctcgcatttgtggccaatgctttttctgagaaangggccatcaaaatncagtgtggcatttgtgcgcagtgccaaagccaatgccaaacccaaacgagtgttaaatagcaaaaccaaatggcaaagccaatgccaaccccatttcagtgccaatctgacctcggggactcgaagctctctccgagcatgctcatctccaccatcctctccaaatgcctttccatctcccaccatttgctcaattcgttcatgccaatttccgtatttttgtccatttccgctgtccatttgacgtactccttgcgcattttcttcagtgattgcttcggcacattctctttcccctccaaaagattcagtttcgttccgcttgcgttgtgcaattgaaaaatggccaaataaatggccaaagattgcaacttttcttcggagagtctttcgtcgaacagaagcctcagatattcgtgctcaatgctttcactctctgcgaaaattgataaaaatttaaaagaaaaattggaaaattattttaaatgacttttaaaagcgattttcaattggatttagaggatttaagttcaaaatggcattgaaaataaatatgaaaaatttaaaaaaaaacctttaggcgacgaatgagcacagtgaatattattaataataataacaataaaaattaataataatattatttttatttgcaaatttttgaatccaaagaaaaaataattattcatttttctaaattaggtaaatcaaaatgattaaatttgtctattatttttttattgaaaataataaaaactgtctttcgttgaattattaaaatgaattgggcaaacagctcgttgtggtgccacgtcaattgatgaatttctgacgcaaattatgttggattatttcagcgtcagaatcgatgaataaatttggttggaattgtttagcaaaatttatattttttataatatgtagtgaaaaataaagatggattttgaaactggcttctcttttctgccttaaattgggcgtcttcccaaattttctggtcgcttttgggccaaaaggctctgatccgatccgtttctcagacaaataatctgcaccattggcagaatgtccacagaatatccgcttaactgtgacggataaattaaaaaaaactttcttttgctttatttaaattttggaaatataaaataaaaaatccaaaaagaaagaaaataatgattttaaagaacttaaaaatgatgatcaattgctcttaaatcgccaccaatcatttgtttttcggcgtccgacttcgcagtgatcggtcgcatattgaactaaataaaccgaatgtttcagctaattgggccagttaaagccatgaagggagggtgccaaactgctgccggtgtgtgccgtgtactcctctcacccgtagtctttggtgccgatcgctactctgatcacaccgttctccgtgttccaccgcttccgtccgatcacttccctctcccattgtgcccatttctgctcattgcgctcaatcggcgccctttccaacagccaaaatgagtgccgacaaagccgcgcagtgaaacgctccaaagttttgccattttcaagaacaaaaggcgtaaaatcggcaacagatgatgaagcgacaggggagggcgaacaggcggaaaaagcggacaaacggacgacgaaattaacgggggaggaggagcggaggaaaagctgaaaggaagtgaacggaacaattaagaaattcaaaacgatgcattaagccaaataatttaaacaataaaaaactttatgaaagataaaatgatcaaaattacgaaatcgaacaataaatcaatttgaaaggtattgccaattttgtgagcccacctctttgagttggtgcacactctctgcgaatttgctctcctccgtcacgcatttgagcaacttcggccgtccgtccaaccgcggcgtgtgcagccacgcgcacaacgcttg

SEQ ID NO: 18647 - DNA, 1636 bp, Heterodera glycines
ttctctctccatgttcttcccttacccttcttcccgtgctgcggcgtcgtgccgttcgttttgctggtgtttcccgtctgatgttgtgatgggtttaccacggccactttcggcttatacgcttgtcccgttgaattctgcacaacgcctggggctaaccttcgcacattttcctgttgttgttgttgctgctgattctgttgttgctgctaaatgtaaatgtttcttaattaatgaaaatgactcggtcataaaaagcgcattaagcggcggaagtcggtaaaacaattgttgcaattagtccatgtccccgaattttttcgttgttcggctttaactcaccgttttctgcgcagccttctgctgactctgctgcaacttcttcaacatcatcagcttggcctcctccaaccgaaggattgactccaactcgcggatttgcatttcgcgctgtaccatcacttctttgggtacttcttgtctttgtgtctgtaatagtgtggatgaaaatttaaaacgtaccacacgaaacacacattttcgtaacgttccctcaaatcggtaacgtccgcttcgttcagcgacgaaatttcactttcgtccgacatcattaccacgtcgccttcggggtcgagacgtatctgtaccaaatgaatgggttaagaaattgggctctttttgcttcgattgtgtgcttacgccaaatttgcagtcgtactggtctaactcttgcccatcttccaacttgcgcttcaactttcgcttcagtgaagagatgcattgctgctgagaaagtgtggaagcgtgttcattgacttccatgtcgcgggagacagccacggcatcgccacccgtacgatgttcttggacctgtgattagaggatccaagtgaatgattttgttgtaatctccccatttcccaccatttccaattcgtcgtcgttgtcttttgtgacactgtcagcgctccgttcggattccgtccgttcgttttgctgcgtttgttttttcgcgttcagtacggagacgcgcgttgaacgacgcaacggacaattcggagacaattgctgctgctccgttaagtcactgtcgtcgttgggctgttgttggcttcttgggcttttgtcctctgtctttttttggtctgtcgtcgtttttgttggcgtttcgatgggattacggtcggaatagtcaatgctcgttgcggaggacactttctggattatgcagaattattaattttccttaatttatgtataattaaggcaattcgataattttttaaggttgtcttgggcctaaaaaatgccgtctttggccgaatttatattttaaagtttgtggtcattgacatacataaacaattcaaattagttaatgaatcgattgcgaacgtttgagagaaaagtaatgggaagaaaatgaaataggagcaatggacgacatcgattgccataaacgaccttttaattaaggtaaggaaggcattttcaaataagaaataagtaacgttgtgaaaaggccgcgttcggcttggaagttaaagatttaaaatagatattcgtttatgtaaatgaaaaatggtaaaaaatgttcaaggcatttaacgcttttatgtttaagtgaagtgaaatg

SEQ ID NO: 18648 - DNA, 897 bp, Heterodera glycines
  misc_feature (16)..(16): n is a, c, g, or t
  misc_feature (33)..(33): n is a, c, g, or t
  misc_feature (67)..(67): n is a, c, g, or t
  misc_feature (104)..(104): n is a, c, g, or t
  misc_feature (889)..(889): n is a, c, g, or t
gatcagaagcagcacnagcagcaggagtacctngggacatggctgccctgcgtgggtgcaaagcaanagtcagtgctgggcaagccgaacagtgcaaagccttntagtaaaagccaaagccgaacagttaagccgaaaaggacagataactgaacatcaatcagcctcaaactccttttatgaacgttattctcaaacaatggcactgtttctgctttcttcttcgtgtgccttgtcgccttcccttttcccctgcttttccaaatgcttattttgccggatggctcttcgcattttgactctttcttttccccactgatgttggccctgcaaagggagtgagtgaagcgatataatagatgccgtgtgaataatgtccgatgtgagttcagacttagagagtgatgaggcgatgaaggtggggaaagggcagggaggggggacagaagaggggaggggggactatgggctttgcattcctcctcttattcttttcaatgcattatatgtatttgctttggcttattctgcgaccggacgaccaaaaagcaatggcaaaagcggcggatggatttggttgggtgggaaggcgtgcgaaagaagcggggaggcagtgcctaactttcacttcattacatgtttgaattttgctcggaattggtcttctatctatctgtttgtgattgactaactgcagcagacagttagcatgggagtgcgaggggggggcattgcttgaggggcattcgggaagcattggataggaaagggtagatggaggaggggaggggaaaagggcggagtggggattgtgcctgtactgctccgcaaaatccaacgaccaagaacagcagcgaggaggcaccgcaaattttcggtgatttagccngaagcgtt

SEQ ID NO: 18649 - DNA, 1550 bp, Heterodera glycines
tgaaacgaactgcaacgtttctctatagtagtataaacttttgtgtggcgcagtaattgctcggtgtagacagtatactttgcacagtgattgcacggtgtagacagtatactttgcacagtgattgcacggtgtagacagtatacttttggtatatatgggcgggcgctgacatgagcgcttcgcgcaaaggacttcgttgctagtgcatgcgcgattttgaaaagaatttatggatgtgataagggattttggtctacaggcatcgcgaggacgcattcataattttgtggaggactttcggccgcttcgcggcctcaaagggcgctccgcatcctttttatatttaaggtttaattcggccgcttcacggcctcaggacgggcgcttcgcgcccgttttttaattttttgggggacattcggccgcttcgcggcctcagacgggcgctttgcgcttctaaatattgtggattgttgggaattttcggcagcttcgcggcctcagacgggcgctttgcgtccgtttattaattttgaaggcaacattcggccgcttcgcggcctcaggacgggcgctttgcgtccgtttattaattttgaaggcaacattcggccgcttcgcggcctcaggacgggcgcttcgcgcccgttttcaaactttgtaggaaaattaggacgcttcgtctttgtttctttagaagatagaaatcccaaataaatcccataataagaggtgtaacagtgattagaagaggtacaaaagtgatagaagaggtacaacagtgattggacaaaagtgatagaagaggtgtaacagtgattagaagaggtaccaaagtgattaaaagaagtacaacagtgattaaaagaggtaccaaaatgattaaaagaggtacaacagtgattaaaagtagtacaaaaatttaatgcaatttattataaattttaaaaaataaattagtcattccttttattaattaaaaagagaattttgaaatgtacaagaattgaatatttaaattaatatgaaattaatttttataaattcaattaaaaaaaatatgaaattctttatttaaagataattattattttttacataaattcttttattattaatttacaaaaaatctttaaatataaattgatacaacagtgattagtaaattcattaaattaaaatgaaaatattttttaacaaatttaattaaaaaatacatgaaattctatcaattaaaaaaaaaaattaattttaacttataaaatttattcatcaaaaaaaaattaatttaaatataattttttatttattaactcagcaaaatattttaaattaattaaaatcattgaaaataacgtaaaaatgcacagaaaaataatgtacatcgatcggatccgaacttcgccccccccccctcaaaatgatgcctcagaatccccaatcacacagggattctgagggcttaacgatgtcagaagtgaaatctgattgcatattcgtgatcagcaccctaaaatgtccctaaggacatgtttttggaaggtttt

SEQ ID NO: 18650 - DNA, 1599 bp, Heterodera glycines
atttttcattcatttcatttcaacaccattttgagctttgcttgttgctcattataggccatggatggcattttgttgcccccgccactgttattgcttgtggcacttgtgccggtggttgaaattgtctttgttgatttgtctgcattttgttgttgttgttgttgttgctgttgatgaacacttccttttcgagctgtcgtcgctggctgatcgaccttaagaatgttacatagcaataaattaaaacttttttttttgataaaatccattaaaaaaggaaaaactaaaattttttgaaagatttctatgattttttttttgaaaaaaattctaattttggaaaataaaattttttgtttcgcgggatgggaatgatatggcgggcaaacgacacagtgggtggggcgggggggcggggggggggaaaggaaacatagggccccggaaacgagtgagtgcactactaacatggtgctgcacctttttgcgcccgttgccccccgccgttgagggcggcggcggcggcggcactcttgctgctgctgctactggctgtcgccatgtttttggtggccttgttgccagccgactgttgctgctgttgttgttgaacagttggcacaactcctccactggtgcttggtacttggtgttgttgctgttgttggacgcgttgcgcttgtccggcgccatcctccagcaacatttcaatggacgcgggcccactccatttggcggtctccagcgtgatacaaatctcgaccactcgccgcaacagaatgtgctcatcaattggaccaacctatgataagttatgttttatgacttgacatgattttatttactctatcgccggatttacgacaatttagagaacgggaaaaattaatgataaatttaatatagatatttaaattatacacccttttaaaactgtaccgattcaaaaagtttgggcaacagtttgacttttccatgaatgtcctcaaggccaaatttgtcgacaacaatgagcaagtgttcgtcatgcgcttcagtccatcctaaaaaaaattgtgaaaaaggcatcatcatttttagtccaagtgtatccaatgggccaattttattgtataaaaatgggggccaagtccccgacccatcggagacgaccggggacaggaatttttgtgggcaattttaaagtttggatataatcgggatttagtagccgaaagttttgatacgaatagagagagataatagagagatgtgtatcgagagtagatagataaagaggtagacatggagataagtagcgagatagatagagagagagagagagagagataaaaagagtggtagggagatagagagatataagagagagagagagagatagaaagacagataaagagatagagtataagagagggatagaaagacatatagagagcccatacaatataatcctagaatttcgcgggcaggccacgtggtcgcaaaagtcgtcaatttaggacccaattcttgaaatgttagggtaactacagtaaccaacaaagtccccaacgcccccaacgatggcataacgtcgagcgcgaccatttgacattc

SEQ ID NO: 18651 - DNA, 2513 bp, Heterodera glycines
  misc_feature (24)..(24): n is a, c, g, or t
actgaaacagtgaatttcattatntgggataattaaattcgattctttttttaattgccctattttattttttgctttttcccttcacacacattgggccgagtccgaggtgggatttcggtgtgctcttttcctatttgtggttccattcggtctgaaattctcaatgttttcctcgtcctcttcctccgccgatgtgtcgtcctccgacacactttttgatgagttttcctcaatttttgttcccattattttctctctgctgttggccattgcttcgatcagtcgcatagagtgcttttttatttatttatatttccaaatgaaccttcaaaagtttgcggaatttatttatgtgctgccattttttggaattaaatgttttgcatattttgggagggacaattcgagaacaaattgaaacttccgtcctaatcccgattggcggacgtcattaaatcacacaaccacacaacaataaccacaacatcagcaccgatcacgccaatcattttttgctttttagaaaaaaatcaaaatgaattaagtgagtgcagcaaaaaggtcctgaaatatgtgcatgaattattttttaagtaatattaaattaaaaaatattttatttatataacaaaatggaagaaaaaacccaaaaaacgatgggtaataatgggccactacttttggccctaactcaaattttatggcccaaaatcattggggacgggggcaaaacgaatagaaaattatacaaggataaaagcatagcaaatttagaaaaaataaaataaaatgcacttaaaagtgttaagaattcattcactgcgctataacggaaaagcgaaggcgtgaaaggggaggggataaagcatttgagggacagacaaacattagcagacggagggacggattatcggtggagaagccgagccgagaaacggcaaaaagcgaaggataataattgaacggttactcaaattcgcttctttcagtgccgatctccggcgggggacaattaagcctattagtctgcgcaaatgaagagaactttaaaattgagaaagaatcatgaaattaatattaaagaaaacattttaaaacataattattaaagatttttttcaaaaattattagacaaatgcaaaaaaattttacgttcagagttttgagtaggtctgacttttgaggctaagatttgctgctcgcttcttctcattattccctcggtttcttttgtttgctcagtccgccaaatttgtggcggcgtgccgttgcactgatagtcatgggaacgtaaaagccaaaattagttttgtaagcacaaaatgagagagagagagccggggagaacaaaaaacttttagtttcggcaaacccaaaaaaaaaaaaattaattgattttattttttattttatttttttgtcattttctaacgctgtcacgcggcggttcgcttctgacagtttcggcgtacaaacaaaagcataataaaatgcactaaaggacgaaaatgggaaaatgaatgaattgctgctgaattgcccctctgtttgtgctgtgatggggcgggggctttgctgagattttggctaattttggtgcgttgggatgcaataagtgagctatttttagaccgtttttttgcccgttggcgaatgacgtgggacaaaaaatgtgcgggagaatgtgcgcgcccatcgcatcgaagcgaagcggcgaagggaagtgacaatgcgccatccgccgctgtttttgtgctcccccccccccccccccccccccggcggcgcgtcttctctcttctcataacattccgttccgccaaacattgggcaaacggcgggcgaaaaatgtgggtttctgcgcgaaaacatcgcttaagtgatgagggaaggccaaaaataagccaaacattggaaaccctcgaggggacgtacggtcatcaggcaaattaagggggacggagagggggggggggggaggggaaaacacagaaatttatgcttatatcgataagaaaagagaaacttcgtgcaaagtttcgattaaatccaacgaaatagcggaataatcaaagcctttgagggagagcgcttttgggttggcggagtcatcgcaatgatcatcacaaaggctattcagccaaacactgaaaggatttaataaaatattatataaatcttcagttgtgaaaatatgtaaacaatggaattcgattcatttttcatatttttaaaaattttacaccaaaaaaggaagtgagctattcctactcaccttatcacttcgctgtcctctgctttggattagtacccttcgaaatcaatgacatatgattttggagggagtctaagaatgtcataaattatcgtacggaactcacaacgacggtcgatagaaaaaacggcgccaaggcatttctaaaaaattgacacaaaaattgctgtggtacgacacttaattcagaatcaaattttgaataaatctagaaaaaacctgaaaagcactgat

SEQ ID NO: 18652 - DNA, 2526 bp, Heterodera glycines
tcttcctcctcctcttcctcctcctcttctctctctcccatttttgttttgttccgcatttttcacctttaattatgctgctgctctgctgttgatgacgatcatttgcttgcgcaacagatggataataattaaccaattaatttgtcatggaatttctgcattttttccctcctccgttcgtccgtcctttccttcgttcgttcgtcaaattcccccccccctccccccaatgcctttgtctttctttgctcattccctcccaaaatgacgcaattaattcgcttcccataaatctttctcaaacatcaaattaagccgaaggataaaaatgactcaaatcccttcctttgccccccgcgggcattcatttgatcgtttagtcaaaagagcccaaagtattatgtatattttaatggtttgttgtaattaactaatggcaatgcgaatttaatgccatttgggcgactcgccgaaatttcacataaaaacattttctaaatatttttggaagaaataataaattttattaaagattatttttcaaaataataaccaaaatggttggaattgaatttgtgcttctttctgtggattataatgaaaagtctcttcttggcgcccaaagtccattcactaaaatttgtgaaaatccaaataacaaaccgaggccaagcaaaactacttactaatagccacacatcaaaatcccatgaaaaaacatttggagcggtgaaccaaaacggaccataactctctttttcaaatccattcgctttggctccgaccgttcggtgccgttgagaattttgtatttgtcgacaaattttacaaagtttgtctcatctcttgacaagctttgttcatttgcaaaatttcgttagggtagagcaaagttatggcaaaaacgtcaaaaattgacttttttgccttttcggcaccgcgtgccaaggacgggcgaagctcggttagcactcgaagccgaagcttcgccgtccctggccaagcagtacccacccgcttgtccaccgaaaaatgtgatgagaactcagatgaaatgaattacacagagaaaaatcaacatcaaagtttatttcagctcattaacagccgatggggtcattttatggtacgattttaaaattaatttttatttttcccaatattaccgtatcccagccaattcggcgccacaatgactccaccgtcgtcccacgcactgccaaaccggggacggactctgtcgactcgtaaatgaatgaatggtacggtagtttcccggcaggcaaaaagcaattaacaaacgcattttattgtttattttatttttactttaaacaaatgatcgcggttcgttcacaaattgcgtttctttgctaatttcccctcagggctttcactcgcaaattattcactcaaatggaaatggacactccgccgacagctacaatctgtccaacggactttggcaggacaaaaagacgaaaaggaggcaaaataaatttggaccgtgctgtaattaatttgatattgtcactttttcaaatgtcgatttttaatgattttatgggtaaaaaataaaatttgtaaataaaaaatctggcaaaaatgaattgattcgtttggatttgttggccattaattcgttttttgctttggcatttttggccattaattggctttaattggggaattaataattcgcttttccgtttttttcgctgtgtctttttttcttttcgaattctttcgcttttctttttctccgatcattcgctcctaatttggcttctgttggaatgcgttgatcacttttcttttttctttccatttgtccgccttttcttcgccttttgtgtcgtcaccgcaaaagaattacacaaaataaaatttggtcgacgaacactttttggaaataaataaatggaaatgaattttttgtccgcccttcgctttactttttctccccccccccccaaatttctcctttttctgcccgccgctcctttcgttgctaccgtatgtccgtgtcgaccttttgctgtaaaacgccctcctcatactccacacccttttctactactctttctcccctttttctctttcccccctctctttttctttttttcctttttccccctctctttttctttttttctcttttcccttttcccctctctttttctttttttcctttttccccctctctttttctccttctgtttgtccttctcttctttaaccttttaccctttcgtcagcccctcccaaattccttctgtcgttttttcattttgcgttcctttcttttgcaaatttaatcgcattttaattttaatgagtatttcgactcccccccccttattacgttgccgcaacttcggtcacaaaaaggaacaaaatggtaaatgaaatgagtgaactctccccccccccccgcccctctgctcatttccattttccactctctcatttttgctccgaccatccatcactccgaccgccccccccccgttgcagtcgcta

SEQ ID NO: 18653 - DNA, 3006 bp, Heterodera glycines
tcaaaaagctaatacaataatggaaacatttgttgaaatagtcattcaccaacactcaacaccagaaatagttgtaactgatcaggggcgacaattcacttcagaattatttaatgatatggcaaaaatttatggatttgaacattgcacatccacggcttaccatcagcaatcaaatggccaaattgaggggtcaatgagaattatggcaaacataatttcacaaatgattaatgaaaaggggaataattgggacgaagtgttatcccatgctttattcatttacaattcctcaattcatacagtcactaaacattcaccatttttccttttacatttgcgccacccaaaaatgcccactgatcgcttacttaaactccctaatcaggaagaaatgaattcagacatttcaatttacaccagaaatcatgtttcaaaagctgtgactgcttggaatgcagtcaaagaagcagtcacaaaggctcagattatacaaaaggacgaaaatgataaaatcagaagggcagaggaaaaagtgattgaaattggtgatttgctcctactaaaaaaggaagttttaaagcataagtttgatcaacgatgggtaggtccattccgttgtgtaggagtcgataagaccaagaaaaatgttatcatacaacagatagatggaaaaggaaaattaaaaaaggtacaccaagaaaagattaaaaaattcaacgggccggcggtccttccgctaagagaggcggatgaacccttaaattgggaaaaatacgcaaatgatccaaatttggaacaagaggaagctgaagaaagctcagagagcgacaaggactcagaaattttagaatgtgaagagagcaaaaaagacggtgaaaataaaaaagagatcaaaaattctttttccaaatttgggtttgaaagtagcgatgatgaaaatgaaatggatcaaaaagaaagaattgtgtttgtgagaggtacggatgaaagagaaatggaggaaagacctgaaattttggacccgcaaatttgggacattgagcagcctatgccttgtacaattactgaaatatttgtagaaggggagtttaaatgggcttatacgagttggccagaggaaaatttgattcctttaacatcgttaattccaagcaattttgttaaagattactgggaaatttacgaaaatgcctcaggcaacagattcttaacagcatggttgctcgggaatagctttgagttatatttaaatgatgaaacggacaaaatagtcttgggaatacaagttcaatttgcattaaatgacatatggcactcaagaactgaaagggaaattgagtcctattgggaaccattaggcgaaatggacggtcaaacattagaaatacaaagatttcccgacttaacaattacccataaagaaaatttggaggaaaacgaacaaagaaataacatattggaccaaacgaacattaatgcaatttgctacaaaaataataataatgataataaaattaaaaataattatcaaaatggtcgtatggaacaaagtataaatgtgattaaagaaggggatttgtttatgagcatatttgatttaaatgaagaaataaatcaagaaatatatgaagaaaaatcagaaaaatatgaacaagaaacaaaaaatgatggtgacaaaaaagccgaaataaatcgtgaaaatacggatttcctaacaaaaaaacttaacagggaatcaatgacctcgccaaaagcgcctgcaatggaagcattcaatgaggagcatttaatcgccgaggaaaagaagttaaaaagtgaaattgaggagttaaagcggcgactggacgaaacaaataatcgaaaagcggaagcggaaaagagaagaacagagaggaatgagagaagacagatcgatgagatagtattggatgtggaggaagaagaagaggaggaagaggaagaagaagaattggccagacaggcaaaaagggggcgcctggacccattggaaacaaaaaaattggtggaaaaaacgatcaatgaaaaatgggaaggccaagagctggtcacaattgacccacgggcggcaggctttaaagagcccccagagggaactgacagccggggatgggaagacgcaatcaggctgcaaatgagaggagaaagagaaaaaggatggagagaatttttgtcgacgaaaacgtcgctggatcaaatgaaagaagacagattgaatgtgatgggaagagcgggattgacccagagtggtcgaagaatggcagaaaatagtgtaaagagtgcagagaaaagcataatggaaactgaatgcattctgccagaggggaaaggaaaacaaacaaaaccgtggaacgaattggaaatgcaacgggaaagcacagaagacatggaaagaagaagaaaattcgcagttcggaccccgccaaactcggaaccttttgcgaattccgggtggggagaaatgtcaaataacgaaggaaccgaaaaaatactggataagatcggggaaatgcaaaagaagttgaacgaagtcaataacgaattaaattggttggcaaaagatgtgcaagaactgagccaaaataaaggaaatgagataaaaaaaggggaaaatggccagcaggacaattgggaaaaaggcaacacaaacatccctttctggagacaacatgacgacaatcgtttccgtggtcgtggcacgggcggaaatcgcgggcgcgggagacaacgcccatttcaatatgggtggcgaggatcagatggatggaaaaaaaatgatcagcaccagcagcagcaacacaatgacgaagcatgcaccagcagcagtgtcactacaactcgctacaccggagaggaattcacaagaatggcaggataccgtgattgaagaaaaccaatttttccaataacgcttatatagtagggaagacggttaaaaaaaaaataaaataaaaataaaaaataaataaaaataaataaataaat

SEQ ID NO: 18654 - DNA, 2318 bp, Heterodera glycines
tccgcttgacttttgttgccccagcactgacccttctccgcctgttcgctcgaatctcgtttacgtgcacggaattgtggactacatactcactctgccttcgatgtgtattgaggaggttcgattttttttttttgggcaaaaaattgcttggaacgctttttctcctccattgcacctataatttagaaaaattaacaaaacaattctggtcgcgaaaagcacaaaaacactctcagctttcgaccctctgaaatctttcctgcttaccatagggcgttagtttctccacgtactcttgaaaaacttacgccgggtttttttttggagagcgacttaaactggccaatttatccaatacccataaaatttcaacgtcacacagtttaccgccgtaccagcccctcaacatgcgctgttctcggttcgggacagtctgagcccagatcagttggcactgtatcgggccggacagttgctgttcaggttggtggcactttttaaaaaatatttcgggagggcgggggggggcgacacgtgccaccactatttcggtacacttcaaaacgtcgcaactgaaacatcgtgggacataacgtcaccacaaaaataaaattttcaacagttttatgaaaaaatttaaaaaaaatcgtcttaaaggcttttttttgaaaactaggtgttactgaaaactaaaatttctgaatttcctgaaaaaaaacaaaagggtaactaataatttttgatttttttctaaaatttttttattgtttttgcggcgacattttgtcatgctccgccacattggcattattgatgcccaattatactcactgatgtgcttgctgctttcataggttggacgagccgactgcacggaagggcatgttccgcgttgacgcccgcacgggcgagctgtacatggaggcgagcacggcattcaacggcatgccaacggaggagacggagcacgagctgggcgtggaagtggttgttgacacacagcagcaacaccaacaagtggttgcacgacggacattcacggtacgcttggtacaacgtacaacaactgcaacggcgacgatggaaacggcgacgcggacaagatcaagcagtacaccaacaacaaccgcaacaccaacaacagctgaacaagagagcgatgtacggagggctaataggggaaatgtagcccggaaaacgggctttttgccaagttattatgctaaatcccagtttggcatgacgacatttcgcccactggacatttcgcctactcaggcaaaattggacaaatgtcttattttgacttaggcgaaacgcccggttttggcttacaaattagtaggcaaaatgtcagtgggcgagctgtcaagtagacaaaatgtcggcgtaagccaggtttagattggaaccttagaccaatcccaagggtgggggaatggcaccaaatttcggtagaccgacaaacggcactgtttagcccagattaagcctaagcctggtctggaaatcgaatatcccggactggcttgtcgagaattgcgatgcttaattttatttgaattttttaggataccactgctactgcaacggaaatgccaacaaccatgacaacagtagtaacagaaacggcaccaacaacaacaccgagcagtagcggtagaacaaccacattggttgaagaacaacagcaacagaagcaatctgttgatggtggtggtgataatgatgaagaggaaaggtgtggatgaaaatattttcaagttcgacaatttgacaaaaaagcctgaacctgcattccattttggatttgatgggcctggattttctgcgtaaaaatccaggtccaggaaaatacaggcatggatatatgcccagatcggactcaaaataattatccattttttaaatgaattaaatttgattccccaaggggaatgcaaccattagaaaagcaaaagtgccaagattggcaattcatttcgaccctttagggagtgccacaaaaaatttggtgacccttccccatagagaatatgccgaaaattggcaatcgatggcccaattatccatctaacaaagtaataagtggccatgaattcaaaatttagcacaattttcccggacgagttggacgacgaaccatttggcacaacgacggatattttgccggcactttcagcagtgccaccaaattcttcagaggccagacgggcgccaactgcggcaccgttggtgccattaagctcctcatcagtggtgagtatcagtgatcggaattcattgtgcctgatcaagaagaataatgcactgga

SEQ ID NO: 18655 - DNA, 1058 bp, Heterodera glycines
  misc_feature (920)..(920): n is a, c, g, or t
gtgaaactaattaaatcttaaaaaatattaagcgaattattggggaacggcactacaacagtttgccgcagtgaggccaaattttctatttggaggagaaaaaaagattgaatctttgcttggcgttgtggaccgattaggcacaattgcggcatacttttttgacccaacttacgcagaagaattcaataacgaatttgacaaattgtttcaagaatggcccgagccaaaattaattaacgagacggaagtgagtggcgaaaaaacaacatttggccaaaaaattattgaaactgttctgcaaattagaaaaaagtagtccaataaaaaaggggaaagaaaaggttgaggaggactgttcatcagcagcagaacaggaatcactcgtcatagatcgggcaaattttgaaaattttttgaaagaaaatttggaaagcctaaaaacggaaatggaacggcacgccagcgcatacaaagtcaatcggatttatgaatggcttttctcaacgtctacaaaccaacagggagttgaaccactcgatgatgacgacctgctcatcgcatttgtgacgagggacagtgccaattttggccaatattgcatggaaatggaggaacacaatttgttgatgcaagtcgggttactgttgaggcgtaagggcaagggcaaatacgatattgacgagacggtacggtatttggaacaacagtatgaagcatatttgggcgcaatgtatttgttgagaaagaaatggaattgtgacggaattaaagatgattttctcacatgggcagaatgtgacagatttagaagctatttgatttcattgtatcaattcatctttcgttaaatatctggagggtaattaattaactaattaaataatcataatttgttttacaaaatagctaacaatccngtcgttggcacgacaatttgcacaaatgagtggtcaaagtttcagcttggcaccaaaatgaatgtgacattaatttgacggtgtggacagtctgccccaatttgggcgttctttttttgattatgattacggccaaaa

SEQ ID NO: 18656 - DNA, 1494 bp, Heterodera glycines
ttttgtccggatggtatttcagtgccatgcgccgatcctcccctgaaatttgttgtggaaaataaagaaacgtcaaaaatttttttttaataagtttagtaaaacaacttttgatgtcttcgtcagtggccgtttttggcagggccaacagctcatacaaattgcaatgcgtggacagactaaaacaaatggaaattataaatttcctttaaattaaggttttggaacccctaaaatatgtaaaagtttgagtcccaattttctctagcattgtacaaatgtagctctgtcagaatttttagaaaccaggttttttgtttttaattcgaatcatgattcgaatcaattagaatgaaaggtaaaatgcaatgatcgaccttggggatccaagcctagatttatccaggaatcaggcccatgccattttcggcaacctgcatttttcctaggcctgtatttatgtccaggaaatccaggtcctttttcaaaaggtcgagctctagtaaaatgcaatccatattattgattgtaattgaagctacctatcctgggcggagactttacattcttccaaaaacattcgtttcgtgacacttacgagtcattaagtcctcttgatgaacgtcggcgctgacggcgtgcattgccttggtcagtatcgggcggcatttatgcgaaaatggacgaaaaaatcggcttttagatgtgttaataaaaacaatggcaccgcacctgctgtacgataaaccaattcatattaattttactttacacatctaataaaaaaattcttattttaattcctcctatatttttcgcactttttcatcgaattttaacaaacaaaaattttaaattaaaacaagaaacttctgatgggtgttgaaattgtcgtgcgttatgcacatgcattaaaatgtctttccaaaggaattggctggcgtaaaaaacaaaacgccaaaatgcctaccatttaaattactacataattcgcgcatttttaaggaatttaatgataaatttattacgtaaaaatttctcattgaaaaacaaaaaaggggctcttctttcaatcatttatcatcaattttcccatcattattattgctgtccttttccatcgacaatttcttccattcttttctctgatcctccagctcttgttcggcttgcaaccgccgctcctctgccgcggccgcaaatgcgttctgtctctcctctttgtctttctgaaaaattaaaaaaaaatttaaatttcatttcatttccatttttttttaaattttcctaccaaaatcttttgctcaagctgttcctctcgcattttcagcttctcttctcgcagtgcagtgatcgctttcattgcatgctgaacaacaattaattaacattttctcaccaattgcttaattggttctatctattatatattaatagttgaatttcgtatttaatttgtttccatgtcacgccgaatttgtttttttcattttc

SEQ ID NO: 18657 - DNA, 3012 bp, Heterodera glycines
  misc_feature (2931)..(2931): n is a, c, g, or t
cgtggtgcgacatttgaggacctgacatttgaggacccgacttttgaggacccgacatttgaggatttgacatttgaggagccgacatttgcggatattcccgacttttgaggacccgacatttgaggatttcaaggaaaaaataaaaaaaatttcgaaaccatagtgcgaatcctaaaaattttgttgtctgctttagccagagttaatttttgaagtgaaacaaattatgaattttgaaattaactctgtttccagacccaaccacgtggaggcagcagactttgagtccatacaaaccacaacacaaaaacaccacaaaattaagagaatataaaatcttcacaccaaaatttttattaagtgcacctttcccaagggccaacgggaacatattcacacaaaactaatttagggacactcaaatatctcgagccttccttaaaatgatgaaaataatttaatttgagaatttttgttggtttgtccctgatgacaaaaacaggacaaatgaaaaaatcagaacaattataaacgtttttcacttaaaagtgaaatatttaacattaatttaaaatagggttgggcccccgtatgtcggggttgaaaaagtcggggagtgataaaaacttcaattccaccgcttcacacaaattgatactcgaagaccaacgattaagcgaggccaaaacaaacaaatttattaaaatcgaagcaaaataataaaaagaaaagtcggaggcgatgatgagaaacaaaattatccaaaccaaaaatcacaaaaaaaacaaccaaaatttagaaaagatcaaaaaaaattaaacagaacgtcaaaattataattatttaaattaataatgaggtcacttatcacatcccgcccctttatgagcggcgtccctgccgtcaaaacagaaaaacccgaattcgactgtcaaaaggtggggctcgtctgggggttctcagcttcagcgtctcggcacaaattcggaacggcgttggatcggagtcgaatggtggaagggccctccgcgcatgcgctgatacggatggaattgagacgacgactgaccacgaaatgaaggaccagggcggtgacctgcaccaacccgtccaaaatgacttttctctccataacttcgcacattcacagaccgaactgaattttgggcatgctcagaagctgaatcggatagagaaggggaaaggtcacctgggcctcctcttttcccgtttttctcggaccaattgtggccaatttggggagggtctgctggacctccacccctcactttggcacctctttccggcacaattatttgcgacttaattgtgtggattccgagttctcggtcacccggaaatcctggaaccaccgccgtgagccatgctttcatcaccttcaatcccttctccgtcatccatccatgatggttcacagtttcattattgaagcttttgccgaatcggaacacctccaataggcttcgcccttcttcattcacagcaatcagctcaatttcgtccttttttcggaaaattgaccgcattcttccacagaactcttcggattcgttctttttggaaaaaatgaacggcggcaacagccaaaaggttttcacgtggccaaattttgagcacaattggcggagtctcttcactctttccatcacactgtcaatcgcttcgcccgccaaaattgagtctttgccgaccatcacgaccaaccacttgacttttgatgacagaatcacttcatcaaagtttctgatcacttccgccactgagcctgcttctgctccaacaaattccgacttgggccaaatcttcattagttggaatgcgcctgaatcgcccaaaattacacgctcttccgtaatgagccgttttctgtgaattgaggccgcccggattttctccagctgaaacccggcactttccatcgcctttttcagcccttctctttcgttttccggcaaaagggacaggccttcgggcacttccattgaaattggacccatgccggtcattttcaattcctcattcacgatttggcactgctcggcccacacttccaatgtcttttccacgtctgattctgacggaaatgcgccactttttacgtcgtcttctctcaaactgcagtaagtggctaactcccaactgacttcggcctccaaaatttgcaaaatcagcttctttccggccgatcctgatttcaccgcttctgacttgagcaggaaattggcgagcagggccttcagcggattgtcgattttgagaagccccattccagaacggtccaaaacagcatccagatcagccattaaaaggtccgcgcagtctttgtgctgatcaccagtgcaacatgtgctccaggaaatcacttttggcgtttcggcttcatcttctcccagcacagaaattgtgtcctcctcaatgtttgcctttcctgtctgctgttcggtttccattgcttcgtccgtaccacctaaaaaatcaattgccctcaattgaaaaacacttctctcagtcgttttttcgtaattaggcctaaaattttggtctatttgttgacactctttataaattaatgttgccacgcttattaagccattcaaaatatttttgtaaggattccttccttttggtagtgaacatatgtttggcaattcttttgggactttcacaagtcgttcgattgggactaccatagtacttccattgggtttatctgaaggcattactgtagccgttgattttttaagctcaacaattcgaaatggtccaaaatgattccatagtatctttttgtgaggcgaacggctgtgagatcccggaaaaatgaccatgactctatctcccacactaaatttgttctcggtgactttggctttggcatcgtaacgctctttcattttcaaccgactncattctgaattttttcgcgcttcatccacaagctgcctaagtgactcacggaacaattgaatgtatgaatttttatcaatt

SEQ ID NO: 18658 - DNA, 2465 bp, Heterodera glycines
atgattatggtattgagaaaagggataaacaatagaaaatataaaatttgtgaatacggtattaaaatataaatttcgtattgaaattaaaattaaaataaatataataaaataaaaatgctaatattttcagaaatgaattatgatgaattgagtattgtgaaggaaggagctgttattatgataaacgatgaatcattgactgatcagcaacagttgaaggtggaaaaaataaaaacaaataaaatgaaataattataataaaatataattttatatttatttttacatttcaatgcttttctgttgttcgttctgttgatgttccatttcgaccaactttttctgcaattcctccaaattcttctccaattgctcctcctttttgtcaaatttttcctgcattttctcaatttcatttttcagctttcgattctcagcctcggcctttaaaaattaaaatttaaacaaaaaatttaaataaagtgaacagttaaaatattcccattaaaactatcgatgtcaccttaaaggaaacttaaattttatttagatttttctttttaatttctttatttttaggtgctttcggttgagagcccgaaatttgtttccactttctgtcttaggatgatttaatatactttttaaacaatcagaaaacatcaaaatggaagatattcaaatctgtcttagttcaatgagtccgaaattttgggttcaatgcctaagttttgagaaatttttttttgagaattacatttttatgcagttgctccaacttgttcatgtactgctccttcttcttctccaattgctcctccttctcgtccattttcatttttgcctgcattttctcaatttcatttttcattttcccattctccgcttcgatctttgcgagcagtgcattcgttttctgctgcttcaacttttcttggagtcccttctaaatttaattaattttttttacaaaaattaattgcaaatcacattaaattttcaaactctttgtaaaactcacatttttgagctcaagtttggtgtttttcaataccaattccaatttttcaaaattttcactcattttctaaaatgtaaaaataaatataaaattatattttattataattatttcattttatttgtttttattttttccaccttcaactgttgctgatcagtcaatgattcatctatcataataacagctccttccttcacaatactcaattcatcataattcatttctgaaaatattagcatttttattttattatatttattttaattttaatttcaatacgaaatttatattttaataccgtattcacaaattttatattttctattgtttatcccttttctcaataccataatcataattttcttaaaaattcttccccttcatttttttcttgacaaattttgatttaaaaatgtccaatatttgctaagaaaatagtcaaaggaaatgtacctcatttacaactgcaactagtgaataaaaaattacttttgcttaatttttggctgaaaattatgccaccattcgtccttatttcggacttttcgccactattttggcattttttgtcactatttatttaattattttggcatttttttgccactaaaaaatccgcgccctactgatgatgatgtagagctggatggagtgggagatgatgatgaattgctcatttgttagcattttttgctattgtttttttgaaaaatgcattaataaagttcagcaatttataaccaacggacgaataggctttttataaattaattttatatattttttagtagaatattcaatattcaaattctatttttttcgtcatttatcagattatgctaaatcatccatctgctgttggtacattttccatctcttctcataaatgatcaaccaacaattttagttgagctgtgctttctcccattaatatggaaataacttttctaatgtaaaagaaatattagcaaatatttaataaaaataaatcgaaaaaacaaaaattttttatacatttctttcttttttagtgtaaaaaatgtgccattttttgaatgtgaatttaatccttttgttattcactttgttcaatgtgctgctgaccatcgctcaactgtatttttattattattattttttactgaaattacatttaaattttcaatttaaagttttcaaaaaacggatgaaatgcggcgatgcaaaaataatctgacggacgaagaatatgaacggtaaattttatcttttacaaaaaaaataaatgtttaaaaatttattttgccttttaaatgattgcaggcttttccctaaaagtgccgacaaatatgtcttcccaacgaatacaaatggcatttgtgtaggacttggcaatcaaatggtaattactttaatggatattaaattatcaatctcagagcaccgggactttgtgaaa

SEQ ID NO: 18659 - DNA, 1768 bp, Heterodera glycines
cctaatgatacattattgaattaaaatgagtgccatttataaaaaaaaaatttttattaaatatattcgactcttcttttaaaagaaatattttaaattgctcttttaaattaattattatatttttatttcagtaatttgcaaaaaaaacgtcttttaaattcaaaatttttatattatacccgattgaaatagaaataaaaatttttttatttttgttattttgaataagtattaaattttaagattttttattccccaatcgggctccctatttccggttaattttgatttttatgcttatttctgggtttctcggcatttatgaccccaaaggctcatggatcaaaaaattttacttccgtttcaaacaaatttaaaaatttcggttatttaaagttaaaaaagaaatgattttttcaactatcgccctcccattgtgcccgttgaaccatcattttgtgccgtgccgttgccactccggcacttcccgctgggaggggtggcctgtcgcgacgtttttggcaaacaaatttaaacattccattgtgccatagattataaagaattttcgtcaaattcattcgttcctactaatttggacttaagtttatgaacagaataaacatttaataggtaaaaaaaaaactaagaggcgaccacccaaaaatgggaaaaacgaaaattttgtcttaaaaaaatgttgaattttttaaaacaatttttcatggcacaaataaacaaaacaatcttgaatattttttgtttagttcagttcattcaaattgtttatttctcataattcccggtttcatgacaccgacaaaacattagtcttatggtctaagaaaaaaagactttaatttaaatcccggtataaatcctggtcttgaatatgtgtttacatcaggaatataacggaataccgattttcagcttcccgtttccgacaattttaagctccgtcattcctaaattttttgagcgctggaattccgatttccggcatttttttaattcaaaaaccgatttcagatcccgaagttacgatttcatcattaggggacagaatttcgatttaagaattccgtctttttttctgccctggaattccgaattccatcatttgtggaggagggattccgatttccttaattatttgggtgtcggaatttgcattcaaatttgtatcttggtgataactccattttccgttttccatctctcgttttactctttggtctcgagagtgccgatggtcgtttatggtcttgcgcattaactctttaaaatgcttgtcatttactgtctgggcacctcccccacaaattcgtgtaaaacttttttttttgtctcaaccatcttgactactcatcacccattcaattatcgtgtcgtgccactttctcactcccctgtgcacttcaaatcattttcaatcctcgtgccaaatccattttcttccttggcactttactctgtctcctaaaattcatacattttcggaaataaattttattccctaaaagggtccccgccaaccgtctccataatgttttcatccattttcccgcatcaaatctcgcctcccccattcccgactcaaaaatgcgtgcaatatttggtgggtgtgtgtgtgtgtgtgtgaatgcttcttggaaacaaattggcacagcagagcgccaatctcgcttgaatatttcttccgagagctttcgtcggtcggtctcggcttggccacttcaatttccaattttttctgcccccc

SEQ ID NO: 18660 - DNA, 1449 bp, Heterodera glycines
attttcaacgtgtgacgtgccctattcattagagtgtgtggtgccggcggcgccactttggaaaaaaaatttttgttttgtttattttcttcggctgctgccgaaacatactttttgaagagaaaatcgccagcagcagcagacagacagacatgtcctttgaatgaaggacagaaagtgccaatgatgcattgatttaaatgagacgaaatttttttttttttggattttatgaattaaaataaatttaatgatttttttgttttagcgtaatgtaaaattaaatatcaaaaaatatttaatgaattattggttttaatattaatgtaaaacaaataataaaaatctaagtttgcgttgaatttatgaattagctcaaattttcactttaaataaattttcaaatttccaatttaaaattagtgaaaaaactttaaaaatataaaattaaattaaatttcaaaatttattatattttcatttcccttaataaaataaataaataatattttttcatcaccaaaaccactaacaaattttttggtgggtgagaaatgtgccgtcatcgggcgctgtgccatggtggcactttttcacggtccctccccccccctccaacactgtgcgctcggttagtgccagctttaaatgctgacagccgcatttgccctaacatttaattgatgagcttcccccgcccttatgcttttccttccgcagtggacctccgatgaatggcatatgacgacgacggatggcactttatacaaccccagggggaaggaaggaaacaattttttgaaaaataggttatcctttaaattcaaagttaattttaatttatttttttgaaaaaatattaaaatgtggctaaaacataatatttaatttcaatgttgtaagatcactgatgttttcttgtaaacaacattttttaacttatcaaaatttcaaaattcattttttaattattgaaattgcaattaaaatttggatcaaaatctataataaaatttcttttcacccttttattaagtttttttcttattttcggaaaatatttggtactatgtaaataaatcatttttaattattacccaaaaaaaaatccataaatattttttgttctcatttataaaacaaataaagcgaaacgcgccctgcggcgccttaggtaacgaaatgcgatatttaaaaaaaaattaataataagaccccaataaccacaaccaacagcaaaaaatctcaaaatttgtgcaatccatgatagcaaaattatcgatttagcttaaatttaaattatttatcggcaaatctattaatataaatacaaaaatgtattttttatattttatttttaatacagatcaaaaacaattttcttgaaaatggctaaaaaattaacaaagtcgcgtcgcaatatttatttctcgtcgtcaccgttacatt

SEQ ID NO: 18661 - DNA, 2628 bp, Heterodera glycines
  misc_feature (44)..(44): n is a, c, g, or t
ttgtcttatttttaaaaaaaaaacttgggccgcactggtttttntggtgaaattaataaatcacatccatattttctaaatttcatggcgatgtgaccccattgcaaaagatttatatccattgacttatagtcatgttaagcatcataaagttgaaaataccctttatatttctgcaattttgcaaaaaactccgaaaaaagctttggtatggaaataaaaaattcacattgaaagtttttagcgaagagatagattttcatattgaaaaagtagtacgtcaaaacgagtatgtattatctatatatcggttcatccctttttcaattcagtgtctgtaaactttacttccttttcgaaagccaagcggcattactttcctaattcatgttgttttttaattgtaaattttatttttaaatctatttgggtataggctatgtcagacctcaaatgctgtacagaaaacaaacaacaatttattcccgaaaatcaacaaagcgcggaataaaaaaagaatgtgtttagataatgccaattttgttggccacgtccaaagcatcataatctgcggctaagcgaacgtaggccttctttgtgtggtcgggcgtgatcaaagtgttgagcttagaaaaagcaatggttagataaagagtactttagaaaaaccctagcacaaaaatgtttttaacaataaaattgaaatgattaacaaaaatagtaagcaaaccacatttttccagctacttttcctccaacgcctttgtaatggactttcctaaaaaattctatattaattaaacattacaatcaattttcattaatacctgtgtttttttactcgcggagttgttttttggtggcatttctttagtttttttattattaaaagctgataaaaaataaataaatgatattagcgcaaggattattcacattgggatgggaattaagtcacaaaaacattaaaaactgactacgaaagagccaaatttaattaatttagtatcctgaatttagcctctaaccggtcgaccgagggttggagagaggtcggcgttcaaatttgttatggcgaacttttcaaaaactttatggaacttgggagtccggagatactgataggaatgaaattggcgtaaatttttgcgcgctaattttaaatttacactggaaaatgccttttttgtattttttattttgatcagccaaaacttgcttcattcccaactaaactgaataaatttggtatctaataataaattgatttgtaccattataggcaatagtgaatttgatttttttcatgtgttagagagatgaaattagtacaccaaaatgagagaaaaataaatgtatttttatgttttgttctataactaatgaaataagcgattgttttctgttaaaaatcgattgaaaaattctttatttttttctctatcggtatacaaaatttggtgtagatttaacgtgtagaaaaaaaaaagttaaaggtcacgaagtaatgttgttttttacaccattaaaatcgaagagatagtacgtcaatgagaaataacaaagcaaaaaagaaacgacgagatagtactaggcttttcgctgcacagtgtggcgtacccatcggtctacgtcagttcggcccccacggttcggccccagcatgtttttccactataactctctataacttttttctgtcatccaaatccaataagcttagtatcattcgaaagcttaatctgttttgaagcttttttaattaactgtttaattgggcaataattttgcaacgcacaatctgtaaattgtgaccgccctaatctgtccaattcgccaggacctctcacgggcctaaaacccaaaatgggaaaattaatttattgaaattgagcaaatcgacctgtgcatctgtggatgggttccaatcggggtcaaaaatcaaaacgcgattcgctccggtcaaatttatgccaagtccaccgacttttgtcgtcaataaaaacacaaaaatatctggatccttattgttagaattaaaatgagaaatgtaagaaaggcagcaacaactttgttgaactgttcgatgagagtttgtcgactgccaattggcgttgtgccgtccatgcgaaggaaggaataactgtaataatacggtaatataaataaattaaatgttttttagcgttaaatttgccaacccttcagtgataacaaagctttcgatgatcgaaagcatctggattttgttcgcgccacaaacgcaaaagctcacggagaacaaccattttgccactgcgctggtaaaagccgaattccatatccgaccgatcttcgacattaaagtcggctaaataaagcaaaacgaatggaatgacaatttaaatccgttaaatattttaattaccaaatctgttgggtccatacatgatcaaggagtgcgccggcgcaccctccccccccccccccccccacgtgcgtcgtaaggggtggggaggtcgtttgtgaggggaggagggagccccgaaggggaaaagagggaaatttctgaaaattttggctatttttttagcaaaattcgttaggaattctcaatttttctcccgacggcgcctatcggcggcgccg

SEQ ID NO: 18662 - DNA, 2369 bp, Heterodera glycines
  misc_feature (2336)..(2336): n is a, c, g, or t
tccactttttatggattttccgacctgctttttttaaagaggactttctatgaaaaataagtttaaatggattttaatattataaaatttcggcagtcggaattacgatgctcagaaaaatccagccatcggaaacgggaattccgagcccaaaatgtcggaaaccgccaatcggaagtcggcattcctacatccttgatccgttctcattgtaatcggttttatttggagtgccatttgctggagtgttgctgtatcagattgtatagggagatagaatgattgagttctcgtcaactttgactttggtcggctgtgaaacacttccttataccgttaagcttttaagatgccatcgaaaatattccagaataagaataatactggccacaaacagactttgttgacatttttgttttttttaattataagaattggcctacggtcccgaggcgagacgaaaaattttctaattttgttataatttcttaatagatttgcataaaaatccaatattatgaatttaagccaaaattaataatgaaactatgcatgcccttaatatgcatgaaaatatattttaaaaaaataattaagctagttttgttgtatcgtttttggataaaactccgactttacaatgacttaaaatgagtaaataacaaatttttaatttttcaaaaatggagttgatagaaaggtataaaatttctctttaaaacttaatttcagttcttttttttattctttccccaatatttcgtcgtccaatttgaccttatcttttcgctccgctttcttttgattttttttatacatttctttcattaaaaggtcaaaatgcacatactaactgctttccgggccgggatcgagaatctgaccgaatcggattgaattccggttccctgattcccagtcccataagtttagggattggtgagacaaatacgaaatcctactgacaaaatgccaaattttgagataattcatcaaatatttaagtaaaataattttatgaaaatactgaggaaaagaaaaaggaaaaaaatcaataaagctgatcaaaagtgatattttcttccttcaatgagtgaccaaatcaaatctgaagttggggccaaagttggcctcaattttatcaccagcgccattcaaactcaaagtgacgaaagggaaaaagaaacaatcagcacaggaggatgtagccatcaactcagaattatctaaataaaaaagcacgggaaatttgaaggaaatgaaaattattttgggttttttgggaaagaagggatagacggtgccgacaagccaggctccaagtttttcttcctattgggttgatgaaaaagttctgaccctctgaaaaaacaattatgcaaaaaatgatatttaattctaaagagattgaaaaagggaggcaggcaattgggatgaatcagcggacggttggccatcttttggccatttgcatttgttgtatagccattacttttgcaaaatcgaacgattttcaaaaaatggacaaaattcgcctaaatgttgcgttctcaacgcaacaaaaaattgagcaacttcgatgggcggttcttcctcatccaccatacagcccaggcatcagcccgtgtgactactatctgtttcgatctatggagcacttcttgagagggaaagaatttgctgatcaaaacgaggtcgaaaatgcattggatgacttttttgtatcgaaaaatgatcagttttataaaaaggggattgaaatgttgcccgaacgatgggggaggatcattgatcaaaatggtgagtacatcattaattgaacatttgttttttgtgaaataaaaaattgtttaatgttgaagtgcttaaagggtcagaacttttcatcaacccaataattaacttacaagtagcggaatgttctcttcatctttgttgtcgcttcttccctttgcggatgtaacgattattataaaattgataataataaaaattgaaaaaaacaaattcatttcaacctttacaattatatatatatttttattttttatttgttttaaaatgaattttttgtttcttacgaaaatttattaatgaagatttgatttgccaaaatgaatattgttattggttaattgattctatacgtgtataagtaagtattaatgattttcttatgatttgtagaaaatataattattttttaaattgtaaagtaatgaaaatgaatgatttgtacaattacgcgagttgaaatttcgaaatacggttaaaattcaattaaaatacactgtataaacaataaatatttaaataaaataaataaatatgaatgngacatttttgaaatttaaaacttaatataaaat

SEQ ID NO: 18663 - DNA, 1030 bp, Heterodera glycines
acgcagcagccatacacaggctttaacatgtgcagcactgagcggtataccacagctccaaccgtatggaagcaccccaaaagccatggctcgtgaggcagctgccccgtaatgttgggcagcgtccacaagtcagctcgaacgacctgtgcccgtcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctg

SEQ ID NO: 18664 - DNA, 3079 bp, Heterodera glycines
tgtggccaataataaaatggcataaatggcgaacaatggcaaaatcatttatcctcgaaaaatcgtgtaaaagcgctcaaagttagcccgcattgatttgctttttcattgctttccgcctaacattcaaggatttagcttcattcaaataggacaaaatgaattaattgacaaaaatttgcaaatttatttatgaaattgcaatttaattaaaataaatcaattaagttatatatatatttatatatttttattaatcgaataatctttgttctgattgagtaccgtatatgctctaattatagcccatgggggattatttttcaacctcctcagaatacaggggataattagagactggaggataaatagagactgggggattataaattttctcggaaaaaataaaaattctatttacccccatgggggataaatggagacagggtgattattttttaaactcctcagaaaggggggggggggggggtaaatttggaactgtcgggattaatagagactgtgctataattagagcatatacggtatttggtgcatatttcacgactttatttgcatatttatgtgcatattttggccacttttcgtgcatattttttgcatccctgattataagaaactatatttataacatttctaatttatgaattgttatttaaaattattattaagcaaataactgcttcattttaaagataataccaaattcaattttatgcctctcaaaaactattaaaatatataattcatatcaaattattattttttatgctaatatccctaataattcaaaaattttaaaagcgagttaatattaattttttccaatgagggaaaagcagtagaactcgcgtgctgttgaggcggcaattgctgctgctgtgcgctaattgtgttcaagaaaatggcaccgtctgcttttttattttcgaaacattggcattatctgatttgttagcaatccaatttaaaattatatttttaagatttatttgttttgttcaaaatattttaagaatttcttagtaaaaaataggccgaaatgatttcgctcgcacaagataaacaatttttactaaataatgataatgatttttattcaaaacaaaattttaactgtaggtgactgaaacttttaaattttatattttaaaaattaatagctttatagtataaaagcaatatttttaatttgtttttttaattcaagcgctagcttaattgtgctatgaaatcaacgtgaaaagttcaaattcattttatatattctattctgttttaaataaaaacaattaaaaactataatttaacgataaagaataattttatgatttattttgcgcttatgctttcatttattacaattttcagtttttgtttcatatatatttcaaggtgaagcaggagctgaacgtttcattttttctaaattaattttatttttaatttcatgaactataatattttatatgtgtatgaaagaaaatcaagttttttaaaatcctcttcaaaatctaacaaatctttgtacatttaaaagagaaatataaatttttaatcaatcatatttttgaattcattttttaaagtttaaatttaaaaatgtttttttcacttttcatttatgatttttaactaaaatttattgaactaattcaaaaaaaatataagtctgttatcaaaaacagttttttctcctattttagcgtactattttacatctctaatatagtaaatacatcaaattagctaattctaataatttgggttattaaggtacaaaatcagtttggatatttagaatcaatagaaaaacgattagtttttaccattttggttggaatcagcagtttaggacgtgttttataaattttaaaattttcatagcttttttagtatgagttaaattgtatagttttttgtttagaaaaaattctccatttcaaaatattttttttttactaaatttgataggttgggttaggaatgaatcaatttatggctgatcaaaataaaattgaaaatttagccaaaaaatgtgccataagacaaagagtaattaatcaatgaatatttactgcaaaaaattcaaaatcatactacaagataaaagatataaattactcaaatccaaaagctaaaaaaatttcaacgaatttgtgtcaaaaaagacaaagagaaattaatcacctaaatactacatgtgctaaaaaaagaaaaatgttaataattagttaattatctaggcaaaaaatgtgccacaaggcaaagggtaataatttttgtctttaaattttaagccaatttttattaatatataaagagtaattaattatttaatttataccaagctaggtctatttgttaacattcattgaatcatttattacatgcttatttttaatgtagtattttgttgtagttaatcgtaccttgatttttcggcatttaggtaatgtaaattattattagcaggactgtcaaaaaatgcacgaaaatgataaaaatatgcgtataaatattatacaaatatgcacaaaaaacttggaagttaggggtgcaaattaattaaaaaaaaatatgcatttgcatatttttgaccgccctgattattatgattccaaataaaaaagtccgcatttgcgtcttgttgcacattaccaaatcgaatattctcctattttttccatttattttataatttttctcaatttatatttttcttaattataagcagggatgcaaaaaacatgcaaatgcatattttttttcctggcttctccatgctctaaatagcaggaaaaacactttcttttttgtgtttgcgtataaaaatcgggacttttatttgcatatttatgcatatttcgccatttttttggaaaatttgttaacaaaaatgcaataaaaacggaaaatacacccctaagaatcggcgctaaaaaattcaaaaaatacacccctaggaatcgaccgaaaatttttaaaacacaccactaagaattggaaattttctcaaaaatcctccccccaatttttttttcattggaaaattttt

SEQ ID NO: 18665 - DNA, 699 bp, Heterodera glycines
ggtccggcggtgcctataagcgccgccggaaaaattttgaaattttcaggagatttgttaacagaatttgtctaaaaatgatcaagttcttggttaaatttgcggtttagctgtttaaaaaaagaaaaaataataatttttaagttgaaatattttttcttaattaaatttcaattgaaataatgtaaagaaaatataaaaaatttctgttccgttggggaattgaacccaagcgaaaaataatgaaaggcagaaggtttagccaccagaccacatttgatagccgaaaaatgattttaatacattaaggaagcagcataagagatttgtgatgtttttttgcgtaaatttgaatatttttctgactgctcaaaagttcaatctgtaggggtgtattttcacctctcatcccaaaaaacgagaggtaagaggcgagagtcccaaaaatggcgagagttggcgagaggcaagagacgagagttgtcccacctctggtacatgcctattttcattttttatatatttataggattttttacagaaattttagaaatcctcaagaaaaaatatcggtaaattttcgtaaaaattttcatttattttttacttacctattttgagaattttttgaaatttatagaatctcttgtgagtaaattaaaatttgttttttgaaaatgtgccccctaaaaattgatg

SEQ ID NO: 18666 - DNA, 1198 bp, Heterodera glycines
attttgtttgttcaattgtttaaaattttagcccttcttaattatttcgttaagcgggaaagatggtatatatatcagggttgttgcgaatcgaaaaacaaaacgcgaaatacgaaactaaaataaaacacaaaataagaattacgaatacgaaataacataagaactcgaaaatacgaaacgctgaaatttttttaactgaaaaattaaaaaatttttcaaacacccgaaacttttttttttgcttttcccttcactttttttgctgcgcattttttttttaaacttttgggaaatggcgctgccgggaaaatttttgaaaatttgaatgcaatttggaacaattttgtccaaaaaatgaccaaaattttcaattttgtgcttcgctaaaaagttaaaaatttgcaaaactatattctcatgaaaatatttgtagattttgatcaaataaaaaaaataataaattttcagcttttgtcagcttttttcctattttcagattaatgccccatgactgttctttaagtgatcgtatggaggactcacaaattttacggcgataattatgagtaaatgaattaattcattcagtttttgcattttcagtcgagaaaatgcgttttaaaattttccactttttccattaagaaaatgcttatcctaaaatttagctcccatttttcttattttatgaaatgcaattctatcgctaatccaaaaagtaggctcacataatactgaatttaaatttaaatcttaatgaatttttaatttgcataattattgaaaatttaatcccaaataactactcaaaaaccgatcatttttataaatattttaaaagactttaataagcaagaatatgctaatcctagaagatggctccacattatattgagttttaattttttataaattttaaattatttttttaatatgtatttttgtgaaaaataaattccaaataatattaaggtgaaaagtttttgcgcgtttaagccagctttttaagaaaaaataaggatttttataggcgacgcaaaagaaaattttttgctatttttaatggattttttaaaaacacgcaagattcggagttctctcagattaatggacaaattggatccaattacttggattcaaaatcgattattcctactgccattggcaaatcttcccggactaaggtgttttcagc

SEQ ID NO: 18667 - DNA, 2936 bp, Heterodera glycines
cacaaaaattccacgcccttttgtggagagtgtcggttgatcagttcagtgccctctgtcatcagtcgcttttgtttcttcacgtcgatcatttccgccagtgatgggaagtggggctcttccgtcagctgttcaattgtgtgggcagtggcaattggcgtcagatggtcaacgagttgggtgtgcatcagctaaattgtttctttgcttggcatgacattaaaaactgcacaggaccataaccacaaaaaagtttctggggatgggggggggggcaaataaaacccggttttttcttcccgaaattagcttttaaaaagcgagcgtttaaatcggagcaggtcgtttcccacacccacatcgtttctccccctgaaaattaaaaaaaaaaaattccaaacagaatttttcaaaaaaattaattttttaagaaaattcaaaaaagcggataattatacacctcctcctcaatgccaatttgaccctttccagtgaaccctttaagttgcttggcagcacaattggtctctatcagttcaacgacagccaaaacagtgtcgagggataaaatgtgagtggaaaagagaagcggaccatttggaaaggcattatagagcaaagtccgaatcttaaaaatatttgtaaaatataatatatatatatatatatatagatacaaaatcaaccaaccaaatcctcaaagagattcgagcagtacagagagcagtcatagttgaggtacaattcagcgacaaggccaggcaaacgccacatgtcgaccaatgcctccagcgcgagttcgcgcaattcgtaacaaacggcggccttagccgcgagaggtgaacccgcggatgaaatggacacagactcggccaattgttcggtggagatgagctgacccaacttgaggaagtacgactccatttggaacctgcaatagttcagttgtgagctaaccaattaagtgaacgagccaacttcagttgaggacgcaatgtttgcaacaacaaaaaacagacgcgattcgctgctgcgaaaattggtaatttttgagtgctcaaaagttggagcagtgtgtggctgagttcgtccttgagcaatgcgtgaagtgatgcggtggtgcgcagaaaatcatcccccgtctcaaaggcgacggtcagcaagtgaagacccataagaatcatgctggacttgttggtgtcatcatggggattgcacaatgcaatcaaaaacctgaaaaagatattgtaaaaatttggttacaattctaacgtaaaaaaatcagttgtttggcacttttacagtttatgtggcccggtaaaaccatagatgggatccttttgtatggtctttcatcggccacctaatctgcgaaagtacccagttctaaaatatggtctaatatttaagaattgaattttttagatcttatgagaattcaaaaggtatgccactacactctaaggaggcaatattatgcaacgttctaatattaataaacacgactcaaattctccgaattttttcatcgatgccaaaacgcagcactgaccctttattcctcatgcaagaaatttttgaattccaaagccgttatgctgattttaaaaaaccttgggaataatgtacgaaaagaacaaatcaattaattcttttgtgtctgtctaaattacttcatcaattctttgagcccgggtcggatgtcctgctcaaacgtttggatggaggcgaagagataacggcacatttccgccaaagcgttctccgcggccattcgaagcagttcgggtagtgaagactcgagaccaatgcgaaaacagcactgcaaaatttcgcataatgtttcattggttaggtggcgcccgccgggcgaaaggaccaaagaacgaagggactgaaacgaaaaattacattaaacagaaaaagggagaaaaacctgtagaatctggaagagcacacattcatcgatgcccaatttcgtagttccgacaaactttgcctttgttaccgaatccgcaatcgactggacagcccctgcgattcgaatgctaaaaatagaaactatttacctttatggccatttttatgacttattcgatgtcaagagtccgtatgtgatgaatttttctattgctgctaaagctctcgcggtgacgagcccatcggtagtttccgatttgatcacttccaaaaaaggactgagaaatgtgtcgaattgaacttcactcagctcagcgacctaaaaatggtaaaacaaaataggtaaacaacaaaaaaatgttgattaaacaccttgttcaaaacatcacgaaggtctgcaaagttcctcagcagaggattgttttcgtctaacagtgttagtctctgacgtgtctgtgcacgacgaaactttctaagcaatgctaagacggcattggcttcgccttggacaacaaagagaccatttaccagtgccattttaatcaaaaaaaagtttaaatgtttatattaatgtatcaaaaatgaaacatcttttggccgattagatcgacaaattaacgtttgacttaatggaattttaagaatccaaccagctgccatgcgagaatcagctggctatcacatttcaggccgtatttcacaaaatacgggtacttttttggtttacggggtacttttaacggtgtacggacatttcgcctactcgacatctcgcctaccgacatttcgcctactgacatttcgcctactaaccaaaaaacattcatttcgcctactaagccaaaaacattcatttcgcatactaagccaaaaacattcatttcgcctaccagcaaaaaaattcatttcgcctacaagccaaaacattcattttgcctactaattagtaggcgaaatgaatgtttttggcttggtaggggaaatgaaagtaggcgaaatgtcaggaagcgaaatga

SEQ ID NO: 18668 - DNA, 3179 bp, Heterodera glycines
agttcaagtcatggaactcttcgacacatcatccgccctccacctcctgaccggcacccatgttggcaatgaacatgacctccatgccgcccgcttcgtctttggtggtgacccgaaggcaccgcacgagggcccgatcaagtgcgagcgaatccaatacccgcttcgtcctggcagcgtgatgacgatcaataaatcacagggtcagaatagttccttttccttcttttgtatagtgttttttgattgcaggccagacgcttgcgcgagtcggagtgctgttggacacctctcagtgcttcgctcacggccaactttacgtcgctttgtcgagggtgcgagactcggacaacatcagagtctgcaccacacgcagtgaccttcgtgtgaagaatgtcgtgattcgggagctcggacgaagaggaggaggaaacggcgttggcggcgctgcccgatgacccaagcgatccggtatgatttgaataaagggattttttgaagaaatttttcaagtttccacgccatccaccggcggacagtgaacccgaggatgacaagcctattgggatgccgaatgaggcggtgttcaaaacacccacgccatccacaagggcacagcacccaaagacaacgccaattgagttgaataacacagtgtccaaacaacatctggacaagttgacggtggtgaaaggcgacatcaccaaacaacaaatttggatgatcgtcaatgccgccaactcggatttggtcaaaggcggtggagtagacgacgcaatccatcgcgcgtgttctcctcgtcaaaaagagctcgaacaactgctcaacatcaagattttgtcaaatggtggaccaattgcggacggcggggtcgtggacacgcccgcgtttggagacttggccaacaacgtccaatgtatgccagtgctaatcgtgtgttagtcttagtcccacatttgtagacattttgcatgctgtcggtccaaaagtcagtgcagcgctcaatgagcaccaccgcaggtccctggcaaagtgctacaccaatgcattggaccatcttgtgagcatgcacatggatatagcaaacccccagtcgagatcaattgttagtgcaattggaatttattcgttgacttatctttccataattataggcattcccaagcatttccaccggggctttcaatttcccccgtgtggatgccgcgcacattgccattagagcaattctgaattggcttgcggaccaaccagcggatgcaccggcaatcgatgaagtccgcttggtcgcatttagtgacgaggactttaaattgtacaaggagattcgcgaacgagtaataaataagcaatcatgttcgtttctatttttttcgtaggtcaaacgccaaatgaacgctggcaaacgtccaacgcccaaaacatcgttgcagacgcctttacgcattccaatggtgtgtatatgataacaggctcatttgtatgtttgttataatagctttccccgacaacatcgcggctgtcggaatcggttgagcgaatcgacctagccatgactcctacaacgagtcgcgccccggtcccccactttccaattcaacagcagcgtcgcgtccgaattgttgatgtacgaggcgatggagcttgcttcttccggtgaatatattaatgcactaccaaattacaagttaccattatgtagggccattgtgttcgccattgttggccgtgacgatgtcaacatcgcattcaacttgcgtcagcaaatgtttactcttttgcgacaatttcttgacgacccaaactgtttcccgcgaggcttctatgccaatcgcgcgcgtttcatgcaatttattgaagcactccttttgggcgatgaaaacaccaactttgacgcttacatcgcaagtcgggtgggcgcaactgcttgggcagacgcatctgatgctctgctcgcggccgtcttactcgggcagacaattgttgtcgtgtcacctgtagatcctgacaatgtccgccgtgctacgagcttttttgacgacacagttcgccatacaattggagtgtttttcccagacggaaatcatatggtgacaaataatttcaaggcctacctcatattggtttaaaaacagagaatggagcaagactttccacatgatcagctgcaaaacttcactgtacatggccatcaaggtcaacaaaggccggtacacaacccggttttgatatggtacaatggactcaaccacttccaaacaatcttggtcagtttctcagtatatgtcaattggagctcagttcatttggtgtttcagggtcctgaacagctgaactaccctgctgcacataacatcgtgacgaaccagcagtacgtgactccagcgcatctgttacaggatgctatggatgtcgggccatctctcgcagggccttctgttgccatgcaagaggaagaatttgcagaagaatttgtaccgaccaagaaattctggtccagtgatgaacgaaggatctgaaaactggttggggttttgggttttggttaaataaagaaaatcttttccaaggtttttggccgaccaataatttcgccccgggatcctgaacgggttcgttcaggggagggtggcctcacaagaaaagaactaccttcgcgctggtgtgaaggcggtaagtacctgttgtgctcaaacagggaagccaaaagtcttccttaacatgaacatgaagaaacatggagaaaccgtttaccacaagggaattggtgttggacggtacgctgccaagtgttgtcatttttgctcttacgaacagccatcgtatggacattacgctgccgagcgttgtccttttgctcttacgaacagccatcgtatagacattacgattccgagtgttgtactttcgctcttatgaacatccatcgtatggacttacgctgccgagcgttgtccttttgctcttacgaacagccatcgtatagacattacgctgccgagcgttgtccttttgctcttacgaacagccggtagcagtttgtcatctgagcatgtttcacgcatgttcctaacttcttcgccctgtgatcctgaacgtgttcgttcagggtgaggggtgcctcacgagtagagactaccttcgcgctggtgtgaggcgtagtacctggttgtgcttaa

SEQ ID NO: 18669 - DNA, 1746 bp, Heterodera glycines
  misc_feature (9)..(9): n is a, c, g, or t
ttttaaaanttctgcgacaaaaagaagtttaagtttatgcttcgctggaaaatttgctattgttattaaaattttataagaaagtaaaataaatgggcacatttttggagcgcaaagtcttatgagcaaatgtcaataaaaattatttatgatttattttataaatgttcttatgattttaatggaataattttcatctaaaagaatcgttgatcacttttttgtacatacataaggcgtcctaaactgtcgtgtattgctacttgttgatccatcagtttgatcattgatttggccgatgtccgttcgtccgaacaccaaagtgtgcatgagcaccggacattgtgggcgttgttccaagttcagcttgtcaagctgttctctcagcacttgctcagtgggactgttcttgagcccttcagcggatcgccacaaaagtgttgcaccgcaaaggtcaatcaaagtgccatccttcaaaaggattgcaaatgccattgattttcatttattttaatccacaaccataataattcaaaagttaaaaaacaaaaaaataaaacattgattccataaatatatattatttttttatgattcagattaaagcactaataccctaaaaaacaatgtttgccttcaaaaatgttttaatgcagaaaaatgattttttagggcttttttacaagagtttttgaaagccttgtcatgaaattttgcgtggtattgaaatcaaaatttcccaaaaatgttatttcaaaatggttcttcttgagtaattttttagaaataattttttttacaattatttaaaatatgaaatgatgagtttacttcaattttgtttgtttttccaggaagcaattctcccattttgccaggagagcgcacttctcttttcgagtaaatgttgccgttaacggacactaaattaattgacttaactttttttacattaattttaattttaaatttggcattatttaagcaattctgaaaaaatgagaaatttctcaaatttttgaattatttttttcaaaatgatgacaattaccttctttccaacaatttggagaaatttcgctgtctgattcattttcatcatcatcattgtttgaagaggaagctgataaataaacggaggccccctgaaaataaaaaaaattttaaataaattttcttctgtttctcttttacctcatcatcattatcattgggtgaaagaattagcacaccatttgtaaccaaaccatcaaattgaccatttgacttttctattttatttgcggctgggcccaaaaataactgaatgaataaaaataaataaattatgttttaattgttttgttttgaaactctaaataaattttataggttgtcaatttcatcaaatttacagcatttagtgtgtattgtcaattttgcctattatttacgcataaaaaatatctctaaaaaatttgtgtcacaatcagaatagttttcaggacaaaataattttcaaattttatttcttcacttccaaaaatttttcataaaaaaaaactagaaaagtccacgtccacatcagaaaagttatttgtgcaggacaaatgtcttttaaaaattaattttctttttttttaattaagacttctgtctgaacgaatggagaggaataataattttatttaaattttttaaaattaaataatgaagccatttatgtacatcatttgaatcgtcaaagccagccgcgtaaatgtacac

SEQ ID NO: 18670 - DNA, 1813 bp, Heterodera glycines
catacgcatattttagagcattgaatcgcacaatggacaatcgcaaatccaatgcgagggatttgttgcgaaacggcacggaattgaacgaggaaactgccgggtcgacttttcagggtgaaaaagacaaattgtaactgtcaaagggggggggggcgggaagggggtccggacaatccgtcagtaatggacaatccgtcaatggacacaatccgtcagcaaaatttattttttaaaacaacaaattttatttaaaattatatgaaaatgaatttaaatcgctaaaaattgtgtaggtattataaaaatttatgaaataattatttttaaaataattaaagataatttttatataagataattaattaaatctatgtaaattttatttattaatttaacaagcattttcgcaagatttttgatcattgctccaaaaaaaatcctgacgaattgtccactgactgattttccaatgacgtactgtatgtccattactgacggattgtccatttactaacggattcttcttcactgcagaattgtcattccacgaccatctcttcgtcaaatttcattcaattgcacccccccccccccccctcccttgtccatatcatttgaaaaacggcaattcgaacgatcctttgtgcaattagtgacgtcgcagtggaacaaatggctgaatttcggcttttgatcttagccaaaggcgcctggcggagaacttaggggctgattgggatcaacaaatagaacggagagaaattaagtgacaaatcacaaggaacaatgacaaatcacgagagttaatgaattggccaattcagtgatgaaaataaaagaaagttgagcaactaattttgttaattacgaggaaaatgttgcaaaataaaagtcacaatggaaaatgatgataattaattatgaagaaaaatgtgattaaaagaaatgaaaggtgttctattttatccctaggccaagtacctactgccgactggcactgatcacaattcattcgaccgttattgctctaataaattttttttttctctgcggcatacaaaatataataattgaattttattatcataaattcacatttgataattaaataactaaacgtagccaataatgataatacattacttttactaaatttaatatttttattcatagcaaattaaaaactctctctctctctctccgtgctgaaaaccgacaaaacaacgtgaattgacgtgtgcagactcaagaacgacgaaacgacgaacaaattggtggcatttgcagtgttgctgacgaagtaaatttatttgaattttgcctataaaaaatatataaaaataaaataaatagaacaaaaaataaaaaatctcttgtgactcattgggtacggtaattacagtatacaataaaagttgttttaatccgagaaatgccaattttactccgatgggtcagaatcggaattggaaccgaaattttggtaaccgaacgaattttgaaaattcacgatttcaacggggaaactttaacaataatcgaggtatgagaggaaggggtaatgaaaggcagaaataccgaataaatgcaattgggaataatgaggaaattccgtcttcttctacccgtaaatctccaaccccaacaatgacatttctgacaatttcaatggttatattttcattgtttggtctaattaatggccaatatcaactatgctctgagcgagtgcccacaactcctatttggctccaaatataaccgaatgttcagttccagagtacaagaaaatggcagaaacccaagtgac

SEQ ID NO: 18671 - DNA, 1862 bp, Heterodera glycines
  misc_feature (6)..(7): n is a, c, g, or t
  misc_feature (1708)..(1708): n is a, c, g, or t
  misc_feature (1726)..(1726): n is a, c, g, or t
  misc_feature (1747)..(1747): n is a, c, g, or t
  misc_feature (1786)..(1786): n is a, c, g, or t
  misc_feature (1819)..(1819): n is a, c, g, or t
  misc_feature (1852)..(1852): n is a, c, g, or t
ctctanngagtcattttccaaaaacaaattcaaaaatttttcgaaatttccttgggctcgaaatgacccttggcggtgtttgcattccacagctgatgactcaaagcgcaacgaggcaatttttagagaaaaaaacagctacaaattttcagcgccaaaaaatatggcaaatgagaggattcgtcgagaagatctcgggaatgatcccggattttttggcgttccgatcagggacagtcccagaatttttgaaaatttgagtacaattgtggatttttggaaaaattttccaaaatttttagaaaatttgaagtaagtcatgagtagggaagcaggcgttttgtcactattttttcactatttcgacattttttggaaaattctttaacaaaaatgcaataaaaccaaaaaatacacccctaagaatcgacctaaaaaattttcaaaaaaatacacccctaagaatcgacaaaaaaaatttcaaaaagcactcctaagaaatgaaaaaattttctcaaaaggtattttcgtggcaagaatttaaaatttaaaaattatttttttatgtacctattttgtttttttgcccttaaaaatccagccctactcatttgcaactgcaatcagtgaataaaaattatttttgcttaatttttggctgaaaattatgtcactattcgtcactatttcggacttttgtcactatttcttcactattttggcatttttactcactattttagttaactatttcgggatttttcgtcactaaaagttgctaccctagtcatgagtttaaaatagatttttttttcaaattttaaagacgccgaaagggtggcagcgtggacagcggcggcggcgccggcggtgtcgcctccattcagccttatcaaacgccaatttccactttggcagctgcgcaaatgcagctgccattgaacgagagttcgctgaggcatgtgtgccaataaaatgccaaaattaatttggcaaataatttttaaaattaaatttaattaaaaaaaaattcggcacttatttaaggcagttacaacaacaaacgctgtaccaagcacaacaattgcagctgcatgtgaggagattacaacatttttaaaaccggatttttaaagtcttttaattgattttttttccaatttggctttagactaaaatgccattctttttaaacccctccatttttattttatttaaaagcttttcctattttttctggccttgatctataatattataattaaagaaactaggcatgcttaattaaattctcggcatcagttttgctgatagagaaaagcttttatagagttttcattattgcacaatttttgctcgaatgattaagagaaaattggccaacaatggcatttcctcggggatttaaataaatggacaaaaaatggtattataaattgggatcaacaaatggcacatttcctgggtaaatttaaatttctgaattttccatgttcacatgcattattaataaggggacttaaacatagcgcaaattaatttatcccactaattgatttattttactattgtcaaaactaattagagtaaagccgtgaagtcccatacccagtgcttaatgagggatttagtccagaggagccctcttacgcgtccgtaattaggccccgcagggcttggaagggaagggatgttgatggatgcctgngggcgcctcccaggcggngatcgattggccattccactngaagactcccgactgatccgactgtcccctttggccggntatccgttgccttttaagcgcccctcgagatgngaggagccctatcggagagataaatgggggggnggggggggaa

SEQ ID NO: 18672 - DNA, 769 bp, Heterodera glycines
  misc_feature (346)..(346): n is a, c, g, or t
tttatattttgtgttaaatctataaaacggggatttgcatttcattttatttctttttaaaaaatgctctaaaaaacaattttttttttttgaacaccgtccctatgttggcatcgccgccgtgcgtccctttgtaaatgtttcttatgccaataaacaaaaaaaaaaaaaattgcatccaattttttccatacatcatcgaggggatatgtgacaagaactaagcccctggcaaaacgaactaacaataagcccctggcaaaacggtgagggggggggggggctaaatttgggagaagggattaaatgagggcgatgcccgggggggggcggacagaaaaaatgnaaatttatggttgggggacataagaaaatattccttgtgccttggtggtgtaaaatgggaaaaatcattaaaaattttaagcggatttttttttttgtacaggtacaactgcaacagcaggcgttgcatgaccaatggcgccgcgagcgtcgcgctcgccgcgacgctgagcgactgaaggagcagcagcagcgacaacagcagcagaacacgaagcggcgactgcttcaacaccaccagcaacagcataaaagccggcacaaagattgcaatgacaacgaactgctgaatgggcgcaatggcattggcatgggatcaattggagcagcagcagcagcaggtggttggggattagtgatgccgttgaaattagaaagaatttttcaacaaaaaaaatttaaatacttaacatttaaatgcggg

SEQ ID NO: 18673 - DNA, 1026 bp, Heterodera glycines
  misc_feature (44)..(44): n is a, c, g, or t
gtagtgacctccctcttaccccagtgattttttactgaagtatntaaaccaattcaatacctgcccaacggactactttttgccgcatcgcgggcggaagtgaactcgtaagtgcgacccggctcggacaacactttttggcctggcaaaaatttgagactcaatgggtttggcgtctcctcaatttgagaaaaaagtaaaaatgattttatttggaaaaattgcattacttgaacttggatgaacatgaagagacctagcatttgaaattagtataattgaatgtttttgaaaaatggcccaactccgtgtcctgctgatgcaacggtgtgcatttgcaaattgcttagtggacgaaggatattttcgcaaaatggaggcagtcacaaaatgtcgttggatttggagcaaagaggaggaacagcacagagacaaattggatagaacagcacgaaatttaaacattttattgaaaaatcagattttttaaatttttatctaaaattttgtaaaataattggaagagaaaataatatgtaaagaaaaggccgacaaaataccgataaaatttagtatggtagggtctggaaaccgtttttttttaatgtcaaagcgtcagatccggcgaatttttgaccgatttttgatttagcaaagaattcttgctttttcattttcttttgaaaaatatacttttggcataatgttgcaaatttttttccgtcaatttaacagtcgatttttaatgggtttgctgctaaaaaacatttcgtcattgatcgtttcgtcaccgttcagttcgtcactgttcatttcacgaatttgagtgttatcctttcgatggggattttctgctgctgctttctgtataaattccagcaaaaatgtgacgcaaattattgtcttgatcaacatagagggaattgcgctacgactttccctctaatgctattttctgacgcattttcataatcagcaacgaatgttaccatcgctgaaaactttaagcattccttttaacaaatt

SEQ ID NO: 18674 - DNA, 1198 bp, Heterodera glycines
ttttgtttttcaaaacaccttttttttcgcggcgcgctttttctaaagactttttggacaaaggggtcagcgctatacaccaggggtgggacaactctcgcctctcgtctctcgcctctcgccaactctcgtcatttttggtactctcgcctctcgtctctcgcctctcgttttttgggacgagaggtgagagttgaaaatacacccctaaagattgaacttttgagcagccagaaaaattttcaaatttacgcgaaaaaaaatcttaaatctctttctttccttccttaatgttttctctatttttggatagctccaattcaaatatggtctgctggctaaaccttctgcctttcattatttttctcttcggttcaattccccaacggtacagaattttttaaataatttctttaaataatttttcaattgaaattttaattaataaaaaatatttcaatttaaaaattattattttttcttttttttaaacagcctaaaactgcaaatttaaccaaaactttgatcattttttgacaagttctgttaatatattacactcaaaattttagaatttttccggcggcgcctatcggcaccgccggaccccgcaccccatgttccaaaaaagtttttttgaaaaagcagcgccacaaaaaaagcgacttaaaaacaaaaaatttaaaaaacaagttttggtcattttttgaataaaatctgttaacaaatccgaagacaattttcaaaattttttcggcggcgcctaccggcaccgcccgaccccaactgtccccgaaggtttaaaaaacgcaccgcaaaaaaaggtggaaaaaatggacaataataaagtttgtttctaaaataaatatatttcatgaaaatattttttaattttcatgaaaaaattttaaagatttttgtttggatttttcatgacttggactcggtttaaaaactaggactctgacccggttttctgtacccggcaataccctgacccggtatttgcccaaatacccaggcccgtacccctaatttaatatacgattttgaagttttttaaattaaaaaataaggctacagaaaaaaattgaaaaactctcgcctctcgtcctctcgccaactctcgtgtttttggggactctcgcctctcgccaaactctcgctctcgtcttttctgagacaagtcacacccctg

SEQ ID NO: 18675 - DNA, 1988 bp, Heterodera glycines
gaatgcacattgcgccattggagttacatccattggcacgctggtttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcgggcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgctgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgggctgctagcctccagactggggtttgctgtccttctgttcagtggcgaatggggcatttgcaggcggagtgcgctgagatgctcggagtagctgcgtgagctcggtcttgaggccagcctttcggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcgggctctcagttgtgcgttctcggtgtaaaagccggtcatctgttcgacccgtcttgaaacacggacccaaggagtttagcgtatgcgcaagtcattgggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgg

SEQ ID NO: 18676 - DNA, 1191 bp, Heterodera glycines
tccgtccccagtgccgccggcgaccgcgactttccgcctctcgacgtccgacggcgtcgtgcccgatcactcacggaaatgcatccgttggcacttattcgttcggctaaccctccgctggaggacgaccagcagcagcagctgatggccaacaacatcgtgcacagacggcgcagcacaccgaaccgatgcgaagcgttgcgcttccgttcgtcccgcgttcggccggcaattgacgaggaggaggaagggaatttcgagccaatcgaacaagatgaggccgacttggacgacgaattcggatcggacatgcacagcgacgacacggaaaacggtcaatcgtcgatggcaacggatgcggatgaattggacagtgaggtgggcacggagcaacgcatggagaccgacgggggcgaggacagcgacgacgaaatggccgaatttatggcagacaatggccaaatggaggccgaagaggaggaggaggaagaggacgagtggggcgaggacagcacggaggaggacctgttcatgttggccaaactccgtcagcaccccgaaattccgtttaaggtgggcagcgaatgacgaataattttcctatttgttggcagccattctctgtaaaacgccaggcccacagaaattttcgaaattttacgagtgattttttcattttttggggcaaatctttcgtcagatttcataaatttttccgtcctctcggtctattgacaaacattcatttgttttttcgcaccttttttgagtgaattatgaacccattcattgggtgattagtgagagacaacccttcccccccccattaattaatttgattatttaattgactgatgatgacccatgcatttctcccccccccccccccttcagcggtacggacacactgtggtggcgtaccatggcgcggcgtatttgtggggcggtcggaatgacaaattcggctgtaatcagacactccatcgctacgacccgggtaagaaagaagttgtttttttggtggatgaataatcaaatgcatttccttcctcccttttcggtgtaatttccgcaactttttccgtcccattcccccccttttctgattcatcccttttcgtttcgttttgattacacgttgattttgacgaccaaagatcagccgattggacattctttcgtttttttttg

SEQ ID NO: 18677 - DNA, 1655 bp, Heterodera glycines
tgacaaaattgcatttatttggacctcaaaacgttccaatggcatcgccccgaggtgaaagagccgacgacggcgccgtgcggacggcggtcactgacaatgtgtaaggagggcgaggagggcacggcggatgaaacgtgtggatttatttgtccatttagggacttatcgggatgcgatttacatttttggcggctaccaaagcattcgaaacgctcatttcaacgacttgtggcgcttcgaccccacaacgaatcgatgggccgaattgctgccctccgggcaaagtccgtgtgcctttgatcatttaaaatgcatttgtctcttttgaagtgccatcgcctcgtcgtcgtcagtgcactgtactggtcggtgaccgcgtgtttctgttcggtggcacaatgttcgtcccgtttcgctcgctttttctaccccatttccctttgccctcaggccaaacggcgagcggaaaagcggactgtccgaccttggcgatttgttcgttttggacttcgcgccgtcgttggccacgctgtgctgccaaactgtgctcaaatttgggctccaccggcatgccgccaatattttgcccacaattatcatgtgaatatttgtttctgaactgtttccccccccccccctccgactgttctttgatgggttaattctgacaaatgggcgtgaatttggggacgtacagtcccaggggacgaaaatgcaaaagggcaatcaaactactgtatgatataattctgtacaaacatttcaggaaggagttgcattatctgagcactcccaatcggatctccaaattgcacgtgccatcgtcggacaatatgacccacggctaatccccactcattcgtctctttgctttcgctcttacgcggctttcgacacattggaacggcatttgatcagtccgtccttctctccctctcttctcatctgatcagtgatcgcacttttctctctctctctctttccctttctttcttttcctctcctttttgccttctcttttgtccaaatccatttctttctcaaacatttgccctcctcctctttctcttctgtgtgctatttcctatgtgtgtttagacacttttaattctgtaaagtcaaattgtacttttaaatccggttcctttgccaattgtcttaataaaagtaagtaaatttattttacatatatccattgataaaaatttaattacactaattctttgggcaataaaaacatcaaaattaattattaataaattcattgggatatttcacttcaaatggcagtgatttgattgtcctcctccgtttaataataaatagccaatagtctgggtattattcaattcaattcattgcttttcattttgggatttttctgatttcaaaaccgtttctgtctgatatggctgctgcttttgctttgattttttgtcgttttaaaatgctttaaatgcgtcgaaccaatcgccgttgacaatgttaaacaatggcgggttctgattgacgagcaaaacaagaaaagtctgcaaatggaggaagaaatagtgctctattcattttccgcatattagccacttaatttggcctaatttgatcaccaacagctgatttggcattgtccgactagcaacgacttactcgggttt

SEQ ID NO: 18678 - DNA, 1575 bp, Heterodera glycines
  misc_feature (17)..(17): n is a, c, g, or t
cgaccctgggtaccccnttttttcattccaattatttttctgataactcgcgctgccagtgtccctgctcgaaatccgcccgaaataattgtccaatattttgtcaaaataaaaattattatgacgattaataagattagtggaataattattaataaaattgatagccattttaaataattcactgcgtcttgtgcctttttggaatatttttcattatgtcaatccaattacttgtttttcccaaaattacgctcaatgtctcatttgcttcttcattaattagtctaatgacttctgagacatttgtccaatgtacgacacgtaaagttgaggaaggcaaataggacgaaaagtttctaagttttttgtgagcttatctataatgtctttttcagtcgcgttaaaaatgttttcgttttgcatactttcacactcgattgttttacccagaatactcaattctcatactgtcgggaatcaacagcaaaaaaggcagggttacaaatccaagaatttgacgggggaaatccaaatttaactgcggcaaatgattcttttattcaaattttgggaaaggcacagggaaaaattcgcatttacgacaattcaactggaaaatttggagaatgaaaagtgtgtcttgatgagatttggacaaacattatatcagtaattgaagttgaaatgactaaatcaactaaagtaataatgggaaaaaccgagataatcgaaccatgaacggaaaacattattagcacatgtaaaggagcattttccaaaagaacaaaatttcttggtaaaaggatttagtcatcaatacccaagcataattattggtagaacattagtgatccctgggaacagtaataatgttacaatccaaattttgaatgctgggaatacaaatgtaaaaatttatgaaggatcacatattgctgacttggaacaaatttacataaatgcactgcctggagatgaaattcatccaaaagattacatgcctccggagacaaaatggcacgaaaatttgcctaaattaccaacacaaatcgtgaacccgccaccttcagaaaaaattaacctggaagggactagactaagtaaaaagggtcagaatgacttaaaaaagctcgcagataaatattccgaagcatttgtgggagaagatggtaaaatcggacgctacaaaggccaaattgtacatcgaatcgatttaatacccggatcattaccatttcatttccgaccgtaccgttatccgccggaaactcaaaaagaaattgaaaggcaaataaaactaatgcttgaccaaaacatcataagagagtcggaatccgagttctctagtccgatcgttatggtgccaaaggcagacaaaatatcgtggcgttttgcagttgattacagggctttaaataaaatgactaaaaaaagggtgttccatttaccaaatattcaagaattgttggatttaatgggtgcaaaaaagtactatacatgcatggatatgcaacagggattcatgcaaataccaatggcacccgaggacattgagaaaacggcatttatttc

SEQ ID NO: 18679 - DNA, 982 bp, Heterodera glycines
cagtgccttacgacaacggcacaaatgagcagcagcagcagcaaccaaacgacactaacatgcaacgcctaacaataacgggacggtccagcagccattgttttgagggagggaaggaggaggagcaccaatcggaggacaatgaaagtggccagatggatgagtcggaggtgacgcaggagcaaagcgacgacgaacgggatgaggagccggtggagttgggcacaacaacggcaaccagcaactggacgaatcgatgcctgcgtaggacgaagcggaggaaacggcggaaaacgacatggccaatcaacagcaacaaccgcacatagaggagcagcaatgccggtggaagtgcctgacgagccttgttatgagctgacatcgattctcgcggtgtacacggacggtaagggagatcgggcgtacttcgtcaagtggaagggtgacttttttttttgggggggggggattttctttgggtgagggggggggggcggctgagttgagcaaggggaaaaattttttgaaaaattgagtgcaatttgttaacagattttcaacaatgagaaaaaatttctgaatttaattaaatttttgaaaaattaaaaagttaataatccgtgtgtgtgtgtgtgtgtgtttaaagaccaagggatttgtccatgcgatgatattcgcatgttgtgtctcaaactcccctcctctcccgtatccacccgagctatggagcggctgagtttacttgcgacagccgtcgcatgcaggactaccctctccctggttagggtgggtattcatgggcccgtcccgtattcatcctaattggggagaggctgagttcacttgcgacggtgtcgcatgcaggactccccgctccctggttacggtgtaaaattttagcatataggaatttggagtgggtgctcggaacggatattttcggactggaaatggccgtggacgttaccggcacatcagcatc

SEQ ID NO: 18680 - DNA, 3065 bp, Heterodera glycines
  misc_feature (65)..(65): n is a, c, g, or t
taaggatggcaaagatttgtccaagatggcacaaaatcggcaaataaaatgtaaaaaaattcatntaaaatttattcaaattagcgaaattattattttttaagttatcaattccgactctgatagcagcagcagtgatgaagaagcatcttcattttcattatcatcatcagcaacaacaacaataacatcagccataaagtttaacaggcaaagattgtcgtcaattttacggaatgccaaaaagtttgaaatgccaaaaaatgcggcatttggcgcgggtcgcgtcgtgcattttgcggacagttgcggacaaccgttggcatcgtttcggctcattccgagctggcgagaggacagcatttcagtggaacaatgaaaaatatggacaaattggaggaaaatgagaaaaaaaaaaccaaaaatttttgagatcgaatttatttaatcctattgttttctttgtatgatttaatccaattttcgaatttatttaatccaatttttctttctttgtattatttaatccaattttctttgtcaattaaaatattttttcacagagttattaatggggatcggatttaactgcaattaaaaagagctaaatttcggtattcgtcaatgaaatattctttttttgagaagactcgcattttatggtggtgtatttttgaaaatattattttcttattatttttatgttttattgaaaaatttaagtgccaaaaaggataaacaccaaaatagggacgcccttattttaagagcgtaaagtccaaaataaaagactgaatttttaattaatatatccatgagattagaaagattttttgaataattggaatgattaaatataatttataattaggaactttatgtttttatgataggatttgcattatttgttcttgaaggtcccttggtaaaaaatgtcaaaaaaattggccaaatcttgaaagtggataaataatggtttcctttatttcttcattaaaaatttaatttttgttttttggcatttcggctgatgcctttatccatctacaaaattcagaaggagtttgattttactgtccatgcacccgcctctcattgtataaaatgacgataattaaataaatgttttaattaattttgtcactctttatcagggcgcgtatcgaaaatttttcaagataagaacatcaaggccaaaaaataagattttagggtaaaaaataaggacattttgcaaaattgcttcaaatcagttatttttacaatttattcgatcaataatgtatcaaatattatatttttcacctcccatgatcatttttaacaattttggtgaggaaatgagcaaatcatacatttcggggcaagtgagatcgtaattcaatttgatttgtgccagacttttcacggtttcgattttcaatgaattgcgtacatcagtccattgcgctgaacaaagagagaaaacgcgctccacacatgcattggacacgggaattgaaagaattttgctgacaagcaaaagaagattgggcaatttcgcctcaaaaagcttcatccacttctgttcagcgttcatttctctaaatttctcatcagaaattttttcaagcgtctcattcagtgccgtaatttcgtcaaaaagttcattgtcgttcaattccggcgcaatttgctcagccaagctcattacttcggcgcgagaaacttttttttctttgagagaaacccatgccaaatccgttggaaagcgctcaacccggaaccatttatcgacatatgaaaaagtttggtggttttatggtttgatgagtcaatagaaattgaaaagggaagtccggtcatttcctgcaatgcaatggatactgaatgcggagcgactattcctaaatccttatcaatttatatttaaatttataggaaaaacaaccagtagtaattgctgcacatttcttctcttttgatccgtaatttgccgcaatttttgaatcaggaaaaatttttgacaacaaatctgagacacaatcggccgatttaaagctttgcgcatggcgcgcggtgtgatatgcccaagcgcctaaacaaataaagtttatttctgatttaatttgtaattcaaccttccactgctgctgtttgacggtccaaattcgttcgtgccgatttgcttggcatgaatgccgtgattgccaaagcggaatttgcagctttcgctgcttttttgtgtttttccgtctttagatggtgaggaatggccgctttgccaatagacaacaatgaaatgtcaaaattgcatgggatacaatgcgcgaattcatctcctgttttgctttttgtgataccctgaaattcattggcatattcacttttaaaaacatttttgcgcttaggcggtgccatttgttagtattagtgcagctgctaaattaaaaacaaaagagaaaaacaacaaatacaaaaataattagacaaaattaacagcaaaaaggaaattataatgcaaaatttaaaaatatttttcttaaacagtacgccaatcagaatttataaagaaaattgacagatttttcggacaagcgacaaataagaacaaaataagaacaatagccctaaataaggacaaatcttacaaataaggacatttttattttgtaagatttggaccctccaaataaggacaaatcttataaataaggacagatacgcgccctgcaataaacccaaaaatcaagtggcatggctatttcctgctatatgaaaattttaacgttttctggatttattaatagctcatgccacttgtgctttgggtttggaccatcacaagatcggtaatttcttgtgcgaatgatcgaatatcattcgttctcatcgctgcatcgtagttgttgcgccatctggcgcgcataagaaccggagcgtgcccggcccttcccaaaatcaaattgaggaggagccgggcggtactcccgttcccgtcaaggaacgggtgtattcgcacctgaaaattcatgattcaaaaacacagccagggagtttttggggtacactatgaataacaaatc

SEQ ID NO: 18681 - DNA, 2781 bp, Heterodera glycines
aataccaaacatgtgcaagcacagcttgttaaccaattaatcccagagactactaaaaagacaacgataacaacaacaactaccaccacaattaccgaaccaccaaaagacacaattgatgattttattgggcaaattgaagaaccaacgaaaagaaacaatgcagagcagttgcttgctgtcttgtttggaaacgatgaatggaaaaaagttaacttgagaattcttaggcaaatcattgaaggagttgagttacagtatcatcccaattttgaacgatttaaagcggtttttacacatccgaaaattgaatatatctcattttcgcctcagctcggctatgtgttgggttttgaaaattctcaatatgtaagaaataatgaaatagccaaatacggaagtgccgtggtggattcgcaagctttgccgtttacgcaaaaggtctaaccgagaatatgattgttggaaattcattgagctcactccttcgtgttgtctctgtgtcgggggcggtaccaggcgaatatacggaaaaaatttacgactcaccgctctatgcacgtgttctaccaaaagaagtatcagaaattgaaattgagttacggacgatgacagacggacgactggtaccattttcctatggtacagtgctggtcgtactgatatttaagaaggtgataaatttttgaaatcactcattattgtttttattatcacactcaattgataaaatggtacatactctttatgacacttcggtttcgggctatgatgcattttttgtgcaaaatggttgtggagtcggggatgactcctcctaccaagtttttcgaggagcgccaccgtttcagcgcggatggggcccagcacagacgggtgcggggctaggtgatatttttcgtggactctggcgatttttcctgccactaattcgcagagcttgagattctgttgcagatgaaacaattcagactggaaaacgctttataaatagggtaatcgatgaaaaacccggtttgaagggaacgatagagacgttggcaactgagagtaaacgtggagcggataatgttttagagaagggcggatttcggcgtcaatttggcacaggagggcgaagaaagcgtataaaagctaacaattcctccattctatcacatcaaacgataattggaaaaacaataacaaaaccgttaattcaaagcaaaaagaggcttcgatcagacgcgttcgggctttattaaaaaatgacctttcacaaaattgacgcgagtagcatcgattcgattaccaatgccgttgattttttcagtatacccccgacaaatgttaccgtatcatcgtcaaaggttttcgagattttgccgagtaatccactcaccgacactccttatcattttaaaatacactcgagccaaaattacattgacctgtcaaagtgttaccttttgaccgaatttcgaatacgaaaattgacaccaccaaatggtgaatggggacatttggatgcttcagatcaggttgtaccgatacaattgatcgggcacaccttcatgcgggacttgaaaattgcaataaacggtcgtgaaattttcaattctaattcactgatggcatacaaaacttatctttctcatgaactttcgcaatcacttgaagctaaagtttcgcatttaactgctgctggatacgaccgtgaagatgctagtaatctacaaaacgcaaattccgaagggttcaaaagtagaagacaacggtatttgggaggtcgaacagcacaatacattgcaaaaattgatgccgatcttttcaatgtaccccaatatttgattaatcattgtgaaattgacataacgatacaaccccatgacgacaattttttgttaattgacaccttagacccacccggtcagccatatagtattgagcttgttggattgaaactctactgcaaaaaagtcagtcttatggatggcttggctcttgagttggcgaaaaaattggaaatgaaaccagcacggtatgctgtacggaagacaatgatgaaagcactgttcataagcccgggacgctatgaatttaatgcaaacttgttcatggaccaagttccacgccgcgtaacaatgggacttgtcgcaaattcagattatgtggggaacaccaaaaggagcccgttcaactttcaacactttaatgtacgggagttgagtgttgtggccaatggtcgctcttatccccaggccccgtatgacattgactatgaaaattggaaatttgttcgtccctacaatgacatgcaggaggcgcttggttttgccaactctacatatggaaatggaattgattatttttcatttttgcacactcactgtatttatgtgtttaatatgacaaacagcggagacgatcatggcggtttattcgatctgatcaaaaagggatgtacagctgtaaacataaaattcaaaaaaccagtacccgatggtggaattacgctaattgtgatgggtgaagcggactctatttactttttggataaaaacagaacgattgcaaccgatacaaccatttgaatcatttttaaaatgttgaaaattttattggcttccctatttttccagtcaattgttgcacttgttgtagaagaaggaataaatactgaggaaattccccaatataaagagtggaaaagattgttgggttttaaaaatgcttcagaaactaaaaatattacaacaacaaaaataaacatatcaactcataaataggaaaattttcaac

SEQ ID NO: 18682 - DNA, 1043 bp, Heterodera glycines
tccattttattaacccccccccccccaaaaaaaaggggagacagacttttttggtgtgtaaaaatttttaaataatgcctaggcatgaaaacctgtttctgtgattttatggtcccggacatgaaccttaaatttttttcgatcaattgcgatttcctacctaaatttaaaaaaaaacattcagtaaatagagaaaattcggcttttattcgagtttgagaaaatggtgtaaataggtgtcacagatttgtggtcagggaccaaaaaatcaaccgagaacaagtttttacgagttataatcataaaaatttgagtccaccctttgggttttttaataaaattcaaaatgggccatttttaaagtagcgcctaacaataaaacgcatcacttttttgacagctttgtcgctgtgaaagccgacttgtcccgtcaccatatcgcccgtctttttcaagttgccccacattgtgtacacaacatcggtgaaagccaatttgcagccctcaaaattttttaattcgtaaaatttttttcaaaaaacacaaaattttcatatgaaaattaatttgttaaaaaaatcacacttcaatcgaattagctttgacgagttggcaacagtcctggagaagcctgaaataagaccacacacacattcgattattttgagattttcgatttgaaaaaaaaaacttaattttctggaatttcttcgacgccttggcctggggacaaccttaaaatgaaggggaaataagtttcacagatttggtagaaataataaacgacgaaccaggccagcaaattgcacaaaactcaccttaaataaacatgggcagaggacaactgaaaaaaaagttgaattaaaatgaagaaataaaaatgaacagagaaaaggcactttgtcgacatgaaaccacacatcctcgggccaaccccaccctgaaaataacacaattaacaaaacgcaacttgggtggggcctaattccatttccgtaattcagtgatctgatgtcaaatttttgattttatgtttttttttt

SEQ ID NO: 18683 - DNA, 1319 bp, Heterodera glycines
tatcaaagaatttacaaacggcagccaaaaacaaattcaaatcaatcaatttttttcgttgccatttctttgatcacttccattatcttctgacgcggctgattctcaaccgaaacgcttgtctcaactccatgctcatatctagaaaaaaataaataaaacaattcaacaattcagaattgggtaatttagatggttggtacccctttttacgggaaaaaaaattcaaaattttaaagtcacaaaaatgcatttcttgtaattttcgagttaggtagattatttttgtgaaaaatagtgtggattaagggtgaaaactcaacgcgtacgagtcgatcagcaaaaaaaaatttttttttagcaaaattctattcttacagttactagagttcgattggaaaaaatatttgataaacacaccgcatgaaaaaggaggtaaaacgctcgctaaattttaagcctttttgggaccctttggtatttttatcgggccacctacaaactgaaaagtgacgccttttggaaaaaaattaccaaaaacttacaaaataaacaaaacacaacaccgaccttgcccaaattcgtggcgtaattccggagcattctcttacaagaatggggaaatcccgattgttctgcttcaggtccacataatctttctggatgaattcccgaactccattgcttgctgcggttgtctggcaaagatgaattcggagttctcgcaaagcaccgccagcgagtcgaattgaagaagccattatttatttgcacgcttggttgaataaatggattaaagctaaaaaagaaagtgaaaagataaaaaactggcaaaacaaattaattaattgtttaaaaaagcattcaatttaatcattttgatagtttaaaaatggaaaaaaacattggattaatgtggacctgaaccatggaccttcatggaccttagcaaagaccaggaaaatccacgcaaaaaaattccaggcatatggatccatggtgtaggtcgaaaattttttttgtaaatctaaaaaaattgaattttgaaaacaatatgccaatttatttctaaatcaattttttttttgataccgtctgcaaaaacaaaacgattttcattttttgtgatccagtaaaactagtgccaaaaaatcgaaaattcttattgttagagatttttggggtgagctctatcggaactatagataataaatttattaagatattgagaaacggattcggaattgattcaaatagatgtcagattgtgatcagcgatcctggaaaattgaacgatttccattccttttatgacaaaa

SEQ ID NO: 18684 - DNA, 3408 bp, Heterodera glycines
  misc_feature (1560)..(1560): n is a, c, g, or t
  misc_feature (1629)..(1629): n is a, c, g, or t
aagcccattaaatgaagggaattttgttttcactgcttttttgtttgagttacagaagtgggcgggtttctatgccactaaatctttagaaatataaatttaatagaaatcattagatgaattcatgtgacaaatgttatatttgtgatcaatgtcttcaaaaagtgacaaatgatcattcctgatcagggacgggcgaatcggcttagcactcgtagccgaaggcgaaattcgaagcctagaaaatccgaagttttcgaagccgaagtttcgcccgtccctgtttttgatcatcaccatgaaaaagtctcagatgctgaatgattgtcaaatagtcaactttgaatttgtgattgatttaaaaaatttcatcaaatccctttgagcaagtgtcctttgtccaaggacaccgtaacttagctttaaagggcaacggccgcttaaggccggccaattacgagcccattgaacaatagttccgtactgtgttctcagagtggatgaccaccgaaattgcttttcaagcccaattccaatggcacggcatacctctttccatttgatgacacgtggcagcaaaagtttgtgcagcagcgaacaggacgagagcgcattcggggcggcattttcggcagggatgaaaggcacaatttcgtacagaagttcgagcggaaggcatttgttggcgaatgtcggcatcaggggacagtttgttatttggggtaattagtgagcaattagctgattagcattgaacgaaaacgccgctgcgcaccggcactttgaaacttggtttggctcgtcccccggcagtgtaacaacagcaaatggccgttttctcctctcctttgtcgtgttgtctgcctttttccttttgctctgtcgctctctcctctccctctccctttctctctctctcttctctccatctcactcattattttctctattcattgcgttctcaacgcttttcgtcgtccccggaggggtattgtgctgtgtctgccgacactgtctcgcttttccctgtgcacactccttgcctttgcttctctattcttttccttgttcagcacttgtaacggcactctctgtgttctctctctctctctctctcctctctctcttctctctctctcttttcgctcactctcacccctttctctctctctcttttcgctcactctcacctccttctcgcactcttacccattttctctctctctctctctcctctctctctcccttttacttctaataatttttgtttgaattttccatgttatgcctcggtttttcaaaagatttttattgtgtatatttgaacattagtgaatgctttgtcatttattaatgtgtttcagcaggactcgtagcggaggaggaaaaatgaaccggtcattttgcaattgtacaaacggcattttgggagggaatttacaatgtcaaaatggcatttcatccatatcattagcgtacaatataattttggtcgccattttcatatttgtacactccgccgatggacaattaatcctccccattttgctcactgatcanctgctgctgcagatcaattagcgcaaacaataatattaattatatttataaatttaattcaacttcttncgctgattagtttctaacaataagcactttcacattcactaattatgtgcatttttacatagaaaaccttttttaccttttatatttttaacttttcatttttctaaaatttcaataatattgaaaaatttgattgaaaattttctgggaatttaattaaaaaaagaggaggatcctataaattttatcaattctcatctttatttcgggttggcaactcttatgcagtttaatcctcccccagaaatttgttgcccaaatttttcgtttgatttaaatccataatgcccatgttttcagtcgccgatcatgaatccatcatccacttaggtctatttcgaacctgggacccgaattcggacaaaaattcagatttttaaacccaattcatggtaactgtgctgtgtatttctaggccgaaaccaaaagcaccaacataatttttttataggtaagggtttggaacttaagttgtgaaagccattaaaaaagtgaattgataatgattaaaaagtcacgaaaaagtcaaataggcatattagaaagttcaaaccaagggcgtagccactagagaatggcaaatcaacctttttattagtttttgcggggtatcaatttaaatgttgatatttaattaaatcaactaacattatgccatcaacgcaaatatcaacgtaatttttaaaatttgcgaaaatttttaagaaattgttaatttatttaaaaaatccagaattacctatatcactcagaaaattctaagatcccccccccccccccgaaataaaaatttttaaaaattttcctacgaataatggaaaaattcacccaaaagaaaattaaaaaattttaatggtacatttaggtatataggaaaattttcgtaacaaagtgcactcaaatttttaagtttttttcaaaaaaattttctcttgggaaaattcccggttggtcccggtcccggcttttctcgcggtcccggtcccggacgaaaatcgaggtcccggtcccgacttttctggtcccggtaagtcccggtggtcccgaccagctctattaaaagtagagaccggtaaaaaaaaatttccgggagcgggagttcaaaatcttccgggacgggagtcccaaacgggaatccccttaaaatcccgctcccgttaaaatcccgtcaactgcgtcttagtagttaaagggtcaactgcgtctcagttaaaaaaccaattacctaatacccaaaaatctataaaattcgataaataacacttatttgtttgccttagcctgctcattgttttattgtttagtgtcccaaatggatattaggatttttcattttctcatagtaccttctttagacttagtgctttcgaatgataccaaagaaaatttttaaaaaattaagcataagcttaggcctaagccagtgtttcgaagtgtcattatttttcagattgtccaggtttttgaggtctccgataaaagtattcaataaaacttccaaaaaattttacggtggcacctatcggcaccgcggctacccgacatttggggacacgacttttggggacccgacttttggggactaactttggagacccgacacttaaggaacccgacttttggggatcccgacatttggggacccgacatttggggacccgacttttggggatcccgacatttggggacccgacatttggggacccgacatttggggacccgacatttggggacccgacttttgggaatcccgacatttggagacccgacacttaggga

SEQ ID NO: 18685 - DNA, 1013 bp, Heterodera glycines
caaaagctgaagcgcattgaatacattgacgtggcggtacctttttttaaataaaaaaatattcattttgaattttaaccaccaaatccgtcccccatttaataaaggaacagtcgctgatcgccttggaagtgatgtcgcgtcgcaatgccaaaaacattctgttgtccggcggcatcgcgtcgaccatttcgcacgtcgacttcttttcattgccttctcaacgtttggcttttgccatcgccgcgaattgcgccattcacgtgacccaaactgaatttcaactagtcaaagattgtaagttcctaataaaatttttatttttatttgtgtttaaatgcttttttcacaggccttctcgacctcacccaacggcttgtgtatgtcgacgacaagcggtgcctggaatcgatctgcatactcttcaaccgggtcatcgaaaacatgcgccaacacccggacaaactccgccaagttgtgggcgccagctttgaattcctcaacaatgtccaaaagctagagtcgttcattttcaatgtgtataccaggggtgggacaactctcgccaactctcgccatttttggtactctcgcctctcgtctctcgcctctcgttttttgggacgagaggcgagagttgaaaatacacccctaaagattgaacttttgagcagccagaaaaattttcaaatttacgcgaaaaaaaaatcttaaatctctttctttccttccttaatgttttctctatttttggatagctccaattcaaatatggtctgctggctaaaccttctgcctttcattatttttctcttgggttcaattccccaacggtacagaatttttttaataatttctttaaattattttcaattgaaattttaattaataaaaaatatttcaatttaaaaattatttttttttctttttttaaacagcctaaaactgcaaatttaaccaaaactttgatcattttttgacaagttctgttaatatattacactcaaaatttt

SEQ ID NO: 18686 - DNA, 1841 bp, Heterodera glycines
tgatttgctcacagatttcccaagcaaattttgactacgaatctgcgtcagtgaatgcattttgcgatgtttttccaactgtcaaaccaaaaatgtgcgcgtttcaggtgaagcaagcgataaatcgccgaattcaatcaatgggatttatgcaattgtacagctcaaaagaaccaaatggacttgagtttcagcgccttgttcgcaaaattggggctctacaattctgtcctcccaactatttagcccgttcgcttcaactcatgcgccacctcatcactagggcgtgtaattatatggatataaaatctcgaaatatggccataaaatatggaccaaaaatcgcaaaatatggacataaaatggcaaaaatcgcgaaatatggacataaatggcaaaaatgtcaaaatatggacataaatttttcaaaattgaatgtaaaatttcttcaaatttattggttgaaattgcatatgagatacatttccaaattttttgactcggtaaggcgctttgacaaagacggctttcgttttgcaattagtcggtcaacattcggaaattagtctcgaattttttcggcaattacgtgcaatcattttaaaagaaaaaaaacataaaagctaaaatttattaatttttttagcgcaaaatcaacaacaaaagcgaaattttcgcttttttgcttatttttgatataatttattaatttttaagaaaatttaaatttattcaatattctcgagaaattttggcgaaaaaatgattttttgaaaaatttttcgggttttgggctcaaaaaggctaatttagctctgctgggggccgttctaatagaggttttttttgaaaaatgacaaaatatggacataaaatatggacaaaatgccaaaatatggaaaatatggatatagaaatccttcctagaagcttcaaaccaagctaaaaacatgtttttcgtgcgtttcaggcctccaataatccaggaaaaaaatatggatttccatataattacacgccctactcatcacacactccccattgaaaatttttcaccaagaatcacatttattgtcccaaacttattcaaatgaacggaatataatagaaaataaagattcaaggccatttagtgcatttgaatcgttttggataatacatgtgaattttggtgaaaaattaatttccgacttgtgttcgaattcgggttcgggattcgaaataggtcaaaattgatatcatattcgtgatcagcgcccccgaaaacccccgagtattactccgaaatgcataaaaacaactttttaatctctttttttatgggaccaataaaatacaggattaccaaaaagtcatacatgaaaattgcaaaaagtcgaaatttttgaaatttgaagaagatttaacataggacaaaaaaactaaacatagaaaagtaaattcaatttttcaatattaggtaagtagataaagaaatagtacgccaaaaagagagatgctttaaaaataataacataatggccatagttaaataaaaaaataatttccaaatttacgctttcactagaaataaaaaggaaaaattgtgtatattaagaggaagtttttatgaatcctttcattcgcatttttaatctgttcttatttcattttttatgcgttcatcacatccttagtttcttaagccataacttttttcttactcaagacatacattcttggtattaatcgaaagttccgaccagtttcgaacccaggaacccaaattcgaacaaaaagtcgaaaatccaaattttcaacttttcgaccgaattcggatccggggttcgaaagtagacaaa

SEQ ID NO: 18687 - DNA, 2613 bp, Heterodera glycines
  misc_feature (415)..(415): n is a, c, g, or t
ttcttggattttcaaagaaaaatatataaaaatttgaagtgattttttttctccaatagcccgagatttcgcattacaaaccccatcagtattccagtctaattttaacggcatttacggtgccagaaattttcggcaaccaaaaaatttcgggccacaaccataattcatcagtgataatttgaaggcggcaacacagttattattatttataacaatattatttaggaggaggcgattgttggcaccgcaggtcgagtccatcataagcccctcaaccaattaattgtctattactgtcggtgtccccacaaaaaatattttattttttcctttgtttttgccgatagaaaatggcaccagcggcgccgcatttttaatatttatttcaacgacacccctttcggtcgaccgnggagatcaatccccccccccttcagaggatatataatgatggagtgaaagaagatttgctcgaaaaaatcggttccccccccccccgcccgccgaggcccgaagagtgactaccggcagggtcgagaatagacgagagtgggccggccggtagcggcggcgccaacaaccacccatattaaaagcttcctcgccgtaggatcgtacccccccccccaatatccaccaaaatccttttccccgtgaggggggcaggtgtgatgcatttggatggaataaattttagccctcccctccttctcggggcgggatgagcaaatattatcatctttgtggcgctagtggacgctcccatcaattacaatcctttccctccgctggtgctggcgcttccgctctccccccccccccccctctttttcaggatgggatttatactgtaagcagtggcccacccctccctatcgccaaaatatattttcgcgacttaataattgtaaaaaaaatagttcattatttgtggtggcagcagtttttggccaaggttttaagtatcaaacggtttagccaatgccgtcggctggttttgggtggaaaaatttaaggcgccctcgccggtcacataccgtattacgtctaattatcccccgtctccaattatccccccccccctttctgagaaggttgaacaataattccccgggggataattagagataatagggtatctgtataattttttggcctcaattatgggccacccagccaaaatattttgaatgcaattaggctgcttctgtctattcgacctttgccagtattatattattgttcattttcttgcaatttaaagtttttttggaacgaaatattacaatttctcatatttaatttatgcttaaagcgggcgccggacttttcgacagtggatttttcgacagaggacttttcgacagcaaaggacatttcgacagaaatattataaaattcaggaggggacttttcgacagtagatttttcgacagtaaaaagtaattaaatttcacatttagttgtgtaaaagcgtaaaattttttccaaaaatcaacaattaagccaaaccagtattgagatacataatatttaaactcaaaattaacaaaaaaataaataaataatttttggtgatgatttttagaaaattttttaattcttattgatgtatttttgaaaattttaaggatcgattcttaggggtttaatttttgtttttattacatttttattcataaattttgagcaaaacacaaaaaaggtcaaaataggttttgttaaacttcttagggttcaaagaaaataaaaacgataaaataagtgctaataactcgaagagttgcttaacaatcaccaaaaaacatattttccatgctttagggccactggaagttcaggaaaaataagtaaaatctaaaaaacttatttctatgtagtaatattatttagcaatacacattaatatgttaattaaaaagaaatttagtaaaactgacaaacaataacttgtttttatgattactgtcgaaaagtccattatttttaatttttctgtcgaaaaatccttcactgtcgaaatgtcctttgctgtcgaaaagtccgggagccaaaatgattattatttttcattttttaattcacttcttccttattataatcttaaaattttttttctgtactttttttaatgaatttaaggctttctgtattgcttcagacggtaaatcatttatttaccattttaatttttcattttctctattaataaaactcacatttttttaatttataaaataatatttgaatttccatttcattgtcctatcggttcggatcattagtcaaaaaccatcaaaataaaaaatttttgacagaaaattattaacaacttcgcccaaaatgaaccaaattgaaaatatgatattattcggtagccctaagtgtttccattatactgcaaaatttcaaaaagttttgttaagtttcaaaaaagttattaccaaaaatgttcaagaaaacttgcttttttgagtttctcaggtcttaacttttttgaaacttaatgaaacattttgaaattttgcacgataatagaaaacttagggctaccgaataatatcatgattttaaaattggttcattttgggcgaggttatgaataatttt

SEQ ID NO: 18688 - DNA, 1832 bp, Heterodera glycines
  misc_feature (27)..(27): n is a, c, g, or t
  misc_feature (105)..(105): n is a, c, g, or t
  misc_feature (118)..(118): n is a, c, g, or t
tttatcattttaaagaaaatctgtaancaagttaagcatgtatccctaattaattttgcctttattcaagtcccggcaattcccggtcccagactttgatcattntaatcccccaccncacgcaaaaaataataataataaaaaaacatctggcaaatgccagcaacgactaattatggaatattaaatatgccaatccataggatgcggaaggcaattttcattttctaaccattttgtaaagcgccgtggccgcaggcaatatgcaaaggcgtaacgccacgaccaatgccatcggtttggttggcattggccccgttctccaccaacaatttgcacaactcaaatctgtcgtcactgccggcacagaagtgaagcgcgaaatgcctgcaatggctttgacttcccaaattgaatgaaaatttaaaaaaatgcttgggatttcaaaattaaattttccaacgtaataaaatttttcaaaaattccagctgctgattgtgagcagaaaataaattggagcgtttaaaataaagcatgataaactgcttaaacactagagatcttacaagtgattgaatcgatcggtaaatattaaaaaataaaaaaccgaaacattttactcggttgatatttcgttaaaatgtcgaaaaatacccctaaagatatcatcgttttcgtcccgaaatcactactttgtactcctcaccatctttgttggtccgatcaactcgcgcccctttcgagacaaaataacgaacaatttgagtgtcctggttcatgacggccaacataaacggactatagccatcattgttttcggcattgatgtccgcctccatttgcgcgttctccaccacaaatttgactaaatttgaacctaattaattgttgttgaaaagagtacaaattgcttgaggatgataaaagaacatttatttatatctgttatgcttttaacaaaaattttttgtcggcaccgcaaatgccaacttattctcttaactaaatatttttaaattagctactttaaaaaaattgcagtcttactcatttccagacggctttcttcggagacatttgtaccatccccctaaaattgttttttctgtgaaaaagttaatgaggaattcaaaatattttcattaatttctttgaaaaaaaacactagataattttttttggtaattttcttcataaaatttaattcttaatatgttttccaaaaatagcgaattatggaattcaaaaatatagacaatcaattcataaacctggtttgtattttgggcattagcacaagattgtgatgcacccattgatgaaagtcttaaaattgatcaattcctaaaagaatccaagaatgtaataaaaaaaaacaaaatgtggattaaatacagaaatttttttaaaacacagattgtgcaatgtaaatcggcagattcatttcgaaaatgttgaatcaaaaatatgaatgcaaaaagtttaagaaaactgaaaggtgaaaatccaatgtaaaataaaaaaacgaaaaattattttcttctctcaaataggtatgtaaatgaataaaagatggtttgttgtgattaaatctttcccaacgattaggcaaaatatttctacaaaatgatgaatgaataaaagaaaaaatctccataatgaataataaaaaaatgggtgctgtgcaatcagcaatcgtccccactggaatggattacaaaaccgagctttgacagggtgaaaagaaaatacttaaaaaagaataaattaattaaaaactaattaagagttgaacagtttcgcatctcttcactcattagcgatcaaaaat

SEQ ID NO: 18689 - DNA, 1617 bp, Heterodera glycines
  misc_feature (1499)..(1499): n is a, c, g, or t
  misc_feature (1554)..(1554): n is a, c, g, or t
tttcatggccgggtgaaccagtggtctgctccttctcagataccagacgaaggagatgaggagatgcaccgacatgaccactgtaaccttgagataaaattgcacttttatctaaggtagatggtcctggacccctgcccctgtaccgcaggaggggggacacttccccttcatgacatatacttggacaggggcaggggtcctgggacccctgcccctgtaccgcaggagggggacacttccccttcatgacatatacttggacagggacagaggtcctggacccctgaccctgaactaaatggatgaaggccttgcgaaatttatataaatagagcaaaaaaattaaaggataaaaaaaagatgtttaacgctccatttactctaattctttctggggccacaggcagtggcaaaacacaatggcttatgaggttgttgagacactatccggaaatgatcgaaccgcctcctaaaaaaatactctattgctattccgaaatgaatcagtcggttgttgatctgatgaaaatgggaatagaaacacataatggggtacctgatcagacactcattcaacatcaaccaagaccacttttgctcatcctggacgatctaatgttgaacatgaagaacgattttcttgatttactattcacccgagggtcccataattggaatgtaagtgttattttcgtcacccaaagtctgtacggaagggacattcgaaccgctagggcaaacagccattatctggtgctgacccggaacccttcaggacagctgcaggtaagaactgttggttcacaactttttcctaaacgggtaaattatttcatggaggcttataatgatgcaacaagtcagccattcagttatttggtgataaacatgcacccaaatgcgcaggaaacggaccgtttgacttcaaaaattttccctgacgagcaacgccaaatctacctccccattgattaattttcatgagtagtgtctctatataaaggtgtaattcgcacaaatttggcaaaatgtgttaccaattcaccccatacataagtgaaaattccgagttttttaaacgtttggcctccacaaagtcagatcagcgtaagaacaagctgctcagagaggcgagtgcagaacagatactcggattagttgaaatttgcgcgaacattttgaaatttaattttcgcctaaatacgcgtcaacggcgacgcttaattcaatacgcggactactacagggcaattgctcgttcacgaagtgagagcacggcaagaaagagacttcaagagggaaccggtgttgctctaggcgcaattattgcaccaataatcagtgtgcttgctcaacatttgctggagaaggcagcaacaacaacaactgctgtagcgtcatgaagtacacaaaaaagatgataatggttcccgagagtgaatatctcactttgataaatctgctgaagaggggaacacaacttctggcccctatgnaagtgagagagctgaactggacacagacatccaaaaaaattttgggcgatcatanaacgcgagcagatgtgcaaatgaagcgccattcctggctgtataagcaaagacggcagctaaa

SEQ ID NO: 18690 - DNA, 1741 bp, Heterodera glycines
cagttgcagctttattttttcattgctttcttaattgttttatttaagcatttgttttatgaattattttaatgtaattattcctaaattcggcatttgtgtgccatttcatttggtaccgaccggccacagggataaaactgggagtcggaaaacccgacccaagcggaaatccgacataaaattttttaaataattttttacagttattttagttgaaattcaattagaaatctttaattttaaatgagttaatccttaattttaagttgaaagaaaaggataaatttgttattccattcgataggatactgcccgtaatactgatcaatttgtctgatcagcttcgaatttgcatttaaatttggtgattgtattccggtctctatttcctagatcttcgatacttcgggatctcaaatgattacaaatcttttcaattatggtttaataaaaccaaccagccgctaaattagtttcagtgtcttcaatttcattaataattgttcggcatgtttctttccattcatccaaagaatggagcgttgcaaacacagcaaaatgagttccgataaaagcaagcagaaaaggagtaaaaattttcatttttttctaaaaaaattattaatttgatttaattaaagattttttttttattatttaaaaaatgaaaattgccgtatttaataagaaatagacactcatttattataatttgcttatgtaaatacaaatcaaatggcgtcttttggtgacgcacgaatatgtggcagttcgaccaataatttattaattgtttgcagtgaatgccatcctactaatgaaaaaatgacaattaattttatattactagggctgaaaacttagtgatttaattttttgcagctttgtttcaacgaaatatgcacgagagcaccttttttgcgtgaaaattcataagttaaacgtcattacaaaaaaaaaaatttgcctttactattttggcattgctacctttttaccactgttttacttccttttaatccaaaacaaaaattgcaataaattgtgcactatagtcgacaccccacccccccccccaaaaaaaatgccgaacaatcggaaagaacaattttatcagcaaaattacgcaaaaaagacggagcaaataaataatggggcgatttgttggaaaagtgtaaggcaacgaacgcccttttttgcacccctcacattaacaaatttaaacgccaaattcaatttatcagaagggctgtaaatttcatgtaaatatttattattattattttcctggattctctatgctccgaatagtaggaaaaacactttctttttggactttttctcacttttttcgttcataatttctaaaattctttttttgggattttatgtgtttctgccacgcgaccaaaagcatggcaaaaatgtattgatataaatctataataaaattatatctattgttgtaatatgcttaaatatattattatggacggggtttattttttacatttttttgcaggtaatttttcatgagagaagcaccaaaactttttctcaacacataatatgtaaatgtttttccttttttaaaccattttttaggattacaggaacatctcctaaatgaatccaaatttaaacttaattaaaaaaaataatccccccccaagcttttttgctaattttttttaaaaacaaatcaaaaaaaatttttttttttccccaattttaaaaa

SEQ ID NO: 18691 - DNA, 753 bp, Heterodera glycines
cctgcaaatttccaaaaaaaattcgtcaattttgaacaaatttatgaccaaaaagttggaaaatatggttttttgagttcttcaggtcataatttttttgaacctttacaaaatttttcaaaactaatagagcatctgaagggctttcgaatgataccaacaatgtttgatttggatgacaaagtaaaaagttataagcgaaaacccgctggggccgaactgacgtgctggggccgaactgacgggttccggatgttctatttcatgaaaaaaaaaaaatttttttggcataacatttttttgccaaatttgaatttatgtttgcaaattttttgctcaaaatctgtaaacaaatctccattaaaagccaaaattttactggcgtcgcctgcagtcagctatattttgttgaaaaaatggtgtgaaactcagaaaaaggatcggctcgtctgtacttttaaaacagttttggctgctacgaaccctggtttttcgtattttgtcttcattttttaatacataaatattaatttgttttttattttcatcaataagcatgcaatcacaagataaattagttatgccgttgaccacactttctggccacccggtgcgcatcatttacggcaccgcatggaagaaggagcgcaccgcggagttggtacgcagcgcaataaaagccggcttccgtgccattgacacggcctgccaacccaagcattatgacgaggtgtgaacagaaacatattcatt

SEQ ID NO: 18692 - DNA, 2632 bp, Heterodera glycines
  misc_feature (23)..(23): n is a, c, g, or t
aaaattatatgttaaatgtttcntaaaattctgtccatatttctgtattaatcatcatttcggtctttgttcccccatttttcgatcctatttaaatgcttctcactcctcctgttcttcacttcaccattttccttggactgttctgcattggaataaagcgcacttttctaaccgtctactcgctcgttttcccccaatcgtttggccagtctctcgcccacacgtctctccgttcgccgccctttcttggctctttcgctgccccttcgtggagacagaagttcatgagctgagcgaatggaccaagcatcccgaattcaccagatgcttagcatcttcttcttttggtgggtgtggatgtttaaatgccggtgccagctgcatcttctaccgtccacatgccattgctaactcgccagttgtctatgagcaaatctcctgtcccatatgggaataccgcttgcgcacttcactcaaactgtcggtcaacgcaaacttcacgaaagagccgtccgtgtcactcacacccggcattactttccgttggaaggatttgagcatcacacctattgcctcttcggttcctccggccccaatcatggcaaacaagttcctctcggatggcaataacatggcaatcagtgatgaaattcaaagtgaccttcaatgccccagtcgtgctaatgccaaacgcctcaactgcacactcagatggggctcatgtccaatgtgcctgcctgaccacgattcagcaaaaatcaactgccaatgccgagatgtcaaactcgaaccagcactcgccgatcctgagaagcgcctaccaattcagctcaaaaacttgcttctccggaacgaaaggcgggacatttttgccgaaatcacctacgcgccgattcagttgtccattcaattcgaggggcttcgaatcgctacggaagaagacctcacaaaatgccatgccatgtccaagggtcttttcgggtgctattcatgccacactggagctcatctccatttgcaatgccacaccgacttcggttcagcacttggctacgttcgttgttcggatggcaccgagttcacagctctctgccacaaaacaccagaaattttaaatgtcagcctatcattcaaccgtgccgaggtcgacatcaactgtaccattgaatgcagtggaggacggaacccattcgtgattaatggtcatctccgctatgtgccaaaacacttccaagcacctaatgaaggaagctcatttgcctcgaaggccaaacccagcaactcatgcctaatttggtgcccagattggaacttcgacttttccgatgtcttttggtatttctttggcctccaaaatgctctacgaactgttggcatcatcactctggcccttttcatcatctatgtccttttgcgttgcaaccctgcccttcgatcttggagagccataagccgagtcgtccttttgttccttgctctttggcctacgactgattcttctgcagcgggagagctgagccatctactcagcattcaaaattcagcaccaaagctgcagtttgaaggccattcttcggtgtcaagacgtgtgactgagactctcgacatttttgatgcacaaatcgggaccattcatctcgccaaaaaccaaaaatcgccaatggacttcgctataaaagccgtctctgtgccagtccattcaccattcctacaaattcccgaatcggccttccacattcaaacccaagcccaattccctccttttccaatggccacactgatctctttcctcgccaacacaatgaacatcgaggtggaacgctttggtcttgccgtgaccacatcgctgagccgttggaacgaggcccgaacaatcgttgagggactgcatgaacgcggctacgaactcaagacgaggcatctgcacccacgtgagcgaaatgtgcgacttcacggatctgagctgagccgaagtggtgcgaatcgtctcggtgcctacaatggaagtgcctgtggcccaactgtctccgagctgtaccgctctcgacatggcatcactcttcggcacccctctgccccatgcctgatggagcccggcgggaatggacaccatgattttttccccatcgaaatgatccgagtcgtggcccctgaccaagtttctacaccacggggcttgtccacacgctctcttccccgcccccgcccgtctcacttcgagctctgggacagaactgaccatccgccccggtcccgagaattggtgatcagcgttatgccccatggtgattcgacgactcgaggtgccgcggaggaataccgcatcggtgttggccgcgaactcacgatctctggccccctcgttctacgaatctatgctggtgcccttcttcttgccctattctctgttgcccttgtcgatggccaatcatctattgctggtccctgccctgctctttcatttgctctttgttctccacggccgctcaaaatttcttgcccttgttcgtcgctttttggtccttcaccttccgattttgtgcaaatcgtgaacaatttgctccgctggcttgttcaccgcttcccggcagcgaacactttgctgaaagccatgccaaattagctgact

SEQ ID NO: 18693 - DNA, 2415 bp, Heterodera glycines
atgaatgtcatattcgtgataagcgatccttaaaatcccggagaatttcattattttttattcagtatattaattttagtcaaaaaaaaataaaataaaataattacattaaattaaaatgcatttaataatatcgctttgacaaattgccgcttgtggtaaatgaataggaagaaagaaagaagaggatgctttttggcaagaaaagaaaaaataataaaataacacattttgatgtgaatttaataatgaaaatgcataaataaataaaaaataagaaaaaacagcgtaaggcaacgaatgaagcgcaaaaagagaattaaaaagtgggaaaaaagaacagaattaaatattcaactgtacatccgcatcaaataatcagacagcaaagagaaaatcagtggaaaaacgacaattaataattaatgaatgaatgatttaattaattgattggttggccttttttacacaaaattgggcaagagattttgcaatgccattgaaaaataataaatttacaaaaaatgaaataaaaaacaactgcattcaattaagtgaagtgattgtccctgtcgtacaatgtttgttttgcaaatgccctgctgctttctgtcgcccgttcttctgccccccttttctgcttcccatttgtctcattaattaattaattagtgcacgtaaaagttcagcgcccctccggcgccgctttcttcgccattgaccgcttccgccgcttcgtcccccgcggcgccttttcccagcatttcctccatcagttggggcagcttcagctgctccgcctgggctttcttccgcaaactctccacgcattttgaggctaattggctgaaaaaagaaaaatttatttaaatttttggccaaatgaaaaaaattacccaaatttctgcaaaatgtccaacaaaacggaggaaagcatcagtccgttgtaattgcgcagttcggaccaactgtgcagcactttgctgtggatttggtacaattgggcgcgaaactgcgcgaatttcgcctcgtcataaggggggcctaattaaaaatatataaatacaaaaagaaaataataactttttcttacggtggaaaacactgtagtcgagcagagtgaggtatttgaaggcgacgtaatcgtactcatcgaagtgatattggcgaagttgctaaaggcaatcagcaatcacaattggccaatcattcattcattgtttgattaatcgaaaattgggactcgagaattttgattcgagggagatcccaacccgagtttaatcaaatcaccgattggcgaaatgccatcggataaattttcattttccaaaatttgcatttgcccaccagcaaaagttcgttccattcgactcggaattggtcacaccccaacagcgcaatgctgcacatttcgacctgtctaaaaattagcacaaattttgccaaaaaagaaaaacccaactctttgtcctggccgacattcacttggaccggaagttgatcagacttaacgccgtaggcaaagtcgatcagatggagaatagcccacgcagcgataaaataacgcgggcgataataacgctaaaatgataaaatgatcaaattggcatcattcattgaaaggcaatgaatgccaaaaatgttgattacgtccaattggttgaagtacacatcctgccgggcccagttgatatttgtggccaaatgctgattggcgaccaacacacaaaagtcgagcaatggcactttcccaccactcaattcattcattgctttttgcaggctgttcagagcgggtctaaaaattgaaattagaaaaaatgattttaaaatgcaacatttcttactgcttttcgcgcacggacagaaaaagttcctccaaaaagtgtctttcggtgccattgttcgcaatggcgccgccagcggcgccgtagaaaacgcagtcaatggccggcatcgggcatatgggcaacagttgctgctgcgatgaacaggaggaggaggacgaaggtgaagcagtaaccccggcaggcgaacagtgccgctgctgcggaggatgccggtgggtcagcagttgctgctgtccgttgttcgtcgcttggctgtgctgctgcgtctggtgctgcgcgtgtccgccgttttgctgcggcaaagccgcgtcgcttgaggcgcacaattgttgctgctggttgtgctgcaattgctggtgcggcggtggatggcagttgttggcgtgcaaatggtgctgctgctggtggccgtggtggtgggacgtcggcggaaacaaatggtacggctgcaacggagtggtcacgtgcagcgaagtgctaaagggtggggggggggggggagaattcggaatttgtgaattagggacactgcaattaatgatgcgcgagatcgaagattcct

SEQ ID NO: 18694 - DNA, 2893 bp, Heterodera glycines
gcacctgtcttcctcctcaatcgacgtatgtttcgttgtgtaacgcaaacattcggcacggacaatcgtccgctgaaacgaatggagacgatatggcacagcagcggcaacaattggtgatgccggcggacattcaatgccattcccacaattgggcctctttcttcacgcgccgactcatccgccctcccctccacggctgccaatcagacctttgctttttcaccgaaaccaacgtacagatcttgtccaatcatttggcttttctccgttagatcagtcgcctttctctcgacggtccgttgggagtgcaccggcgcatcgattcgtccgtctcccaaagttgcggtccccagcgcgaattcaacttcgaccttttgctgggtcctctatggcccggcaatgggctccacagcgacgcgtgttttcagttggaagacggacgcggcaccaatttgggttgttcctgttcgaatgttcgtgcgggcaaattaaatccatcgcagtgattccctttgcttgtgtagaatggctgcaaccggctgattccataccccatcgacttgtctcgaaaaagggtcaaatgccatttggacggcccattattcgccccttcccgtgccgacttttgtcttggacatttctgttttactcaaagaatgcccgtccccgactctgatggacaatgggcggtgagcagcgggtgtttgagcagcaatgaatcggcggcgaggacgagcctaaaagtgtcttggccaatctttgaattgttgttttaatcccacccaaagattggctaccgaaacattttgggcgtggagcaatggctttgcgggaaggacttttgcaattcgaatatcggaggaggagagggagagggagcaaatgattggggcggaagggagaaagggcggggacagacggacaaagatacaccgaaacagaacggaaaggacggaggaggggagggacagaaagagggcgaaaagagcggacgcggagaggaaagcagcgctaggcggaggacacgcggatggcattggccgatgcacttttgttgggccattttggcactttatttccttttcacttttgtacacatccattaataaaaactcgattataaacattcaattttaaacgttttcctttggaaatgacctttggacttggcttttttctgatcagtcgcattttggtccaaaaattggtcaaaggagcgactctcctttcccatattcccttcccacctaattatgtttaacatcccattaattatgcactttaacgtttccatgccgacttcattcgcaaatggtcttttcggtgaactgtcctccgtatgctttcatttaattaataatttcgtttcactttgcttttgctttctattaactcacttaaatgaattgttcgaaataaaaattgccaaaattttaaaatatttccgtcgaatttcggcacaatgaaaacctacgggaagcaccaagtgccaatgtttgatggggaggagaaggaagagaagaaagttggaacagaacaaacggaaggcaaaggaactcgcttgtcgcaacagaaggacgaatatttggagcaaaaaaggtgaaggaaaagcaaacccacgccatttgagtccctttccctcccctccgttaagtgcgtcggctctgatcaaagtcggcccatcggactttccgatcgcccaaagggtctcttcgcttaggtctaacggcgtcaaattaaaaacacatccgaccatcgctcttctcaacggcacaaacaatgaacagaacattcgcaaaagcgcttcgaccccttcgcttcagacaaagcctctccaaggaaaggaagatcggctgcagctgagaagcgaattcgaccggactgtgcccaatgccgcacaaatgcttttagcggcacgggaacgagaaaagcaaatggcaattgcatcgccgagaaatgttggaatgcgactgccaccgcttcagctgccaaacgggccgaagagaattgaaatggaagagtgtaagaaaggagaggatggagggcagggaatgatcgcaacggtggcgacacggcctttgccgcaactgcagccgctgaggcagtaccaagtcggagaataacgggcagggggggtaaccaggctcattagtcattcaatttcagaatgccattgaaaattcggcacttgctcagcccgttcctcccccaccatgcaatgccactgagtttttgcccaattcatccccaatcactacaaacatttccaatgtgccgtccaaccaatgccttggcaatcttcaaaatttcccccggcggcgtccttcttcggccaatgcaattttgacgaaagttcacaagccgcttccagccatttcggcgcaaattgggcccaaaagtggtctaatatgtcgagttttaagcttagcccttccttttagggtacgcaatgctttcccgtggcggatacttcgtaaagcgacgcgcaaatcgctttttgtgcacgacgaaggtgaaatgtgcgcttgtcgccggcttcttctccgtgcccgtgctggtgttcgcgctgatgctgcttctctcctccgatggcttttccccgcattccgccgaagtctcttcgccctcttcggtcgccgcttcttccaccgccgcttctgctccaatttcgccagtctccgctccttccgatgttaacatcgtcggaggtgccatttttcagccgatttccatgcaaaatgcatcaggagataacaaaatgatgacattatgaaaagagaagggcaattaggcataaaatagattcaaaagatgatttggaaaagaaaattagtctttttttgatttggttcatacgtgaaaaagggggggggggccgaacccccccccc

SEQ ID NO: 18695 - DNA, 2457 bp, Heterodera glycines
  misc_feature (156)..(156): n is a, c, g, or t
atcaaagcagagtgtgacgcataatcacgaagcactgctccagaattctgtaatgttcacggcagattttgtgatatttttttcactgatttcttttatctctacgcatatgcattattgtttaagctcaaggtgtcaataaaaacaaagtttgtntaatgaatatttacatcaaaaaattaatgacaatttcgaaaaagaaagtcaagtaatttttagaagcttttatttcatgttttgttgctcacttgttgaaccgcacatgagccgttggaaatattttcgccttttcttggcaagttttttcccgaactgtttcacgacagttaattgagtcaattattttcgccagtttcttttatctccaagcgttatttattgcatttcacttaccttggaacaagattacagtaaaataaaatattgttttgtgaatatttacgacaaaaatttatcgacaatttctaaaggggaaggaaaataaatgtttgcctaatatattaatttatattttcaaatgattgaaccgcatctgttgcttatgtttttaatattttttgattttgccatatattttggctttttggaatttttccaatgtccgaaaatttatgtttgcttttacatgataagtaatgatttggttatttttgtatttttcttcttttcatcatgaaagtcatttagccattcatcccctctaatgaaaatagttttctgcagctgatttaacaatatttttctttgcactatacatgtagtatagcactggttgcgccttcaattctgccccttaatagaaggttcctcagcaaaaaataatactttctcaacaaatgaattcgctgcgcccaccccttagtattgtgataaatctcgaataaaaaattctcaactattttcccagaaaatgcagaaggtttttaaatttgaaaactccattcatctcaatttatattgcccgtttcattcagtgcttattttactatgctggccataaaaatatggagttttgcaggttcgaaagagctcggcgcgctcttcatattcagacgtatcaactaagggcctatcgccactctcaggcgagatatggccaatcaaagcagagtgtgacgcataatcacgaagcactgctccagaattcttgtaatgtttcacggcagatttgtgtgacaatttttttcactgatttcttttatctctacgcatatgcattatttgtttaagctcaaggccttatcgaaaaaaattgtcaataaaaacaaagtttgtttaatgaatatttacatcaaaaaattaatgacaatttcgaaaaaggaagtcaagtaatttttagaatcttttatttcatgttttgtttttcacttgttgaaccgcacatgagccgttggaaatattttcgccttttcttggcaagttttttcccgaactgtttcacgacagttaattgagtcaattattttcgccagtttcttttatctccaagcgttatttattgcatttcacttaacttggaacaagattacagtaaaataaaatattgttttgtgaatatttacgacaaaaatttatcctcaatttctaaaggggaaggaaaataaatgtttgcctaatatattaatttatattttcaaatgattgaaccgcatctgttgcttatgtttttaatattttttgattttgccatatattttggctttttggaatttttccaatgtccgaaaatttatgtttgcttttacatgataagtaatgatttggttatttttgtatttttcttcttttcatcatgaaagtcatttagccattcatcccctctaaatgaaaatagttttctgcagctgatttaacaatatttttctttgcactatacatgtagtatagcactggttgcgccttcaattctgccccttaatagaaggttcctccgcaaaaaataatactttctcaacaaattaattcgcttcgcccaccccttagtattgtgataaatctcgaataaaaaattctcaactattttcccagaaaatgcagaaggtttttaaatttgaaaactccattcatctcaatttatattgcccgtttcattcagtgcttattttactatgctggccataaaaatatggagttttgcaggtccgaaagagctcggcgcgctcttcatattcacacgtatcaactaagggcatatcgccactctcaggcgagatatggtcaatcaaagcagagtgtgacgcataaacacgaagcactgctccagaattcttgtaatgtatcacggcagatttttgtgataatttttttcactgatttcttttatctctacgcatatgcattatttgtttaagctcaaggccttatcgaaaaaaattgtcaataaaaacaaagtttgtttaatgaatatttacatcaaaaaaatgatgacaatttcgaaaaatgaagtcaagtaatttt

SEQ ID NO: 18696 - DNA, 2703 bp, Heterodera glycines
  misc_feature (31)..(32): n is a, c, g, or t
aaaaatatttgtaaaattaaatgaaataaannaatttaggtatgtgaaatatttataataacatcggaaaaaccaatccatttattaacgatacaaaaaattatggatttacatatatttttcatttaatataattttattcaacgtaaattatgaagatgtaataataagtctgggtttattatgcaagtaaaatacaattataatatgtgtctgagtcgtatagaaatgaataataaaaatagaaggaaaaacactttatttttttgtgtttacgatggaattttattagatattttttcatatttaaggtttttctgagtttttgaactttttcgcactttttcatacctattatgcaatttttctgaattttttaatgaaatttttcataattgctcaaaataaattcaagttttgaacttttctcgtacatattttcatttttctaaaatgagtttgttaaaaataataaaattttttaataacttaaactttattctaagcataattagatcatttttatgacattttgtcttttttctaagaattttttgtcacaaaaatttacatattttggtacataatcggaacacaaattccattttttatttgcgttaattcatattcaaatagcagctaatgtttagttgaatattcgggatgtaaattgactcagttaaaactcctgtataaaatcaaatttttgctgacaaaataaatatgataaaagtaaaagcgccgaaataattacttttataaatattaaaaaaaataataaattgtcgttataaatttcaaaaatatataaaatcttcgtaaaaaaaatataaacgaattatttaaaaggcgaaaattaatattttaatcatcttttagatatatttcaaaaatgaatcaaattcaacccgaattgctactttccacttcaataacagttgaaacaaattccttcattgcttttcgttttaatccgtcaagaagaagcttaataacataaataactatttaaattactatattaaaattagcaaaacatactatttccaaatattcgtttttctggtcaaatccattggcattttgagcaataaaatccatttttattttgctcaaaaatatataaaaatgttcaatggttacgctagctttttcctgtaagaaataaattaatgaaaatgaaatttttaattttaaaaatattaaaatagattataatgattcattttcaaattttattttttgaggatcaaaaataatcattaatttaaattaattagcaatttttttttattaaaaccaatgtcttttctgtagcattaaagttattgttgttgcgttgtctaattgtttgcactaatcgctgtatcaatgtacgtctacacatttcttgttcactaaaatagaaacaaatcaatgaaatttttttttattatggttgttctttggttttttgaatacttttttatttaattttaaaatattatttgatttaattaattaatttattattacatatttttcatcaatttttctttgatacattctgctaatgctataaatgtgccaaaaatacaaatttttgatcctttcgaacttaaattactctaaaataaaaaaaaatttttaaattatgataaattttgtgtattttttcattcactgataatgcgttggatttgttgggttcatcggtagtgttaatgaagccaaactgctcacagcaaaaattcaaaaagaaatgaccaatttcacttaattgtacaccaatttcctttattttttcttccaatttgatttttatatactttaaaactgaagagatttgttcatcataattcatctgaaaaaaattctaactttaaaatttattaatttaaatgaaaaatttatataataaaaaaaaattattgtgaaaaatttcgcaaaaacaggacaaaaaagtccggcttttgaatcaataaaaattgccgacaaaatttctaaccctattgaacttgttgctgctgaattgttcatcaacaatttctgtcaacagcttcaaaaattctaaaccctgttcatgttgaaccttcattttgtgtatcgtttcagtggatgaaccttaaaaagtgtttttaaaaatatgaaaaataattcattaaaaatatttctaggacatgttaaaaaaatcgtagttcgatattttccgaccaattttttgcacaagttattcagatcactccttaatgataataagaagtgactcaaatttttagcacctcaaattgacttaaaaacgaaatctttgggaaatgtttatatcagttttttagattttcatttgccttaaatgcttaactcgtaaaattaatttgggtcaccattttttgaaaaaaaatatttattttttgttttttagacagttttaattcaaaaaagtgctcctaaaatgtcggagaacaaaaatatttaccatttttatttattggagtttggctttttactaaactgattatggtaaatagaataaatatgagtaaataatttgccatttattatggcactaaaaaaataaattaaaaaaaaaattaaatgaataataaagctaaaatattatgcatacgaaaaatataataaatttacgtcataaataaaaaataaatttttctttgcatatttttaatagtcataaaaaaataaaacgtcaattaatcgaataaa

SEQ ID NO: 18697 - DNA, 1985 bp, Heterodera glycines
  misc_feature (1698)..(1698): n is a, c, g, or t
  misc_feature (1798)..(1798): n is a, c, g, or t
  misc_feature (1905)..(1905): n is a, c, g, or t
taaaaaacagaatttttatcattaaatttttcgtgataatgaaaatggactttggcataaaaagcaaaaataataattaaaaaaatgaatttgcaagtagaggatccgaaccgggggtttagaaaacgctgactagcgcactaccgctgcaccactgtacacggcaaagcttcacaaacaattatttaatttgtttattcattaaaaaagtttggcacgtcataactcggcactcgtactcatttcgcagaaaataaaaccacttttcttaagaacccatgggtgctctatgcacccaccaaatttcattccgaaactccacggacacctccagaccttcctttgttaggtctttcgctccctaccggcaagcgccgaaaccgacttatttttgctctcaaaatttggcctaagccctaaccgatccaatcctaaaagatttctctgtaaatttcatccgtttaccaccattaacttcttaatatttaaatttcaaccgccccaaaattccccaattttttttctttagcttttccatttccaattctatggcatccacttcaacagccgctgatgaacataatattcttggcaaatgcattgtaagcgtaatgaatttttcaggaaattttaaaattcgaaaatttaccccctcatcccctcacagaaagacaaatacgtggtgctgaaacagattggccagggaggctttggacgggtgtacctctgcgagaacaaatacgtgcgcggacaacgctacgcgctcaaaatgatcccggcaagtttatttatttttggaaacaatgccttcgacgatggagtctgtatgaggcctcattggagaaaaaaaaatggaaagaattgagtcagtgactttttatgagtcattgccctgagtttcttgaaccaaaaatttttttcctaatcaacctatttgtacattttttgtatcatttgaaagcaaaaatggtacttttccgtttgggtgcgccacatttatttaaaataaaaaacgtcaacaaaaagcgcgtgccatagggatccattcgattatattttggctaaaattgttgcttttatgactcccaaattgctgaagcgctgtttttgaatattcttcgcgctttttgttgacgttttttaatttaaataaatgtggggcccccaaacggaaaagtaccataattaatgttatttttaaaaatattcattttcccctttttagcaggtcaaaatttgtcaacaatgttctttccatctcacatttctcccacttttcactctttagaattggtcaactcctctccatttggcggcccaggcaggcaatttggagatgacgagacagctcagggagatgggtgggcatctttcccaattttggagttcagtgtttaattgcaggagcggaccctgcacttctggacgctcatggtctcacatttgcattaaaaaacggagaataattattttctgccctaaagtgcgttttggatttcagttggtgattttctccttcaggtaagcactactacgattacttaccggccgacaacagaaaattgtttcaaaatgcgaccccaaaaaggcagaaaactccaagtataaaaaatgcaggtaaattcgcactaactcaaaaaatattgcaacaaatttcacttttcagaggactctgacagcgtaagcagcaatcaatcngcaactttctttgtcgttgcatcaccgttttgagacgttcagaaaaccaataggacgggctgtaagcgactttcttcacaggaagtagaagaattgacgnagatggtgtagtccactgtatgtatttgatcgcaaattatttaaaaaatagttttaactttgctttatttacttttttcaaacaaataaataaagggtgctttgagntgtcactgttaaacaattaattccatcctccatcactgcatttcgaaactcttcttgtcattccttttcgaacgtttttt

SEQ ID NO: 18698 - DNA, 2890 bp, Heterodera glycines
ttcatcaataagggcgtccattggaataggaggaggaagaaaatggccaaagaaatcggccggagagcagtaggaacgggggggggggggggggaggatacccctcgcatacctaatttgcattttttttggtgtttctcacaattgtttcggtacgattcttccttttttaatagcattgaagactccgatttattttttaccaaaaaaattatttttattcttatttaattcaaaaattgttcgagttcgggtcaggcgttcggtattgggaaaaataaacgtcaaattcgtgattagcggcccaaaaaaccccaaaaataatcaaaatacaacttttacaggcaagaggatttgaacccacagcccagaaacccatttttaaccaaccgagcaattcgtttcccttcctttccctctgtcgagaatgtgccccgaggcaatgaaattccaatttttgagggcctgtaacttttgaagcaggcaaaatgcaccgctaaaattaaaaattcacaatacaagtcgaccccgctctatccaatggtatatagcttatatgcattttcccactcacagctcggaatgttcccttgttagcataggaaattctggggccatcctaaaaagtgacacatttttctgtatcccttcagctatttgttcgtctcccaggagcgtttcggcttcgccctttggtccgcccttttgcagggaaatatcacttggcaagagaccggcattttcccacgcgtcacttggtgcgattttgatgtgagaagaacaatatatttacattttttaattttttcaaaaaatgaacatttaaaatttttagaatgaaaatttgtaattttccccccaatttttcgtgttaaggtgcgcgagatgggccaaactgtcaaccacacggtgcaatgtgtgctcacactgaacgttttcatggagaaggtgtgtgtgcaattgacattaatttttcatttaatttttgtctcaattttcggtagaaattagtttagcccaaatgatttatgactaattggggggcggcacgggtttaattccattccatgaaatgatcattttcctattttctacgccactgaacaggtgttcctgatcttgtgggcttggtacgctgtgttggccgcgttgaccctggccaacatcaccgcttggctgtacggctatttgagcgtggcgtccgctgaccatttcattttcaaccatttggagatggccggcgctgaacaaatgctgctgttcgacatggacgggcggacgaaaagcaaacgtaggcttatgtttggagcaaaatttttttaggtttaattaccccctattttactttaatggttaatttgcatcaaaaaaattaattgaaaatgaatttattttttattgcaattgttgtctagtggtaggccagtgttcagacaaagacaaaaatcacaatatttattcattgaaaatttttaagagaaaaagaaatttggatttattttaattatggtaaaaattctgaaacatgtaacattaaaagaataaatatttcgggagcagctcgttacactccccgtgtcgttccctccaaaagtttttaaatttcaaacttataaaatgtttttttgaaattttctaatagaaaattaaaaaaaataccggaaacgatacgggaggagggcgtaatgaacccaaatatttcattttataggcaatttaggggggagctaattgtgtgggataaatgtgtgaaaatgatcgatgctgtttgttcatttatattttttgttgcgcagatatgcaattcgccgtgcgtcgcttcgtggccgaatatttgcgctccgatggcatgttcattctgcgcctgattggccaacatgcggacgttgtgttcaccaccgaccttgtccaccggctgtggacatcgcactacgaaattgagaaacagcgcgagtaagaacagaacagcaacagaacaccggacggacaaccgaaaaaaaaatcgaaaaattttttaaaagagattttcaagaaaaaaatttcagaaattttttgtaaaattttttcataattttttatttctgaaattcccccccccttcatatgaaaatgaaaaatttcaaaaagaaaatggctaataatttcttcaccgcattcgtttatggttttaaaaacaaaaacagcatcgaccagtctataataatttttgcgatttttttctttaaaatactttaaattgaacaaaatgcgccattctcatgcccagctattcgttacatccgatttttaaatttataaataaaaagactcgaaattttcaaattaccatccctttctttagggcattgcgtcgaacggagccgttgtggaagaagcattaacaacagttaggagcggaggtgaacagacgggcggccctagtggtggatcgcccggccacgtaaatcaacatctactttatttttacgacagaggcgaataatctcaaaatcaatataggggaggggccccacctgatgagtaaaatatatctctttaggaaacctctcagtatgaaaattttgaattatttgaaattaatcgaataatcacataaagcattgatcagattttttgtgtcgtgatttcggctttattacattttcaatcagtcggtcaaaagcctttttagttgttgcgcgatgagcacatgcgcgcgctgcttcggattggccttgggcaaatcagggggaggccgcttttcggcctgtgatcagtggcaagtgctgtgcaatgatgccataatccgtcatgaggataatgaaatcaatattaattaccacttattccgtttatctcgcacgatttatcgaaaattttcgtatttcaaattcatgaccacattctcttt

SEQ ID NO: 18699 - DNA, 1379 bp, Heterodera glycines
aattttataggcatactccccggtacaggactaactaacctgaaaaaataacaattgtaattggttttaaatttttttagaaattctgagtttttaactgtttattattttttgcaaaattaattcataaatattttttcagaaaatgctctgaaacgcaccaaattttatgtacaagttaaataaggctctctgatgcttttactatcaaaaagggagatgaataaaatttttaattgctttttaaacatgccaaaaagtttaggcttaaattaaaaaaattttcttcggttctagctctttcaataagcaataaaatcgtaccaaattttataggcatactccccggtaaaggactaacttaacctgaaaaaatgacaattgtaattggttttaattttttttagaaattctgagtttttaactgtttattattttttgcaaaattaattcataaatattttttcagaaaatgctctgaaacgcatcaaattttatttacatgctagtttaggcactctgatgcttttactatcaaaaagggagatgaataaaatttttaatttgctttttaaacatgccaaaaagtttaggcttaaattaaaaaaattttcttcggctctagctctttcaataagcaataaaatcgtaccaaattttataggcatactccccggtacaggactaacttaacctgaaaaaatgacaattgtaattgattttaaatttttttagaaattctgagtttttaactgtttatttatttttttacaaaattaattcataagtatttttacagaaactgctctgaaacgcaccaaattttatttacatgctagtttaggcactctgatgctttttctatcaaaaagggagatgaataaaatttttaaaaatttttaattcctttttaaacaggccaaaaagtttaggcttaactttttttcagaaactgatcagaagcgcagcaaactttgcagggatactgaaaggaagagaaataacctattttaaatattatctagtcagttcatttaaataatttttattcaaaaaaatttttttttgggttttcggggcagtccccctgaaccgatgttaggcttaactttttttcagaaactgatcagaagcgcagcaaactttgcagggatactgaaaggaagagaaataacctattttaaatattatctagtcagtttatttaaataatttttatccaaaaaatttttttttgggttttcgggcagtccccccgaaccgatgcgcccagatttatggggagaccgaatccttcgggaaaagcttccctatagtctgtactttaattctgcgttggtgggggggacccataattttgagtaccccaaacggacact

SEQ ID NO: 18700 - DNA, 2854 bp, Heterodera glycines
  misc_feature (18)..(18): n is a, c, g, or t
attcaattcgcaatgatncatattgagcaattcaatgatcagaaaaaacgtgaaattattcacaaatttcacgcaataaaagaaaaaattaagaaaaggggaaaatattctcagaaaatttggaattaaatttggcaaaaaattgctgtaaaattgggaattaaacgaaaaaaaaatttacaaatggaaaaaaggaattggattaaaaaagcaggaattcattaagcgaattgatgaatttaaaagaagctacgaaaatggaaaaaagaatttggcattgaaatgagtaaatgtaaatattttttaatataaaaaatgtgtaatatttttacaatttaattaattatttaaaggtggaaaaaatattctaaaggagaaaaaatgagcaaaatgaatgtttattataaaatgaagaatgaaaatccgtctttatcagacaaaaaaattgctggcattttgaaaatctctgtaccaacactaataaataatatggaaaaagaaaataaaattataaaatattcataaatattcattatacaatatttgttgtttattaatttattatcatatggttttcttaaaatgagatttattttcaattgcaaattgtaatttattattttttgttcgaagaaatcgattaatttagataatggaataatgaatagagaatatgccgaaaaataatttaaaaatattatttacttggtttttttttggttgaaacaagttgcaattaatttccaaattgtccaaatctttccaacaattatgctctatgacctgagaagatttcctattcaaaaaaatacaagaaagaaaattattttaatctgctaataagcatataaatttatgtcataaatgcccgacagaataagttgcgagaaagaaacatttatcaataaatgatagaaaaaactttttattttcataaatatatttatttttaattactttgcgaatgctttcattaatgaaaaatgaataattttaacttaaccaatctcacgaattgtgatggaaatcactgaaaaattaagcaaaattccactattgtcaaaatgtgcaaaaatatgccagaaccaatcattggccagcaaggattttgatcagaaccaatatttattaaaaatgtgtaaattatcaataatatttaataaatcaccggcaatattatcatttcttctttctctttttttttgatttcattcattataacttaataaaaattttaaagaaatttattaaaaaacaacattatgataagcgttattttctactcaatctttggaaatttcttctttcagtttaaaaatgaataaaaattacaaaatgaataaaacaaagtatgaccaaaatatacggttcgtctcgcaaccgacgaagacgcaaaaaagaaatgacatgctaatggggatattagccgtggtgggttatcatcattgtggctctgattgcatgctattttggccgagcgtgtgatgagagcagttcggcatcggcatcggctggcgccagtgccaacaaatcggcaagcaaaagtgccatttcaagcacaaacgaaggagcaaaaaatgatgatcaacactctgggatatagatgctagattttagggatacattattgtcattatttggcactattttctcttcaagttcggcatattaggggaatcaattatggattaattatatagaaaaaaagacaattctataatgccaaaattggaaaaaatgaatattcaattgaattttattcgaaattatttcttttttaagagataaattttcaataaattcttccctttaaacaacaaatttgtctaacaacacaaaaagtaatttaaaaaattcaaatgtttttcaacttttggaaagtgtttttattcggctgactaattaatatccggccccaactttctgaaaatatttaaacgcttattggtttaaaatttttttcaaaattattagattttttttttaattttgtgccacagcatttttccataagttatcataagctcaccaaactttgcagggatagatacttgaaggaagaaaattagcttatattaaacgtttacatcccatatcctgaaaataggtttccttttgcttttttggcataaagttgaaaaattttttgattttaatgctcaatggttggctttttggcaacgctttctccgcttttattagaattattataaacattattttctaatgaatttatacaatttaaacattacacatttaatgaaaaaagcataaaataaataataaatataataaaatatttttatttttttagtagatgcatttgcttattattgttttagtgttctttttcataaagaattcaattgacaaaactttatcagttaatttatatgaaaagaatggaaaacttaggccaacttttgctgaaatatttggccaaaaatgggacaatgaaaaaatggaatgtgaaaatgaaactgatcaaaatgcaaattatctccaaaatgatcaaaatgaattaaattcggtcgattcaattagcagtgatcagaataatcaattagatgatcaacaaaaattcgaaattgttcacaaattcacgcaataaaagaacgaattaagaaaaaagggaaatattcagcaaaaattcagaataaaattgagcaaaaaattgcggaaaattgggaattagtcgaaataaaatttacaaatggaaaaagaaattggattaggtaagtcaaaaaaagaaaagaaaccaaaagaattattatgaaaagaaaaagagggaatttattgaacgaattgacgagattaaaagaatgaaaaaaaatggaaaacagaagcaatttgc

SEQ ID NO: 18701 - DNA, 1802 bp, Heterodera glycines
ctattctttttcctacgacgtattaatcccatgaattttttttagcggcagagccaccgtaatgtgaatcttaggaacacaaaagataaaccaaaaaatctcgacaaaaaatcgagataaccgataaaatcccgatcacgatagaatttcataccgattctcgactttccgcttctccgtcctcggcgtcgcccgacatgattggatggatctgctcattgttcccaaattgtgaatcgacaaaatttgaacgtgtggacaagccaacttcgtttttatcttcatcatcctcctcctcatcatggtcagcttcgttgtcttcctcctcgatgaaatgcaatttttctgccattttgtgacagcgttctaatttttttggattttccattccgctgcagaacgcttccttgaccgctggccaactcgtcaggtcatccaagttcatccgtacctaaaaaatagtgcgtgagatttctttttgattttaattttaatttaaggatttataatttttttttaaatttttattttattttttatatttttatgtgcaaccttgaagcttttttaagaaatttgtacacttttgagtggagaaggggaaatcatctctgttataaaatatacaaaatggtgaagcgggctaactccctgtgagggtgctgaggcgttataaaaaagccatcaaatacaaattttcaacaaaaaactgcctccaattttgggcatattttccattttttgctaacaaataagcaccaaaatgcttagtattcaaaaattacaaaagaaaagggatcgataatgccaaaaaaagcttgaaactattggactgagaatcttaaatttggctgagacggagttggccaaaagcatttgacgtccccgcaaaaatagacatttgtcaacgtgccttcattctcagctcataatcggtgaacagcttcccattttcatcacgtgcgggcaacagtttttcacatgggccccctttggtttcgtccagcaccgtctcactgatttctgtttccaaatcgggattttttgccaattttttctcaaaacttttcgtttttcttgattcaataaaccgcttaaaaaaatgttttacaccctttggacggggaatattttcgcggattttgcgcaaatttgccaataattcttgttgaatttcttttgctgattttatccgtctttcttcgtccgacaattcttttgcaacgataagtgtcgacaaagaaaaagaactattggtctgttaatcaattaaaaagtttagtttgtcacctcgaataatctatttacataaccccgtaaaaactcacttgctcattactttcttgtccatcattgaccatatggtttatcacaattaatggttcattaaatgtgtaatttctcgctgacattgctctgcggagcacatctcccgctgattgcctacggctaaatcgaaattcttcaattgctgcaaatgaatcactaataattaacgtgatgatgacaattataagaaagaatatcattgaataaataattttgcagaaataattaaataaatattaaatttataaagaaatgaaatgctaaatttatgcatattcaggtccacccattacgtcgtcagtaaacgtggcacacgcacatttctatattgaaatagcctcatgcttaaggaaaattataaaacgcatttattagaatatgcattaggctattagcgtaatttgataatatagcatttggcagtgggacattaggggaaggacatttgcacacatttcggcaaaaaaatataa

SEQ ID NO: 18702 - DNA, 2466 bp, Heterodera glycines
tcggttgtgccaatttcgtccgggaagccgctggcatgcgttttcatggccatgaattcggcaacgtagcctcgaaaaacgcggtcgctccactgcgtatcgtcccactcgacggggcgatagtaggccgtacaccggtacccgttacgaagcgcctccaactcgattgacgtcacagtggacacccacccccgctcatcatcctcgcgatgcgtgcactcgtagtcttcattgaccgctccatgcgggtgttgcagagcacaggtacggcacagcgggaaaagaagccgctgatcaaatttcacgggcagaacaggcacatcaacgtgatgggccggcacaacgaacactttgagaatgccacggaccggcacctggtcggcgcgtcgccagtcaaccgcctgctctgcctcaccaatgatgttcactcgtgttgggtgacccacggggtatgctgtcacggcattcgtgtgggggtagagcgaacgaacgtcgtaatatttcatccgccacccctccggcacctcgtagtgcagtcgctgcggacccacacgtcctccatggtagcagtccttcaaacggatagggccgctgtccttgtactgcgcaaaggagcgcttcatttcgttgttgttgcgcttctccgcgttgatttcgcactcccaaaatacgagcacttgttgcacctgagatgtgatgaaggccatccgtcgcgcatcgtcctcccgtatccgctgcgccgttttcccatttgccatcactgtttggggctgaaagcggtgacgcgggtggtcgtgcgcgtgccagtggcagccgttgacctcaatcacggtgtcggtcgccgcgatgtatccgtccacagtgtactggccaattttttctctccgcctggcgagtgtgccgtctgaatgctcaccccgttctttttggcgtaccagtccatgaatttaagcgctacaaggctttgcgtgtttgtagtgtcgtagccgcactcgggcacgatcgcgagctgatccctcttgaggtgattaagtcgaaagtgtctcattgaggcactggcgatggtcatcggctcccacgttatgtcaatgccaccgccgatcacttcaaatgcattgtcttcttcctcctcctcctcctcctcttcgtcgtcgttgtcgtcatccaagcatccatgccgctccagcgggtcactgatcgtcaagaactccgtgcgaaaagcgaccaacgcctcaattagtatgcgcgtgtcgttggtgcagtaggctgcgagctgttcacacaggtcgaagtgctgatggtggtgttccgcgtaccactggtcgaatctgcgctgtcggtcgggcgtcatcccgccgtataagtagtcagcttttggcggtagcgactgcagaatgtgcccataattcgccgcaacaatcgccaaatgagggaaaaattccttatcctgcacattgagtccaaacgctccgggcagagcgccgagcggcaccggcataaggttccagctgtctcttacgatgatctccgggtttttttcgcccctcgcaattttcatttcgtataatttgttaccccgacggatcatctgtggacaaaacccgttgaggaagaactgccgaaacagcataatgttgtcaaagcgacccccgaaatgggcgaagagcattgtgggatagcgcggatcgaattcgttgagcagccattgagcaaaggccgccattggacacggagtgatgaattgggcatcggtttgggtgtgttcataggcacggtgggagaatgtgacggtgcgctgccgcccacaaatgccacatggcgcttgtagagaatttcgccataaattttcgttatgcactttgtacagacgacatagcatgagatgaagttgacggaatgaagtctgcggtcgccctcaattcgcgtgttctgtgttgtttcgcagtcaaaggcgatcagcctgtactttttggggcggcacgccatcaactgctgtatgaagcagccccgctccggcttatggtaacatttgcaggtgtagcagaatttctcaccgcaaacgtgtccgcttcgtccttttcgtcggttttgtctgacattccacacaactccgcactggttgcattttttgaactgttgacacacattgctcgacaaatgatgactgaaacagtcttggctcatgaaatccttgccacatgctgtgcattctttgtaataattgtcgttgttgtcatccgctcggcacggtcgccccgctcctatgcgaccgcagtttatgcactttgctttgcattgtagcgtgtgaccattagcattatcgtaggggcactcacacgaaaagcagtagtagtcacgcccaaacaccgctttgcccaccccgcatcgaattccgtcgaaatgtccgttgtgatggtagagcgggatttcgatgttgtaattgtccggcccatattgaaattttgg

SEQ ID NO: 18703 - DNA, 2530 bp, Heterodera glycines
ctttgtgtcagcccctcccatcactttttgtccctcaattgaccaactgcccctcccctttttgccaccctcaattcccccggcccgttcgttcgtccattcattctgttaattgttgaacttttgcttcgcttggctttggtttttaacacagcgaataaagagcacatcgaagaggcttggtgttttggccattttggccagcccggggctacaacgaggggccccattttgggtgtccccgagtcccaacagtctccagactagggctttgtcaatttactctaacgattgtttagaactaatgtgtcgtagagtaagtgataaaaatatggacgatcacaggaataaaaaaaaagtaagtgaataaaatgaataaataaatttcccggagccgcagtatttgaaaattctagctaaatatgaaaaaaaaagaacagaaaagtgattacctaattcatttcgaaatattaagggatgaaacatggaacagcgaaaggcccaaaatgtgtcacccacacccatccgtcccttaatattacgggattttcagacagcctgtcgtagttgtcgggacagttaggttcggcacagaagaattgctcgccgggacactggcggcaacattggcactatatgacatagccgatttggcattacgaagcgtgccatccgccatggtagtgctggctttgtgggcaccgcgaggacaggcacaatttgggatggcaaaagtttcattgacgggacgatgggggacaccgaaaaacaagttaattaaattggcccaattaaaaccaattaaatcattgagacggaccgatcaaatgggcgacttcgtggaagaaaatggacgccattgcctcggggttgtgcgggtaaaactgaaattgttgcacattttgtgagaatattttaaatttattgttctataccaaccccggccatcatcacatttcgccctgagcacagcccgccgatgaatgcgagtccgcccgcgtggcgatgactgatcagaacggcaacattgtggaagggcaactgggcaacacgctggttacggtactgctcgaaagaatacagtgaggcggacagatcgtcgcgaaaagtctccaaaatgtccacgacaagcagacggatgttgatttggaagaagtactgaagcagattcgcttttaataatccctgttaatctgacggcgccgacaagaattatggcggattttccaactttctatttggtttttgcttatttgggcctaattagtgccattggcgtgctaattaatgttcggtctcacagtgtttgcctcatttcgcagtcgcatcacttctcgcttcacgacttcgtgttctcggcgataatggtccgactaaataatatttaaattgacccaaaattacctatgcaattcccattgctaaatgaaaggaaaatgccaatttttagcccactttagtgcttcaccgtcttcaagtcgacaaacagcagagcatagaggaaaaaggcagtagagggaatgccgaggctgactgccgaataatccggcgccggctctccccacaccgctggggccctgcgccaccgattgtgccgatgttcctcaaatttgaccactttttccatcgtcaatagatcaatttcaaacatcccctcaggaaaatgctataaaattttggaattcttcgcccattttggggccaattaaatacgtttgtttgtcctttggtttcaaattgtcacaacgcacacataccctatgctgattatgattatggtggtggtggttctgttgcttggggaagatgacctcgtccctttctatgaaagtgtcctcattttgcggtccaacggcgaaagccaaaggaaaaattgggagaaaaaggagggcaaagaatggacaaattggaggatgataaggataacgatgcatatattcactcactcacatagcagcaatgttcttaacgcggaagtttttgcgtattaaaattttgcgaatttccatttcgtaaaaaagagacatcggacggaacgatttatgtgtttctgacacaacaaagaagcaatttgttgtgctcccatccaatggaaatgttcattaatttttaatggcagcagaaaagggggcgggggagagaaaagttgttggaaatgatgtcattaattttgccgaaggggcgggggatattgagaaaaagagcaaatcgatgggggatgaccagcagcagcagaaacagagggcacagcacagcgaccaaccaaacacattaagcagccttctgctggtggtgggtggccaaaagttgggagaaaatgggacaaatgaaaggggtacgtacaaaggaggcactggaaggggagagggggggtgtgggttttccttaaataatgatcaaaccagtgtcaattgtaaaaaaattatgaatatttattaggcggcgatgcaaattggcaacaccggagaaaataccggaacttttaatgaatttctgaactaattaccatacattttttaggggggggggg

SEQ ID NO: 18704 - DNA, 1145 bp, Heterodera glycines
tgaaaacggggaaatcgatttactctaatgaccgtcttctattggcccggttaattaccctgatcagtccgtcgtactatccgctggcgatgcaatcgttctcccggaaacgcgtgatgttcggcgtgtacagctccgaggaggacagaatgcgcatcgcctcgcgcaactgcgtttgcgtctcctcgtcgcagcggtgcaaaacattgcccaaggcattgagggcctttaattaaaatttaattgacctttttattccccccccccggcaggcgatcacctcagtgatcggagcgtcgaccagcgaacccgacgaacggcctttttggaagaaagcggctgaaacagagcacaacgccataggattattgagagaaagacgcaaagtttgcaggggaacgaaacgaatgaataacaaaatgaaaaaaagcattgacagagggggaaaaaagggtgggaaaacggacggacggaaaatgatttggcaatcggacggacgaactcagtcccacccccgaaaaagcgaagaacgaacgaatgactcaccaaaagggggggggggatcagagggaaaggaaagccaaccaaaagccgaaaaaagtgttcaatttgggcgcttaccgtcagcacttccgcgcttaacgtagacaaactgttggctgaaagagggcgaagataatgaaaatgaacaaattaaatgcccgtccggcggctgacctgctcgaattggttggcacggcaatgcattgccaatcggatgaacgacggcggtccgccgttgagggacaaacgcccgcgccaccgccagcagcagacgaagggtcgacgacggactgatgctggccatcgacggacaatctgccaaaggaatgccaaacatttgaaattgcgccaaaggacattcccacctgttgttgtgctgctgctgctccgtcttcgtccgctcttctgtttttggtgcggtccaagtgaccgccgcggtcactgccgccgcggcactcgcggcaattgtggcggtcgcgacatggttaagtgggcgacgacggcctatcatcagttgcttcagtttagtggcattggcatcctacccattcatggcattggcattatcctccattccctcttggcactgccccccccccttt

SEQ ID NO: 18705 - DNA, 1356 bp, Heterodera glycines
ccgtcaacaattcgtacgctctattcacatactggacaatgttgtgttcatcacagattttgaggggctgttgtgcctcttcaacaacagtgaaaagagcggggacagcccggagacgggaggaaaggcgggagaactgctcgcaaagggcgatgtcgaaggaggagcggaggaaaaactgaaaatggagggggagaggggtaataagaggggaagaaaaaaaataggggagagagagagggagagagatagaagagagaacgggagagagaaaagagagagagagagagaaaggggggggggggggaaggagggagtgacctgttgaatccgcaactgtttggccagccgacggacggtccgttcatttggcatttttgggaaaaggacggcgtacagaacgtcgtcggcaccgaatgcatacggagtaaccgtcacgtctgaatggtcgtcgtcgccacggactgcgctaaagggggggaagacatttgagggggaaaatagggaaaggaaattaaaaaggggagaaaattagggggggggagtaaaatttaaaattccatttaattttgaacccgagaattcgttttccccactcacttcaccatggtgcacaattcgttctgattcgtcccgtccagcaacacaacggcgggccgccgctggcgactttcttcgccggagacggacgaagtgcaggtctaaaaagcacagaacgcattaaaaaggatgccaatgtttgaaaagggtgccaaaaggtgattttttttaaatttggctccataaacagtttaaataagccattaattgacctgcacttcccatccggactggcgaagagcggcgatgaaaggccaattgggaggatcgaaagtgtgggaggaagggacggaggaggaaaaggaggcggaagaagaagaggaagaggagaaggaacagcaaaaaggaagacgtccggagcatggggagggagaaggaagcaccaaaagagcctaaagcaaatggggggaaaatgagaagcaaagaaggaaggaaatgccaaacaaaaaaaagtgccaaagagcaacgccgcataatttggcacatttaatcattccaattcaatcgaaattcctaggcttaattggccaatgcttttcggtttgctttgccccatggggctttgtttgctgctggcccacccgtttgcattgtctgagcagcattggcccgtattggtcgctggcggagggagagcggaggggcggcgaagagggcgacgaggaggaggagggcggcgagtcctggcaaaagcggatcattacaacagaagcggaacaacgacggacaaagagcattggcaccccatccaaaatc

SEQ ID NO: 18706 - DNA, 2450 bp, Heterodera glycines
agaaaagtcattgggtaagagtaaaataatgcagaaatccgctattttttgctctaccatataaattttattttacatttttatccctttttaaaaaaaagatataaaaataaaagtgattttggcattcgggaccaaaggggggtgcacatggtttttgagtgaaaaaattttttcgacaaaaatcttccaaaaacatgtctttaggggttattcgggccgctgttcacgaacacgtgaacagattttacttttgacatcgtttagacctcagaatccctgtgtgattggggattctgaggcatcatttttggggggggggggggcgaagttcgaagccgggcggtgtacattatttttctttgtattttttgggttaattttcattacttttaataaatttaaatgtttggttttattaataataattttttttagtttaatttaattattttttgatgaataatgattttcatttaaattatttattatatttaattaaagaatttcagcttttattttaaaatttaattgtaaaatttttttcatttcaatttaaataactattcaattattatacatttcataatttgtttttcattaatataaagtgtattatattttaaaaaatgaaaaatataacacatcgattttttatctattttgattaaaaacaattccttaattaccataaatgctctatttgaatgcccactttctaatcactgttgtacctcttttaatcacttttgtacctcttctaatcacttttgttcaaattataatcactgttctacctctttaatcacttttttaatgttttaattcatttaaatgagtgttttttctatataaaaaaataaatttttttaatttaaattaaattgtttttttttgtgaaaaatttaattaaaattaattattattttttaaattattatttttggtgaatgttttatttaaaattaattatttattaaaattaaaaaaatttcatgttttaatttaatttaaatttgttaaaaataaattcatttcgatttcaaatattctataattctatatgctttatagtttatttttaataaagaaatggagaatttcttttgttatattaaaaatattattaatattcaatttttctttttttaataaaaccatttccttatttgtttaattttaaactatacttcttttaaccgtaattgtacctcttttaaccgtgtttatacctcttccacccctatggttgtaccctactaatcactgttgtacctcttctaatcactgttacacctcttctatcacttttgtacctcttctaatcacttttatccctcttccacccctatggttgtaccctactaatcactgttgtacctcttctaatcactgttacacctcttctatcacttttgtacctcttctatcacttttgtacctcttctaatcacttttatacctcttccacccctatggttgtaccctactaatcactgttgtacctcttctaatcacttttatacctcttccacccctatggttgtaccctactaatcactgttgtacctcttctaatcactgttacacctcttctatcacttttgtacctcttctaatcacttttgtacctcttctaatcacttttgtacctcttctaatcactgttgtacctcttctaatcccttttatatctcttaatccctgtgtgattgcccgtctgagttcaactaaattttaaaaacgggcgcgaagcgcccgcccaagcccaataaaatttgaaaaacgggcgcgaagcgcccgtccaagcccaacaaaattttaaaaacgggtgcgaagcgcccgtccaagcccaacaaaattttaaaaacgggcgcgaagcgcccgtccaagaccaacaaaattttaaaaacgggcgcgaagcgcccgtccaaggccaaaaaattgaaaaacgggtgcgaagcgcccgtatgagttcaatggatttaaaaaacgggtgcgaagcgcccatctgaaccaacaaaatttaaataattcgggccctggaaacgcccgttaaagacataaaaattcataactcaatgaaggactgctcaatttaagtgaattaaagctttaaaaatagcaaaaaatcgggagaattttatgagatttatttggttttataatgttcaaaagaaaaaaagttattccagaatttttggaaattttcgatttttcagaaaaaaatttatacctcggttctgaaaagtcattagggaagagtaaaatactacaaaaatccgcaattttttgctctaccaaataaattttattttacatttttatccctttttaaaaaaaagatataaaaataaaagtgattgtggcattcgggaccaagggggggagcacatggttttttaagtgaaaaaaatttttcaccaaaatcttccaaaaatatgtcttta

SEQ ID NO: 18707 - DNA, 2205 bp, Heterodera glycines
taaacaatcgctgatcaaaattctcgagtcgtattccccagatgctcatttgaaattctcagatcactttataattctgttgcattatgaattcttaaccccgcgtcccaaattttagctcatattgtgcctttttgatcatcccacgacttataaaaagctgagctgatcagttgttgatcattgaatttatttttgcgtccaaattattcccaattctctccactcatctgctggcttattaaatgctcgagctctgaattattatttcatctgaacccatcaattatttttgatccttcctaaattagtgtccctcctcctaaaaaaccattttgaaatgggttcacattaagccccctcctcctggaaattttttttcggaatacggtagtttctaaaatttttcaccgaaagcacgaagagaatgtcctggcggatgcccttccgtgacgggtcaatgccggtggtgttccacattgctgtgtattcgccggttgatgaacagtgcgcaccctccgtgaccagctccaaatcgctgccgccaatgtgcagtgaacttaatcacacagtgcaattagggcgattagtcaatataattattaattaatgaggtaattaagagggccaatttacaggaaatcttgcggcggcgtgcactgtacactgacacggtatttacagttggagtgcagcttcagcgtgcgctgcgaggtggtgaatcggttgccgtcctgtttgaacatgattggtatgccgttctccgcatcactgaacaaaaataagaattcagtgattagaacataaaatggacacaatttggcaccgaaaactgagtcttttgatagcgatttgtggtagcatgggggcatttgttaaatttggcaccgataaaaacaaatttggccaaagaacccaaattgaaggctgtgtgatattcgagaccgagattctcccgaaagtcgtgaccgaaagcccaaagagcttttgtttggttttcgtcgattcaagacaaattcggtcaaccctaaatcgatcaggacaaaatttgcaaacattgactctgtttcagtccataaaaacgcatgaataaagttgatcaaacccgtccaatcagtcgcaataaaatagcttccaatttcaagattacttagttttttgggctaaaatttttattgtcaaaatattgacaaaattcaacagcttgaaaagcgaaatttcgttattcaaatgctgattgtctctatcctgatcaaatcgataatgggccgtaaaatgcgtttttgtctgatcactgtcatcgatcgatattggctcgtcggccatccatcaatacatttagctcccgctaattagttggttcaaaagtcccatcacacctaatcctgatgctcagcttgaagtgcttgccgcttcctccgctgcttccattgtttatgtgcgccgcggaggcaccggcggagtttggcacttttgcggtccccgtcggcaccccacagtgttggccttggaccccgtcaacaattgtcatttccgctccacctgcgactgatccaacggaccgtttggcactcaacgacaattttggatgaattgtgtgtccaatgccggcggcggttgttgctgccgtaccattacagccgctgccgccgttgcgtgccgtcgttgaaagctttggccttggcttttcttccaccgccgccggcggcagcggtgccggcgtgggaacactgccgccgctgtcgttgtcgtcgttttccccggaaggcattatcagcagcatacaacagagacagcaccggaggcaaaaagatggaatgaggcctttttttgccagacacagagagcgacgagtgagagagtacactgctgggcccggccagaagagaaacagacaaattggcgggggcaaagaacgtgaaaaaagcgttttctgtctgcttgtttggcttaacgaatgttctctgctaaggcggctggcttgcttcggggcttaatgcttaaagggtccgagaccaacaaagcccatggtcttgtgtcttgagaatgggtgggaatgtctgcctataaaaataaatgaaattgtgccagcgccaatttaagttttgggcaccgggggcgagcgtgacatacacgaagccccaccccgctaatcatggacatggcacacgggatggcatcaatggcacatgcaccaaataaact

SEQ ID NO: 18708 - DNA, 1461 bp, Heterodera glycines
gagtaccgccgccgcagtgtgggccgtattatggtgttagaagagtgtatttccgcgagattaccctcgggggctgggggggggcacagataattcactttcctgccctagggacaccaaaaaacaagaaaaaaacaaattgattctggcggacgctggggcgacgacctctgtggggacagatgagccgatttaggtgcacggaaagggataaagcctctggcagacggaggcgcttaagtgatgaatgtgtgtggatgtgggagcatcgctcaatgaatgatgaagtgaattttatgtggaaaacgggcataaaaaattgacaaacaatcgctcggaatcaattattaaatttattttcaaaatttttaaattatttattaataaaataaaaatatattttcaatttttgtattttcgatttttaaggtatgtactgaattgtaaattaaaaagcactttaattaagcttaaaaatcagtcgcctgggcaaaattccaaaacggaaaaatgatatgccaaaacatggcaaattctcatctaaatgcttaaagcgctgctccaatctttgaaataaaaggcatagataaagcattaaaaataaaaaaagatgctaaatggttttcgaagtgttcccttgtaagtaatagctgaatagcttatgattgtgatcgtaacataactgggtgggacggtacggtacacaggaaaatgccaaaactcggcaattcgtgccaggataaatgggcagaccgggacagaaaaatgggcaaattgccgagtcatgtcgaatttccaaccaacatttgcgggaaaagttccctgaatttttactatttcattttttataataaatcagcgaaatattgaaaaatggataatataaaaagcaaataaaaaattccgggaatttttcccacatcctttaacatatttttttgccgtcgttgccaatttttgttttcggcggcgcgtggggcgaaggacaaacaaatggaaaatatggaacaaaaacatacaaaacatatgtcttttttgtgtttgagatgcatttgttggggctttgaggacaatgggaaaaaacggtgaacaaaataaatgatggaggtaaaatttattaatattttttttcactaggctacgccacgaaaagaggagatcatagttgttatttattttgtattatttttggaggttcgccaagtgaaaaaaaaaaaaaatttgccacacaaaaatcaaagacatcaaattaaatggactttgagccaggcacattaatttgctgcctctgatgatcagcaaatgccatttgttcgttggaagcaacaaaaaaagatgcataccgtatttcctataatagagccctgggggttttatttttcaacccccctccccttaaaaatttttatttcaggggacgtgccactaattaaggcgggagaggggagggggggggggggc

SEQ ID NO: 18709 - DNA, 733 bp, Heterodera glycines
aataggcaattaattagctaattacatttggttgactttcgtgtaacgaaatcggccaaatttggttggagtcgggggtcagcgagaacgccgtttcgggccacgtgcagctgatggagcccggcaaaaccgcgtgtttcgctgtgagtcaatggcattcgattgtcacccctacccaattccccccccctttctttggcagtgccttcctccgctcgtcgtcgcctctcaaattgatgaacgaactctgaaaaaagatggcgtctgcgcagcgagtaaactaattggatttggaattctattttcattggcattggcattttctacacaaattgttcctcctccaacaatttttttgtcttaggtttgccgacaacaatggccatcattgccggactgttagtccaaaatgcgttgaagttcgtctgattattgttctcccctttactttccattctctttttttaggtttctgctcagttttggcgaagtgactccgtttttaggatacagcgcgtaaaaaacaactttatttggttggtaatccatacaatttattaagtttggtggatttcttcccgaaacatgaaatccgaccgaatccgcaatgcgacgactgtttctgtaggaaaagacagcgcgaacaccgagtaaaactggttgggggaagccaagggacgacctttaaatggggtggcggatgacacatggggaaagcattttgggggggggg

SEQ ID NO: 18710 - DNA, 1774 bp, Heterodera glycines
ataattagggctgggatttttatgtgctaaaaatcctgaaatatgtaataaaatatgtgctaaaaaccaaaaaaaaaggcctaaatatgtgttaaaaaatgcaaaaatatgtgctaaaaattggaaaaaccaagtgtatttacgcaaaaaaaatcatatttaatatgtctttatcaattttcgcccgacctccaatcaaaattttggcgatatcaatcaatttgtaaagtcccggattaatttttccatcagttgaataagttccttccgggaactttgaaatccagtgacgatttaacacagcgtttgatttggctgctttaggcatttaaatatataaagaaattttctaaatgctaaagaaacgtaaagtagtcaatttttagggtgcattttcagattttcttgtattttttttacgatttttctcaaaaatgccaaaatatgtgcaaaatatgtgccaaaaccccgaaatatgtgacatatgtttttatgtgccaaaacgccaaaatatgtgtttttatgtttttataactcctctaaatcaaaaattgttaggagaaaatgctatttttgggcttctctcgccataactgagccgcaaaaaaaatatgttaaaacataaaaatcccagccctaataataatttattagcattgatcaatgcaactttaagcgaatgttgtgttaattgacaataaataaatatgaatttttgtggaatcaatttaaaatagaaacaaatcaaatgtgaaaaaatagcaatagaaatttcaataaaattggtaataggtatcaacaaattgtaatgtctttgtgtcattccgtcgcctcttccttcagaatttgtgtctcacagagtgtcgtgtaaatccctcctctgctcatcagttcgtcgtgcccacctgtgtttgggtgagcaaatgtttttctttggtctttctctgcctctgctaaccctgctcgacgactcggccgtctttgatcacgaaaataatgtccgaattttggatggtcgacaatcggtgcgcaatcacaagacaagtccgccccttgcgggcattttccaatgcctttttgacggcctttaaaacaaaggaatttcctccctttccgccccattcggattgattgccttctcattttccgtgtcaagtgctgaggtggcctcgtccagcagaagaacggtcggctctctgatcagtgctctggcgatggcaatgcgttgcttttggcccccgctcagttgggcgcccctttcgcccacccgcgtctcatagcccaaaatggggcaacaaaacaaacattaaggcaattaattaggggctaattggtgggcggtcatccgccaaattatgctgttccgccaatcccttaactgcacaccttcgggcagtcccagcacgaaattgtgcacattcgcctgctccgccgccctcacaatttgctcgtgcgttatgcgttctctgtccgccattccgtaagtgatgttctcgcgaattgtgcagtcgaacagcgtcggctcctgcgaaaccatcgcaatttggttgcgcaatctgtgaatgtttatctcctcaattggaattccgtcgatcagctgaaattagcactgtctttgattggtccctcccttttccatcctttcgttcttacaatgcttccccgggtgggcaaataaaaccgttcgagcaaagccatcaccgtactcttcccacagcccgaatagccaaccaaagccacggtttggcccgctttcacttcaaaactcatccga

SEQ ID NO: 18711 - DNA, 1407 bp, Heterodera glycines
agcaaatatcagtaactaaaatagtgcaaatgacatgaaacttacattggataaagcacccttgaacatgcccttgagcagtccctcgtttttgatgattttgatggcacagtccaaagtgtctaaaacaaaacaaaaatcagaacaatcaattgtgggaaagtgagggaaacgcactcttgtacatgatgtccttgcggcccgactgcatcatcatacgacgacggacggtgtcccacgggtaggagagaacgccggacgacacggtgacgacctgcgcaatggcccagttgacgaagaagttcatctgcttgccctccggggagaagagcattttggcggtgtcgaagcagccgaagtaagcggcgcggtaaatgatgatgccctggacagagacgaagaagccgcggtagagaccgatgggaccgtccgacttgaggattttcatgatgcagtccgccaaacctttgaactcacgggcatcggccctaaagggacgttttatttaagtattttttaaaattttaatctcactttccaacatccgctgccaaacgcgttcgcgcaaagtccaaagggtacacaaaacacagcgaagtggcgccagcggcaccgcccgaagccaaattcatggcgaagaacttcaagaactgcttctccttgtccactctagatttaactttcatttaaccattcaatgttgaacatacccttgcgtgaagactcgcttataagtgtccttgaaggcgaagttcagcgcctgagtcggaaagtaacggatgacgttggccaggttaccacgccacaacgacagaaagccctgctccttgggaacacggacgaggacgtcgatgatgcctttgtagcgtttgtccgcggtgatgtgaatggaagcatcttgcacctaagcaatacaatagttgaaaactgtgatacataaaggaaacccgagaattgttttagtattagtaaaggttagtaatcccatgccataaaggccggcactacctactgacaaatttctttcaaacctgcaacaacagcttgacacgctcgatgggtgcaacagcggtttttgagactgcagcagcagttccgccggatgcgaggtccaacaaaaacttcttcgtgttgaatccaccgctcttcttcttttcagcgccaccttcggacttattttcggacatttttactacaataagaatttattacactacctgaaaaaaggaaaatgaaaagcaatggtcaaaaatgaatttcaaaaaagttcatgcgctgcaattaacaaaaagtagggtccattgttaagtaaaagttaaacattttgtgataaaggagaatctatctgtcggccaaccctcctcttttttgcttcacgtgaaaaaatttcaagtcaatgagaacgaa

SEQ ID NO: 18712 - DNA, 2617 bp, Heterodera glycines
attagagtgcgccgggacagggaattttgggcaaaaccgggaccgggccttgccgggacctgagaagccgggaccgggacctcgatttttgttcgggatcggaaccgggaccaaccgggaaatttcaaaaattcaaaaaaattttaaaaaattcaaattttaatttttttaaagtgaaaataatataaaattatttttttaattttatttttattttataaaacccaaaagttaaagctaattaaattaatgaaaattttcaaatcgaatttacttttattatttcaaacaattaatcaatttttgactcaaatgatcgaatattattagaaattcagatttgcttttcacatcactttatttcggcgcgctttttccaaaaaacttttgggaaagaaagggggtccggcggtaccgataggcgccgccgggggaaattttgaaaatttgagtgcaatttgttaacagattttcaacaaaaaatgctgatttttgggattaataggctcattttgtactgattttctttaaaaaatgataaaatacaattaaaaaattgaggaatcatattttgtcggtaggaaacccatgaatatacaaaaagaaaattcaaaatattttagtttctgtaaagggattgaaccaggggaaagatgaagggaaagtcaaggagactagccactaggccatttttacagttggtactactacttttatcaaatatcttaattattatttcaaaattttttcttttcactccaattttattcactaatatttcactcagaccctcattcctaccagtgcttgttccgggacctcggatgaccgggaattcccggcccggtcccggtcccgacgcactctaatatatataattaattggataatgcccccatagaattggcaatccgcttgtgctttctccgcttgtcttctctccggccattttgtccccgagcattttggggttctgttttgacctaattgtctaattgctttttatttatccatttcacaccttttggcctgcaattttgtcgcctcgttttttctctcccctggttcgcgttcattaaccctttaattatgtttaattggaccaaatcatattttggattatatcgcctcgtataatggctcccatcgtgttgtctccgcttgtcttctcatccattattttgtctccgatacttatggagccattcattttgtcgccaggtcaaataaaaatttaaatgaaaaacaattaaatcaacttttttagggtttttgaacagtctcgtaagttttcaatttgaaaatccacatatttcattttcctgtcccagattttgagtccggccatcttgaccccgctaataatgtccccccagttgttacatccggccattctgtccccgctggtgctgaccccggccattctgcacccgacagtgatgtcgcccactgtgctctccccgttcgtgctaaccccgcaaattttctctcccaaatttctgggcggtcttttcctctccccctacgcactgtcccccgtttttaagtcgccccttttcgtttattcgatcgttttgtcgccgagttggctgagctgatcaaaaattgccttcataaatatttgttgttttccaaaaattttatacagaaatttaattttatttttcgtattattttattttttttcttcttaccatcttttttttgtacatatttttttcatacatatttattaaaaaatttaataaagaataaaattgcaagggaaatacccaaaaattttacaatgtaattttttgtattttacgagtgaatgttacaaaaataaccatttctacaatattttacatgactcttaaatatcggctatgtttaattaataatttgcattttttcttattatatttttattacttttcgttcgaattcgactcaaatgactgtggtttaaaaaaaaatatttttgatttgtaatattttagtgaacagttcatttctcgttttccattttcggtataaaaatcatttcacgcatatccaccaaaatcggtaatttgtggatttacggaaaattttgcggtcgagatttccgagacttcgttaataaaatttcaataggtaaaatgtttaatgatgaagaataaaataaaaagctggacacttttaattttgcgggaaattacaaataattaagggaaaagataacgaacgagggaaatgacagcaaatttatgggagaaatgacaacaaaaaacgggaaatttaatagacacatcgccaagaacattcaaatcggcataactaaaattctcttggcgtatttgcaagcaaaaagtgctgatttgaataagcttaaaacacactaaaaagcattttatttggcctatttggttccattttagcaactatttggtaaaattatcataattggaacaccgtttaaagagttcttaattaattaaagaactccataaagataagcaataaaaacattcaaatggtttcaaataatacaacaaaaccacaaaaatctcaaaatttaaattttttcttggggggtttttggagtcgttctgcacaaaattctcccgacatctttgagctcccaccaattttt

SEQ ID NO: 18713 - DNA, 1339 bp, Heterodera glycines
  misc_feature (13)..(13): n is a, c, g, or t
ttgaatgcacacntgcaaaagcttccgtagctccacggaagttcatttggcatatgggccggctcatcgataccgattttgctgccggactcctctttgcactcgacataacaatgtccaggccctttgaaagggtatttgagtgcatattttatatttgccttgttaccgtacgcaaatagtacattatggtgcactcggtaacgcagcaaaatgtatgggttgtacggcacgacctgtgagttgtcgtatattaagccgttaacctcaatttgggcaccaccatcggttgggctaggccggtaatacaacgcgggcctgtctgggtgcagaatcgtacatttcgagtacggggctgggaagccctttttacaccgcccaaagttggggtcacgtggaccgcaccaactatcactgcatctatgcagttgcatatgcatcaattcgcggatttcgcgatgcatttgtgcaattggggagtcatcgcctttgtctggcaaaggtggaatatgagcccatatgtattcctggatgacttctgggactgcgtccaggtccgtctgggctacaatgtgtgcgtgtgggccaccacgcccttggaactccattgactcgcctgagccaaggattgttccgaagaaactcttttcatagagctcctggtggaaaacagcaattttgctggaccacacacgcatccacatgtcaaaacggtcagtgaacatctgaccatttttgtaaatgttctccttgaactctggccactcacggttgttcgtgaatgtgatgaagagccgcgccttttttgggttatggcaacgtgcaaaaatggtgttacagtcttcatacctttttttccaatactgaagcgaatttacattcttttcagaaaggcgaacaacactgccaatgtcatcaacactcttttgttgtgcattggggttttgccgagcttgctgcttattgtattggttcaccaaataatgcagcaaattttttggagtactaatgcgcaagtccatgtctggacggcgcaaaaaagtggcaatttgccagtcaatttttgcagcttggtctaggacccagcgctgtccaagaccaccaccacatgaaagaatgtggtggtattgccactccaaattttcatcccttattgcgagatggtacttgcagtaatctcgcagagaaatgaattttctcgtcttatcgatgcgatcaatcaatgattcggtcgatgcgaccgactcagcatctgatgcatcaattgactcagtctcgcatgagccatcatcggacattgcaacagagtcaaacatttgatcgacacattgatcgcttc

SEQ ID NO: 18714 - DNA, 2201 bp, Heterodera glycines
aaatttggaaggtgccgctccgttcagagcaaccggcgactgtcgcgcatgtccaaatgccggtaaaaaaggggttcaacacgtaaaacaacaatttctaaaactcaaatattttatgcattaccgaaaaaatgggcatttttaggcttacatagcgaaaaaaaaagacattttatatttggtaaatttttgaacagatttgtagcgaaagtttgtccagaaaattacatgaaaataaatttaattaaaaaaatacactctctaaaatcaatttaatttactaaaattccttttttttaaaaaaaaagtcctaaattttatataattttaatcataataattaaaagcctaatatagcatatttaacaaaaatttgtgccttacttatttagaacactgaaaaactgacaatttttggccaaattttgctatattttatccttgaccaattaacaatttttttgtgtttagtctcaacaaaaccaaatgaattatggcaatgccaatccggcacagtttaatttttatccaacggcgcctccagtgcaacgcggagcaccatgaaaagcggagaatggagcatgtacacggatttttagttgaagaaaaggattcacgaacggggggacatatagaagactattgtagctaaattttgtgtggatttccttatttctgcataaaatttttttgttgatgtttaattggtgcctgttgtgacagaagaccccagacaaaagactcactccgacaaaagacctatggacaaaagactcataccgacaaaagacctatggacaaaagactcataccgacaaaagacctatggacaaaagactcataccgacaaaagacctacggacaaaagaaccacaccaactaaaaaccattcacgtataaaagacgcaaaaaaacccattttaattaaatttacaggactcaggttacccgaccgagtcagacctggatacccggattttccaagacccggacccgacctttttaaaatacaatatgtcgtacctgacccggcaggtccggatccaaaaaaatgcactgccaagaatggaagtcgggtcaaatttgagggaaagaaaaatttagaaaaattaatttactatataaatacttttactttcttttaaagtggcgttgtctattgtctctctctgcttattgtcaatatcaatttcttcacatagcgatgaatattaacagctatgtttaatatttttgttgaaaaactgccacagtatgcaagaataataaatttatatgtttaaaaatttattagacaattttaaataataatttccttcctttttaaacgcctaaaaattttttttttttttaaagacaagtctattaaaaaatttgcaaaattccatccagaatccaatgttaatcgaaaaccttaataatttaatccaaatttttcggattttctatggtggcatatatcgacagacatccccggactacactaaagattttaggaaacatagtgctgcaaaaaaaaaattgaattttttagcaggcatcacctcatttgtcggaagaatatttatatcaaaaacgtcataatttacccgtttttcccaaaaattaccggttacgtgctattcaatttgaggaaaaccaagaaaacaaatgaaaatttaaaaaaatacgatttcgagagttttgattttttaaaccgttgattacagtattttagctaattaatatcttattgtaaatggagagaatttttttatcctctagatttataatttatatgtttattacatattcataaatgtttatgaacatatttgctagattaatgctacgactcatttgtctgccttttttgaacacaggaaggcacagaatcaatatcaaatcaataaagcattataaaattaaaaaataagcaaattttattattttgttgcaaaattaatatgtggattgtctttatttttattaatttttttcgtaaaaaaaataaaactttaaattaatttagatttaagcatatttggctaaaaattttacaataaattaaattatttagttaaaattgttttggtttttttaatattaatttaagtaagataaaaaataattttctttttttttcattttaaaatgtaaaaaatcacgtaactttttctggatcatcccatccataagtataaatccatttaacaatgtgc

SEQ ID NO: 18715 - DNA, 1642 bp, Heterodera glycines
tatattttttaaaaggctcaaaatttttatatattttatgtttaatgatgttaaatcaaagacagtttgtatataaatgtatttatatacataacacataaaatgaatctgacaaaaaagaactgtataaaaaatccgaaacaaacataatacatacagtaaaagagggctatcagataaaaatttgaaaatcataaatatatgattcataattttgccaaatgaaaaaagcatttgaggccaaaaatcatcattttgatccaaatcaaaaaatcaacaaaaaagttttttgcggtgcgtttttccaagaaaactttttgggaagcggggtccggctgtgccatagccaccgcctggaggatttttaaaatcgattttaggtccattttgcgcttagaaatcatcatttcaaaaataaaaaccgtcattgactcgtaaatcaaatcaatgatgataaatctcataaacaaattgtaatatatagctaaaatttttgatccaaatttttttatttctatgttctttcatacataaaatcatacatatacaaggggtgtctcgaaacacccccccccccccatcgttcgtcgtaagggggggctgtaaaagagggagggggttgtcgtggagggggtcgttaacgaaggaggaaatttaaaattggcacaattttcttagcgaaatccatacaaaattttaaaaaaaaattttccggcggcgcctattggcaccgccggaccgcccgccaccccttcccgcaaaattttttttgaaaaacgcgccgcaaaaaaagatggtttgaatagcaaaaaaaggtcgccagaaaaaagcggtctgaatagaaaaaaggtcgtcgccggagataaattaggaccttcgtatgaaaaatcggtcccgagacaccccccccccctgtcccaatcgtccgtcgtatagcccttgatctgagaaaccctttgtatatgtatgaaccaaaccaaaaattataataaaaacggtttctgtttttaaatcctctaagctggctatactttttaaaaattattgacaatttcgtcgattagtcatcaaattttcgaaatttaagttttatttcgtttgtcgtcggcattaccaatgcagaacaacaacttatcatcggatgcaaaatgaaaaaatttattttatagtcaaacctactaaaatttcataaattttcaataaatttaattttttttaattgcaaaattaagttttcctaaagttttgattaattttcaaaattcttataaatatgtttagaatgatattattttatagaggaataaaatgatttgagggaaggaataatggtttaaatcccattatggaaaaacagggcaacttggacgacttggtctctcggctgacgcgcggcattggcatcaccaacgaaaagttggaccacctgttgacgcgcattgacgcggtggacgcagcggcggaacgtggcgaacgcattgaactgttggagcgacaggtgcgcgaaattggggacgacctgcacatgctgaagccacctattgacgagctgttcctggacgtggacacgctgcggcaacatcggcacgcggacgcggccgacttcaacaaacagtgagcggataatcgagggatttttaaa

SEQ ID NO: 18716 - DNA, 1575 bp, Heterodera glycines
atgacccaccgggtaaatctcctggtaattgttgatgagttcggctgaccgatggcatttgaaagtgaaattgtccttcgggtcctttggctgcaaacattgaatcgccactcgtcctaaaaagcgaaacatgggaaaattacgattagattagtaatttgccttcggtggagccaagagcgaatccattgggctgtcccgtcattttgtctttgaaaatcgcaatgcaacgactctaaaatgaaaacgaaattcgagagagtaaaaggttttgcatgcacctgaaacttcaactgagattccacgtcttgaatttcagagctaaatggaaaaaagaatgaatgctagaaagctctctgaaaaactcacggtgttccgtccaacttatacattttgatgtgtctgtcggccaaagcaacgaccatcagcgggaaaaccatgtcggagcagtacacgcgttcaggcagttggatggttgccagggagttttgggtgggcaattggcgcatgtcccaaaaacgcagcgtccggtcccaacttcccgtcattagacactgaaaatgttgaacattacattcaaattctatagtggttacagcccctccaccgccaataccgaatattggggtgtcgctatccaatggcaacttcgcactggctcattgtgcgtgccaacaacagccatttggtttgagcctaaatcccaggcgaacgcttgtttgtctgcaccagcgatgaatatttttgagccgtcctggaaagagtacattttttggaaaattttcaagtctgattacaaaacaaaaaattacgacctccgaccaatccagcgaaagaatgggcgctccaacattttgcattgccttcggttcaaccattccattttcattgacctgccaaatgcgacaggtgttgtcccaggaaccagcagccaaaaaaatgggagacccggccaccagcggattgaatttcattgcctgcacagtgtcatcgggagcttgtggaaccttagaaaacaaactcaatcgagccaattgcagcaagtgtaaaagcagttcgcacgagttaaaaaacccaagatacatttactacatattttatataaatccgaatcgaaattggcgcgacattcacacaacaacacatgctgtttcgtcacctcgatgtcctgctgcgttgtggtcgaagtgctgggctgcacaactgcggtgttcgcagcgccaaagagaccaccactcggcttgctgccaaaaggcgaagaagtgccgatggacgaaccaaacaaactcataccagaattaacaggacacacataaaatgtcggttaaaaaagtcagatatgtaagaaaaaatcatggaattgctaaagaaagacgaattactttttttaaaagttttcagaaacaatttatacacatttatcgatgatctgccaattttcctcgtttatgtgattcaattccgtcgcaattttagccggcgactgcttttccctcctttcctttttcctctttcttctcacttctttacaagccactgtgaaattttataatcaattcaaaaataattttgatt

SEQ ID NO: 18717 - DNA, 976 bp, Heterodera glycines
gaatggtggattattcggctatttcgctcttttcccgcattgtctgtcgcttgttcctttggaggtgagttgcgctgcttttccccctgattttccagccgagtgagtcgaacacggcgaatgatgtaattcggctttgattcctcatgctcaagttcgcattcccaattgttaaatgcaatttttttctcatcttttgaagggaaataagagtgacacctaaaaagaaataaataatccaactattaatgaaaatgaaatttttatttaacgaacgttgccgatttcttacttgacaaagcttttttccatgactttgctgagcataatgcagattgaaactaaaacgagttttattgaatgtacaatgagagctgaaccaaccttcttgctcaaagatcatctgccaaaagtcacaggtggtgttgggcagaggtccctgggtcagaatgtaattgcgatgcgcaaaaggcaaatgcaacggggaagcattaatgtacgagtcactctcggaagaaacaccgcacctcagcattattctgttctggtcatctgacaatggaaaaaaacataatcgtataacacaagaaatattttataaaattgtaattttatacaataactccatagtaatacttacatggcaacacattccgatatcggtttttctcatgaaaagtgttggacagatcacagcacaaactcagctttttcgcctgattttccgactccacattaatcttcttaaaaaagtaattttcttacttaaaatttgcagaataacaaaaaaaacggacatgaaaaacctgatcccaactgtcgttgcgttcgtactcatcaaatttgcgcaaaaaatacgcttcgtccattaagcgaaatgtgagtggcgaatgtcgagggatatataaagacaaatcagaggacaatagtcgttttggaacttgtatgaattgcgtaattcgaggatgaatggacc

SEQ ID NO: 18718 - DNA, 2030 bp, Heterodera glycines
  misc_feature (1391)..(1391): n is a, c, g, or t
attcgaaggacggatatagacaaattggtttttctaacgtatggattcgggttttaatatgagtttcaattggcggtacgaattcgggttcgaaatgagttttaactgcagccggattggtgatcagccatttcatttgtttactaacccatcagcaaaatttatgctaaaattcgctttttatcgcaaattgattttttttgctcaattaatcacattattcggattcccccgtcccggaaccgtttaaaagcatatttatatcgacagttaaattcaaaatcaaaaaatgagagtaatctttcgtagattagatattgcacacaaaaaattacaagtgaaaaacaatcaaaaaactgaaaatttctctgcgattcttcccccccccctcattttccgtccatttcgcttccgttgtcgggacgcattttctttgatgtcggagtccgcaagatttcctgaatgtgctgcacaatcagatcaatggccacgtcgttttctgctcctcgcggaatgattacgtcggcgtactttttggtgggcaggcaaaagtcttcgtacgccttaaaggggagggacagaggtcgttttcccgaaacatctttttttttttaatatgagtagaaattaggtagttattttccgaatttttaaaattggggttttttaagaaatcattataattatttgtttcaatttttttcaaaaattttggtgaaaaaaacttggaatttgggaatttttattcattgttagttgtttttcttcatcagcagataatagccttaaaggggagggacagaggtcgttttcccaaaaagtttcaaatgatttttaagacaaaaatgaatgaattttttcaaattaagtagcaattagggaattgttttttaaagaaattattaagtgaacgccccgtgaaaaaatgggtcaaatggtataccaatcgattcatctcaagaagctaagcacggaaaaatatgtctcgagttgcggaaatgccaaaaaaccgctttttgaaccggttcaaaactcgaaaaattgagagatttcgcactctaacttacgatcaaattccgacaaatttggtaccatttgaaagctcttcaaagcattgttttgtgtggttaagcatttgccatttcacacaaaatgccgaagtgagcacatggcttgggcttatcagcacacccgcgcactgtttgtacagaaactttttcgtgtccgccgtacaatagcgaaaggcacggacaaaaacaagccacggaaaacggagcgatcttcatcagcagcagcaagctgggcatgtgcagttgcactgctaacagtggttagctgacgagaaaatgcaaaattaaattaaaataattaagttgttaggacattttttntagaggagcatctaagctaaatataattttctcaaaatagactaagtttattgcctaaatttaaaaaaatagttttatccattgtttcattttttatatattttattatgaacataattttgatattttaattgtttaaaataattcaactcgtttataacgccctaatttatgtaatgaattaattaattaacatttggctgtgcttcatccagctcataatagtcggaagtcgcacgcgcacagaaaaaaacatttgaaataaagaaaacaatgaaaatcattaaagacaatcagcgggaggctaattagtaattaatagctttatctgcctttaattgaaataagttgaaaaaaactgtagttaaaatttgccttatgtaaaaaattcaaagaaaatgtcaaatattttgtgaatgaaaaattgaaaagatcagttgatcagatgattaaataataatagcgccaaaatcagtttataattggggcaaatgacaggtggtccaacaagcaaattaagcaaatatttaataaaagagcgtgggttttattagtgtacaaaatcatgaattaaaacaatgtttgttcgccatacagaatggctttacgattggtaaaagtgccaaattaattaattaa

SEQ ID NO: 18719 - DNA, 2091 bp, Heterodera glycines
  misc_feature (266)..(266): n is a, c, g, or t
agaaacaccgagttcattggctggtgaagtaaaagcatttcctaagattttgtttcagtttattttagactagtatttttttcgagtgtttttccacctgactgatgggactcgcactgaacatgttgatgttacccgtgaagcttggacttattggcactgtttcactgccctcttgcggcacagcaatcgccaaaggacattttcctgaaaataattgaaattataaaaaatacaccttaatatctctaggtttttttctttanaattgtgtaggttaaagggttagtttggattcgttttttgcagtaataatgatcatttttcagtcacattcagacctccgacttcgtcaaaatgccaacgtttatgatcaaaaagaaatttaaatctgttgattttaaaatgaaaaatggattcaactaattaagtaatattgtcaaaaaaaagttaaccgatagcattcacaatattttgaacattagcggcttcatcgacaaaaggctgcggttggatttccatttttgttctataatttaactcgacgaacataacaccaaaaggagttggtaattgtccgagttttttagatttaaattcatcgccaagctgagaaaggtctggttcaccgttaaataccttaaattgtaaaataggaatgcactatcgcttttatgaaccctgtaagtgatgacaaaagtctccgactcatgggaagggttttcttgtcgcacataatgacgataagtcggtgtaaagcgtgacgcaacgaccaaagacctcagcagagtggacaattggtggtagaaacttgtccgggcactttgcgtccataagccatgatgggctgaccaatcttggcactcagaatcgagtcggatgaccctaaacattacataatacaaaaggaatcgttcagattgcaaaaccaggcttctaatggcaaagtatcaccatcgtccgtgtacaaaatgaattcgagcgtcattaccgtggaatttggcggatagctaaaacaatcttttggatattaataatgagattaaattgtcaattaaatgactttttgccaactgtcgactttagatatgcagaaatttcaccaatctcatcgattacaatattgaaataatctgcttgttcaggatttggtgtgcaagggtgagaaagcattttgcccattcgtgcctgaaccacagcttgaaccattctcgaagaaaaaaagcgtaaaaaacttgaatactccttgaagtcattggattcgttgtagctaaagtttgcgtgaatcaactattggataaaaatttgttgagattttgtaggctaataaaaaactcttagagcattaaataatatcaagaatactaatttggatacttctagaaaagttatgctttaaatttgttattttatagtcgtgtaaattgttcagataactgcaatagagccaaactatttttgaaagtgacaaaattacgtcattttcactggtgttttcaaacgagcgtttcttcaattaattacaatgatgttttccagagagcgttcttcaataattacgaataagaatacatatgagaaataactcaattgacttctaaaattaaaatataatacctatttaggtacatataaattttgtatatttcgtaaattttttaaaaattctatttctttttaattcgaaaaacacactaatacgcagggatacctaatgcgaggattttgtcttattttgtggttttggtgaggccgtgttcaaaataagtctgagactttttgtttttttggggaaaacccgcaaaaaccaatctgctaaaaattcaaaattttcccctacggcgccacatactacctaatttttattgaaggagaaaataaaaattctgtacctaatccgaagaatttttttttgtgaaattttcaaaaaaatgccaaaatagtggcaaaaatagtgacgaaacgccaaaatagtggcaaaaaactattttagtggccaacttccgaaaaagtttttttagtggcaaaactccaaaatagtgattcctagtgatgaatagtggcgttataacgaagaatatccgaactaaa

SEQ ID NO: 18720 - DNA, 1042 bp, Heterodera glycines
  misc_feature (48)..(51): n is a, c, g, or t
  misc_feature (57)..(57): n is a, c, g, or t
  misc_feature (63)..(64): n is a, c, g, or t
  misc_feature (89)..(91): n is a, c, g, or t
  misc_feature (99)..(99): n is a, c, g, or t
  misc_feature (103)..(107): n is a, c, g, or t
  misc_feature (109)..(109): n is a, c, g, or t
  misc_feature (113)..(114): n is a, c, g, or t
  misc_feature (119)..(119): n is a, c, g, or t
  misc_feature (126)..(126): n is a, c, g, or t
  misc_feature (139)..(139): n is a, c, g, or t
  misc_feature (143)..(143): n is a, c, g, or t
  misc_feature (171)..(173): n is a, c, g, or t
  misc_feature (184)..(184): n is a, c, g, or t
  misc_feature (192)..(192): n is a, c, g, or t
  misc_feature (197)..(197): n is a, c, g, or t
  misc_feature (202)..(203): n is a, c, g, or t
  misc_feature (263)..(263): n is a, c, g, or t
tggcatccatttttggggggttttttcaaagaaatttcaaaaagattnnnntttttntttgtnnttttggttggttccctccaagcccnnnggccggcngggnnnnngncgcnnggggnggggggnggggagaaaaggngggncagcggaccacaaaaaaaaggggaaaannnggccaaacaanaggaaacngggcngggcnngaggcagcaagagcagggcacggcgaccgcaacaaggaccagcgagaagaaagaagccancgagggggcggaccccccaagccaagggcacacccccacacaggcgcgccaactgttgttcgcccgggacgagaacgactttcacgaagacggagacggagcagttcaacaatcgcatgacgaaattgccaaaatgtgcatggaaattgtgccaaacgcgacgacactaacgacaatggcattagccggcacaaaattgccaacaagttcgatgccatcctcggcatcatcatcgtccaattgggtaacgatgaggagcaacgaccacaaccaccattcggaggaaaacaaccgtcatcagcagcagcacatgtggcatacgcaacaactacatcatcaacaatatcagcagcagcaacaacaacatcatcatcaacaacaccaacaatttcaacagcagcaatatggccatggcacttgtgccaataacagcacaaataacgccaattattggcaaaatgtcgacaaatgtgacgacgacgacaacaacaacaaccacaattacgccaaaaacagggatcaacaacatgagcagttgagcatgtggatgcgcacgcatggcgtcattgaagctcatgagaccagcagcagtgccatggactgctggatgccggccaaagtgtcggcatcgactaccgctacgccggcgccaacgtcgatggcatcggcttccacaactccggcgccattgaccgctgtgccggcggaacacatggcgtaccagcggcagcagcaccacaccacgcatccgatgaacgccgcgcagccatgggcacagc

SEQ ID NO: 18721 - DNA, 1542 bp, Heterodera glycines
ttttctcttcaatttggcacttttattaatcacataatttgacattaaacaaaacaaaattccagcacgaaactgcaatcaccacctccgcgcttcaccaccattaccaccaccaatccaccgacatttcttcgtcctccccctcgctgcttcaaaagcagcagaacccattggtcgacatggtcaatccgccgagcaatggcagcatcagccaacactcgtcgacctcgccgcccagcctcacaaatgtgctgttgtgattgatattcgaaaataaatgcattataaaattccctatttttgtacatttgtgaatttatcattttagagctttattttttattgttttgttattttgctgttattaatcctcgagatgtttcctctgaacctttttttctgggctttagctaattgtttcccgagtacaaaaaataactgttcatatgttctaatatattcctatcctttctcaattaacgcatacctcaaaagcataaatcactgaatatataaattcatttattttattaaaataattggccaaaaatcgcgtcacagtcagctggggacaactcagcctaagacaactcagccgagaacaactcagctgatgggacaattcggctcatggacaactcagctttacgagatttacaaaacgcaactcatacaatggcttaggctaggcttaggcctaagctttaggcgaggcataggtttaggctttattttgtaattttttattgtacggctgagttgtccatcagccaaattgtctcctcggctgagttgtccccagcagctgactagtccagaagccgaccaaaaatattcagtgatcagaattgaactcgagaattgcaggacatgactttttggcctcttgctaactatgcttttccttgggtcgagattctcgctcgattggcttttcctattttattttaaatttgaaattgaatttaattattttattctcatttgccgcctattatgtattgtttgtacataaaagggctgttgtaaatgcaagtgcttgttttgttttttgttattcttcctctgctcttttgttctcgcgtttttttaaacgccaattttccgaaatgtgatacaatatttatttatttattcattcctcaatcattcctaaatttataaatatattgtcgagggtaaaacccaattagtgctaggccagatcgaactgccacgactcgcactgtttttcgataaaaaaaatcgctataacttttgtcaaagttgaacaaattaaatattcggcaatggtgaggaattgtggtcccgatgaaaaatcgtagaattaataaaagcaatttttctgggataaaaaatatgctgatcacgaatatgaactcagattttacaaaagccatcatttgtgtaagatttttcatcaattctcacaaaaaaaataaaatgcagccaagccgactcgaaccgcgaccccccctccccctcaagagacctttcaacactcgacgtaaacaaaatgactcgacgtcatgtttttagtat

SEQ ID NO: 18722 - DNA, 2308 bp, Heterodera glycines
ccagggtgtttctgggttacccgaaccccgataccggaaacccgaaccccggccttttctcgacccgaaccccgacccgatgattttgggtcgggtttcgggtcaaaataagcactggtaagaaagggggtctgggtgagaaaaagagtagggaaatggtgaaggagaaattttttgagaaaaaaaaaattaaattatttattttcatttaaagcattttgttcgtatgcataagtggtcaagtggctaaaccttctgattttattatttctcgcttgggttcaattccccactgggatagaatattcttcatattttctttaccattattttaattgaaattttaattaaaaaaaaatattccaactttttttcattcattttaagcatcctaaaaatccaaaaattaatcaattggtctttttttacaaattctgttaacaaaaaaaaaaattaatccggagaaagaaagactaagcctataaatttttggaataattttcgtttttaatcccgttaatttactatctttttggaaataaatccgtttttatataataatttattacttgtttatttctaaataattatgtttaatctttctttaatttatgatttgaatgatttatcgatatttatcgatatttatgccgtttcttttcttggaatgagcgtttaattttcttaaagttttcgttcgagttattatttactaactctgattaatgtaatattttttggttcattttaattaattttttgaaatatatagacattcgtttttacttatttttatagttttttattaaagcgtcaagtttgttttcttgatatcctaaatttagaattatttttgcaatttgctgccaattaactttttgtaatttttatcgcttatataatttattaaactcattttatccatattataatgagataatttttagtgctctttacaagcccaattctcacttcattttcttgtgttaatgacgaccgcacttatttttgcagtaatatctttactattatttaaaaaatattttttttttctctgagttattatgtttaatgctagaaatgatttttaaattattatcttttctcgggctgagtgttatatgtattttttgtttaaagacttatatgtgtttccattttatttttcgcaatgtatacgatgtgtcctattgagcaatatattattttttcaatttatttatatattcccagcctttataatcagtattcttatttatgtagagatataattttaaatgatttgagaaacattgatgctttctttttaagatcttttggtgtgtatctcaacaagccctgagagataggcatttgccgcaactgtttaattatgttttttctgcttttttctgttttttaaatgtgtcaaaatgtatttttatacacatttaaattgcaggctgaaagcaattaaaaatatgttttaattaataaatattttggtgtgaagaatttaataaaaataatacaaattggttgtgtggcggcataaggaaagatttattgcaagttctatattcatattattcattagatttacatttttatattatgtttgaattaaaatatttttgttaatgtaacttatttgaataattttttattttggcttttatagtacgttagattcgcgcatgatcaagtctcttggcaaccattgcgagaactctttttaaaaccctaattattttattcataatttcatatttatccaatgttaaacatattcatttaatattttaaaattaaaatgattgattgatagaattaatctacaatataaattcaacattttataaataaaatttgatgcacaagcatgacaaccgtcagacggtttgcaaaggcgcgctagatattcatttactgtacaagtattgttctaacaaaaataccttttttaaatatacaatgtatctgcaaaactttattttaaatattgaaatatttttaattttttttgatagtattgaaatataatttttgattatattaggtggacccgtaacaagatgcattacagattatgaatattatattttgttttcttttaacaaattttaaaatgaatatttaccttaatcaatgtataaatctatataaattacttctattacatcattaatattgaattttaaaatatttttatcaatattgaaagttttatttttaaacatagatttagtctgcgacgtttataatgaatgatggctgttttcgcagcaaacttatttaggctttctttgtatatataaacagcaggctt

SEQ ID NO: 18723 - DNA, 3224 bp, Heterodera glycines
ccaatttttataaaaaatagagttgaagagatacaacaacttcactcttggaattacacatcacttttcattatgtaaaatcagctgataatccggctgatttggcttcacgaggagcaactatgagtgaattaaaatacaacaaattatggtggaatggaccaaaatggcttaaactggaaaaggaaaattggccacctcacagcttttacagtcctgatcaagaagaggctccatatttagataatacagaggaaataattaacactcaaataaatttaataaaaaacgaatataacggaattatcgaatgggataaattcagttcatggcttaaaataactcgcatttgtcaaactttattaaaattcatatttttcaaattgcagaactctaaaaagtttaaagaaaaatttatttgctctaaattcaaaaatgcattacaattaaaaatcatggcacaaaaaatacttatacgaattattcagaaagaaatggaaccaaataaagaagaagaaagacagttaagaatttatctcgataatgatatgatactgaaatgtgaaggccgattaaaaaatgcacaaattcaaggtgttaatcctatttttctaccaagaaaacactatggaactcatttattaatcatggattatcacacacgaaatttacatgcaggtacaatgacaacattatcggaaataagaaaaacttattggataccaaagggaagaagaattgttgatcaaataaggaaacaatgctatcattgtaggagatataataccaaaccttttcaacaaccacaaatgccaccattacccaaatcacgagttgaaataacggaaccatttcagaacattggactagattatatgggaccaatacaaataaaaaatttcaatgaaaaatgctggataattttatttacatgcttaacaacacgaggtattcatctcgaattagtcacttccttatcagttcaacattttctcaatgcatttagaagatttatatcaagaagaggcacacccaaacatgtatggagtgataatgcagcacaaataaaacttgcatcaaaaattctaccagaagtgttaaaattaagagaaattctcaaagacgaatcaattaaaagttattttttaaatgaaaatataaattggacattttctatagaattagccccttggcaaaacggagcaattgaacgacttaatcagaatgtcaaaacagcaatgagaaaagtaatcggaaaaagatttattgagtttgattcttttcaaactctgacttgtgaaattgaagcgttagtaaactcacgaccaattacatttatatatgatgaaattaactcttatcaaattcttagaccaatcgacttcatacttccacataaaaatttatgtattcctccgattttggaaaatcaggaaactaaagacccaacatattacccaaaaaagacttcatacgaacaaacaattgaattatggaagaaaaccacgaaattattagatgactattggaaaatttggactgatgaatatataccaagtctaagagaacgttataaaatcgaaaacaaaaatccacgaaattgtatgaaatcttttccagaattgaatgaaattgtaataatacatgatcaaactcccagagcaatgtggaaaactggcattgtcaaaaatgtcataactggatcagatggtatcgtaagaggcgctaatatcgaacttccaaataaaacagtactaaatcgacccttaaaattaatttacccgttagaaattaattcaaatgatgataaagagcaagaaactctctctaatctaataattaatcaaaaacccaattatttcaacagaaaaaggaagatggataatcccttagtccctataaaaatgaatagactgtttcaaaactcgttaacaattatatcattattaacattaatttcattatgttcatcttattcatacgaatgtccaaaggaacctaaaatatggaaaacgagatatacaactctatgtatcgaaaacggttttacaatcagacaaaataaaataacaaaagaattttgctataaacaattggtatgcaaagacaaacatattattaaacgacgaccaccgtattgtggtaaaaaatgtaattgtcccgagggattcaaattttgtagtttcgcatcttataataaaatcaaaaatgaatcagttggaagaattaattaccaaaaaataatttcgttctacaaaccaaatatctgctcactaaataaaactgaaaagtgtccaaatatgcagagaaaattatttaattcaattgttcttcatgacaattcaattcatatggtgaaaactttaaatttacttttttcccaaattgactcgataaacaattttcgttgttttggggagggcaatctgacgattggtactccaatttactgtcgagaacatgactgttttaaaaataattcattcaaacaaatatatggaacgaaattttgcttttacgatccatacgaaaaaatttaccttgttaaatctgatgaagaattaattcaaatcaaagcatggggaactattgaaaaaatattttacttgccaaataatttaaatcaaccattcattgaaaatagacggaataaaagagaagaaaactcttcaatcactgaagaatcaaccattgagtgtttaaaaggaggcattattattaaagcaataaatgatatacaagaattacaaatttccattgaaaattatacaattataaaaaagaaccctcaaaaagaggaaataatttatttacccccaaaacttacatcctttgaatataaacctgtcattaaatttataagtaatccagataaaactaatgagaaacaaatcacatgtcaatcatctccccgtatgtgaattaattaactgtcgattttgtatggaatatattaaaaaaccacaatgtgtagaccagattccactgggcattaatgcttgtaattataatgataaatttatatggtatttcatttaagcctcccaaattattccaaataactcccccgttttatcccttgggattttaccaattatttttaattgtttttaaaagaaaaacccaaaagaaaaccaaattaaaatttcagaaccaaggtaaaaaaaaacattggtttaattaatcccttcccatttaattttttttaaaaaaatttttgtttg

SEQ ID NO: 18724 - DNA, 564 bp, Heterodera glycines
atattttatgtccttttttggcatttttccaaaaaacctctattagaacggccctcaacagctaaattggctttttgacccagaaaaaccggaaaatttccgaaaaaatcattttttaatattctcgaaaatattgaataaattttaattccttaaaatcttaaatttaggtcaaaaataagcaaaaaaagtaaagtttctagttgatttttgctaaaaatgagtaaattttagatttatcatttttttttcttctaaaatgatttttaatacccatatttagccatttttgaaagttttactttaatttagcgaatttgaaggaattttgaaaatttaaatgcaatttcaaccaataaatttgaagaaattttacactcaattttgaaaaatttatgtccatatttggagatttttgccattttatgtccatattttgcgatttttgttccatattttatggccatatttcgcgatttttggtccatattttatggccatatttcgcgatttttggtccatattttatggccatatttcgcgatttttggtccatatttttgg

SEQ ID NO: 18725 - DNA, 1636 bp, Heterodera glycines
aatgcagcagtggtttgaactaatgatattttataatcaatttgtgaattcaaaaattaattttatataaatatgaaaatataaattaaattgtttttttggtgaattttttacgatttcaggagcacacttgctgtgaatacgtatcggccttgtccagcattgaacacgaggcgccatcgcctggaggtgtacccgggttcgtaagtttcttcaaataactcatttttaatggatcaaaatattaaaaaaaaatcaataatttttaaagttttttcataaattttgtaaattcgaattctaaatgatcaattatttctattaaaaaaatttgtaaacacagaattaaactatcaacttctgatccaaaagatttaaaacttaaggcatgagggcaacgactgttttgtgtacaaattgcctgacgctggcactgacaaacaaacaaggccattattggatgagcagtacgagcagttcacggtgctgaacaatgttgaccatgtgccggtacagttggacggcgatgatcagcagcacggacagcaacagtttggctatcggctaaggctgtttctattgcgcaacaaaagcccaccagttttgctggtgaagagaatccatagggccaagtaattgaaattcattttacaaatttataaattatgcacatttgatttcagggaaggctttgaagtaaccatctgccgaccacgttgtagcaatttggaagaagctgaaactgttaagcgagaaaaaggatggggtaaaacgagagcgaatcggttgataagtgcaagaagaaaggaagaagaagaaaaggaatcaaagatacaaaaagaaaaagagcagaaaagagaggaagagacaaataagaaaagaggaaaggacagaagagaaaggaaaaaggaagaagcaaatgtgagagagattcacataaaaataataaacgaaaatgaagagaaagaaaacaacggaacggaaaaaggaggaaagggagagaaagaggaaaaaacaaaaggattaaaaaccggaagaaatacagaaggagaaggaaaagacaaaagtcacactgggagaaacacagttgaagagggaaaagacaattctggaaaaaacacagccgaagaaggaaaagacaaaattggcactggaagaaatacaactgaagaaggaaaagacaaaattggcattgggaaaaacacagccgaactgggaaaagaccaaattggcaacggaagaaacacagccgaagaaggaaaaggcaattctggaagaaatacaactgaagaaggaaaagacaaaattggcactggaagaaatacaattgaagaagaaaaagacaaaattggcaccagaagaaatacagccgaagaaagaaaagacaaaattggcactggaagaaatacagccgaagaaggaaaagacaattctgaaagaaatacaactgaagaaggaaaagacaaaattggcactggaagaaatacaactgaagaaggaaaagacaaaattggcattgggaaaaacacagccgaactgggaaaagaccaaattggcaacggaagaaacacagccgaagaaggaaaaggcaattctggaagaaatacaactgaagaaggaaaagacaaaattggca

SEQ ID NO: 18726 - DNA, 2973 bp, Heterodera glycines
gttgtttttcaaaataattatataaatagaaaaacttttaactctttttcaggcatttataatttctcttcgttataaaaaataaaatttttcatttatttagcattttacataaataaatagactgataaaatttgtttatagattaattatggaatatttaaagattgatttacaggaaaaattatatctaattgtactttctttatatatataatctcattattccatgctagctattgactcagtttgctgaatcgttcaatgttttttttaataaaattttatatagtgcaaacatcttggcaagatggtgttaatccattgtgattcattctaacggcgaaattgttatgcatattcacagaggctcagtgaactggttcttatactatgaattaatttacattttttcaaaatatattttaattcaaattttgaataatcgaattaattctttttttattactctggttgagaattatatttaaaagatttcaaaaacgaaaaaaaaatgaaaaagcactttttatataaattcctggcgcagcgtttttatttatgtacacaaaaaaattaactttcaacattaatcaaaaataatgataattttgaattttaatattcgcagtgtatttcaatataaaaattctatattaattatgtatcaattaaaattaataaaaacattatttattgtattatttagtttataaattatattgtatttacataaataaatattgtcattaatggtgtcattgtaaaatcagactattttttatttaatatttaaaagtgtttaattaaaattctaatgaacttacatatttacattttcaattgatttttggttacattgaatttttatttatgtatactttcgccatttaatattttaattgcttatttttttaatatattatttcttctgtcctggtaatggttatgttagagacaatagataaatttaactataaataaattaattttattatgtgtaagtctcattacgatgaatcattattttattgattttatacacaataaattgtttcgacctaaatcatgactttttatttttacttgataaattgcctgatttaaaaatcacgtatatgggatcaattttttaaattgtttacacttattttttaagatggtttgaaaaaaaatatcaataaaatatgtttttgcaatagttcttttgtttgaaaacattttttttattataaactgttcaatttaaattttttaattcaaaaaataattcattaattagatatgattaactttttattctgagatcaccaacactaagtatgacaataggaaaatgtttcttttattggtcatgcttttatattagtcgataagttatttttaatcagacaacgtgaaaatattaaatttattgatttaattctgctagaataaaatttaatttttggattattatttaaatactaaaaaaccatataatttttagctttcctaaaattttatttacatttatttatgattttttgttatggttttttgttattactttattgaatcgataattcatacatatatttaagaaaatttgtattaattataaatgcaattaattttccatgtctgcattttctcgagatattgattcatccatattgctctctttttatcgagtcaatttttatcacttaagaagaagaaacaattaaaacaattctatgaacacataagttattatattttgaatcgcatcccattactctatgatattatagagaaatttaattccatatttgttatcttggtaaatataattgaagtatgcttaggttgttataatttataaacttttatgtcgatcagtatcaattataataattttttagttgtaatttataaattaattttttcgctatgccttgaagccatctttgttttttccttttatctttttacattttaaaaaagcaaatttatgaattataataacttgtaatatattctggtttaaattattattattacattattatttatgataaaatttattttaaatgaataaagagaatggaaatttgccaaaattgaggtaaaattagtacgtaaaataaacaccaaatagttcaagcttgaagcttctaaagcaatattactttataaaaattcatacaaatattaggattatttttaataatacgaaaataattgacaactacaacgatattgaacaatacatttatttttattaaaaataaaaaatgcaattgagaaaaacaacaattaagtataaaaattctagcaatctttaaatttctgtcataaaatatccaactgttttcaaatataacaaaaataaaaatataaacgactcagtaatacaaagtaataaagcatgaagaagcatttaacaaaactttttaagtttattaaatataataataaaaatttgaatattatcttgagaattaaaaacctacgatagtaacgatatccgaaaagtgagtatattacgtgttttacaccctcatccttaataaaaaaaatttatatgccttatttttatgcctttttgttattttcttgccttttcgtacttttttaatttcattaaatcttaacacttttatctctttatttgttatatattttaattttggcatgttttggaatgatttgtattttttgtaacctgcattgtttatttgaagaaaaaattattaaaataaatgaagcatggtctttctaattgtgttcaacttcccttataacaattatattatgtcttatttgtttatgttaaataattgtttattattattattgtagatttcaaattaaatttctttaaagaatcatggactactcatatcttcttgactttttgatctctataagtagttagttaccctggcgagtagcgggtgctgataagatgggttgcggtttctttgaaggtgccgctgtgattaatga

SEQ ID NO: 18727 - DNA, 2489 bp, Heterodera glycines
  misc_feature (151)..(151): n is a, c, g, or t
cgacttggaccagctccagtagagaacgattcatatttcctaaaagacggcgacttaccatgtccggccccgcaccggttgaaggaggattaaggggcggtgctgcgggagtgtgctgggggatttaagggggggggggaggaacgggganggtgccggtgcggcagattgtgccgccgccggtggagcagttggcgttgtgtgtggcggtcccaggcgctgttgctgcgtcgttgcatcacggaccattggggcctggatgggcgccatgaaatttccatcggcgagcggacgagccataacgtaatttggtgcaccggagaggggataaagagggatatattgcggaggagggtaggccatgtcgttgttcataattgtttttgttatgttaatttgtggatgattggctacaaaaattcataaaagcatataaatcgttaagaaaaagagaaaagataaaattataacaaaggggctaaaggcagcctaattcacatagtttgggtggtcctatggttgcctcgcggcttaaatcttcgtgatcggcccctgctagccctggctgatcgggcaacagcgactcccgccgttgccggtgggcaacaaaccagagcaatccctgcgagtgagcagtatctgatggccagccaaaacaaaataaaccaaatcaagcaaacgccaatcgctaatattgcctggggcatggtacccactgattgaaaaagggcaaactttatttgcggaaaagtcaccccgccagtaatgaccccttttgccccatgagtcgaactgataggcgcatatttatcttccctaacgagaaggaaaatcagcgtgccctttaactcaaaataggtcttttcccccaaacagtcagcctggcaccgtgttttcaccacgggatgtggccaggacaaaaccaccgagcttggatgacctttaggggtacagcgcgtcacccacatggtgccgtcggcgcaattaatgctggcaaaggattcccccctggaggaagtacaagagaaattaaatcgccccccggttctgcagctgtggcaacccaacaggcggccggggttaatggtgcacctcgtaggggcatgttggacagctaagcgggtccttctcatttttacgattaaatttatgggggaatacggaaatatagcccacaattgcccatttctgtaaccaatctgcaactggccaagtgtggtcgggagtcgcagaagggggtcacccatgacccgctccaagtcaaattgccgtgggcaataacacttaaccaccgccgactcatggtgtacgtaacatgagtggcatgcctcaggtaagagtgagcagttgaggtgaaaggcggctaactccgtcggacaccaaagatgggtgggccgttccggggctaacgcagcatgagtacggtttgttacaaaaacattccccaaaagtggtaaaggtgggaggccgcttggggagaaagtgatggataaattagcatagggccagtgatgagtgattcccgggtttagcgttatttcctcggcccgtgacgaaccttcaatgtccaaaatgagacccaactgtaaatgaatttgccaagatgggcacttaaaaaactcatagacgaatggggccattggttccgcgtaaatacgataaaagaggcacgcatatgcgggagataagcagccttggcggatgaacccggacgcctcccggcagaaattaagacccggaaaatcctctactaattctgggacggattgttcgggatccaattcagaacaaaatgtgcctgcgcacgacccggctgtagggcagcgtaggatcgaggatatgttaacacggtatgagcgggtccaaagcttactttcttttacacattggagggataagccctttaaaataaaaaataaactgcccatgggtacggaatgaggggtgtgaaaaacaagctccaccttttggccgactggtagcagtgtaagtgaagtcacactgtcaaaacggcactgagtgctgccgtgatcgacaacgcactcttccgtgtcggctgacacggacaccacttctagtcccgcttttatgcatgggataaaaaataaggcgaatagcagcccgagtaaaggaggggaaagtgcatatccgaagcgggttaagagtttaggccgagcagccggctctctttgagtccgggactgagttggcctttcttcagccggacctatttccctctgctggatgatcccgcccgctaagtccccgtgctgaaataaaacttcgtcctcgtctgacccttcctcagttatgacgcgactccgcctccatttggcagccggttcgggactgcgccggtttttccaaaaaatacctgaaaataacccggtccatcgaccccgcaccgcacttctttggacggtccacaaaaaacaaagaaatatgaaaatcacggcaccaattgccccagcaatgtcccaaggcaaagg

SEQ ID NO: 18728 - DNA, 3156 bp, Heterodera glycines
aaaaatcaaatcaaaaattgttggcaaatctttacataaaataatttcatttttttattaatactttttttatttgaaaagataaaattaaaagaattttatcattgtccatgaaaaactgaagaacataaaaattaaagctctgcgattttcttgacttgatcatatcagaaataatacaaacattaattgtggacatcagcccaaatccattgggccctgactaccgaattgcgtcggcattgaatggaaaacaatatatatttttagcagtgttttagaaatgaatatcaactcaatattaaaaaaaggaattgttatttctaattaatgcttaaatttatacaataatagaggactattataaaaattgaaacaaagaatttatgacaaaaaattaaatttaacaaagttaaatatcatttaaatagtaagacataatcaatattacaacaatttaataatttacgtcatcctagcaaacgaaatgttatcaatagttcctgaaacttagattatgataaattcaaaatggattacaaaggaatttattatttttgtatacaaaaaacaacaatattaattgataattttaacatgaatgaaatttattttataataaaatgcaaataaataatttaacttgaaaaatttgatataaaaattgctctgtcacgaggggggttgataattatatttacagttgaatttccaatattctcgtccagcaattcaccaaaaattatcgttgtgagcatgagagcgaaagattcaaaaaatgcctttaagacgaaaaattcatttgaactttatttagaattttatgtgacctaacatattaacaaattacgcggatgtaaaaataaaaaaatagtaatataaaacaaacttctaaatataatgtaaaacaaattatgttaaaaatccaattaaatcagtaactaaagtatttttatttctcaatgaataaaagtaattcttttaaatagaaatatttcgaaaattcctttataaaaacccgaaattaaaaaataaaattacctgatttaattaaaacttgtttttaaacagatttgaattaaattatttaaatatgttttttgagtgggttagcaagtgaatgatttttgatgatggatacattaaattccgaaatgacgatgatgattcatcgacacagcttttatttaaatattttactttttattagtaatgagcaaaaaattttaaaaataaaacttgaaaattttaagcatataatattgactaaagaaaaaatcaatgatttattatttgtggtttccagcagaaagtgacaatcaaaaatattgaaactgtcaactaaattaaagttaatgaaaataacataacacttctaattaattatatacattataaaaaatattcaaaatataaaatcaattctttattagtaaatttaatatattgttttacaaaatagatgaggttgtcaattaagcaactactatcgttttcaagaaattggctaaataacgacacaatttttatagaagactaatacaattgtaaaacttatttttcctatttgttcttgtaaaaaaaggaataaaaatattaattaaaaaaatatcaagtaagaataagattaaaaacaaaaataaatgtagatgatagtcacgaatattttctgattaatagtagtatttatttattacatgtttttcatattgttctttctcaatgaaatatttccaaatatatgaaaaaaggctaacacatgccctgttccaaaaattccgaatccaataaatccaattgactctcggtttccagaattttagaagaaataacaacaaatctaagaaacttagttggaaaattttttttaccaaatgtcaattgaagtatttaaattctattactaccagaaaaaaatcttcgtagagggaacgaaaggtaggcacaaatgcaatttcttaatttgatattaatttataaaaaataaataaattattgtcatgaaaaagtttaaactgaatgaggatcggtgctatgtcgatacttaaaaaccatcataatgggcgatacttaaaaaaccatcataataaaatttgggcgatacttaaaaaaccatcataatgggcgatacttaaaaaaccatcataatgaaatttgggtgatacttaaaaaaccatcataataagaaatcgatatacctttaattaattacaggttcctttaattaattatatgattacaatttgaaattacatgagttaattacaattttaaaccaattatcccttttatttttattattttcctcaaattcacacattttttatttggaaactttaattttaaaaaatatttcagccttgcttaagggcaaacaacaagcatttttacatgatttaatagccggaaatacgtcattaaaatatgaattagatttaattgccggaaatacgtcattaaaatatgaattaataaatgttaatataaaagcaatgtaaatttattatttggcaattcatttaataattaacattcctgttatttcataaaattttcaacaaagcctattaaattttacaaattcaatcgaaaatgatacggtaaaggtagaggcaaatgcttttattatttatttacaaaaacaatggattgataagtacgatgaaagtaacttatggaactttcaccggttggcaagaacgcggagtataaatccagcggaaagttttcattcatctatgaaaaggtgaagatatttttaaaattgcacaaatttaaatttatatagagcccatctgtaataaaaaaaaggaaccgtgaacaattttgtgaactatctacaacagctcgtttcagaaaccgatgcgcgcatttttaaattaatgacagataaaattaaacccagaaaaaaagggatcgtttatataaaaacattgatgaacaaattttgagagcattagatagatacaaggtaatttgtcgaactacaaaaaaactaagataaggtttaggacacacttgagattgaaaattcgcagaataatgggcaccagtttcaacaaacaactgatcgcgttcttgtacgcctcagctttcttctgcttagcttagattctaaagggaaaacgctaaaaacagtaaaataatatcggtaat

SEQ ID NO: 18729 - DNA, 2160 bp, Heterodera glycines
atcgtcactgctcccgagttcgatcaggtcaatctctcttcttaaccgacgagcctatctcttcgatttcatcgtcatcgtccagttggaccaattcatcaaacgaatgatcatccaaattgactgattttactcccgttttaaccggggcataagcagcagcatccaactccttaaactcacaaaatcaaagtgccatctttctgtggacacacttttttgttcttttctatccgatccaatcgttctttttcaagtctctgtgcttctttggcttcctctgaaatcattgacgaatcgaagttcctaaattaacggaacggaaaataatatttaaaagcgaccgcacaaacttaagttttctcttccgaaaattcgaatgcgttgacgatggaacggtgttttcagttcgttttagcaacggagtaatggttttttcttcttcttcatcgtcctcatcagttttttcgtcaatcaaataaccgccgcactcgccgagaggcatttctaacttcacagatgagatcataaagaaaacagtaaaagtggttaattacagccaaaaaataataaattgtctaaatttttaattatagaacaaagcttttcttacatttcacacacgagactgagttttaatttaggttttagcctatttttattcgaaaaacattttgttttttagtggttatgaagatacttttcaagttattagtagagcccggacggtgattcaaaatgatgatacatgtgcgcaggatccggtcctgctccgggctctagttattagtacccattttctagattttcatttttagagcctaaaaatctaaaattttgaaaaaatctgtttgatctattttgacattttgcccaatagtacaaaaatgcattaaaacgaaaaatacacccctgagaatcggctcgaaaatcaaaatacacccctaagaaatgaaaaattctcattcatgttgtgtatatcactcaatattcaaatgtacgccatttactgtactcaatttcgtgtcaatactcatctctcagcatcgtccataaatacccatcactttgtcactcaattgcttcttcttccactcattcaacacatcattttattattcatttattcttcatccaccgacacaccaattttattatttattcttttgcctccgacaaataaactatttttattcttcgttgtgttcaccattgaacataacatttttggcgcagtcagcgaagtgatttatttttgtttcatcatcattttgcgcctagcatttggcgcaaatcaactttggctaaattgtcaacaattcgattggagcatctcaaattctttatttattttattctctcatcattcattttggtttttgcgaagttggttgtcagcagctcgcatcggtcggcacttcacctatttcactcattttccatcaatttcgacctttgcccaccccgtaacacatcggcttgaaacgtcaaggcaaaatcatagcccgctgaacgccaagcaagccgagaagcctttttgcaacacttacgccgtaaaaagcctctgagtgcactgttttaaggaaagacacatttgtgaaagtgtaagtcattgcgaccgctacactcagcgcatttgtgcatcttcccatcaccaaaggtcgtttattgatttcccactcatttttctgtgcctgaccaccactgcagcacttgctggccgacaccaagcaaagtcatttcaatctcttatcaccattcaaattcactactcatcaaatcattgctccaattgaattcaatttctgactaaaatggccgttgactttgctcaaatcctaaagcaattagtcgaccaacaaactcaagcatttcaaaatttgcttcaaaatgcccaaccaaatcccaatgtttccaatcattcaacaatttattccaccattaattcccaacttggtgaattttcattcaatccagaaatggattcaacatttcaaaattggctcgaccgttatgggcctttcatccaaattgatgggaaggacctccccgatcagatgcaagttcggctcctgctcggcaagctcggatcggaggagtacaaccgctatgccgaaagtgtgcttccaagcaagcccactgatttcacactggcgcaga

SEQ ID NO: 18730 - DNA, 2367 bp, Heterodera glycines
agcctaataaattgcgtagtgaaattttaaaaaaatctccctcctaagctaatgtttaaataatttaactttttgaatgtgcccgaactttttcaataaatcttttggagaaagcgacgatccatcgactttttttgccaatttccgctgctttgtttggtcatcaatgttcttctgcttaaatcaaaaataaataatttaatcacaaatttttggccatttaatttattaaatattgaaaattcggaagactttaataaattattatatatttttaatattttatgcgctttattctgtgtaaaaccaaagaataattagtgcttagtttcatttcttcgataaaattgttattgtttttaatgtttcttccccattccaataatttttcaaaacaatccctcacggggaaaagagcatttcccaaattactaatcgtttatctcataaataatacatataaaagaataaaatttaaacaaattttcacattttaaggaaggagcaccaaaattcgtcataattccgagtttaatttatttgagtaattattcactaattaatggccaattttctctacggttttaaataacaaaaataaaaaattaattaatgctttattttgacgtcaaatcgattatcgttttgtgttcccgggagaaagaatttatttatttattttcgcccgttttcaaaagtcgtaattcaattttatgcatttcaatgctttcacatggcaaaaatggggctaaaaatagcaaatttaaaaagtaataattatttaattacatcactaaaatattataaaaatagtaattctatttttagaaaaatgatttttgctttcattttttcttttatttcttccaaattcaacaccttcgcttttgccttattttggtgttttctcgttaataaagtaagtacctttttaatttaaaaaattaaaaaatatttttaaatttttatttttatttttattttctccctttttcatacgttgtctgatgatggtcagtcgaatctgctgacgaacccaaaagaaattgtcacatttttgatggacgaccaattcccgaagtttcgtgatcagaccaaccaatattgggccgacaccgttctcagttatctgaacgccctttacccgaggccggcaaaaaattttaaaaaacataaattaattgttgtattaattaattattccgttttattgccttaggcatcgctttttggtcattgttggttcgggtgccgtggcgtataataatcggttggccattacttttcaagaagggaataagtgagaaaattgagaattttaaaacgaaatttaattatttttattttatgccacatgtgaccgtttacatggcattcggagctgaccaatttgagggcagcaacaattgttacggggacataaacagcaaattcaacaggtaaagcgaaggcacacggaaatagtgggataagaaatgcgaacaaaaccatgcgccgatcagctgctacccggacatcaaccaaatcctcggatacattggcgaaacatgcggctatcccaagtcagaattaatattgtagaattagttaattcatccgaattatcaaacattttgtaggaattttttggcaatttttgctacatgtatcataatttgttgtcatggatttacatttaaatgccatccctttccgccgtcagtctcttaatccctgcaggtacaattccgagtcggtgggcattcgcgcagtgatcccggacaacgacggcaaaattggcattgcctggtccttgccgaactcagccgtccgaagggaagtgatcaagcggaattgtgaagtggggaaaaggcaatggcaagtgatcatcgcactgctccagaaaaagtaaagcaaccaaaaagtcaagacgagcaactaaaataagataaaaattgatattaaaaatgatttattttaatgatccatttggctattaccgctgattttttattttaaaattatttttattttatttttgaatttattattcactgctttgcgagttaaatttattctaacagaaacagcacagcaaatttcgtcaaagctttggcccaacattactcatacaattcttcggactcaaattgcattttgccaaacaccgatcactttgacgagggactgtggcagccgaatggcatttttatcgcaattttggccacggcattggcactaaatgttctgctggtgattgcgatgtgtgtaataataataataataaccttttaaaaagtcaaattgaagttttggcattgtttttgccacatttagttgcgttctgggaggttctttacactttgctcaaaggaattcggcacaggg

SEQ ID NO: 18731 - DNA, 2311 bp, Heterodera glycines
aaaaaagaattttaattattcaaataaatttaaaattatcatgaaaatattttatttctataattattctttgggagactagacaataaattattcattattaaattgaaataaaaaataattaatttttaatttaaatttttaggttttaaatgattttcactttttgaattattatttatttttgcccaactttgccaggtgctgttactgcttgacgacgtgcatttgctgcgatttggacgtgcactcggccgcatggacaacgctttacgaaaagtgctgcaaatttaaatttttaacaaaaattttttttggcattttttcattttccaaatttatttttttttttggcattttgatcagttatttcctcgcctgcacattgtctgcacgtccaccacagctcaaccaatgctcggctttcctcgttcggttgaactggtcgaaattgctgggccaacagctgaacaggcaaattggaaaaaatttttcattttaaaattaaaaaaatatttttaatgaattttgaattagtaaattattattattaaaaactagttaattttttaaacatttttactcaggaaacaattttttctttaaaaactttttttttgaaaagcttgcctcaaaaaatgatgtaaacacaacaaaaaatgttgctatgcttcacccttttgttgccgtcatttgataaattttttgaaatgtccttaaattcgaaaaaaatttttccctttatgtcctttgaaatcagagcatcggtcctttaaatggcaaacttttgtcgatagaagccctgtccttaaaataaaaattaaattaaccccatataattaattaattcatcaattaggtaatttattcacttgccaaatttatcagatcaataagtttcatccattttcaggccattggcattctgtccgacccacaagtgccgtcgttgtcctctgatcagatcagtgctctccgtgccgagtcagccgtgtgagcggcaccgctgctgctgatggcatcgatttggtgctgggcgcaattcaacgggacgaactgatggccgggcactcggaggtggtggcaaattttgtgacggatttttttttttttgaattctgatcagtcatgatcagtaacaggatagaagatggctgatcaattctggctttttccgctacagctaatttagagacgacaccttttttggtgccaatttttcttcaaaaaaattgttataagaaaattttccagcgattttttttaaaatttttttgaaaagaaattttaaaagatttttcttggaaaatctttaaatttgaaaatttttaagaaaatttttcagcggtggggggatgtgctcctccctgcccgattagacttttgatcagttccagaataaattggtctgtcaaatcaatacgtattcaaactggccagcctttcatgacgggtttattcgtaaattaaaaatttggggtccgaaattctactcttaaactttaaaatttattattgaaattaaatatatcaatcatctttataaataattataatttctagaacataaattatggaaagaaacaaacgttttttataattttcaagtctttttgtattacaaaaagaaactttcgaatatttatttaaatcttgacagttccgataatataaaacgaacgtgaaatttaaatttttttttgattctaattaagtagtgttcgatttttataaacatcgtttattatattttttacttataaattattatcttttttataaattataaagaaattcttacttttctattttaaaatttattttaaaattgtactgcaatcatcgcgtgagctccaatggcgataacaattttgaaatttataattatatttgatttttttatttgtgctattaatttcctttttatcccataaattcaggttcttacttcaactatatctcctagggtcagcttccatttttttaaattttaaaatatttgttttactttccaatttttattaatttattattctttatcgtcataaatttatattttgtaaatatttcattaaaaacaaaattttgacatggcaaatcatacagtcttatcgacgataacttttctttcaaaattttcaatttattatttatctattagataattctgtttgagtggataattatttgaattgtagtcaatatatgcaataattaatatatgttatttattttaggaagaaaaacctttttggaaaaaaaatttatttaattttttcaattttatgttctctcggtctcatttgaaaag

SEQ ID NO: 18732 - DNA, 1815 bp, Heterodera glycines
tgaaaccaaaaaagtaaaaatattcagcaattttttgaaaatttaagcaattttcttaacaaattgcattaaaatgccaaaaaatttcccggcggcgcctaacgacaccgccggacccccatcttaccatatttttgaaaattgaaaaccaaaatgttaaaaaaatagtaatttttggcggaaaacagcttaaaaattttgtaaaatacaccccctaaatttgggatttcaaaaaaagaaaaatacacctctaaaaatcaaaattttttacttcagcgccccccccccccccgaagccaaggatttggctacgcccttggtctggaggtaattaattttttgaaagcgaaaaaatttgactatttatcagatttgaaaatgttgataattttgatcgctaaaagtatttgtttttctatgattcaataaaatttcaaagaatttattaaacctaattgcaaaactttaattatggtccgacgccataattaaactactcaaaacaaaaaccggcgctcaaattcagtcataatgagttaaattttgttcacataaaaactagcagcagatgaatgaatgcatttccatgggcttttgaaatctttggcacattgacgaatatacaaataatcaattaattaattacctcagttttgggatttctcaattttttgaccaattcctttttcgtctctctaaaatctatggcatacgacttttgatcactttggtcgttttcctccaagtcaatgcggcctttggcgatcaatttgtcgatgaacttaattaattgcttcgcccattcccttgtttcttcactgatcagttcctgtccatcattttgggtaatatttttggattgatcacattcaatagagtgcttgtcctttcgctttgattgactttgaacagcgttgaatttatcttggtcagccttaattagtttatttaaattctgcatgtgttcttgatcgcgtttgttctcaattcgtgataagagatgatgatcgttcatcccattgataatcggtggtacaatgataattatgacaaaaataatcattgaaggatttgtgaatttaaaatgctactgaaatttaatgataaaattaaaaaataaatgttaatttttaaatgaataaatccatatgattttataaaaatgaggtatttgcgtcgaaaatttttgaatttgatttaaaatgctactgaaatttttgatgcttttatcatttaaaaaaataagaataatataattagccatttatgcttaattctaaattaaaaaaatatatataattctgatcattgtactcaatacatttatactcaaaaaatgtttgacgtcatgcctttcatttaaacagagcttactgatgtactgattttttagatttgtccttaattggggataggcagaacatctggaaaataaaatgccctgaatggtgtaccgacttttgcgcctcgacacttgcgccgcccagtaaaaatagacatttgcgcctcgacacttgcaccgcccagtaaaaatagacatttgcgcgtcgacacttgcgccgcccagtaaaaatagacatttgcgccgcgacacttgcgccgcccagtaaaaatagacatttgcgccgcgacactttcgccgcccagtaaaaatagacatttgcgccgcgacacttatttgcgccgcgacacttgcgccgcccagtaaaaatagacatttgcgccgcgacacttgcgccgcccagtaaaaatagacatttgcgccgcgacactttcgccgcccagaaagagatagacatttgcgccgcgacactt

SEQ ID NO: 18733 - DNA, 1756 bp, Heterodera glycines
aaacgaccctccgttcattttgggagcgctcaattattacggacgtttggtaaaccaatgcgagaattagggcgccattggacaactcctccgaaaggatgatcctggagttggggagatgaccaacagtccgcgttcgagcaagctaaggcaattatggtttcagaacttctgctgacccactacgaccccacacttgcgatcgtcgtagcggcagacgcgtcaaaagatggcatcggcgccacaatcagccacatttttccggacaaaaaggaaaaagtcatcgagcacgcctcaacagttctgaccaacgcgcagcagaactacagccaaattgagaaagaagctctggcgcttgtgttcgcagtccaaaaattccaccggatgcttttcggacggaaattcacactgctcacggaccacaagccattgctggccatcttcggctccaagaaatgcatccccatttatgccgccagccgactccaaagatgggccctaatcatggccaattacgattttgaaatacggtacatcaacaccgcatcatttggccaggctgacgttctctcgcgcctcatcgccaattatccccgaccagaggaggatattttgatcgccaacatctgcaccgaaactgagtgctacataagcaccattctgcaaaccaaaacggaacaacttcccgtcactgcagacgaaatcgcagaggcgacaccgaaagatgagattttaaagaaaattttggcattcacccaatcgaattggccaaagaaatgcagcgaccccgacatcgcaccgtattttccaaaaagggaaaacattttggaaatcgagggctgtttgctctaccaaaatcgcgttgttgttccccaatcgctccgcaaccgaatgctgaagtccctgcacatggcacaccccggaattgtgcgcatgaaggcactcgcccgccaacacgtctattggccgggcatggactcggaaattgaacggattgtccgtcaatgtgaagaatgccaaaaggctcaaaaagcaccgataaaggcaccgcttaccccttggactccaaccgacaaggtgttccaacgggtacacatcgattttgcggaccatgccaagacggtcacgtctatttcattttggtggactcattctccaaatggccggaggtctaccaaatgaattcaatgacggccgcggcaaccgtcttcacactccgttcaatcatccaccgactcggaattcctgaagaaattgtttcggataacggaactcaatttcgttcgtcagaatttgcggcactctgtaaggagttcggaataaagcacacttttacgccgccattccatcctcaatccaacggacaagtcgaacgtttcgttgacactttcaaaagggcgatgatgaagtgcaaaggcgacaagaacagccttgaaaaagtgctgctctcctacagatcaacaccaaattctgccatcgacggatattcgtcagatcaattgttccttggacggaaactgcgcaccaaattggcactcgtccacccaaaaggacaaattgatcagtcggagaaatttgaaaaaggtaagttcaaacagcaccaaaaggactattcaaccaaaatggcacagcaattcgatcggaacaatggcacaaagctattgagttcctcccaacggattccgtcctactcttgaattatcgccttggaaaaagtaattggctacagggcacaattgtagaaaggctcaacaat

SEQ ID NO: 18734 - DNA, 1142 bp, Heterodera glycines
accgcgctaccaaccaaattattgtgttctcttttgtcgttatgtggaaggggacaccaatttcaaattttttttttttgtaatttgtgactcggttttgactatgactgatcagcttaacattcccagaaatcctctgaccagctgttctcactatcggaacagcccttccacttcagcaaatactccatgcgcccatcccgtaacacgcgccgtgccaaaatgctgtccacttgaaactcattctcgccaacgcccctcttacttcgccgagtcgccattccccaggcagaaaaattatgaacacaaaaaaacaccaacaatgatttgattaaatatcatttgatcactcaacaaatattcgagaaaaaaagggatttgtgatttatacacgtgcttttgtcagaattctatgcttaaacacaacaacagcagccatcgtcatcatcatcgcctaattagtcgaccgttccgcacaccccacgagacattcattcattcgtccgatttgatctgcgaacggagtccgggaatataacgggcgaaacgcttccattccgtaacgtaaaccaacacaagaaaagcagaggctgaaaaagaagaggaatatttgagttgaaatgcagccggattttcagaaattacacaataaaataaaagttgagtgttattttacactcgcattttcattaaattcccagaaaataatccgtaaagattcgataaaaatggtgcaaaagaacttaccaccataggcagcgtatgagacataactgaaaaatgcaaaaattatagaaaaccataacccgacaagaatttacagcttttatttttatatgacctcgattagatttttgcaatttgtcatttagtaaaaatacttactaggagctgttgacagtcgcgcgtttaaggagtgtcgaaaatttgatgtgcgggaaaatcaacattgtgaaacgattatggctaaaagtgaagtgcgtaatgtgatgagtcgaatatatttactttaatgggaacatgaaaatttgtttgaaaatataaatttaggtatgtattaggaagttttttgggctattctcgagaagacccccattcttaccagtgcaaatttttaccggcggtaccggtactagacaaac

SEQ ID NO: 18735 - DNA, 663 bp, Heterodera glycines
aaaaaaaaaattctataaaaaaaggggggcaaccatcggcacgtaaattacccgtttttgttttgttttccattttattctgttatgctctgaaattttttaatgaatttttttgtgcactcagaaaacgtactgacaaatgagtacgcacagatatttttatatttttttaaaataaaacgccaatattgtcaaaaatttaaatctatccaaaaataataatttttacgtaggtaatttaaagacgaaattttatagaagtgtcgagagaaaattaaatattatcaaaaaattcttggccaggtcaagtcaagggcgttatttgagaaaaaataaaacaaaataggtgaaacatttatcaaagcaaaaaacggaagattggtctgattaaacaattataaatggagtgtcctaagtcggttttcccttttctcttctttccacggtgtcgtcatttcgactgttcgtctccgtcgctggcgagtcatggttttgcaagtccaatgattccacacgccagccgagcccctgcgtttccggttttcttactctcatcttccttttcacccagaccacggcctaaaatattaatatttctgacaatgagttagttcaattaacgaggaggagaaggaagggggcttctcaatatggtgctcggca

SEQ ID NO: 18736 - DNA, 2355 bp, Heterodera glycines
ttacaaggggacaaattggcccacccaaaaaaagctgtgattaaattattccgtatgtatttgtaatttgtcttccactatttcccgttttttcttcgcttggaccaattcccttaaccaactaacccctgaccgccagcacccgaggcccaatcgtctctcgattcatgtctgacgggtgagtggctaacatttgaaacataatttgctccattatctcgtctacctgaattaatataacacttagagttacagatccgggactcaagtggccaaatgcctgtgggactgaaccgtccattacgaatgataccaaaatggtaggacaaagaaaatagctatagtacatgctggggcccaaccgttccggcccaactgagcgagtccgatattttccgctcgacatttaaataacgaatccaaaagcatttttggacaaaaaagaaataatattttgtcgcaattccatgcgtttttaccctttgaccgaattcgtgcattgtttcttatcccctctcttcccacccacctcctcgacaacactgcacaacaaactaaaatttaaatagaactaaataattatttgttttatatttaaaaatgaacttacatttttggttttccgattagccccgggcaattgtcggccatcaaaatttcaaaaaaatcattggccaaaacttttggccgtccacgccgacgaatgcctcgtagtggccatgggtgagtaccgccacaattgcgctaaagaaatttgccaaaatctttcaggagcgccagatgttgggactcggaatgggccgggtggggtatctcaaactcaaacttgggtaattaaacctttatacttatttgataaaaatacattaaaatatgaaaataaaatgggaggggaggagggacaaaaaaaggggggttggcggtttggcgggtaaatcacaaatgaattgggggtgttcatcggggtaatacaatatgtgagggaggggcggggtcgaatggcattttggccaataacaacttttaggggggattgtacactaacaaaatttattattgtcaatccaaaccctggcctcgcagtctgaaagacaccaatccgaaagaattttttgattttgactgaaagctttttgtggccgagttatggacccgggagtggtgaccaaatgatgattgacaaagaaaaaaagttatagtccaaaaactgggctggcgcccaaacgagggtgtccctggtattgtacagtattcttcaaatccaattttattgttattccgagactcactcttgaggatgtggctcgtcccgacccgctgtatcttcctgtttttcctcttgttcccgacatgttttgctgactttcaaaatctgaaaattatgaaatgaacatgaatagaaataatgcgaaaaatgtcaaatctatagatgagtaaaatgggatcgagccaattccctaccgccaattcccttccgccaattccctaccgccaattccctaccagccaattccctactaaggcatttgggccatctccgtaccaaaaaatttttagagagctcgtcaagagctttcggatgataccaaatttatcaagattcgatcgttttaaaaaagttagaagtgtcaaatctctcaatttttcgagttttgaaccctcctaaaaataggttctaaacccatttccgcaactccaggggaacccgaaaccgggctcaaaatcccggagctttagggacttcggattcgtaaagtacctgcttgtatgaaatttgaataattaaaccccggccttacttcctaattttcgggcccatggaagtcctacaaagcgatttgaaatcaattgtaaattcgaaaaaaaattcacgatccaatttaagaatccggagactggataaagctgctaaaatagacaaaacactattttaaaatttttgcttcgatttgtgaaaaattatgaatggtcattgttttgaagctttgtacggttctttttttgttagaagtattttcattttcttctctgcaacattaaacaaaaaatttattgtcttataattcacgagaaacatcaaaatgttgaaaatcccctttctgtttttgaaatttttccgaaaatttcgaaaaattttttggtacggagatggcccaaatgccttagtagggaattggcggtagggaattggccggtagggaatcggccggtagggaattggcggtagggaattggcggtagggaattggctggtaaggaattggcggtagggaattggcggtagggaattggctggtagggaattggcggtagggaattggctggtagggaattggcggtagggaattgacccca

SEQ ID NO: 18737 - DNA, 146 bp, Heterodera glycines
aataatatttttagttttttctgttcgcttaaatacccctttttcaattagttatgacgtggcttttatagacaaaaacatacatcaaatcttcatagcggaaattgaatttaaggtttaaaatctggcgaaatgtctttaattca

SEQ ID NO: 18738 - DNA, 1043 bp, Heterodera glycines
gatatttaaatcagaaaatatttgacgaaaatggcaaaatatgcaaaaaatcttaaaatatattttaaaaatggcaaaatatgcatgaattatgcagaaaaacccaaaatatgcaaataaaagtcccgacttttatacgcaaatacaaaaaaaagatgtttttcctactaattatactacgtagaatccaggaaaaaaatatgcattttcaaaaaactaacaatagatatgccaacgggtatcaatatgtcagctgatgaacagagaagagttttgaaaattttttttgccattaatatcatttaattaatattgaaaagctccgacaaatttcactcaacattggcatgtgcattttctaagtaaattagcaaatttgtcaatttggcattaactgaatttttagaaacattacatttcgtcaaaatgtaattagtgaatgttaacgctttcatttgacacgagaagattttacagtgtttaataaaagtgcgggcaataagttttggtttttaccattttttaaaacatttattttactttagcgttaaaatataaatatacgaaaaatatatacgaatttttagcatatcaattttggaatttaatgttctaaagcactacatccacttcgacattataaacatataattattttttttgaattaattattattttttttttaaatttatttttttcattgaattgttgttcattcattattactagggtcgagacttttagtgattaaaaataactaaaatagtgaggaaaaatgccaaaatagtgacaaaaagtccgaatagtgacgaatttagtgatataattttcagccaaaaattgagccaaaatatattttttcacttatgcagttacatttccattataaaattaatttagcaaatgttgacattttttaaaaaataagtcaaatcagtttacattattttttaaattcaaaaatttgtccaaaaaaaattttaaagacgatttttgaaagatttttcatttcttagggggtgtatttttgaaaaaaatttgg

SEQ ID NO: 18739 - DNA, 2030 bp, Heterodera glycines
attatagaaaaagatttcattttatattcgaattttcacattttctgattaatcctcaccgttgttatcactaattacattcttgaatctagttttattattttgtacaattggtttttgtccgggttcgggtcaagggtcctgaactggctgaaatagatgccatattcttgatcagcggtcgcaaaaactccaaaaataatttttaaaaatattttacaggcaagtggaattgaacccatggcctaaaaactcatttttaacaaaccgttcaattcagtttcggttgtttcctctgtcgagaatggacaatttccgatttttgaggctttgtaactcttgaggcaggcggaatgcatcgcaaaaattaaaattcaaatataagtcgaccccgtacattaatgccaatttatcaaaattaatttaattaccttttggcacttttctatgaatttatctaaatgccaaaaaaaaatcaaattctaaatatccgtccaatacatttgcgatttataagaattgaaaacacagcattttattacaaataatgagttcaaactcataaattttttgccaaattaaatgaatatcatccactaattacattttgacatttggccatatttcttcgaatttaatttcatttaatgccaaagtgacaattcgctgatttacccactttgaaaatgcacgcacctgcaatttgttaattaatgcatttgtctgaatttctcaatattcattaaaaaattgtctatagaaaaatttattattgcatgttgaagagtaacaatttttgataatctttcagaaattggaaacgaaataaatttttattcgttatatcaaatgaattatgaaactttttgccacctattttcccattttagtatttaggggggtttttagaacctaaaaactaactattttggcatgttttagcacctaaaaatcgtatcattattaattaatttcaattataataaagcaaaaaaataataattttttaaattgtattttcatgatatgacaaaattttaataattaaacaattttaagcattctgtaccggttttcatgaaaatcattgcgtgacttcgtgtaaatcttttaaaaaagttggctttgcgtgttagaacaacggcattaatttttcttttattcagaatttttattattgcatgctcacagacaatgtttaaattaatcttatttctaatggaatgctttgcagaatttttcgttttaaataattattttaatttaaatgtcataatgttcaaattttattaaaagaatttcattttcccttcttttagtcaaaaattaataatgcataaattttaatgcttttcctttatttgttgcaaataattttagctaaaatttatactaattataaccgttttgtttaattccattaaaacaccaattaaaaatgtctgcatcaaatacaacgtctacaactgattttgaaacattccttctgttcctttgcggtgtcgttgagctgctcatccattttgttggcattccgttgtccattgtcaatttaattttggtggcacgcacttcggtcattcatccgaacatgaaattcatcctccttttccagagttttgccgttcttctggtaaaatattcgggattttttatataatatatgcccgcatttttttttaattttagcgcggtttttgtcgttttgtcatttgtctgttcaaattcatcctttgggatccgatcagtgccgaaatgggcttgtttttcccagccatcttaaaaatcggctatttcggcatttacagtcgtaattatgtgccccatattctcatcattgagcgcattttggcaactgtttttgtccgaacttatgagcagcatcggggctttttgttcacaattatttggcttccatttgcggtaaaatttaaattttgaaaattgcaaaaaaaaaggacagagttttttttaattataatttatataaaagaaaaaaatagaaatgggaaattcaatttaaggcgaat

SEQ ID NO: 18740 - DNA, 2753 bp, Heterodera glycines
  misc_feature (912)..(912): n is a, c, g, or t
ggtttataataattggtgagcaatcagccagtcagtcccattagggaattaatgactggtggtcggtctttcactgatcagactcaaatgattgattcgccttataaaattaggtaggccggattgatgtattgcctggttcaaaacacgctgtggaatcagccgatcattggcaagactgcccgagctgtgttcctccttactgtagtcaccgtattttgcctgcattgcgtatgagccgagaagcactgcttggtccggtggacagtacacttcgtcggtcaaaatcaggtccttcacttgcaggtaaaacagacgctgtaatgattgatggtggaaataacacactaatgaattactaggatctttcaaaatttttgaaaaaatcgctaaaaaactttccttcaatattttattcttgaatctggggacctttctttgttagcccaaaacattaaaaatacgatttttcgcatgtttatggccataaatttgtgtaatttgacgaagcttttgcaaatttaacaggctcacattatagaaaaccattggcgctttcgaatgataggcaaaattttttgattttgttacatctatgaaattaatgaagctgtcaatttgtcatgcaattgtttacggtcatgtaaacaaattcagaggcctcaaattaaaactcttttttatatgattatgtttttttacatataatcaacctacgagggtcacatcctggatgatttcttcagcaacatctataaaaaaaattgtgtaaaattttgacttaaatttcaatttttttaccctcagggtaaaattttgcacggaatttgaactgcaaagtctgctcctttttgatgtcctgtttcagtactttctgaaaaattcagcaagaattatacaataaatgttgcngggaggttttccattttttgtccatggcgctgaaaatttatgtcaattgaaaaattttttggccaaaagagcaaacaaaggctcttcgggtgccacccccgaaatttttttttctggttacgggcctggcggcggtgagtgggaatgatgtgggacccgctccaactccaacccaccttgttcagcttcagccatgaagaaatgcccttggtgtctgtgtattggagcccaaaataccaaatttcgcgcaaattgattgtcttgaccacttggtcgaacaactgcttgccaactgtcgatggcggaatggcaaattccaattcttaacaaattaaccaaagtaaattctttttttttttatcattctcacctgcgtccatcattaccacttttacattaaccgattttgaagacatttttagacaaaaaaatattttaaaaaatttttgcctgaaggaaaaatgaacaaattaggaaatatcataggtaacgaagaaagcaacccaactcatctacagcacgatgcggctctgtatcgtggcattttttgtgcatgaatgagttgggtatatggatgagttggtatagatgagttgtgaagaattttctcaaatcaactgcttttataatggaaagtttgcatacatactacatatgtagttttaagaaatactaccgccgaccgacctatttaaaaagaaaaaaatagttgcaagcgaaaaattaaattcaaatttttgttattttttcgaaccagcaaaagcctggtttttggtataataaacaaaaaaccatttttggattggcgaactttaaaaatttgaagatgatttttaaatttttcagtcactaaattttgcctacattttcggaaatcggaagacccaaaaaatttcggaaatcggaaagattactcattgcttactagtcttgtaattaacgcctttttactatcgctttccaattcgatatttgtttaagtgttaaacattcagtccattcgaataaaaatttctgtccgattctctctgaaatgactacctccgatgagaaacaacttcaagtggttgtggctagcaatgaaaagaaacaaattaagaaatcggaagttgactttcccgtggtattgaagcgtggggtgcagggacgtggtctgtgtttttctgatggcattttaaatttattttcttatttccagtgaaatggtactcgcccgaggatgcctatgggttcatccatcgttacgacgtcgacgaagacattttcgtccacggctcctccatcgtccgtttcaacattcgcaacaaaaaccagcatcccgtccttagcattcagcaagaggttttaactttgaatcaacaaattgtcattttgaaagaccaccattttcccattctgtatagattcgatttattcatttggttaaccgtttcgttaacttcttccgtcgttcaggtggaattcgatgtgatcaaagtccgcaagggtctcgaggcgcgttgtgtctctggcccgggtggccgacttgtcggacgcttcttcaatattcctcgtcgaagtgtctcgggtgctaagaagcaagtttcgaaaaaaaacattaaaagggtcccccgtaatactgccgatggtaggaccccttttttgaaaagaatatttaaatttttaaaagtcactgaaaatatgtttctaagggttttcggggtcgctgaccaagaatctgacattcattctgaccaatttcgtatcacagaccgaattcgaacaaaaagtcgaaaatctaaaattttcaatattctctaattttgttcccataaattgattaaaagatgctaaatttagtc

SEQ ID NO: 18741 - DNA, 2691 bp, Heterodera glycines
agaatttattatcgaaccaatttttattaatttaaatttccaatgtttcataaattctcaaaaaagccgaaacccatatttaccatcgaaagctcccccaactcgctcattcaagcgggtccaacagaagagcgtcaatacctacgaaaggcggaaaaattaaggagacatttcaatttccgtattatatgtaactttttttattattatggattattaaaaagtaataatgacactaaattataagatttatcaattggaactttttaatctttcattaatatttgttcaaaattgtatttttccgtaaatttttgaccccaaaaacttctgaaggcagcgcctccgccatctgtcccaaggatttgagtgagtgattgagtggggcactattatggtaatatatttctgctgcaacagcagcaggtgagttatttggtccaccgccgtaaaacaatcgctttttcttcgccatcgctttggatgtcgttgacatggcgaatttgtccgcgacaggagcgagccattgggaagacactttttggggcaaaatggaacaaatttggtgataatttttgttggttgatggcgttatgtatgatcaccgctaattgataagcgggtggagagagcggcggccggcggagtatttaagcgcaacggcgagagcctggcgaggacgaaacgcgggaaacagtgttaaatccagacaaatgacgacgacgccgagagagagtccatttgtctgtctgtgataattcagcagacaattaattaattaattcttttgttttttaactttcgaaacattgccattggcttctcccttttctattttttttacaaataaaaagcaatttacgcccaaattaaaatgtatgccttttaaaacataattaaagtgaagatgtacttttttgcggaaattagttatgtttttttttcatttttatttccaaaaattaatcttatatttcagaaattaataggaattaaaacaagcaaaatatgtgctttatgattaattatgtacgtaataataaaaatttaaaggaaaaaattacacattaatttagtccataacaaaattttcacgctgaattatatagaaattttctagtttttttcttattatttacctccaataattaccaccaattaccaaatttaattgctttaggtaaagcttttactttgacaacagttgattttatctttttgtcaattttttcttcaatcatcaaattttcccatgaccccatttattcacatttttaaatttatttttggccattatggcaaagcacacgtgttttggcataacaaatgtgcactttatcatataataaaccaatttttattttcaaagaaattaatttttaaagtcagtttttctttgctaatttccattaaatggcatattctaattagcttatcaaatattatgaatgcttaaaattaaacaatatatttcatttttaagattttttaatttactgacacacaataaaatttgcgggaatggacaagcccggactggtcggctcggtgctgttccacgcgctgtttttcggttttggcgacctcgagtccaatgtgctcaattatttgtctgtgccattgcgcgagttcttcgccgactcattgcaacggcactacgcaattgagcctgacagtgaacagtttgagctggcatattcggcaatagccagcgtaaatttgattaaaaaatatttaaaattataattaaacaaacaattaatatgaaattacaataaataaaaataaagataaatgaactttaaaaaaatttaattacaaatattcaaatataaaatagtttaattattatttaattcttattaaatttaaattaaataacaaatatttatatattaaaattcgacttaaattattaaaattaaattacaaaaaacattttagtctttctttgttggcgcgatcattgcgagtttgatgatggcgtggtgtatggaccgttacgggcgcaagggtactgcagtgtatatacggtaaagattgaaatttacttaagcaacttaattgcccatttcagctcttctcttggcattattgcagcactggccatgctgatggccaaatggcttggaatggccgaattgtttgtgctcggacaccttttagccggtgccatctctgcgctgaaaacggtcgtgttcatttatgtggcggaatgtgctccggaccaggcgagaggtgggcacaatttaattttgtttttgaaagttcctggttttgtttttgagctagctaacacaaaattcgaataacaaaaaagcattcgctaattgattgttgctaatttttagttcgactgggaattattcgttttgagactgcaagagtcttagacgattttctcaactcgagaatttgactcccgaaacatcccaactcattcattaccgcatttcctataatatagcccgccccccccccccataaattagagccctaccccttgaaataaagcccccttttgaaggggaggggagttgaaaaatatagtccccaggggttctaatacaagaaatacagtatttatttttgaaattttaattgcctattaatccactcatttgttaggctggtcctcgaccgcaattggctccggtgccaacctcatgctgttgctggcctccccgttgt

SEQ ID NO: 18742 - DNA, 1291 bp, Heterodera glycines
gtcctcgacgcaatggctcggtgccacctcatgctgtgctgcctcccgtttgtgcctgcggcgtgttcggcaccgtgagtcctggtggtgctgccagccggctgtctcctcatggccatgtttcatctgttcggcgccgcccatttcccagagtcgcccaagcaactgtacatcggcaacggtgccaaggaggaggccaaccagtccgcaatgttttaccatggctccagcgcaaaccttggtagttttttatttgaaaatctaattatggcaattagagcttactcttacactaatttatattaatattcttttatatttagccgaactctttgacgaatttgagcatgaacgtctaattgtgcaccatgagaaagtgggatggaccgagttttggacaagccatcgattgaggtggagtccattaaaaaacaatggctttttgtttaggcattctaggttaactttaaacgtttagggtttcatggaaaattaccaatttttaaacttgatgaaattttgaagctaatagctatcgaaatcaagaagtttaaactttgctgatttgagcaaagttaggacattatttgtttaaaaaatgccaaattagtggattttacgaaacaacctaccattaaatatattgccgtaagcttgaaaaaaattcataaattgatcaattaaataataaaaacgatttttaccttatcagatggtccatggccattacactgctggcctcttcagtacccgccttgtcgctgataaatttgaagagccaatacttggagccgatgctgatgcgctatgggttgggccaatccgagtctctagtcttcacaatggtgaatttaatttaaataaaaaacagaaataaattaatatttataataggccggagaattccgctggttttgaatgggagaaatttataaatttttgataatcaattttcatttttgattattcttttttgcataataaattataattctcttaaaattaggtttgaaattacattaattgttttcccatttgctaggccatgaccgcactgaccgccccgttgtgtttggtggcaccgtgtctgatcgaaagttggggacggcgtccattgttcctgctgatcactgctctgtcaacgcttgagctaacgctgcttacggttgctcagctactgtatgacgtactcggtaagtctaacaatgcaaacgatctataaaaacagaattgattcaggaggcggtggcattgttgtctcgtcaatgacactgatcggatgtacgatggg

SEQ ID NO: 18743 - DNA, 2369 bp, Heterodera glycines
tgctggtgggttgagtcccatggtttggaatgccggaaatttgagtcccagagattggaatgccggaaatttgagtcccagagattgaaatgctggagggttgagtcgcagagattgaaatactggtgggttgagtcccagcgattggaatgtcattgaaagttggtgggttgagtcccagtgtttagaatgccggagatttgagtccattgtttggaatgccggagatttgagtcccagagattgaaatgctggtgggttgagtcccagcgattggaaagtctgataattgagtcccagagattgaaatgctgttgggttgattttcagtgattggaatgtcattgaaagttggtgtgttgagtcccagtgtttagaattccggagatttgagtccattgtttggaatgccggagatttgagtcccagagattgaaatgctggtgggttgagtcccagcgattggaaagtctgataattgagtcccagagattgaaatgctggtgggttgattttcagtgattggaattcattgaaagttagtgggttgagtcccagtgtttagaatgccggagctttgagtccattgtttggaatgccggagatttgagtcccagagattgaaatgctggtgggttgagtcccagcgattggaaagtctgataattgagtcttagagattgaaatgctgatgggttgattttcagtgattggaatgtcattgaaagttagtgggttgagtcccagtgtttagaatgccggagctttgagtccattgtttaattctttcaacaaatttcactaacttttgataattgttggaagtaattattccaaagcaattataaaattagaagaaaacaaattttttctacgaaggcattttataaacattatttgtgaaagtgaaatttcagaaacatattcccatacataattcacttgaaatgggtaaatttttcggtcatattattttgcaggatattggtttttgtttttacgctcttattttaatatgaaaataggtgaaggaaaatttcctaaatcatcttcctgtgcttaaatatcaaccaaggtaatgagttaagttttcgtatgtatctgtttttcagatgaattttacagatttaatatgctgcaattttgatttaaatctaagccattaattaattctttcaacaaatttcactaacttttgataattgttggaagtaattattccaaagcaattataacattagaagaaaacaaattttttctacgaaggcattttataaacattatttgtgaaagtgaaatttcagaaacagattcccatacataattcacttgaaatgggtaaatttttcggtcatattattttgcaggatattggtttttgtttttacgctcttattttaatatgaaaataggtgaaggaaaatttcctaaatcatcttcctgtgcttaattatcaaccaaggtaatgagttaagttttcgtatgtatctgtttttcagatgaattttacagatttaatatgctgcaattttgatttaaatctaagccattaattaattattacggcctttttggagttacgaattacgggttacagatttttgggatttttccgtaattttgatccgtaactggctttttagattatttttcgagacgatttcttgcaagattattttttatataaaaatgaattttttttttctatttttattaaaaggctacctatatttcgatttaatctgacctattcttggtaatttgtagtattattaatatacataaagggggggggggaagctagcaaaggggaaaagaggaaatgctaaaaatttggctattttttaacaaaattcgttaaaattctgaaaaaaaattatcctcggcggcgcttatcggcaccgcccgccccaaaaattcataattatttttgcccccccgcccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttagaaa

SEQ ID NO: 18744 - DNA, 1868 bp, Heterodera glycines
ttgttgctgttgcaactgtccatgcccaaaatgctggaaaatctgttgttgctgctgttggtggtgaacagatgtaactgtcgtcggaacaagtgcatgatggtatgatgttgtcgcagttgtcaccggggagttgctcacagatgccccactggttgcactcattgtcagcaacacatcctccgctggtgacggcaacgggaaatgctgttgctgcaaagaatgcacggtttgttgatgttgtggctgttgttggatatattgcgacctgaacagagagagaacaattctcgtttcacaatcagatacaaacggactgtctcttactgaatggtaatgggtgcgttcacaggaactgtctgaacaactgcttctcgctgcggttgctgctggttttgggcttggccactcattgccatgtttgttggataataatagtcgcactcgacaacaacgccttcccgttgttgtggaaaagtaccgttcgtggtcgtcgttatttggtgtgcgttttgctgttggttggcccgttggaataagtcaattgtgagttgctgttgtgccaaattgggagaggcaatttgctgcataattaatgctgtcgattcttggttttggtgctgcagcagtgccgaatttgtggccaccgcgtcgactgtctcgtccattcgtttcactgtctcttccgttctccgtctttcttccgccagccgttccaacgcgtcttgttcacgtttctgttgtcgcaaatgctcagcatcgacctccacaaaaccattgcccacgccagccatgtgactgtccacagactgaacaaagacaatgagggaaatgctgaatgatggggtattgttacctcattcgatgcacgtctttcaacagtttcgaatttaaagccgacacttttgtccactggtggctcttcattggctgttttgtccttttctcgtgaaactgtctcctcctccacctgttcacgttttatttgtttttctacggcacattcttctaccttttcttccatatttttctccttttcctcctccaccatttccgttactttttccaatttcacctctttttcggaaggtctttccaaaaccttccaaccaatatcgtgcccgatagcatcgatttgcggctgattggtgtccttaagaatggggtttttgtttattgttttgaataatcaaagacacaaatggtgtcacctgtggctgccttaggtcagctttcgtttggagtcccaaagaggcaaccgccgcctcctcttcgttgcgctcctccatcctgcgcaacagttcggcttccatctcctcctcgtcgtcctcttcggtaggcagttcgttcgcctctctctcttccctctttttcttttcctcctcctcttccttcctctgcttctcctcttcctgttcccttcgcttcttttgttcctcaagttcttcctttcgccttttttctttctcctcctcttccctcttcttttgttcgtcctcctcttccctcttcttttcctgttcccttcgcttcttttgttcctcaagttcttcctttcgccttttttctttctcctcctcttccctcttctttagttcgtcctcctcttccctcttcttttcctgttcccttcgcttcttatgttcctcatgttcttcctttttccttttttctttctcttcttcttgcctcttcttttcctgttccctcagattcttatcttccttttctctctatttcctctccctttcttcccctatttccttctgttttcgcttcgtttcctctccctcttccactttccaaaagtcgataatttcaaattcgttgtcctccatccgccctgtaggaacgatgttcagcaactc

SEQ ID NO: 18745 - DNA, 1871 bp, Heterodera glycines
ataaatgtcgaattttccgtcgtcgttttcgcaactgtcactttcgtagtcccaactgttgttttcgacggcttttgctgcttcatcttcttgtccaattctgccgttttctcgaccactctctccactgtgtcaatggttccgcttttgttgcttgtcatttgcttttgttggaagtgtgccgttttgagtgcagttgcgtctgatttgcttctgtccctcacagatgtcgtcgttgttgttgttgttgctggcggcgaagtcaccgtttctttttcggtatttggtttgctctaaattcaaacgtacataccaaaatataattaatgcccctttcccagttgaaaaagccaacctttacttttttaaagcgtttctgttcgaccgaagagaccgacgacaccgaagagacgcgagtccgtttcccttgctcattggtcgtgagaagggatttgttttgagccttttcggtccgaattttgatggcttcttcgtgtttatttccaacttttatttttggtacaacaattccctttttaattgtctcattgacgacgcctttgtgtttggttatggacgaagaaagctcgactttgttctgacgaagaggaggaggaggaagaggaatagcgcgttcaccagacgattcttcggatgagtcagccccgaagacatcttccatcgaaagatgcttcacctttttctaaattcagttaaaaaaatatagtataagtttgaaaaaatgggttcgacctgtgatggtaattttttcgacattccggcactcaattttggtcgctctttctttggctcactgtcagtgacactttcggatgacgacgaactgtccgatgatgaatcacttttttcagagtgagaatctgacgaacgggtttggcacccctcagtcgctattgaaatgaccttcgtcagtttcttaattaaacattttatttattcaagcgacagacgcacttcgttaaattgtttggcttcgtccgccgatgattcggaactttttcggtatcgcgacaacacatttttaagctaaagtacattttgattaatgggtttctcattgctagtgttggtcacttttttgattgccctgtctcccgcgtccaattcgccgtcctcggcttcgctctccgattcggacccattggctgattcctcctcaacagaagaaggcgaggagttcgccccctcctcttttgttggtcggtcgtccatgaatggttttcggggcgctatttcgggccgtctgatggtcaaaatagcagttgtcttttctaatttctcgtcggcactgcttttcgtgctcatatcgcccgaagtgtccaagtgtgttttcggtttttctgtcctcgtcattgcgtcatcgttttcctccgcgttttgctctccgttctcttcatcggaggtgtcactttcgtcctcttctgccgactttggttttggagacctctccgccatttttagctgggttgttgttgcttgggcgtattcatttccttccgaatcggttgaggtcgaactcagccgaacacgagagaattcttttctctaaaacaccaatatttgtaattgtctcttactagtaaataggtaaattgatcgtcattttgtgtaattacctttttcgcgtgcttcgtgttcaaaacttctaatgccgtctttttcttctgctcatcgtcagggcgttgcgaagaacgccgtttcacccggtcgtacatcgaaaggccaaagccaatgcccgatttgatcatcttcatcatccgcttctgctccctcatgtcaattccgttgaacatatccgactcctccaaactctcatccgaactgctcgacgacgtcgactgctcagttga

SEQ ID NO: 18746 - DNA, 1956 bp, Heterodera glycines
tattgttctggtgctgatcattccgactctttcccaggtgtgggtaaccaaaagtttgccgtgccgccatctgtcgtcaaaatcaccgcagcgaaaatcgtcccgagcaatggatgaggcgaagaatatggcgctgttgttctttgttgaccacctaatgcaaaaggggggccagcggactatccacgacttgagctgtacgtgcagacaaatcggggcaaagggcgcaaatcgaagcgcgacacaatgccaatttgaaagattggcattccctccggtcattgcactcgcccccctccccaaggccaatttggtgcacgcggattcaccgatgaaatgcgtcaggcggtcggcaccacccaagagggcctctacgagttcctcagccagtacccgtccctgttcaccctccaagacggggacaaggtccagctgaagggctacggagatggcgacgagggccgcacgcatttgtcgcacattcctccgtccggccgccaacgcgactacgtcgcggaggcagtgcaattttttgtggccaaattggagaagttcggccccgaaatgcaggtctggcaaagcaaaagagcaaatccatccgaattcgagtcgatgcttttgtcgccttaggtaaaatcgctgctcggccatcgttctcaagctgcccccgaagtccggctcgtttccggacgccatctgaaggaatttgccgactttttggccaaccaaaccaaccatttcacggtggagggcgaccgggtgaagttgaagcacatgccggaaccgaatggaacggatgccaaacaatttttggacgaggagggccgcccattagtcggccatcgggcgaaattggcggccgtggactttatgagaggggtgcttgaacaggtcgaattcgggggaggcaaaagcgacgcaaataacgggcaatcatcggcagaacgaagaaatgcccatccctttggacattttctaccgccgtttctgcgaccgtttcccgcacagtattcgccaggaagtggccaccaaccccaaggagttgctgctgttcctcaagctgaaccggcacgtgttcttcatccgctccaacaaggcatctcttttcgcacttctctcatttttaatctgtggacctttcgtttgagtatttaaattgcctttttctttggcgttccgtctcaaccgttccatttcttcgcctttttcaggtacaactcgtccgtaatcggcctggcgatgaacatggttccgagagtggtcgttcgaccggcgaagacggcgggtcgtccgatcgaagtgccacaagcccagcggagaacggaggcggctgtgcgccgccgagggcaccgacggacggaatgtctcccgagacgaacgctcttttcccgctgaaccgcgacaatttgcaccgcgtacaaattgtacaaacgctgcagcaggcacaggaagcggtgcgttgcctgcgcgtcgacctcgactccgtcccgtcttccgccttcctcgccctcgacttcaaattgctctctttcggctccgttccgtccgctgaccttccgctcgtcgttctcgccgttgtcgcgtcgccgctgcgtctcgtcgtttttgacctcgcccaatcggataaggttctgtcggagagcggactgcgcacccttttggaggacgacagcgtgctgaaagttacgcacgacgttcaacgaattgcgccccttttggccaaccgatgggacattcgaattggccgactgtttgacactcaggctggtcattcaattcattcactcattagtcctttttgggttccgaacatgctccaaaatcctttgcctaattaccctaattgttttgcctttgatcctccgctaatttatccccctttttgcccttctcagatcgcccattcggtcattcagcacgacaaattcagtaaacccctcggcgacttgcgtgcca

SEQ ID NO: 18747 - DNA, 817 bp, Heterodera glycines
atagctcttaaggttctatattaatgtgtaaaattcaaaaaaaaaattcgtcagtttacaaaaaagttatggcaaaaaataacctaaaaaattgactttttcttggctttttcggcgccgcgcgctataactttattttttatttttgattgttttctttcaattttgacatgttatgcggagaacaaatagagttttcaaatgatgccagattggctaaagttaactgacaacgaaaaaagttatgggatttgaaaattgacggcgccgaaatggtctgcgccgaagtgaccccgaccctttgatcagcccctctgatcaggcaaaaatgggcatttttgggtgttttctttaaaagtcgctcactcacgcgaagtccgactgcgacttttttcagtgacaattggtggagctgatcattggcttttccgtcccactttgttatccttttgtacatgtcctgactccaatttgttacttttttcaaacccgaagcagcaaacacttcgccaacaatttcatgaaacaatcgccgtctgtggcgtgtctaacgaaagagcattttatgtacgattatgtgtgataaattaaaaatgaatttatttttaattatttgcctgtatataaaaatgaaacttcaaaggataattcaataaatgtttttctcttgggttactgtctctctctcccctctcccctctctctctctcccctcgctctctcacccatctctctctcccctctctctctctctcctcgctctctcacccatctctgtctccactctctctctcactccctctctctctctctcctc

SEQ ID NO: 18748 - DNA, 1860 bp, Heterodera glycines
tgaaaaaattttcattaaaaattggcaatttgaaaaattttttaaccaattctacttaacaaaatgcattaaaaattaaaaattttcctggcggcgcctgtcgcaccgccggacaccattttacacaaaacagtccttttttggcgaaaatcggcctataaatggacggtccctccctggcgatgccatattaatcagtctcataaaattgaatttatttgtgccaacaaatagtgccatgcctggaccacttcttcggcccgtgactgcgcgtgctgatggttaagccatgtgctgaccatttccaattccttttcaaaattttcccatttttctttggcgtactgtttgaactcctgtgactgaacaaaatcaataaattaactaaaagtttaatttaatttgcttcggtttttctctgttttgttacctcttgtcccaccgattcatttgttcctttttttgtttttaattcaactaaaaaatgtttaattgttaatttaaacaaatttttatcaccagcgatagtcaaaataagaagaaaaaatggaattagcagcagatgatttatgaacattttaaatttgttgtttttgaaattgaaaaaataatataaaaaatttgctttaaaaatgtaaaaattatattaataaaaggaaataaattctgagattttggcattgttttcttaaaaattaatattgcaattttggacagcgtttcatttgcttttcatgtgaattcgtaaagcataaaaattcattttaatgatgcgtaataaattgatttaataatattatacaaccatggcaaatgaatataataaaatgaataatagtaataataataagcaataagactctgttgagtttagcggaaatgaaagtaataaataaattttaaaaatatatatatcccattgataacccttattatcctccacctctaattaaaaaatatcatttatgaaggcaatttggattaattcaaaacgaatgaataataaaactaattaattatttcgatcattggtgcgtctagacttaatttgtttgttattttttgaaatcggatgtttttcctctttaaataaagtaaatatttttttaattttgaaatctgaaattggaaaatcaaaaataaaaagcgattaagccaattgaccaattaaaatttctttcagaatttttcttgtccatttaattttaatatttcatgataaataaattacaaaagaataaataatgttaactaataggccaatttattgtttgactcttttcatttcggcattctctgtttggctttcaatggaaattgtcgtattgccggtaaccaaatcaccgtcaatctgaaaatggcacacattttttcgcggagttattttttgtagctttaaggctattcaaggcaccgagaagcactaccaagaaaattttttacaaattttttgctaaaattatacaaaatttcagattctcccatagataatttttaacatttttctacggtaaaataatttttaccttttccattcgatttcgaataagggagatagactaaaagctgagtgtggaaatgttcaagataatgacaaatcacatcttcttgaaaagtagcactccgctcttatcttctctccttccttgtaagaatgtcttaattttcctgtgattttgctcccaaaaacagaatgaaggctcctaacgaataaccacacttcacaagctatcaaatccagtactgtcctcaaaacatgatggagatgagcctagacttgtattgttttcataatagtctcctatagatataatcaccaaaatggggatggtctcttcatgacttaaatttttgcaaaaa

SEQ ID NO: 18749 - DNA, 2381 bp, Heterodera glycines
  misc_feature (2362)..(2362): n is a, c, g, or t
acaaatcaaatattcttcacacacgtatcgtccgttgttctgctgctgtttccgttggttctgcaaatgttaccattgcaattgttctgcttcttcttcctcctccgctgtttcggctaccgtttcctctccctttgccggggatactgtcatttgctctttcgtcgttactgtccctttgcttccgttgctcagaatggcagtgattgtgtcgaccagcagaacgaccggggcttatgttgttgtttttgttgttgtttgggtcaaaagagtcagcggaagaaggcgggggatgaatttgcactgcacacaaacggcaaaacgaaagttagtggggaaaaggaaagaaaagtgatcggaaaagtgatcagaagagaaaaaggggagggggagagactgtggggattgaagagccatgggaaaaatgtacaaatggagggggagaagccccgaggggttgccaaatgccaaaacgatttggaaatgcgaagggcgacagaccaaaagggaaggcacgcgagaaaagcctatcaaatggccaagcttggggacagaacttcaaaagtttcacccttttttgcgctagtatcagccacaaccaattaaatctacaaattgccttttatgacttattaattacccaccgctggcagtcattgagcagcaattagtgacggcggacggtcgccgcgaggaggcgccggaggtgcgacgcgagtcggacggaaggcaccgctgggcggcagacggacggtcgggcgagccggttgaggcgaatgatacgccggcggagagcggagaggcgccgcctggggcgttgtcggcggcaacgctttgctgccgctcgacgtccgccgcaccttgcggcatttcctcccgcgaggcggccatcgcacggacaaccaaagactgtaaaatatggtcaaaactaataagaaatacggtattgatttatttgggttaattaaccctcagtaatggctaatgggccaattaattattaattgcttatttttcatccgattgaccttaaacgattttcccgtccttcgcccttcgcttttctttgcgtcgaccgaactttgtctgaaatatatattttttaattgttttttttataattagtttttttagtaatttaaataccgttttgattgaaaaagtggcgtgtttccaccattttcttgcgattttttcatcgccaccgaatttttcgcgtttgatgcgaagccgcccggggcaacgacagagatgagtctaattaacaattttgaattttgaactacaataaagtgcataatttatgcaaattaccgtattagtttaatttttaggcaattttgtttccgaaataggtttttttgcttaaaagggaagtttttaaaagaaaattctgggataaaggcaacagacaaaaattattcatgaatatatgcgaaaaattatgaatttcgggatctctcattccaatttttttttcttaatgcaaatatttgctcttttcttgtatttataaattccctaaactttaagctttcgattgatagcaaaaatgtttggtttgagcaagtaacaaaaaagttatgagctaaaaaagtgagggtggtcactcattggacgcgtaaactggaatagagccggtcccccccccccctcccccctaataaattttcacggggtttcccattttttcgatttttcaaaaatgagagagaaatttactcccatttaatttagtcatttccctcccgctttttgttctccttatgtgtctttcgttcgcatccaaaaaaatgaaaattgtgtccaaattgttatgccgatttttgaaaaatgcattgaaatttcgagaccgaccacaaattcttttcccgatgttatattttttcagaaaaatataggcattgagtgaaaaatgtacttttttttttacaaattttcgccaaaaatgacccattttcgggttacaaattcgggcttttttgagcgaatatatacacaaaattcttcgaaaatttcctcccctgtccgctctaatacagccccccacacactccatttgcggcaaatttcaaaaaatttccatggaagagagacctccacttgttccgttaggcccagttggccaatgatggagtcctcttccgccgccatttcggccgccaattcctccggcgttttcttccgtgccgagcccacgcggccatcctcaaagccggcacccattgagccgctttcgtcctgaaaaatttttcaaaaaatgttcccaaattgcgtcaattttgaacaaatttatggccaaaggttggaaaatttggttttttgaatttttctggtcataacttttctgaaccttaacganattttttcaaattttgcag

SEQ ID NO: 18750 - DNA, 3107 bp, Heterodera glycines
  misc_feature (3066)..(3066): n is a, c, g, or t
  misc_feature (3088)..(3089): n is a, c, g, or t
atatttgatcaaatcccaaattttactattgaagcgccaccaaaacatgtcagtgggggcgcctaaagtcacttattcttttgtgtccaatattccctgcactaatctttgttgatcacccccggggcagacaaaggaagataacatctgtatgaccatttctacaatgaaaagacggcagattgacaaaagaaacaaatttttggaaagcgaactatcgctctggggaaggggtgggggcatactccgctggtcatttcttccaatattcgcatggtcatttcttccaatattcgccatgcagtggatcaaattcaactgcacgctttgcccgattggtctgcattgtttttatccgcgcaagtacgcgaagcctgtactgtgtgcgcatcccagcgtccacaacatcacggactttttgcgcaccgggcagcttgaggaagctgcaacgacaacagcaacaacaacagcaattccaacaactgcggaggtggcggcgcgtccgaatgcgcacctccgcccgcgcatttgtccgcatgggtcgcggtttgcacagcgctggtgcgcttttgatcatcgcgcaggtctgttaattttgggcatctacccacgcttccgctaaacccctatttctcaattaagattgtgcgcgccggattcaaagtgcgcaaatttttgaaggaccgcgccttcaaaaagggatgctgcgccgccatcgccagcgtgagtttcgcactatttgaattacatttttagcaaattgtaattaacaatttgtacaggaatgagtgccgcccgtcgcaaccgccaaccggtgagcgcgccgactccgttgatttagccggaaatgttggccggcgtttctcttcgcccgaccggcgtcaatttgacggtggacagggtgggcaattttaattaaaatttttatataatttcatttctctatcattacaatacacaaatcttaatcgttttaaggcagcggggcagcgccgcgcggatggtgcaattgagaagggcgaagagcccgtgtacgatgaggtgccgcttgacaccgtggtccaaatgcgtgatgaagaaaatggggaggaggatgaggaagaagatgacagttatttttagtgattcggcaagcgatcaaccaccatttaaccaattgatcgatttttcactttaaaataaaattttttaatgtttgaaaataggattacaaataaaataggaggaattcataaaaagattaaaaataggtacaacgcatcaaataaaaaattctaaaaaaggatttagaagcatttgaaaaatgtgggtgggcgctcgctctatataaataagtgtgcgtgtccccgtcggcccatttcaatttattcctgtcaaacatttcgccgtcagttttttgtcagcagcatgtcggataaaaaaagcattgtttaagcgtgttatcgcagaggtggacctcactataagcacggtcggcataactttgagcggcccccgtctgtctgttccccgtttcattccgtttgaggaaaacgggcgttgccgcgcatgtaaaggaactgaggctgaggtggacacaatggtcaccaaggatggaatcaccttatggtgcacacgaatagaaaaggctcagtttgtcccttttgatgttgtttacgcgcttcccggtcattgtttctttcgcgtgaaaaataaggcacgtgtgttcagtgttccatatagcaaactgccgtcctcagacaagtgtgcacagccgccaccacccccatcatcaaaacatcaacggacaccggacgacgaggaggagaagaatttgaggcgtaaggcaaaagtgacgcttgacttagtggaagctggtctaatggaagacgcaatacaggatgggacgcgctggaagaaagccaaaacctcgatcaatgtgctgggcaatctgcttttgccggaatcattaacagatgcctcaccaacttttcagcaacaacaacaacacttacagcatcagctatcgtaaaaagaggaggagaagagggaggaatgcacaaacaacagcagtgctggagcaacaactgaatctgctcccgatggtgatgtaatgaacgatttcgtcaatagcattcaagcggcgacaagcaatatgcaatagcaaaaaaaagcttaaacgatggactcgctctgccctatatataaaagttgttgattgctcaatttgtggttctccatactattattcacattttaaaaatgttaaattctcaatcgttcagtaataaagacatttgtttcaaattgccttgcggtataattatttccgggccatcctatcgggcaaaacggaattcctactaaaatttattgctgagtgcaatgaactgatcgcacccagtcccatctcaattatgtactgttttggtgaaatgaattcggcggttccgctactgcaaaaggcgggagttgaggtgtattcgggcgtgccctcggaggagctgattaggcgtcttcccaaaccgatgctgctcatctcgacgatctgatgttgtcaatcgatgagcgctatctgtccgatttgttcaccaaaaaatcgcatcaccatcagtttgcggttgtgttcatcactcagaatttgtttgagcggaagatcaaggtggcgtgcctttcggcgcagtatttggtgctaatgcgcgcgcccaactctctgctgtccattcgaaatattggagttcagctttctccgcgtcaactcgattttttccttgacgcctaccgcaaggcgaccgcccgcccctatggttatttgctaatcgatatgcacgcatcatctgatccagcgcttcgcctccgcaccaacatatttaaagaggagcaggatgaggacgtgggaacagttgtgttcatccccaaaaatggagcggtataaacggaaacaacaacaacaacaacaacaagctaaagttagtcaactaataaaagaaaatgccaactggctttgcgcactgtcgaaggcaaaatgcgtgaaacgatgcgggagactgatcagaaaggcgaacactgataagctgctgtcacttngtgaagtgtgcttgaacattgnntgcttctgattccgactg

SEQ ID NO: 18751 - DNA, 1345 bp, Heterodera glycines
  misc_feature (119)..(119): n is a, c, g, or t
ttccaaaggatttaaacaaattgaagcgatgacttggccttttttttgatgatgaattgggaaatggcacgaaaaagcaaatgaaaaagtgccatttttaggggaatttgccgcatttngaaaactttgcgcaaaattttgagatttcaacgaaaaaaacaatggaaataaacaatcattcggtggtcaattagcattttattcaatcaatcaacaacgagttttgctttatcgaagtcaaaaatgccaaattgggagctgcgcggggtcatttttcttccgtccgcccaccattcatttgccattcgctccttctgactaatatttcccgttgcacttccgtccccccaccttccaattggccaatttggcatttcccctcccctcggcacttcgtccttttttacactttgctttcaattttggcaaagtgatgggacgggtgggatgagaataatgaaggaggacgagaagcagcgtaaggaaaggaaaaataaaaaacgaataattggaaaaagaggggagggaaaacaggggaagaaaggcccttattaaataattaggaattgggggggggggcaatgagtgaaaaatgagtgactgaatttttagggggaatggggaaatgccattgtcaaaaggccaaaaacaattgagaaattggcaaatgaaaagggcaatgataatttaataagctgacaagggaaagaaagaaaagactgtgcatttgcattggcatttcctttcccctttttttgttgcgtcttttggcccatgcgatcactttttgagtttacacaaaagcttcactatttggcagcagaatgaaattgatcggacggaacttttaaatttgaagggacagatggtaaaagaaagcgaaaagcaaagggaaaatggcgcaaaaaaataaaagagaaaaaaaaggagggaaaagggggggcaatggagggaaaaactctttggccaatctttggtcacaatttgctgggatttgtgaagggtttagtttcttcttctcttttgaacggacagcgaatgagcagagggagaagtgtttactgtgtacaaagtgcacgccaatggccaatctcagcagaaattgccggggctgaagccgatgggaaggcgggggaaggcattcaaaaacccctcgggggggggggggggtgaaatctgagcttgtccttgtccatgcggtgggaaggtgcgaaagtggccaaaaaagaaacaaatttcacttaaacatataataaataagcaacaaaaccatgcttaattccgcactttttgtctctcaaaaggtttaattttgagaattttcttccttttccattgccccaat

SEQ ID NO: 18752 - DNA, 618 bp, Heterodera glycines
ataataatgcataattagtgcatctttaattacgatattattaatttggttatttcttcattgcactgaataagtacacaactagacaccatcattatgagactcacggccccgcgttcattgtcaggagtattaaccaggctcgagcttaccggtcaaaaacgtcccatctaccgggcatcccgtctctagagacattacatcaaatcattaataaatatttcacatgggggcacattgtctattaatgtcttcaagcgccaatctatttccctcattttccctggtgtcgcttttctgcgtttatcggcataccctctgtctaagtccaaagcgaggttcacgattagattccatgcctcctgagcaaattgattaaatctcaaaaaggcgttcttcttcacgctcatcttccgctgaaataagtagggtgggggggtcttaaatttcgatccttcgaggcactcggataaaggaaacttgaggatttgtggatttggtcgatgactttgtttctttgtttgtccaagtgttggcgttgtgtagcgacaattttttggatggttttgctaaaattaatacgccttcaccttttgtccacctgttttagtggtgact

SEQ ID NO: 18753 - DNA, 1259 bp, Heterodera glycines
  misc_feature (1214)..(1214): n is a, c, g, or t
gcagggtctttctttaaggttttgtctttgactttgcttttttgtccatttattccaatcgactagggccacttatagtcgttattttatggtataaagttgggtcgtccgtgtacaaatcgctcctccgttgcaccatcgacttcaccaaagggatcggcttcttaattcactttgtatgattattctccgttcgcctgttaaaccggcttcggcggtggcggagggtttatcactctgagctttttcggctgttgcgccggccctttgggttttttgctgttccgtttattttgcgttagcttttgctgtatctctttatactcctctctctctttcgtaattctcgcaatctcttcacaaatgtctaaattatttttcttttaccaaatattttgtgtttgtgttacaaaaaccattgtaaggtcgtttcagcctgaacagcaaagatccctaaatgaaaagcattctgttgctttacaattctgagcatcaagatttaaattacatttttgttttggtcagttgccaattcaatgtcctggtacagatacttgtccatgatgcctttcaactgtcccgttgggaaaaactctttcagtgcctgtaatcttcggatcagtcaaatcactcccactccttcgttattctcaccgctttgtttaattccttgaaataattatgttcatacaattttcgtagttctaacaagtccacgaagcgttcctggccacccaaattataaatcagagaaagcaattgttcttttccctgaaattgacgtccgttttattttagtccgttttttaaattttaaaaatgaaatgaacattagtgataaaaaataccgctaaaattttcggattatacttcggatcgccgatgagaatcttaaatttatttatccaccaacaaatccgaatgtttctttaacctcgaagtggcgctgtttctccgcctttttgtccctatgttgtgctgattcttcgatgctggagaggatatgcgtaaccattggaatgttcttaatctaacacaaaattcaggtgaaaaacaatcctttcgacattcttaccctgtaactaaaaacttttttcgggttttcatttccggcccccttggcaaggtcagtaaaacacggctcaacaatgtcggacaattccaccgagtctaacattgcctcaattgaaggataacccaactttttggccagnctggaggatgtcttcattagtgtcctctcttaattaagttaatat

SEQ ID NO: 18754 - DNA, 2085 bp, Heterodera glycines
aaaacttacaagtttagaacacctcaaaaacttacaagtttagaacacctcaaaacttactagtttagaacacctcaaaacttacaagtttagaacacctcaaaacttacaagtttagaacacctcaaaacttacaagtttagaacacctcaaaacttacaagtttagaacacctcaaaacttacaagtttagaacacctcaaaacttacaagtttagaacacctcaaaacttacaagtttagaacacctcaaaacttacaagtttagaacacctcaaaacttacaagtttagaacacctcaaaacttacaagtttagaacacctcaaaacttacaagtttggaacacctcaaaacttacaagtttagaacacctcaaaacttacaagtttagaacacctcaaaacttacaagtttagaacacctcaaaacttacaagtttagaacacctcaaaacttacaagtttagaacacctcaaaacttacaagtttagaacacctcaaaacttacaagtttagaacacctcaaaacttacaagtttggaacacctcaaaacttacaagtttagaacacctcaaaacttacaagtttagaacacctcaaaacttacaagtttagaacacctcaaaacttacaagtttagaacacctcaaaacttacaagtttagaacacctcaaaacttacaagtttagaacacctcaaaacttacaagtttagaacacctcaaaacttacaagtttagaacacctcaaaacttacaagtttggaacacctcaaaacttacaagtttagaacacctcaaaacttacaagtttagaacacctcaaaacttacaagtttggaatttcaaaaataattctttttttttgaacaaaaaaaaacttaaaactattcatgtagcacaatggactcgaaccaccgcccttttttcaaaaatacacccccccccccccctaagaattgtcctaaaagttaatacacccctaagaactggaaaattttctcaaagtttcatccacttaatttttttttttgacaaaattttgattaataaaaaatattacaaatgtacctcactttcaactccaaccagtgaataacattttttgctcaatttgcttgaaaataatgtcactattttcgtgcaactttttgtcaccattttggcatttttcctcattatcttagttaactattcgagatttttcgtaactaaaagttgctgacctattcaccagtcatattttggtgttaagtattaccgtacttttccttttgacctaatcccttttaccgaaggagtttcaaaatgaaattttggaattccgacactttcctttcaaaagaacctatgctattttttgaagtaaatttcctaaaccacaaaatcagattaaaaattgtggtggagtcgcatggcggacgaacgattgaccgtccgtctaatccctcaagaatcagtacatttttgttacaattttctccccggggccgctcgctgaatgaaggacatttggcggtgggcgtgcgcctgttttttaaattattattcgtattctgctgttttattacttttaacaaaaatcatcatcatttatttccaaataatcaatttctaattctttttcttctgcatcgggctcagtagatggtgccaaaaacaactggtccatatttgctttgatgtctccgctcaggcttaaattccttggttttacagaaatcagaaatcaaaaataccgatttcttaatgagttgccataaatgagccccgctttcgagaacagcctttccgatgacacagatgtggcgggaattgaatgaacaatccgggccagtacaaacaacaaaccggtaacggtactttcatttttgaaaaaaccggtaccggtaccaaaaaaaccggtaattaccggccagtaccggtaccggtaccgctcaaccctagtttatattcagttaattggtcagcaattttgtcacagtgccaattcttttgcattaaatacataacgccaagatgggcctcaaatttttgcgtcaaatgttttttcattttctcactttcaaataacccaaaagag

SEQ ID NO: 18755 - DNA, 2931 bp, Heterodera glycines
  misc_feature (2849)..(2849): n is a, c, g, or t
  misc_feature (2858)..(2859): n is a, c, g, or t
  misc_feature (2876)..(2876): n is a, c, g, or t
  misc_feature (2899)..(2901): n is a, c, g, or t
cgctttttcattagcagctcatttaactgccaaattgtctccctaggaaagcatcttttgctcgcgttacccactgcaccccttcgttcgctattattttgcaattttacgcgtgcttttttcccattcggccggacaaaaattgctcgaacaaacggcaattaaccaattgtgggacattttaaaaattttattttatttagttaagtttagcctctacgaactcgcgcttaaaccatcgacgagcaattcgctgatcaaactgatcatcgtcagtttggaatactttcctagcgatgaaactgacgatggacagcagggaatatttgcacgaggacttttcgaagctgtgcttctccattcgacacttaatgaggtggtgaaaggccagggcaaagaataattaaatcctcagcaagtgattagcacaaaaaaatattggcacgaaatgtccaaaagttttatagtcaaaaaaataaataaaaagggacagaaatatggactatgataacttctatatatgcgatgataaatgataaaactaaggatcaaagtaacagaattttacaaaagatagaggagaaaaacagaaaacaataaccgaaaatggaaatcaaagataacccggaaaagagaaaagtgttgtgaatttggtggtggaaaatcactgtgccaatcaatcatgtgatggtgcgttcgctgctgatcaattctgatcaagctttttgttgcttttcttgttcttacccgtgtttctcttcccatttccgccccggagacggaggaccaagtggagcgtggactccttctgtatgttgtagtcggccaacgttcgtccgtcctcgagctgtttgccggcgaagatcagccgttgctgatccggcggaacgccctccttgtcttggatcttcgtcttcacattgtccacagtgtccgagctctccacctccaaagtgatcgttttgcccgtcaatgtcttcacgaaaatttgcatgccatcgcagccgggcgcaattagcagtagagaaacggcgacgaacaaaagtcagcccatatgcgcagaatttctcactcatggcatacgaaaaagtcaccacccaaagtcatgtgccaaatcatgtggttttggtataaacgggggggatttatttgcggttggctctttggcatggcttattattatgcatatcttttactctttcttgggttttttgcgccttcataatccttttaatggtaatacggccaattattttgtctgtattattacagtccatccaaaaatgggccacccgtttcctggatgtgttcatctctctcgaacagcttggccatttgcccaccttcccctgttggcattgggcactttcgttggcttttcggcaactgtccaatccttcgctgaaaattgttcgctgtgccgccaaattgttgcttgattggttcccggtctgttttaccgcttttcgggagtgaatgtgcgagatttgcccattatccattaattaggacatttaactttattttttttatagaaatgtccgccggaggcgcgtaaaacggccctacttttgctaaggacatccaattttagtacgcttggcaatttgggcacgcttttggaggtgattaaacagagagatacttaattgagtaaattaataattcgtcatttttgggtgtttttgtacggcgattgggacgaattgtcactttgcgaaagtgaacaattggccagggaaacgcttcggagatggaaaaaggtgcgtttcgaaggagcaatgaaccgatgttcagttgcttcttatatttaagcagttcaatttgggttacgtggacattgtggaggaacgcatcagaaagtcgttgtttttgaacaacgccgaaaccttccaaaataaacgctcaatggatggccattttgcgagagtatcatctaattagtaagtgtcccaatcaggttttgtacccctaatttttttttgaaaataaaaaaggtttaaaaaccggtctagcctgtccttactattccataaatccttgtctatccattctttatcattttcaacaaattaattgtttagcgaaagtggcaaatgtcggccctgccttttcagtcccgagcatttgtatgggcaattaattaggacacaaacgggccaatcacttctccaatccgaatgcgccgtcgatgacatcatcaaaacattgagaagctttttgattggcaaagaaatttgccaaaaacaaatcaaatgttcgttcctttcaattagctttcatttttgctctgcttgtttcagcttcgctcttcgccttggcccatttgttggccaattccgaccctttccatgcccatcttttttcctttgatctcgccgcttcctcttccgccgtttgtcgctttccaattgctcaattggtccgcttgctttgcgattgtgtgcgccagcagcggtcactttgtgtccgcggattcgctctttgggcggcgaatattgcggcaaacggaaacggacgaggcgagtggaaaataatgagaaatcaattaaacaaacattccttaattgcctgttatttattagttgctgaaactctcactgcctttggttggcagtgcggcgaaaatgccgaaaattccgttggttattcgccgtatgaaaatattttaaagaatggcacgaaaatggcgaaatgggacggcacagggaaattgttggttgaccaaagcaaccgctatttcaatgaatttatcaaatgccaaatacccaatgacaaacaattggaacatcggcaaagaattcgcacggaatttcccgcaaacattgcaaaaagccaagaaatttccnccaggtggnntacatatttaaacactnttaaatattataatatattttannnagattttaagattttccgctccgtttctct

SEQ ID NO: 18756 - DNA, 904 bp, Heterodera glycines
atacaggcacacaaaatacccacagctatttccatcgcgttctgaccgtaagatttacggcatccacaatcacggtcaacgctgccgacggcaaaatatcagaaatgatctttctaattttatccgtaagttgacaatccaacctgccataaggggtaggcaaagaatcggcaaaatgagtaccgaactggacatcatggacaatgagagtccaatgtccagggaaatgtactggcaaaagtataacttctgccggtacattagggtcgtacccaaatgtcatatttttgtatggcatgactctgtccaagccacttctccataccattgggtcgactacgaccacttttcgttgtgatatggttgccaagtatgctaaatatgtggcagcaaagccgtcattgagaaactgggtcagatcattccaacaggtctcaatgtatcttgggccagaactcggggcatgctctgtttcgccatcacgttcgtaaaggccaatggctgcccatttccaaattttgcaggcaaaattccgcgtggttgcaaaattaatttgcactgtgctgaaatttattttatcagacacattaggcaaaactgccacatttatgccagcttcagagctctgatccattggcgagtcttcactcatgaaatcatttgttttagccctgcctgagcctgcatgaccgcctcttttcttagccggccggcctcgacgacttctttgcgaggaaactggcgttgaagcaattgcttcaatagcagatctgggtcggtcaacatcgtaggccttcccttttttgctgtgcggcgttaactcaatattttgagtggccgatgtaaattgtgtgtcaactgaagacacactattttgcgaagccgtgatagcctcatctccggc

SEQ ID NO: 18757 - DNA, 1218 bp, Heterodera glycines
  misc_feature (32)..(32): n is a, c, g, or t
  misc_feature (1169)..(1169): n is a, c, g, or t
tggtcgcaaagcagaccggcgtgtgcactaantatcatggtcgctaagcagaccgatatttgccatggtcgcaatgcagaccggcatgtgcacaaatctcatcatggtcgcaaagcagaccgacaagatttggaaacaaataaaaaatgtgaatctcaaaagggaataaggacagaaatctttacaattgacttcggtattctttgtaaaataattttaagtacaaatttaaatttctgtcaagagtaaagacttcttaaattctattttggagcttatgcgtgccaaagtgtacgaaacttaattcctaactaacctcagatttgggttagtaaaactatttgctttgtgtacaccttgccataattttgtatatatgggcatctaaaaatttttggttattttattctattcatggtcaaagtgatgaattttaaagattttaaccggccaaacacagagattgcctgagagaattttttaagtttggaaaattttgggatggaaatggtatcattttttaaaaaattacactaattgatttcttgtttgaaatatacaatttcataaataaaaattttcttcaattcaaggaaaaatgtttccatttttctatttttgaactcgaattcaatctataattttcgagcttagaaaggtttgaccggcttatttgaaaaaaatgaaacttgcgcaacaatccgcttttttcccttgaaaaatttgcacaccagcgcatcgaaacggagcgaaagcagtgccaatttgaggtcgagatgagcatgtacaaaagaggggaaatgtccatcaaacattgttgagcggttgctgaaaatttcaagaatataagaatacaaaatagcaaaaaaagaagcaaaaacactaaaaaagagtgcttttacaccaaaaaaccgaatttggtttttaggcaaaaattctttgaaattggaggcacccttttggcacaaaatcctttaaaaacactaaaaaacaattcacctttttgccaccgaaatgtttgtcgaccaaaagttcaaaactgggcgaaatctgtgccaatttgaggccgagtgagcatggtcaaaagagggaatggccaaacattgttgcgcaggtgctgaaaaatgtagaatatatgattgcaaaaaaagcaaagaccctaaaaacgngccgaattggtttttaagcaaaaagcaattgaaaattggaaggcctttt

SEQ ID NO: 18758 - DNA, 1906 bp, Heterodera glycines
  misc_feature (1872)..(1872): n is a, c, g, or t
  misc_feature (1880)..(1880): n is a, c, g, or t
aaattttaatttttaaaaagaaaaaatgatggtgagttagtaagtttttcaaaaaaaaaaaaattcaaaaaaatttcaagaaaagtcaaataattgattttgccttttaagattttagtaaaaactctggaacaaaataatatttgatttaataaaaattcctcaaaaatgatccaattatggaaaattgtcctttcttatttttaatgatgacaaagccaaggctctttattttttttacaaagatttggctttttaggtatttatcctggttaatatatagtaagtataagtaaatgagtatcaagatctgtgtgagtggtgggttattcaacatctaagtagttacagtagacggaagagagagacatagttcgttgagcagatggccgacttcgattccggatggttaagtctgcaaaaggcagtgatagcgtcatgataatcgaggtggacaaatcgatggtctggatcagtagagtagttcgatcttgaatgagtgtaattattgaacaatcaggcgggaaagttcgtgagatgagtcggtatggtgggggtggcactattgtaaacgagtgtatctgatgcggaggctgttattctagcgtgaggtgatttcttttccatttcaatgaagtcggggaaccaatcgcatcgcgctcaaattgaattgctaaaggaacacatgcaactgaaactggcatgcagtcaccttcttttttcatgccggcactgaaaaataaaaatgtgaaaaagtataaataggggggaggggaggcacctcagacacttttggaagcggcaaaagcgacacgcacagcgatagtttttgtcgatgacgcattgcttgttgaaacgacaagtgaacttctgacttcgcaaaatagtacggcgaaaaaagccctaaacgaaagaaacaaaagtggcggagagaaaaacgaaggcattcattgccttgcatccgttgcaggaaacctaaaaaaacaaaaacagtaagtgatccacgggaccaatgtgtgaaagggagggaagtcaccgtgccgtaatgtgtgccggtggatttgtcaccacaaacttggcaaggctcggacaaagggtcaactaaggaacacttaaaaaggtaatttggcaaaacaaaaatttaccaaccgatgtccattggatgatgtaaaaacaaactgatcagaaaattcaaacagttcaaaaaagggggttaatcgcaataaaaattatatcagagtcaaatcgaatgtgacgaaaacgataagtattccattgtatttttaaacaaaaaatttaaaatgaaagaattttgcgtttactttataatggtcaaaaaggaattaaaaggaggatggtcgggttaattagtcattaattggtcaattagccgtcccgttggcgttcctttcttcctcttcgtcaaagtccatcatcagctgctcaataccaatgcatgcttggcgcctacggcgtgtagagcttaaactgcgcaagaatttggacactcgccgtccgaacagctccgagtcatcctcctcatgtgtgggaccatcaggtttaaaagaagaagctgatgcctaattgtgagggaaaatattatttggcatttggaagaaaatgaagtaaaacattttatgttagtaaatgcatagattccattggtcaaaatcaagaacctcttttcttctttctctctctctttcactttttctttctttcttgttatccctttctttctttctctctcttccatttctctctttctctccatgtctattacttttcccctttctctctcttcctgtctcctctctctcgctttcatttcctctctttttctcgccttgtcttatttccttctctctcctntctcttcnttcgcgtcctccttttccttttctct

SEQ ID NO: 18759 - DNA, 1538 bp, Heterodera glycines
  misc_feature (93)..(93): n is a, c, g, or t
atgtgacgttctacgaagtattgttcaaccatagaaatgttttcaaccattttggtaaaatattcaagggcaattcaaaaaatcacaatgatntaagacctgtggagaaaaacgatcattttatcaaattaaccaataagtgataatcataggcgaccgtacaaatgcaaatgtcgaatcaaaacaatccaaagcgtttattctatcaacaaaatgtcaacgatcagagagggtaattcagtcgatcattccgcggtttctttgatggccaattccatgcgacaaaatgtttctctgagaggacgcgtctcatcaaaatgtgccgacttccttctgtctgactcaaccgttcaacagttcgcattttcagttttcttttcactttaaaaccgaaaaaatttggcgtgtaaccgctccgatgccatggacagttgaatcgcaccttcatttttttatttgttagcaacagaattcgagtttttcaaccaccccaaaatgtggctagtaaaaaataacaattatgagaataaaaaagcacctgcaacacagcgactggagaagctttcccaatgaacgctgagcaattaaagggattaaagcgaagaaagacgcggtcaaacatctctaagccaatttatatataacaataaatttaacattgttaaaggaaacgatttaggtatttacaactttttagggaaatgattttaaactgttgaaattttgataaatattttttcatagtttattaaaatatagaattttaattcttcatttacaagagattaataagatagtaatgtgataactgataaacaataaaaataaaatgcactttgctcttgaaaatttcggcactttccggaaagattttggagcatttaccccagcacaaatcctatgaaactttgtgagagaaagtgccgaaaattgttgtaaatttggaaacttaagcaaggcggatgcaataaaagaactaaacaatcaaatgacctgcatgtgctgagtatccttatttggttggttatggataatttcggacggagataagcgagaggacggattctaggaagtctcaatgggatttgaattggcggtaaaacagtgcgttaaaaagttaaaaaaaaacaatttgtacaaaaagaattcctttgctacgcaccactttaaagaaacaaaaaatgaacataggcagaagaaataaaaaagtgaaattttaagacggaaaatgtcaattttgaaaaggtttccattgaaggaagggccatttccgaggagtgaggtcgtcgatgatttgcttgtgtgtgtatggctattgggtggccgggtcagcgggtgcttcgtcgccgagcagagatggaacggccttaacaattaacaatcactcagagtcattccaaaagaattttcattgagtccaagggatgggacacaaaagtcgcattagaatggatttcggacgctatcactttggtgcacttataatccaaaactgacaaattaattagaatttatttttttactgaattcatttactt

SEQ ID NO: 18760 - DNA, 2692 bp, Heterodera glycines
  misc_feature (16)..(16): n is a, c, g, or t
ttttcagcgaatattntttgaacgaaacttttctgtatgctttatttatccagaaattacagacacatttccatgaaatattgtgaacttgattataatccctagtgtaagtaaccgatattcatacaaataaaaacatctctttgacttaagcaaaataaataataattaagttattaattaccgagtctgcaataatataaaatatttgcgtactgtgctttgtacaacctctgaggttcctattaggaaaagccttcagattaagcctatatcctatacgagtatggcttttaaatgacaaaataaatatatgttaaattaaaatgctgacacaaaagacctatgttttgtagaaaatccctaatagtttcagctttggctagattttcagcgaatatttttgaacgaaacttttctgtatgttgaatttatccagaaattacagacacatttccatgaaatattgtgaacttgattataatccctagtgtaagtaaccgatattcatacaaataaaaacatctctttgacttaagcaaaataaataataattaagttattaattaccgagtctgcaataatataaaatatttgggtactgtgctttgtacaacctctgaggttcctattaggaaaagccttcagattaagcctatatcctatacgagtatggcttttaaatgacaaaataaatatatgttaaattaaaatgctgacacaaaagacctatgttttgtagaaaatccctaatagtttcagctttggctagattttcagcgaatatttttgaacgaaacttttgtcgcgactcacgtcacgagaaataaaatggaaatgataaattttataagcatgatgcaatttcattaaaaatgggaaaaaccttaatttaattggaaatgttccccctcttcgtcgttctattcaaaaaatatttgtttgtttacattcaattcttattcatttctcacacaaaaatgtattaatcagcgaatgacaccctatttaagtcgtggaattgttattgaaatcggttcagtcggaataaaacatcattcccctgcttgtctactgtttgtcccaatttctattttgccaaaatttttgccgggccgaatttgcatctgtttggtcccgacaagtggtgcaacggccgggaacctctgcactgatgaatgcttgtgatcagcgggtggcagacgctggtacaagggcgacaggacggagaggagtcagtctggtcaactgatcgctgtccaccgccgcggagcggatcttcacaagcaacaagggatcagcctggtcaactgatcacctcacagattttacgattaaccaaaatcaaccgcccgcctttctcagcacagacaacccggaatgaggcataagaaataaaacaacaacatacaggcagacttgcagcaactgaaccacccgacaactttgctgtggggagtgtcgcgactcacgtcacgagaaataaaatggaaatgataaattttataagcatgatgcaatttcattaaaaatgggaaaaaccttaatttaattggaaatgttccccctcttcgtcgttctattcaaaaaatatttgtttgtttacattcaattcttattcatttctcacacaaaaatgtattaatcagcgaatgacaccctatttaagtcgtggaattgttattgaaatcggttcagtcggaataaaacatcattcccctgcttgtctactgtttgtcccaatttctattttgccaaaatttttgccgggccgaatttgcatctgtttggtcccgacaacttttctgtttcttgaatttatccagaaattacagacacatttccatgaaatattgtgaacttgattataatccctagtttaagtaaccgatattcatacaaataaaaacatctctttgccttaagcaaaataaataataattaagttattaattaccgagtctgcaataatataaaatatttgggtactgtgctttgtacaacctctgaggttcctattaggaaaagccttcagattaagcctatatcctatacgagtatggcttttaaatgacaagataaatatatgttaaattaaaatgctgacacaaaagacctatgttttgtagaaaatccctaatagtttcagctttggctagattttcagcgaatatttttgaacgaaacttttctgtttgttgaatttatccagaaattacagacacatttccatgaaatattgtgaacttgattataatccctagtgtaagtaaccgatattcatacaaataaaaacatctctttgccttaagcaaaataaataataattaagttattaattaccgagtctacaataatataaaatatttgggtactgtgctttgtacaacctctgaggttcctattaggaaaagccttcagattaagccgatatcctatacgagtaagggttttaaatgacaagataaatatatgttaaattaaaatgctgacacaaaagacctatgttttgtagaaaatccctaatagtttcagctttggctagattttcagcgaatatttttgaaagaaacttttctgtttattgaatttatccagaaattacagacacatttccatgaaatattgtgaacttgattataatccctagtataagtaaccgatattcatacaaataaaaacatctctttga

SEQ ID NO: 18761 - DNA, 2563 bp, Heterodera glycines
  misc_feature (523)..(523): n is a, c, g, or t
  misc_feature (528)..(528): n is a, c, g, or t
  misc_feature (538)..(538): n is a, c, g, or t
  misc_feature (551)..(551): n is a, c, g, or t
  misc_feature (554)..(554): n is a, c, g, or t
  misc_feature (565)..(565): n is a, c, g, or t
  misc_feature (567)..(567): n is a, c, g, or t
  misc_feature (572)..(573): n is a, c, g, or t
  misc_feature (575)..(575): n is a, c, g, or t
  misc_feature (584)..(584): n is a, c, g, or t
  misc_feature (604)..(604): n is a, c, g, or t
  misc_feature (613)..(613): n is a, c, g, or t
  misc_feature (615)..(616): n is a, c, g, or t
  misc_feature (621)..(624): n is a, c, g, or t
  misc_feature (633)..(633): n is a, c, g, or t
  misc_feature (647)..(647): n is a, c, g, or t
  misc_feature (653)..(653): n is a, c, g, or t
  misc_feature (678)..(679): n is a, c, g, or t
  misc_feature (683)..(685): n is a, c, g, or t
aaatattttgatgtgcaaattccgtttaattgatttttgtaacaaatccgcaaaatattcagagctattgcgaacacatttaatcagtgccaaaaagctaaataaaaaatgtaaacaaacaagctaaattattataaatttaaagcctaattagatctcggatcgttatcctaattaccccgcttcgtcgtcaccgccaaattcctgtttaattcccgtctcaatgtcttggtctgcaacttcatgataaaagtcgaatgtgagtcggagcttaacgaaatgactcatcatttttaaatattttaaatgggaattttatttttatttaaaataattttttttatatacctggactaagtttcttgtagcaatcacttcgttgaacactgattcgttaatgcttttttggccttcgccttctttgatcagcttcatagcatcctaaacaaatagtaacgaaaattattaaataattttttaataaaatatattttcaaattaaaagaaattattggtaaaaagnaaatnaaattatttnatatttgtatatnaantaaaaaaattnantaaannangaaaaatanttgaaaaatggttgggtggnagagatgangnnaaggnnnnaaaattttnggaaatagttaatngatggnaaaatttttttggaaattgggaatnngatnnnaaaaatgtcaaaatccgaattccgtaccatccatgttgcatggtgtgccatttgggcacatttcaagataaacattttatttatttcgctaattacttccttagccaattgctcgtcgaccagctcagtctcatcacgagaatgtctgagcaatgagagcaacaaattttgaaatgggccgcttgtttttgctttaatgtcattctcaaggccatcaaacacatgattatatgtatcaattagttcagcaatttgtccatttgtgcgtgttatcaaaatttcggctagcaccggcctgaaatggtccgcgcagtaattagggctcattttttattttgtatctctataaattgtccaacaagggtaggcttttaagcaaaaaaaagtagactttcaattttagccaccatttgactttttttttcatgtttttcgctttggtccgtaaaaatttttcatttccttttcggtgataaaatattaattaaattttagttcattttaaattagtttttgggtttcatgaaaaattattaatttcatttctttttcgttccaaaaaattttttggtttttgtgtgactttgtttccgtgcttcgtgctttgacgtttcctaaatctgccaaggggtcaaaaaaatataaatattgtacataaaaattcataacttggcttaaattcaacaaaaataatattaatggtatcattcgatagcatttttttaaacataatatgatttcacaaatgtataaaaaaaaaagttctcgtcaaaaaattccaataaattttgggtcagaattttttaagtgttaaaagggtttcaagttcttaaaaatattaatttgcttctgaaaaaaagtactgaagcatttaattaagcattaaacggatgaaccacacgtttttgccatgattatgcatattttattgtcaaaattaatgattttcattcaatagcccaaaattctttgttaaaattttaaagaacaaataagttgtggccaaactaattctgattcaaatttttgatatattattacaataaattaaattggattttttgatagagaacactaaaatttgttaaatgataccatgaaatatttttattttgattgttttttgagcaaatctaatgaatttatatattttttcctaaaccttggcggaattaaggttaatctcctaaacacctcacaaatcagtgctttttacttattgatgttgaagccgctcaatgcattatgcatttggtttgtatcataaacaatgggcgtttgcatcagataaaaacttaaaattttataaatttatttaaaatatgcatgatttaatgagaaaattatgtttaaaaaaattacatcagttcccgaaagtcgccagtgaactctctatgcagcatagcaatcatctctttctcaaatatctttttatatacttcactcaatttttggcgctgaattttttttttttttttttgaaaaattttattctatagggatcaatttttatttaaaaggttcattttttaaataccgtaaaataaataaagacttttttccatttgtttccattttatatcatcattattagatggatatggttgccaaatgaaaattttcaaaacaagcttttggccgacaaaaaatcagcatttggggtcaaacagcagcattttggaacaattttgaaaatttgagtgtatttttatgaaaaaactaagttttaggggtccggcgggccgtgccgggggaaaatttgaaatgttgaccatttttaacagattttcactaaaaattggcaatttattagtcaaaatttttgtaaattttaggggaattttgggggggcggcggggctgtatatagacaaaaaat

SEQ ID NO: 18762 - DNA, 1225 bp, Heterodera glycines
  misc_feature (48)..(48): n is a, c, g, or t
cagataatttgcgtaacaatagccttaatttataaaaaaaaatttcanaaaaattttgacaatttttttttgtgcctctttcttcgtcataattgcagcttgcaaaatttctgcataagctacagcgagatttgcatcaaatttcggattggcatttatggttgggccaatgttaaccggcacacaatggcaaatcatcatcacggcaccagtgatcagcaccagcagaacagtgatgattagtgaatttttgtccatttttaatgattgaaactttaattatatgtaaaaatccaattttttttttacaaattgtcaaattaaaatgcaataatttgaaaagataatgaatgagattgacaataagaaataaataaatccatatatgcatgccatgccaataacacatgttcaacgtggatggcaacgcgacaaataccagcaaaaaaaaaatttttctatttttttaatggtggctttgatgagaggcaaaagaatattgcaaaaaattgtatttctaaaaaaaaaacattttttaatagatagatataataaaaaatttatatttattcatatgattcacaatatacgatgcttgtatcacgattactgaaatgaagttaacaactaaaaccataaaaataaaattgggcgctttggagaggaattttttgtaaatttattttattaaaatttgaaatggtaattcattcattagacgcttgaaatgaccaagggcatgggttaatggatactttcttctaagccggaatggtgagcctaaaagtgacaatgatatatgggtgtggggatatggcaaaatcaagaattcaatatatatatatatatatatatatatatatatatatatatatatatatatatatcaaaaaccatcaaaatgggcgttagtcaaaaaaccatcaaatgaataatttttgacagaaaattattcataatttcgtctaaaatagatcaaattttataatatagatatttttcgatagccctaagtgttttctattatcctgcaaaattagaaaaaaattctttaagtttaaaaaaagttatgacctgagaagctcaaaaaccaagtttttttgaacatttttagtcataactttcttgaaacttaacgaaactttttggaattttgtaggctaatagaaagcacttagtgctatttaatgatatcaagaattaaaaatttagatgctttgaacaa

SEQ ID NO: 18763 - DNA, 2032 bp, Heterodera glycines
  misc_feature (772)..(772): n is a, c, g, or t
tctctgccatttcccaaaagcactttttgattttcaatcttataccaacttcttttaaaagtcttagaaaattttcaacgtcaagtctttcttccgtctcacttccaataattatatcatcgagataaattagcattgccgctgtaagtcttcgcctcaaagagttcattactctctgaaaagtatccggggccgctgtaagtccaaagggcattgtaatgaactcaaaaattcccaaatgtgagatgaaagccgttttgtctgtatcctctggggccattgggatttgcatgaatccctgctgcatgtctaagcatgaataaaattgtttagcgcccattaggtctaaaagctcttgtatatttggaaggtgaaaaacacgttcatcatctttatttgtttttcgatttctttttgtgtttcgggagggtaactgtaaggtcggaaatgaaaaggtactgatacgggcactaagtcaatccggtgcacaattggacatttgtaacggccaattttcccatcatcgccaacgaaggcttcatgatatttatccaccatttgtttgagatttattttccctttttcacttaatttcgttccattaaaatttattctttcggatgggaaccgattcaatttttcttcgggtaaatttggaagattttcactccaatttgcctcagggggtatataattttttggtagaatttcatctccgggtaatgcatttattagcactggttccaaattggctaagtgtgaattttcgtanatttttattggtgcttttccagcgtttaaaatttgaattgtaacatttttgctgtcccgggtgaaaccaaagtccttccgacaattactccgggatattgatgtgcaattccttccaccaaaaaattctgatcatttttgaaattcccgtttacatttgctgtcaaaattgtttccgttcttggttccaaaatttctgtatttttcatagtcactctcatgggtttctctgattctgtgccaattaccgaaatgatgtttgtccaaatttcgccaattttcacttttctttctccaaatgcaataactccctttaattcagttaaaatgggtaatccaattaaaagtggaccgggacaatgtttgtccactgataccaataaagttgcttcccattctccactttttcctgtgagtggatcttcaattcgaatatttgcttttgtttttcccaaaattagaatttttgagtcattcgccgcggccaaatttgttttgtcagtttctaatggctcgatttttaaccccgctttttgagctgttttttctctgcagtaagaaacacttgcgcaagagtcaaccaaggtttgccaaaaggccatttaaatggattttgattgttggcaattttcttggattattcgttttccagagaatttctcatattttcttactcatctgacttaattgcattttctaaattgtctttcgccttttgaaaaattacttcatcactttctttttcatcgacttctgacaatttttgaaattgtgagtctttttctccgctttcatttttaatttcaattgtttcagttttcattggttccctcccagaatttttcgaattttttttagaaatctttgaaagtattgcatttttgtttggcaatgcctttttggcctttgtttccgccacttttggtttgggagttgtggttgaaattgtttttattgtggtcattttaggtgtttgtgttgtggttatgtttttgttaccattttttcttttggtttttgtgtggtcattatttttggaatcttttcctcctaggcattgtttttccgtttaattctttgccaatttttaccgttttgggaggtctttcttcctttttcgcttttatctctgtttttgtcttatttccctcctttaacttttcattctcaaaaacgaaatccgaaatattcttctgagttttttcctgttttggatttgttgtagtaaaactcatcaacggagttttggccgttgttgttg

SEQ ID NO: 18764 - DNA, 2448 bp, Heterodera glycines
  misc_feature (1341)..(1341): n is a, c, g, or t
ttctataagccatattctaaaaatttgaattttggtttgtgtccgaattcgggcccggggctcagaattggtttaaatggacgtaggattcgtgatcactagggctcggatttttaaggacgaaaaagtccaaaataaggccgtaaatttcaaaatgttattatcaaaaattataaaatataatcataaacataattctaaattcgagaatgaattaagtcactattagcgaaaagcaccgccgaaatttttggaatttttatattaaaattttgggggaaatattaatttaaagaggagtaacaattattgatctaatgtatatcttaataaaattttaattataatttaattatttttgtatattttttcctatatatatatattaaataacaggaaaagcatcaatttattgaataaaaatcaatttttcaatgtttataaaatggtttatgacatgttaaaatgcatatttaacaaaaattaaaaattttaaatgaatttatttaaagtaatatttattattccattatttcttttcataatttctgttttttacaaaaatgcaaaagctgagaaattgaaattgcgcgtcatttacggacaattggatgcaaattggaaggtccaattggatttgatgattgtttcccattaccacgaatatggtaattaccataccaaagaaatggtacaccgtaacattgaaaatggaaagaattttgaagtaaatttggagaacggggaacagacggagaagctgacactcggcttcggattctcaatacaattaagcagcagcagaagaagccaatttgagactgtgagacttttaaaaagataattggggaagataaatggaagtaattaactgattaatttattggcaagcaagaaaaaattaattgtcccggtcaaactagtacagctagatttgatttacattcctaaatacgaaataatgagcttttgtaatcctcttatgccatcctcgccctctccccgcttcatttttggcactttttccaaagtttagttgggaaatgcgagtgacaccgaatcatcggatgatgcgtcgcctttccatcagcccacttcaatagggacacaattgaatgctgaacgtttcagaaaggttgtccgggttgatctgtacaggccgaactttgcgaaacggcaccgaatcgaattgggcaatgtcgaagtgccaatgccgccaaatgggacggcactgttttggaatcgcagagtgatttttgaggcgaacaaagacacgggcaattatcatgcctttttgtatgcaaatgttggcaaaaatggtcggagcaatcgcaactctanaaaaatgtttatgggctatgcaccgctattgagaattgggcagcacggggaaggaggagaagcaccgacaatagcagcagcagaacaacaacacggggtaattagggggtaattaagggaagcaagttggagagagcccaattaggaatttaatgggatttgccgaaagtctaattgaattgtaaatcatttagacctctgaataccaagtgacaattcctgtcaaatttggcgaattcttcaaacataaattgtggaatctgaaagtgtttatttaccaatttaaagaggtaataaaatagcaaaataattcaattaaaaaagattaattcagctgccaagcgcaggccaaaaccgaaacgcaacagaaaatgaccaaaatgaggaagaaacgtgcccaatttgcttagattctctccagttggagaatcgtcaaataatcaaattgcatggaaaaaggacgaattatgaggcgaatttttttgcaattttttgacaaattaatcatttttgatttaattattatttttagcacaaatatcacgccgattgcatcacacgatggtttgttgaaaaagataactaatttatttgaatattttaggatcgaaagtaaacaaatgctgcggtgccctttgtgtttgaccgacccaaaattaattattgtaataagaaatttaattgccatgccattaatgcttctcgtgtctgttccctacaaaaggtggccgattttgcgccaattttcttcgactcgtcccaaatttatcacaaaatgtacgtcaatccaaccgcgcaactgtttaaaatggcaaattcggaaggaaatgatcgcttcagccatggccaagcactgcacgcatttgccaacatccgacgcaaaatggagcaagccgaaagggcagtgaagcggagtttggccacgatggaagtgccattgttaatggacaaattgtttggcgaaacgttttttgaagtcggatttaacggatttggcgagaagcaaagcattgaaaatgtgcggaacgaattggagacaattgtacaactgaatttcacacaaaacatgatggataaggcgaaggaaacgctgaaactgatcaatgg

SEQ ID NO: 18765 - DNA, 1790 bp, Heterodera glycines
attttaggagaggcgaaaagttcagaatgagttagcaatgggctcgggagaaaacgtggcctcagcgaaagtccgcattgatgtacgtgtcgtacaaaactacatgaacataagcgaagaagaaagaaacaaaattcgcaacgaggcatgcggcaatgcaaaagcaacaaaaaaagtaggcgtaaagattacaacgaaaaaccatttcacatattacaggcgctttatcgagcgcaaacaaagcgcttccttcatgaacgtccgcactcttcaaggactggcacaaaacgattgtcgtgcgctgtggatcactctccgagcaagaagcgccgcaccggaatcgccattctatgacgaactgcttatgcgctacttggacgatgatctggccatattcgcatcaccgcgacaacttcagttactgaagaaatcagctgtcattgtgtcggatgggacgttcaaacaggcgccaaaaggaatttaccaagtatagttatcatcctatttttttcaattttttaaattagatttatcatgtcttcggctttgtagcggcgactcatgcggtaccgctgtgcacggcactgatgcgtgggaaaagtcgtgtcatttaccgacgcttctggtcaacgttgagacaggaacttgaggacacagaaggagagctaatggttgctatttctgtgaaatttatatatttttcgtgctttagataaaccaagccaattttgattttgagcccgcctcaacgcgtgaacaagaaggccgcgcatttcaagcacttcttcgcaaaattggcgccctacaatttgcacccccaaaccacgtcaaccgttcattgcacttgatacagcaattgatcaacgaaagcgagttggagttggttattcgattgtcgttgttggacatattagaatattatgtttgccttatttttttcttaaaaactaaacttaggtcactacttgggtacgcaacagcattggctccgagtttttctctctttttgatgttccggttcatcggacaatcaatcatgcggagtcttatcacggccgacaacgttggttttatcaaccacatcaattactcggtcgttggcttgtgaatttccaggttaagaatttatttttttcaaatttgactgttttgcttaggaggttaatcatgcagaagaagaatcagctgtgtcaattgaagagggacgacagccaccatctcaacagttggcagtcaccgcagaaatagatgccagcatcgcgcgtgagaaggctgacattttggcattcttggacagcgattacgaagatgagcaatttacggagacaatgtcacgctactatggccgtattggacatttgattgggttcaatgtgcctccaagattagaaatagaagagcagatggaggaggcagcagcaatggaagaagcggaagcgagtctcaatgagagtggaatttatgttgtgccaaatgatgaaaacctcgatccttgttgaattttttaaatgaattattttcattttaccgaattttgtgcatttttatgatttttattatttattttttgctgaatttttatcatttcatcgattttcgtgcattttttcgattttaaaaaaatttgagcgattttttgttgttttttttttcgttttttgttgcacagtacgagttgggaatcttagtacgagttgggaaacttagtacgagttgggatacttagtacgagtcggggtaccagtacgagttggggcagtacgagttggcctagtacgagttgggtgtcg

SEQ ID NO: 18766 - DNA, 1142 bp, Heterodera glycines
tttaaagagaacaacacctaaagaaagctattggatggttctcaaaaaagttaacttaattaattttttctggaaaaataatcaacgactttttttcatcataaaattttattgagaaatttaatttcttttgcaattttcgatcactaaaattgacataatgaccattgcaaatttcaataccctcgacaaatgctcagccgtgttcgggtctcccgggcgtgccgacatggtggcctttgtgtgccgggcagcgtctgacgagaatgccattcggctggcggatgccgtcatctgaaaaaattgagaatttgattaattcataagctttgcggaagcaattatattcgctactgtataatatcgtactaaaaatataaaatttaaaattaaaatattttgccaaaaatcatttgctccggtattccgaaaattcttctgctgatgggcctctcaaaaaacaagtacggacggggcaaaaaaaaggcaagttcttgtagatgtttgttttatttttgcaaaaatgacaattttaagaggaatgtttttgtatttatatttattttaaaatatttttaagtgtttttaaaacaaaataaaaacccaaaacataatttaacgtaagcatttttttcgcaaatcctcaaaaacatttaaaaataaataggccctgcaaacgcaaaaatttatcttaataacagcccaaataaagaatttttatgtatttttaggtccctaagaattctttgaaaggtcattatcgcagtcttaaagagatttgtcaggcttttcgtccgccaaaggcttttaccttgaccattgtgccaccaccaccctcggcttcaccggttggcaagcgctcagctttttgttgtactactgctccagttgctgtcggtgccactaccgctcgttgtcgttgatgctcctgcgattgttcatggcgatgagaattttagaattttataggatgtgtaaaagatttttcaattgcgctagaaaaccgccgcacactcgactacggcggccagtaggtgtggcgagactacgggctacggaagaagtccgagcgtgatccgcactgagtctcagtgaaaatcgccacaaaaggaccagaaaaaaatcgaattaaaagtaaattt

SEQ ID NO: 18767 - DNA, 914 bp, Heterodera glycines
atcgcctcgggggcgcgtcgggcgtatccgatttcaacgaaatcaatcaatttgcgatcacaccgggccccgatcactttttgttacagctgcgcacgccgctagacgggtttatactagccaaatagcttcaccgatcaatcgatcgtggaacggatttttttaggccggtgggggaactgatcactaatcggaggaatgattttttggcgagatttgtgaagtgtgggggggggggagggaatttgcgcgcacatttttcaagaggttcaggagaagcggcacttaagcgcaaaagtttacgaccgatcagctcattaagtgcgggcggattagcttttttcgaggaccaatttagagtgtgccaatgggagaggggaaaggtaatgaaatgtttgctaaatgagaacacaaatgcggtaaagcatggggtggggggagagataaagcaaggttaagaaactttttgaaatttcggttacccgtggtataagaaacattgcgagataaggaaatatgctttaactgattacttgggcccggattaaaatgctaaagaatttaacttcaattttttgtagaaaaaaatgcaaaatcatttttatgaattgcaactatagataagttatttttctcacttctaaaaattaacataattcaatttttttaacttttaagtagtgcatttttgaaaatttaaagataaaattctatgagtgcattttaatttttattatatttatgttcaggaattttttcaaaacttaacgaaatctttattaaacctaaaaattctcatcatataaaagtgaaggaaaaagaatggaaaaaagctctcaccgatagcctgttctatgaaaacaccttttgttttggccttgatcacaattattctctagtctttccgtccacca

SEQ ID NO: 18768 - DNA, 1032 bp, Heterodera glycines
tttccaattcggttcgaaaaatggtgttaaatgtgaacagattgcaaaaatcccaaattaggacaaatttcttgcacaaaaaaacttgttgaaaccaaaaaatttaatgagaaatgcttttaaagtttttacgcttcttatttaacagcatatgagcaaaataaataaactcaattaaatataaaatattaattacacataataataataataattaaaaaaacagacggactaatgactgacccgaatgtattggattgcccagtggggaagagtgaaggtcctattgaacaggacaatgttgttcagacgcaccgaatagtcactttcattgtagaagtaaatgtccaaattgaacgaatttcccggcttaattggccgtttaagcggatagctgtccttctcttttagatcataatcattctaaattaattgcaataaggacagtgatcaaacaaagaaaaagagagagaggagagagagagagagagagagagagagagaaagagtaagaaaaagagaggagtgagagagattgagaaagtgagagagaaagagagagggaggggaatgagagagagaaatacacacacagagagggagagatcgagaaagagacagacaaagagaaagaggggagagagagagtgagtgggtgagagagagagagggagagaaagagagagagaggagttagaggaggggggagagagggagagatcgagaaagagacagacaaagagaaagaggtcacagagagagatactcacgtgcgagaaacatagacagacaaacagaacgagacgctccatttgcatggcgcaatgttttcgacactttccgcgcgatccgtttccatcttagtcggctgaaggcgctttcggctgattgccaacaatgcgctgcactttttgatcgaagcggcagcgatcggagaaggcatttcatcagccgactagttttcgccaaaagatgccctaaaatttgaggaggacaaagtgccaaacacagaaagggcttacatttttactc

SEQ ID NO: 18769 - DNA, 743 bp, Heterodera glycines
aaagaggggagagagggagagagagagtgagtgagagagaggagttagaggaggggagagagagggagagatcgagaaagagacagacaaagagaaagaggggagagagggagagagagagtgggtgaaagagagagagggagagaaagagagaggagttagaggaggggggagagagggagagatcgagaaagggacagacaaagagaaagaggggagagagggagagaaagagagagagagagaggagttagaggaggggcgagagagggagagatcgagaaagagacagacaaagagaaagaggggagagagggagagagagagagagagggagagaaagagagagagaggagttagaggaggggggagagagggagagatcgagaaagagacagacaaagagaaagaggggagttagaggaggggggagagagggagagagagagggagagcagaaagtttaatttaatttttttatttataaatttttcatttctcttttgcttatgcttatttgtttgtaaatttacaaagcgctcggagcatttcaactcttttgcgctgaattgcatgtccaaaatcactcggccaactgaaaaatgactcacaatttcaccctttttaaattgatttgtcatactttttttcactttttctttttgctgaattgacgaatgaactgaaaaaagatttttatcatttgttgatattattagcaaggacggaattatttagtaata

SEQ ID NO: 18770 - DNA, 663 bp, Heterodera glycines
  misc_feature (579)..(579): n is a, c, g, or t
ggttggaccgacttgagtcccagcggatcgctccgatccgccagcaccggcactgagagtggcccatttccactctttccactcacaaccaaatttttttcaacccgcaggcaagggttttggagacagaagaattggggcggtttgaaggaataggtttttgcatctaaacaaatgaaaacttggaaaataaataaaaatgaaaattgaaaatggaaaaatggaaaaatgaaaataaggagcggaggaaaaaaaatgagaatgaaggcaagaaatggcttttctgaaggatgagcaggccttaaataacgatgaatccgagtggacgatgggcgtaacagcaaaaaatgtaatttattttttgaatgttacaacagcggcgaggcaatggaaaaaggcaaaaaaccctcccgagcggtaggggagagtcatctccgtaaaaagctaatgtcgcgacgggggagagcaaaaaacgggagagggaacgggagatgaattgctttccgtcgctgccatatttggcacggagagaaaaaatggaggggcaactgcaaaactttgatcatatggaattaatanaaatgcagttataagcggggaaattgcaaattttaatgaaataaaattcaaacattatttcaattgaatcgggttcaattgacc

SEQ ID NO: 18771 - DNA, 1901 bp, Heterodera glycines
tttgcgtttggtgaaagaaaggcaaaaatatttcaggaataattcggaatgaattttggtctttggagactatgattgccaaaaaataagggggcggggtggaatggaacattcgcaaacatgccggcacaaggaaattgcgaaaatgggcaaaaacttaaggaaaatgttgcaagggaaaaaaaggaattctttggccttggagagaaaagaagaaaaaaaatgggattggttgtgcaaaaaggacggcgccttccaccaaaatctcatgggaaatgaatggcaacaaaaagggaattgccttaaaaccgggagaaaaaaaggagacaaaaagggaccaaagaatgccaatgagaaccgaaaaggataaaggagagaaacaaaaggaaagaaaaattaactaacttatctgcgttttggtgattgtagagagtccatggcggcacataggtagcggtatgacaatcgaaattgctcattttggagccattgctgattgtcttcgagttcatcagcgccaaataagttcgttccgacataaatctgctcagcccaccaatcgcgaattccatcacccgaagttgaccattcatttgctgaagtcttggctcgaaatcccgtagtttggacccgggtgccttcttctaattccattaaattaacacttgaatcgatttggtgggggaagaaacgctgattactttcttccccatacaaaaagacatcaatggccataatttctgaggtgattttattttggttcacttccctaattattccacagcagctcgaagggacaatttgactcactgatggtcccagttttggaggagaagtcatttgctacaaatcaattgttttgacccgagttcctaatagagattgtttattccaatcaacgaaatttgtgtgaaatgtggccagttattgttagggtccagtgtaatagtcgtcacataacttggagtactttggaagaccaattgatccgattctaggcttaaatttttccggtccaatagctcattttgttcgcccaaaatgtccggttgtaccagtgcccacagtatggggtgtgagatgaacacaaaccccaaaactgagctttcaattggcgatggaccagctggcggcggtgaggtgtccgcaaatattttctcaatttcccttagactagccaatttttcagaatccgtcaattccagattttcaaacaaattcatgaaattaacagaattttcgtcaacctcggttctcattgattcatttccatttccggccatattttctgtttcttgcctgcaggcgaagggatttggattattattgggattaatttttgcttagatctaagaagaggggaaaaatgttcataaacgagcaaggtgagagaaaaaaaaatcagaaaatgaaaatgagtggctatggagagaagaatttattgaccgatgggtgcgaagaaggcggggcaatgtacatgacgcatacattaaactaaaggggctaatgttagcctaaatggatgcaagagataatgattggagaaacaattgagaaagggtcaataagtcgggcaattttaatgaatttcaccttgaatttgcgttcaaatttattaatatttattaatttaatctttgtttgtagattaatgtgaaaatgtgcacaaaactgtagaatcattgactttttagaatattatctagagtacctggggtccgggaattttggacaatatcaggtctccggtacccgtgggcactctaaaataaactatttaaaatacaaataaaacagacttttgttaatgaacattcagcactttcatacaaacatttgctaaagcttttgtcgcaatcgtagcgtttttagatttgtttatatagcataaatcatagtaa

SEQ ID NO: 18772 - DNA, 1125 bp, Heterodera glycines
ggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgcatatatctcagcgcctagtgcatgaataggagcgtttttactgttttctgagagcgcctgaaagcagctttcgaatggtatagctgatttttttggatctggaattttcgcagagatatatgcaaattagtaaccagtgtttcgtttcaaattatttctcgtattctaacgaaataattttttactatgagtgtttggtttggaaactgtctaaaatgttccgggtcgcccacattgcacaattttcttgaaaataccatgaaaaatgctctaactccaagagacttagttgagcgcactgcaaggagaaccctaacacagttcagcacaaaaaaattaactattcacgcttgagaacgcgaagtttgctgcggagaatggcaattatatgcagaaagtcaagtgca

SEQ ID NO: 18773 - DNA, 1209 bp, Heterodera glycines
agtctgtttgagcaatactgttaatattaactctccgttttttaggatttatttctctttcatgaattatacgagaaattgttttaaagaatatttttataattttatccaaattctataagaaaaatacgattaaaaatataagaaacgaactttcaaattttaataacatccaaaaattggcttttttcaaaaccaaagccatattttacaatttaaaatgagtgattcacttttagttggaaatgatgcgccaaactaataaatttgtttacctggaagaaactaatgtaaaatttatataaaaattgaactaattatacaaaataaacaaaattcagttcaaactgttggggatggaatttgtgggagggaatgcgcacctttccatcattttgccaaattcaaacgacggactcacaaaagtgttgggggaactgacggaggccaaattgatcagaatggtcaaaaaatcatcaccagtcattagagttgaggtgagaaaatggaatttgatttgatttaatataaaaaggtcaacaaaagtgcggtagaaattaaattatccaacttatcaaaatttcatatcaattgactggctaattgattcgtgagaagtatttactcgatcctcctcccttattatgagtttatttgtttattttagggttcgagccccgtgggcgggggtggcttttcgcggggacggatctttagtcaatgtatcgccttgatttaattccttttggcataaagtgcacagattttgtctaaaaaaatgaccaaattagggattttaggctaatttaagagaagaaaaggttttttatggggccggcagtgccaattagtaccgcagaattgtataaattttttgccctttattccatgaatatgccattgggctcaaaagtgcgttcgatccgaacagtgccgatttctcgggcataagccatggttcgctgttcattggcaatgtgcttcagaaagcgatgatttcggtaaggcaaaaagccaatcataaataattagcaaggctcggtttttatctgataaaagaaatgtatttcattctttacctaattctctgcacaattacaaatcaaaaacacttcaattctttttgtttgggttgccccccggcccccgacttttttgggcctatcccccgaccaccgaccagggacgggcgaagctcagcttggcact

SEQ ID NO: 18774 - DNA, 905 bp, Heterodera glycines
ccaagtttcatttgaaattccacggtcacttgccaacccctccttgtcagcccccccctcgctgcgcccttgtggtcaatgacaatttagcacttcttattctcatccgagagatcagggaggaaccctaaaaaataataattaatctgtattgaactaattaatttataattaggtggatgaaaaaggctgtgaagcggctgccgcgacagttgtaaaattcaagccaattgctaccatcggccaaaagccgccgccgcccgttttccgtgccgaccatccgttcgcattttttctagtcaaaagcgcaaaagaagtgatgttcggcggagcatttgtgggcaaagaataacggaataaagagaaaataatttggaatgaaacagaaaacaattaaccaataagaatttgaaacgaaataattaacgaattttgaactgaagtaattattaataatttgttacaatggaattgagagatatgtatgcgcatcaaaataataattaaatataagaacatggtgtgaaatcgacagagcaaaattccaaagtactggcaaactaattgcgaaagaaaaatagggaaaattttgaaaatttgagtcaatttgtcaatagtcttaattaaaaaaatttaggggtattttattgtcttagcaagtgccataaaataattttaataaattgaattattctattttcattgaaatttacattccaaccaacctattaattaactttgtttaaatatacttctttttaaaatttatcaaaagcaattattagaagagtaaaaacacatcattaattaagtacatttttattaaattgttattttttattcgtttaaagcaaatatcttcattgatttgagtgttaggttccatttaatttttatattgataa

SEQ ID NO: 18775 - DNA, 2084 bp, Heterodera glycines
actctcctggtccagtgtcccggcagtgtgaggggatccacccaggagcgccatgtagaccataaaaggtaactcgcccggtgggactcgaacccacgaccccagcaatccgtgccgtgctctaaccaactgagctacgggcgcctcttttagaggttctctcaggtcctttatcccactttctcccacactccgttccttctggcatcacacaataaatatgtttttatttcttatttttgaaatttattaataagttagtgcgtaattgtattttaattagcatcatattaattaattttgttaaaataaccatcttgattaatttaatattcttaataatctttaaatgagtaatttaaggaaaagattttgcaaatatttgttaggtattctatcaaaaaattgtgtaatgctagttatcagtatgtaaaacgaaattttatttaatatttataaatctatatgataatattggatttttatacataatcacgcttaaatatgtttagatgttcatttaaatttatttaattctgtaatttaagcattttatttaaatgctatcttaaatttaaactaagagaaaattttaatatccgatatgaaaattagaaaaattttttaggaaaacttaattatcctgttttcaattagagaatgcatgtaattttcattcagtttgtcaaggtttattttcatttttatttctcttttattgtttttttgaattacaaattttttaacaatctaagatttcttttgcattattaaatattctttgtacttttaatttttctcttttagaatattcaaatatattttattctagtagattattagggctgtattcttgtgcatattaaattcatttatatttttttaaaaatataaaattataacgaattatatcacatcatgttttaaattaaattcattcatttcttgcgatgaccggatctcttggatcttcagttctgttctcttattttctttattacactattaagcttgaaattataatacaattttaatatttttctttaaatttatatgatttttattttatgcactttagaatttttttgttatttaatattgttgttgtttttttgggttcacttgcataattttatttggctgattaagcattgaatcatatttcttcttgtaacattagaaactaaattttatagtagttttttttcatactaatttcctagttgtttttgcaaatgtgttcagacatgcttcttttgttattattaaaattaatttttatagaatttcatcattttttaaataattaattttatatatatatatatatattttttttttacttccgtttattattctcctgctggtccaccaccaacgggcttggctgcgccgcctcgccggcgtccaacaccgtgctcacctccccttccgccggcggtgcttgcacaacgccagcgtcttatattctattttttttaataatatatgaaaatctattaattcttcatttatttatttaattttagcttacaaaatagaattcccccgacaaatttgtcgattaagtcacgccgcatctcaaaaggattatctgatttcgcctgttgattgtgtattattctttttgttgttttatttttatggaaatatttctgccttatcatttttattttataatttttggctttttttaatacacaagaaatatgatttttctattcagttcattctttctcaattagatcatttcaaagtaacatcttgaaacttaaaaaatctttatctaaaataaataaatcaataagctttataatgaattaaattttataattgaaattatagagaaaacaaaccttttcataagttttatatcacaaatagaaattgtcgaatgtttattaaatcttgacagttacacaagttataaaacgaacaagaatgattattataaatatttacaggttttaaagacttcgtttttatttatattttttagttataaatattcatgttttttataagttataaaagaacttattataagcgaatttatcaatttatttaaaatagcagttcagtta

SEQ ID NO: 18776 - DNA, 2351 bp, Heterodera glycines
gtgaataaaaatatatgaaataatttctgtttttaattcttcttccgacaacaggtatagccatatcatttaattttctaaaatgatttaaggttttgtcgtgaattttagaaatgagtaaaaaatttgaatttacctggtccttcgtttttgaaaattactttgtaacgagaaatagagttaataataatatgaaccagatcaaatgttcatccggcaccgcatttaatctgcagtatttattgtgtcattctgatacacgatatgatttttaaaaatcatttagaatttatttttgctatggaaaccttttatagtgaataaaaatatagaaataattttgtttttaattctatcttcgacaacagattcagccatatcaattaattttctaaaatgatttaaggctttgtcgtgaattttagaaaagagtaaaaaatttgaatttacctggtccttcgtttttaaaaattactttgtaacgagaaatagagttaataataatatgaaccagatcaaatgttcatcaggccccgcatttaatctgcagtatttattgtgtcattctgatacaagatatgatttttaaaaatcatttagaatttatttttgctaaggaaaccttttatagtgaataaaaatatagaaataattttgtttttaattctattttcgacaacagattcagcatatcaattaattttctaaaatgatttttcacatttgaaaaatgaaactaaaaatttgtaataacgccgcaagttattgacaaacactatcaacctagaaaagagcttaaattaaaaatatatatttcaagtgaaaatacaaaattaattttttattttataaaatccaaaacttaaagctcaataaattaatgaaactttcaaatcaaattttcttcaattatttcaaataattaatcattttggactaaatgatcgaatattattagaaattcagatttgctgttcgcgtcacttttttggcgcattttttccagaaaatcttttggggaagaaagtggtccggcggtgccgataggcgccgccggggggaaattttgaaaaatcgagtgtaatttattaacagattttcagcaaaaaaggatgctggttgggattatcaggttcaacaatttgtacggattttcatttaaaaatgctaaaattgtgtcaattgaaaaaaagtatgaggaatcatattttgtcgataggaaaacaatgaatatagaaaaagaaaatttaaaataattttatttctgtagagggattgaattttttcctttatctccaattttcatctctaatttttcactcagacccccattccccgaattatgtcggggagtcgggggcaaaaagtcgggggccggggacctcggggagcgacatgtcgggggtcggggctgggaatagtcccaaaaatgtcggggatcggggtcggggaccggggagctcggggacggggagcaaccctaaaaatacgaataaatgttaaaaggtaatcatgataaaaagcaataatattttattattattttaatgtatttgaaataagaaacattttttatttgaaaacacaaaaattacatactaactaacatggtaatacaaacgtttagtcctgcgagatttgtattcacacgcgtacgcacgcacgcttaccacgcatgcgctcattcggggctataaaagcctgaccattcgcccatttgggcacttcgtctcacttcttctcactgcttgtactcagcatttattaatcaccccttctcttcatttaatcacatatttatttgtaactaataaaggaattgaaaaagaagggagaaaaattgaagagaaagctcttctcgcataaaaatacaaaggaaaggccaaagcctcctcctttgtccaacaaatcaattaacgttccacaggggaacgttgaaagggttcgaaatccctttaacttttttgtccattccgcgacaatcttctcaaaaatttttttatgattaaaacaaataaatattaaatataaaattaaaaaatgaaatataaaattaaaataatttaatttaagtaattaaactcgaggaaaaaccaaatcaaattttctgtaactgcatctaggtcagtctgggacacaatgtgtgcgtgcgagcctccacggccttggaagtgcacggactatcctgatccaaggatggttacaaagaactttttttcgtaaagttcttcacgaaattcagctaagctattttgccgatccacatacgcacccaaatatcaaaacggtcagtgaaagattggcagtgtctttattgttgtttttccaaattatatatataaatagaaaaa

SEQ ID NO: 18777 - DNA, 2022 bp, Heterodera glycines
ctatttattattttaatttttttaactaattacctttgtcaatagaattctttagttctgtgatttcgttgtacaatttgtgtagtaaattggccatcggcttgtcattctcatttagtgcttttattgcttcgtattcctggctcatggccgggctgtaaatctttagggggtgtattttccaagaatttcagttgttcacgcaaaactcgaagttcaaaaacccgaaatttttaactttcaaagacaaatttcactcaatcattttagagttaaaggcttaccactaattacccttttaacattgataataatttatcattcgcatagataaaatagggataaaatcttgtcaatataataccgtctattcggagcgattacctgtgccgagttgtcccccaatgctgtttcgatcaccttttcatattcactcacatcacttagcatctcctccaattcttgcttctgctgctgttgctctccatgttttccgtttttgatcacctcactgtgcaaaatgtccatgaacgatttgcgagtcggcgcatttttgctgctttgcaccccgaatgcttctgctgcttcattcaatgaaaagttgctgctgttgttggggttcgcgactttggcaaaaacgacgacaaacgacgcaaaacagaaagccaaaagagagggaaaaggcatggaattggaaaatggtgggatatgaattaatgggtgacatatttagcaaataaatattaataaaaaagggtataattccacgttatttgtggcatgacaaatcacacgcatgtaagggaattgacaatggaaaataaagaaacaattatattgcaaatattacaaaaattgattaatttagagaaataaatttaaatatgtatataaataattatttaaaaaaatcgtaatttggatttaaattgaaaagatggaaacttccataagaactcatggtaattgttagaggtgcggcgtgactcacggtcacggttaccgtgaatttcacgtttttttccgtcacggtcacgattcacggggtcaactcacgggttttccgccgtgaataatttacactggataaaattgaaaatttcaggattgcatatttttttatataaaaatttagtaatttttttgcagtttgctaagaaatcggggaaattttttaaaaatttacccggcgcacctatcggcaccgcagaggccaatcttctatttcttcccattatcaattgaccgtcgaccactctccgacacgggacaccctcgtttcggcgccgctcgtttcggcgcctgcccagtttttggactataacttttttctttgtcaaccaaatctaacattattggtatcattcgaaagccctaagtgttctctattagcctgctaagtttcaaaaaatttcgttaatgctcaaaaaaattatgactagaagaattcaaaaaaccaggccacatgtgtacttttggccataactttgttcaaaattgatcaaattttttgaaattatgcaaaataatagagcatcagaagggctctcgaatgataccaacaatgttagatttgatggaaacgaaaaaagttatagtccaaaaactggggtggcgccgaaacgaggtggacccctccgacacccggaccctcttatttttatatccaatcaaatttaaaaataattaaaactcagtaattactttaaaaaatgcgcgtagttatgttgagtaaaatctgttaacaaaccccaataaattattaaaaatattccttggcggcgccttatccaaaactcctatttttcttaaaaaatggctcaaaatgcaaaattttgtcattttttggagagaatctttgcataaattacactcaaattttaaccgccggcctccttgttctcgaaaatttttgaaaaaagcatagcgcaaaaaaaaggtgtaaaacagggctcgcaaacgaaaatttttaaaagcctaatgtttgggtcaaaaagcctcattttcacaaaatttattcaa

SEQ ID NO: 18778 - DNA, 1421 bp, Heterodera glycines
cccgtttttatcgtcccgaatctcgaagcccattttttctcgtcccacatctccggacgtccctaccttaatcccgggtttttatcgtccccaaatcccgagccggaaaatcttgcagtccaatgttttttttattgttcggaacactataaatttccagcagggaagggggtaaactgacgtccattcgagaaaatctcgaaaaaaaaacaaatgtatacagaaatcatcgctaaatcttcgtccgataaattgattgttttagttaattaaatattttattccaaaataattaaataaaatttatataaaaacgatttttctttttgtgccacaatttttttggcattttaacagcttcaatcggttcacacattatgcctgtacacaaatcgtcaaagaaacagcccgttcaaaattggtctaaagaaaaagagggaaaaatttgtgtaaaatttaattttggcaaaatgttttcactgcaaaattcaaatttaaaacgaatgactctctaaacgaattttatctaaaaatgttatttggaaagcataaaaacaattatgtataattaattatttaaatatgtataattataatttacataaaatggcaatttgttagagggaaggaaaaacaatggacggacgagaagggaagagaagcacagaggggcgagggacgtgaataaatgatgagacccttttgtttggcgagagaagctggggtgtgaaaatagtgtaacaaatggagagagcgagagagagagagcggatgaagaaggaacaatagtgtgtgtttttggtgttaaatgttatgtgacaaagaaaaaaatagtgcgttaaatgatgagagtgatatacaaagaaaaaaacggcaaaaaataatcaattgttaaataaaaaatcaaccagcaatgcttccaaaagtgatcagtctaatattgattgatctgcatgaactgatcaaagagaaacagcgtagatttcccgaaaaaaagatttgctgatcagaaacaagggtctgatcaggatcgatcaaaaattcatgaactttagtgcttgctggtcaacaggttggtcattgaatgccaacattgatcagatcaatattgattaaggcaatccttcaataccggatcaagatattaagcctgatcacttgtcgatcaaaattacatacggactgatcagtttgttcaattttggaagcattgtgacacataaaaaacaaagacaaagaaatgagaaacagaatgtgtacgaattgggttggatgggttagagaacacagagggaacgagagaaaaaaaaatcagtgggacgacgaaacacaacgccaaaatggagcggcagacagtgaagacgatgacacaaatacaactgcaacccgacagagaaaacagcagggacagcacagcggac

SEQ ID NO: 18779 - DNA, 843 bp, Heterodera glycines
ctcctccagcgaccgggtatggcggacggagtaggtggacttcatctgagtgatggcaaatttaaaatttgaaatgttggcgtatgcggcaaaacgccaaaaaaatggcgggcactgctatttgtggcattatgtgtggagcagcaacctgctgttgtggatcgtagtaatcgtagagcagcagctgggcatctggagacagtttgttgattaaaattaaaaatgagaaaccaatttaatttatgaaaattttcggggatttaaaaaaatgcataaattttattttccatatgggacgtcggcacggctttttcggttaaaatttcagttcgattggttcacaggaagtggtcaaattagagtaattttccctctgaaatcgccccactaccccaataaagccaccccccccctcccccctaatttttgagggcggggggggggagcagtccatgggcattattagagaaatttcggtattacagtacaaaaattgcacgccccgccccctctcgtccattagcatttttgattatcataggattgataagcagattaagagctcaaaccccgctggtccgcaatttggtagaccaagtccgtgttcatcgacaaacaaacgggcacatcgccaagctaaaaaaaatttaaatttaaaattccatttcattttttttgtgagacgaacagcattgaagtaaatgttcagcttgctgtcctccttgtccagctcaacacgttgcaaatcggcgattccggtcagacgacggacgtcctccttgaaaatgaggaaaaatttgcaaaaagtaaaaattatttaaagaaattaagagaatacttaaa

SEQ ID NO: 18780 - DNA, 1980 bp, Heterodera glycines
ggggaagtgataacggacggaatcggtgctcctttggccgcgtgactgagggagtggtcggtaaaacggcgagggcgggagtatcggcaattttggcttgacgaacgtcgtttaccaccgttccgacattcatagccactggaagagggccgggtgcccaaggtgagcgaataatggggcaaaaattgacgaaaatggggggagggcgatagcgggcaaaaagagatgaggaggaggcggcaagagcatcacgacgatcggatcatcacgagaattcaggcgattggactcatccccccaagagggaccttcaggtcgggattcagactgaatgggaggggggttcgacggcgcagcttgttggacagaaagtccctcaaatcgacgaaatagggggtcgggccattcccttccccagacgaggagtcggacgagggggatcgcgaacgagggggtccgtaaatggactcaagactctcgacccctaccatctcgagaggaaagtaatcgaaatggggggagccggccatccagaccggcactcccgtccggagtcgtcgcccgagtggcggtcgttttgggctgccttcgactttgccgtccactcccgccagtaccccgcctttcaaaagcacctcctcctcctacagtacctcgagaagggctcgccaccacgacgaatgatcgagggatatccaccgtcggacgacaattacagcacagtcgtgagtagagcccggaattttgaaatggccgggaccgggatcgggaccgggacttggaaaatggaccgggacgttatccgggactcccggtcccggtagtttgtccaaaaaagccgggaccgggactcccgttttccgggactcccggtcccggccccagtttttgggcagggaccgggacttttttcaaaaattctcaaacctgcccggaacaacctcaagcagttgcgccaacttcagcaagagatcaagcggatctgcaccaaactttgcagcctcgagcccgagggggagctctcgccaatcgccaacagctcgctggtcaccaatctcatcaaaagcaaacttccatcaccggtactgctcgaactaatccgaatggaacgcgagagatacacttcttggacggcccgaaattggcgtgagggatttgctacaatcgtcaccgacaaggagcaggtggatttgtgtgtgcgtacttcccaggacatggatatccaaccccgcaaacgtcccccgagagagcccccgcactccctcgtcctgtttgccgttcttctcgcccaccaccaccaccagcagcgccggagcgacgttatttggagaacactcggacctttcctgctttagcccaacccatctctgccaacggcatcagttgctcactttgtgagcaggagggacaccgtccgagcgcttgccagcgatacaccaccgtcactcagcgccgacgacgacttgaggaacaggggcgctgcctgcgttgcctccgccaagaccatgttactcgcgaaagaccgatgctcaaaatgccaggctaaagaccatcatttcctcctctgcccgtcaattgaccctccagggcgaaccaacaatcgaacaagagaatcgggagcggaatggaaatgcgtctcacaacgtcagtcgtgccacgggccccccccccccgcctctctgagcacctccttcggattcacactttcggagactcacgccccaaaaccgtccgatcagcaaaattcgccattcaactgcagcgcctggacgtaggctgggagaccctcgagcttaacgtaatcgacgaaatcacgaccaaaatcaaggcccttcaatgggacaccaccgatggacccctccctcctaatgccgtcctcaagctcgtcgaaaaagcgccggtgattggcatccgagaattttgggaattcttcaccggctgttcaatgctccattccgggctccacctcatccaaacggt

SEQ ID NO: 18781 - DNA, 2480 bp, Heterodera glycines
ttaaatgcctatctttaaagattttgttgcctgatatccagaagctttacttatgcctttgataaaaaatatcagatggtcaataagctaccatttgttattttagaatcgggatgcgcaacacttcctgtcctcttgcttcacttttgctggagtcgcagagttcgtccagtctaacatcgccaagggtgccggcgatcggtaattgtgataatattctaacagttatcatcattgatcgcagacttcgtttcggggaaaaccggcgaaagtgacaatctctccaaaagaggggccactctttagccctcgacagtgcattcgtcccgggtattgacaatgcggcggaactcgtccggtttgcatggccgctttcggggatttaagccccacaatagcttcatctcaaagtggtatcttcaggctattgactaaaccatacacaccattaatcggaatcgtcgagcgcatctcttccggaatagccttctgcttccacatattcttacctcaatattctaagcttcccgcctctatccgggctagatcctcggcatctctttaacctcggcatccgttttagccttctcttctgcgtctttcttggctttagcctcggcatccgttttagccttctcttctgcgtctttcttggctttagcctcggcatcctttttcttggctttagcctcggcatcctttttagccttctcttctgcgtctttcttggctttagcctcggcatccttctgagccttcttctcctcagcctcttttctcttcttttctgctggagatggtggtacttccactggtttctcttcctgcttcagcctttcctttgtctcttccgccttcttcgcttccggcactacggctacgccttcggcaggtgcctcaggcttttcttcgggcttagccttttgcttcttcatttcttcctcctttttctttgcttctgcgtctttcttggctttaacctcggcatcctttttagccttctcttctgcgtctttcttggctttagcctcggcatccagtttctcttcctgcttcagcctttcctttgtctcttccgccttcttcgcttccggcactacggctacgccttcggcaggtgcctcaggcttttcttcgggcttagccttctgcttcttcatttcttcctcctttttctttgcttctgcgtctttcttggctttagcctcggcatccttctgagccttcttctcctcagcctcttttctcttcttttctgctggagatggtggcacttccactggtttctcttcctgcttcagcctttcctttgtctcttccgccttcttcgcttccggcactacggctacgccttcggcaggtgcctcaggcttttcttcgggcttagccttttgcttcttcatttcttcctcatttttctttgcttctgcgtctttcatggctttaacctcggcatcctttttagacttctcttctgcgtctttcttggctttagtctcggcatcctttttagccttatcttctgcgactttcttggcttgagcctcggcatcctttttaggctttgcttctgcgtctttcttggctttagcctcggcatcctttttagccttctcttctgcgtctttcttggctttagcctcggcatcctttttagccttctcttctgcgtctttcttggctttagcctcggcatccttctgagccttctcttctgcgtctttcttggctttagcctcggcatccttctgagccttcttctcctcagcctcttttctcttcttttctgctggagatggtggcacttccactggtttctcttcctgcttcagcctttcctttgtctcttccgccttcttcgcttccggcactacggccacgccttcggcaggtgcctcaggcttttcttcgggcttagccttttgcttcttcatttcttcctcctttttctttgcttctgcgtctttcttggctttagcctcggcatcctttttagccttctcttctgcgtctttcttggctttagcctcggcatccttctgagccttctcttctgcgtctttcttggctttagcctcggcatcctttttagccttctcttctgcgtctttcttggctttagcctcggcacacttctgatccttcttctcctcagcctcttttctcttcttttctgctggagatggtggcacttccattggtttctcttcctgcttcagcttttcctttgtctcttccgccttcttcgcttccggcactacggctacgccttcggcaggtgcctcaggcttttcttcgggcttagccttttgcttcttcatttcttcctcctttttctttgcttctgcgtctttcttggctgtagcctcggcatcctttttagtcttctcctctgcgtcttacttggctgtagcctcggcatcctttttcagccttctcttctgcgtctttcttggcttagtctcggcatcactctgagc

SEQ ID NO: 18782 - DNA, 2112 bp, Heterodera glycines
tttaaaaaaaaaaaaaattacccaattttttttgggaatttaagaaggaaaagaaaatccccctttttattatttttaatattctttttatgatgggaaatgatcaaaattaaacggaaaagaaaaaattccatcacaaatcttttaagtaattttggggggaaaatggaaggaaaagaagaggcaataggaaaggaattaaaaaaaagagaaattattggaaaattttataaaataaaagagaaaatttagcaaaagggaagaaaatattcaacaaaagaatgggataaaattattcgaaaatagcgaaaaaattgggaacaaattgccaatatatttataaatggatcaaagaatttggtcttcaaaaacgcagatctttcaaatcaaaaactgatgaagaaaagttagaaattgtacagaaatttattgaaatgaaaaatgaatttaaacaaaaaagaaaatattcatccaaagaatgggaacaaaattatgtcgaaatttgcaaaaaaattggagttagtgatttcactattatgaaatggaagaaacaatttggcatttgctgtaaaataacggaggatgaaaaaatggaaaaaatgaaaatttattgggaaataaaaagagaaaatccaaaaatgagtgacaatcaaattgctaaaacattgagaattagtctaaatagcatttataattggaagaaacaatttggagaagaaatggcagaagaagaagagtgatttagtgatttgttaggttttttatgataaatttgatttactgtttaatgcaattttcgcagttttctcgtttcatttgaaagatcataaaatgtaattcttttactaatacaatattttttcatcacccgagaactaattgcaattaagtatctttatttttaaatgtttaattaaaatttcagaaatattcgaagggtaattagcaaaaaaaaaaaccacctcaatcattccggacaagaaagttttgtaggatggaatgtagtagagaatgtggctggcggtgtgaagaaatgggatgcgcatttcactgtggcacatcagtgccgaagtataactcagtccatttttactgtaacagaatgccaaattaagaaaaaaaattgtcaaaaaatggctaattaatcatgatttaaacaaaagtaaaaattcaataatttaaggatttcttgactatttcaatacttttaaagtatggataattaaacaaatttttaaatttattttccccttttagagatttcttatcaatttttatacttttattaaagtgccaaatatgaaaaaacattaccaaaacacgaatttaaaaatttatttggttttattatttatgcatactgtagctcaggcactgctttctgtgtgatccagtccaattctgaagagcttgagcaactcagaaacacgtcataaccaattggtgttgttgcgaggcaacaaccgttcggacgagtcgacgaccgatcagaggcgcgacggtcaatcctgaaaatttaaatatttttattaaattaattcattagaaaatttaaaagatttcgaaatcaataagccgatttttcgagtttttttttggaattttaataaaattacatttttatttgaagaaactactcgagattagcttggtgttgaatttcctggatttttttcatcagaaattctgtacgcatgtcaaatgttaaacccagatcaagtccgttttttgttgttgaaaagatcaaaccttattttaattaacgccaaacttttcaaggactttgcttgccattcaagtataaaaacgctaaacattgtccttatgcacttttcctaccttttttcatccggcttaatcatcgtccaactgctgttggtgtactgcttggacttgttgttgccagtcgctgctgttgttgctgctgaaccgctcgtgctaccgctgatcaacagttcaatcattggtccatatgatgagcagggaccgcctccgcttccgctcgacacttttccgcgatggaaaaagcgccgcgggcgcgctcggaggatgtggcggtggcagaaacgtcaacagctgcagtggccagttatccggaagcgtgtgcacgcg

SEQ ID NO: 18783 - DNA, 1010 bp, Heterodera glycines
ctgagctatactcctccaaataatattacagtgattttaatctacagaacctttcgagcaatttaatttacaattctgcgtactatgaaattacggtatttcctgtaccggtacaatattccaacaatatgatacagtataccttaaatctacagtagatgatcaggccaagaagtaacaaatagttgagcgccaaaagtggtagcacaattgcccacataggaacagccagaggaagcgtatttgtcgacagtaaaaaaccaaaactcatcacaattaatgcttcaaacatcagcaaaagtgcgaatctgttaaaagtgattataatttaattattgaattcatttaaataaattttattgaaaaaatctttaaaatattttaatgattagggactaatgagtctttaagtgtccattataattaattaaaattcactattaaaatttaaatgccatattataatgactgtaatttaataatatttaattaatcgctcactattaatctttttaaatgcatagttaattaattttaaatgaattaattaattaccttttcaaatgcgttaacaagcgtaagcggcacagacgcgcaacggaatgccaccgctcactgcaacgcatcgcgcatcgttgcgtctgtaacttaatgaacggcacccgctgcgcgggcgtgagcaacgcgtgcaaccatcgcttgccgccaatgattttcgcgtccacaaagtccaatgcttggctaattgatgttagcataaggacagagtgccgttgcagaattgcctcaagcaaattacctgaagcaaaattattaattagggtttaatttgttgaatttcattatttactaaagggtaataaattttaattaataggtaatggattgataattaaatcattctaaatattatagataattatttctaggatttcattcaatttaattctaagaaaaaattttgcaaaaattaatatttaaaaaaattattaaaattttttattaaatat

SEQ ID NO: 18784 - DNA, 1900 bp, Heterodera glycines
tatttttcaacgcctcgttgactggggcttccttggtcattgggggattaatggagattgggggataattagaaaatatacagtaagaattttgtgtatatttcgtagagcccggaacagaaccggatctagtcgggatttttcctgatcctgcctgatccgggcgggcatattttgaaaaaacgacccaaatcacgagcccggcaaaacaggattttcaatccttaaatccggtccgggtccttctctgggaaattttgatcatgatctgatccggataagaatgaccaggatcaacgggatttttttcttatttctaccaaaaaacaaaattttttttttaattaatttgtcataattagagctcgcaaaaaaggtgtaggaatttggtggatggcggaggtgtaaaaggtcagcctgcggtgggattcgaacccacgtcccttcctttccgtggaatgctctaaccactgagctacacagggcaccctttacacccttctattgcactttttcatcagtgcaatgagaaactctctgcctcccaggcactttgagagagcccgcactacaaaggcacgaaaatcccgaaaaaggcatgaaaaaaggcatttaaaattttttattaaggatttttagggagtaaaacacgtaaaacttaaccaaaaaccttaattttggtcatttaaatgattattaaatattttataatgttttcgaaaaagtaaaatttttaaaactaaattttttatcaagaaaaaaattaaattattttttgagaaaatttttaaattcttagaggtgtattttctgaaaatattttctggtcatttcttggggtgtattttcccaattttattgcattttaatggaatttttcggtaaaaaacgccaaaaaaggcaccaaacggcaaaatgccaaaaaaggcatttaaggcacgaaaatcccgaaaaaggcaaaaaaaaagaataagctcaattaaaacttttttttgtttttaaaaaaggctcaccccgaaattcgtctaatgtatttatattttatcgaaaatggcacaaagtgggcattttttgatgcaaatttttaagaaacacttagggccaacattttcaatccccccccgggcggcgtctatcggcaccgtcgaacccttccctttacaaaaatggtaataataatttaatggagtcttcgaattgatctctcaaaatttcggagcatttttagggggctctaagctagaaaccttctgacatgacatgaatagcttttatttaaaaaattattgattttctcatttaaatttttttaggtttttggtaaaaatcctaatccagttcacgcacgatccgggccaaagctttgggacccggatcaggagccctgaaaaacaggatttttcatcctgaaatccggtcctggtcaaattgtttattaaatttgtatacaatattagtctattcaaagtaataataataattattattattttttagttttttttttgaaattttgattttttattacaaaaatttaacttaaaagttcaaaattatatttctgttcttcactaaaggcgactacaacatgtattctcggctggacggatgttggattgaggaaatcgctggcattaaatgcggaaaataaataaattattattccattgattttaacttaaataaataattaattaattttttaaatttaagccattttcattgggtagtgtgttttttatataacaaacttcacaaatcgcaaatcggatttaataattcaattcaaagttttcagaaagacatgaaaataaataaataaatttactgggttgtaaaaaaaaacagtgtaagattttagagacaattggacggagttccgaaaccggaaaagtaacta

SEQ ID NO: 18785 - DNA, 2499 bp, Heterodera glycines
agtggacaatggcattggcacgaggggaaagcccttcttagaaatgtaaattctcgagataagcccatgggtttcatgcagttaaattattcaatcacaaatcccaccccgtgaaccatcggatccgatgtgagcaatggcatttgctgctgctgccgctgggcatgcgattggggaggcatccattgggcacaatgaaacggaaagaacggaacgaccagcgaaaggacgaaaagcactgatgggagaggaggaagacgatgacaatttttggtgccaaaaataatggcagaaggaaaagcagcgaaagaatcagtcatttttgaatgtgtggcgatgctcattgctgctgcgtcagacggatggagcactaattgagggttaagcacaatcggtaatgacccgccggcgctttttagtcccaattaatttgccgcgcccctccccaagggggatggatgataagctgggccaatcagcatccatcattcatatttcaccttacccccccccccccccccctcccagtgtctcggcctttatttgcgcatgaatcaccgtcgtaagacagagagagatggagagaaaaaggcaagagaatagagaaaaagggcacgagagagagggagagaaagatggcacgagaagtgaggggggaagagagaaggagacaaagatggcacgagagatgggggaagagagagagggagagaaagagagcacgagagagacagacagatgatcactttttaggcaaatgtggctttattccgctgctttttcttcttttttagtggctttgtttgctctgatcatttggccaactgaattaattcgtcaccctcactttcatcgtaatccctccgccgctgattgcgcaaacggaaaagcaaacagaaaacaacaaacagatcaacgggggaatccaaatatttctgccactgatcactcccccggccaaagataatcgcgcggatggattggggcggaaggattaatgatcaattgatgattctcgagaaagcaaacagagaattgaaatgagagctgctgaaaaatggatgagtcaaagtgagacggagggggagggggaggtaattaggctaattagggcactaatgagaaaaaattgtcgaaatttaaatttaaaagaaatcacatggccaggtatatattgagagacaaataagtagcctttctagaaagacaaaaaacaaagagaaggaattgatggttaaattttcaaaaatcgactttctttcgaatgctttttcgattttcatttcgtttaataaaaagaattgtttaataaataattaattatgaacccgaatttgaaattgtcttttgggtgccattcattgttagctgatccgttcgccgttcgtttctcttttttcactttttgtcattccgttggcttttcgctctttttttattggcatttctctgattgcattctcttggtcattttttccctctccatcacattcaattagcatcatttggtaacgaagccttcgttggtgttggtcccggggaagggaaaaattggcattggcattttgtgtcccctcaggtggttccgtccccgttttccgctcttcctccgcttgcctcgggaaatcaaaattgaatgtgcattccgtcgttggcgttcccattttccgctcttcctccgcttgcctcgggaaatcaaaattgaatgtgccctccggcggtgccgtccgctttttccccttttcctcctccgccgttgattttgttaggctgccgcaccctgttgacaacgaaagcacttcgcgaagtttgccaaaagaagatgaaacaagccgaacgaagcgcgaatttccattcccttgggagcgatttctgatgaattaaatctcgattcgtttggtctctctaatttcgagattttctcaagactgagacttcaccttctgctgccactgccttggtcaaattgaagccgtcctttctccggtgccgtcgcctggacagccatgtgtccaggctggtcgcgtcgtccgcctgctttccgaccgctgcggcacttccgcacggcgggcgccggcggtcgtcgtaagaacggcgcaatgccaacgaattgaaaaactgtaaattaacgattggtcaattagtgaaataaaatcgaaaatgccatgtttgaatttttggatttaaatgtaaaaccgatccaattccataataaaataaaaataaaaagaccctaatgtagaaggatgaacgtccggcgtgtgatgaagcttcatcatcatcatcatcatcatcatcataataaacagagtctctcttgtctttgtcgttttgcgtctgtcgccgttcgtcccccgagggtaatttagaaagctttaaaacataaaagattactttaaatgtgacagattaagccgcggaacaattgactgatctgagcactgactgatcggaataaatacacaaaattggaccaacagaaaagggaatggccactta

SEQ ID NO: 18786 - DNA, 2306 bp, Heterodera glycines
ttatcggaaaaatgaccaaatttgcgatttttaacatatgtattagggttgggcccccgaccccgccccgaccccgaaccccgacatttttggccatttttcggggttaaccccgacccgaaccccgatgcttccaaccccgacgaccccgaaccccgacccttaaccccgactaggggtcaggcttaaatatacacccctaagaatggcatttttgtgggggaaatgcaaaaaatttaaacatgagttcgaaccctgttggctgtttcctttttaatttatttttatatgattaataggattttttaaaccaaaaatacccattaaaatcaatcgtccttggcataatttatagacgtattaaacccaattttcctttctttggaattaaaaattcaattttttgactaaatcatgaaaatttaatatatgtacgtacatctttcaaaataattttgacaaaaaaccaagaaaaaaaaccaaaaatttatcaaaaattcataaaatttttggtgaaaactgttacaaaagagaccttaaatttcaaaattcgcccggcgctgcatatcggcatcgccagcgccacaaaaaaggaagaactatttttacataaaaaaaatttggctcaaaattgaaaaatttcataatttttttggacaaaatctgttaacagacccatccaaattttcaaatttttttcccggcggcgcctatcggcaccgccggacccctttctcctaaaggtctttagaaaaagagcaccgcgaaaaaaaagatgatttgaaaaacaaaaaaagataaggtgatcagaaatttttgtgcatttttttgaataaaatccactatttctatttgggggccaggcgccagaggaaaaatttgaaattttgactattttacagattttcactgaaaatttgtcattttaaatgccttatgtgtttttaattattctctacaaaaatatttatgataaaaaaataataaaaaaagcatataaaattattattatgaataataaatatttttaagcaaaaattttataaagttttttagaaaagtgctgctgttgtcggactaaataataagaaatttcgttgggtggcgatagaacggccaaaaggggcacccaattaggggcaattagtggagaccaaatgtttactcttttttaatgtcgcattttcagttttactggttctaatggttttgtgttgattgtggccagctttatcttccaatttattgcctcaccctcaacgaattctcattagattttcttactttttcttgcaaatgacagataatacgcccctaacctttaaaaccattggacaagcacacctttgctctcatttgtcagtttcgtggtgtttggccgctgcctttaaataactttgaaatgccaaatccatttgatatttaaaccacctgctgttgaagtgagggcgcccgcctcctccccccggggcgaaggcctgtcaaaaatgaacacaccgccagcagaggaaggaaatggcaataagttttaacaattttgaaaatttatttatttgaactcctactgtacatgatagtaatgtcagaaatgttaaattttggttctctttcaattgtaataattagggcaaatttatatgcactaaaaaatgtcaaatatgcactacaaatccctcaaatatgccctaaaaacccaaaatgcctaaatattaaaaacaccaaaaagtacattaaaatagtatttgatgacggaatgtccggcaccatgggtgggcgtatccctttcttcgcgcttatcgatcattacttttatttcattcgcttggaatttgtccattcttttcctccatttgattggttttgtttccatctatccccacatacatatgatcgattaacgggggggggggtcaacccaaacggtggggcaaaatacactaacccaataaaattgcattaataaaacatttttaactaactttgcaaaaatgcaaaagagatgattttgagcaatttttaaaatttatttatttcaatagaaaaaacgaatgaatttcatctttttattaataaaagcataataaaatgcaaaaaatttttaacatttgatttagcaacagtttttagctcaatgagcaatctttcaggtccataattaatccacattccaaccggggaaaaaataaaattctttcgttagcgaagtgtgcgtttcgggcaattgaaaaagcgtcttccctccttcttctcccatggtgccacccggggaggactcttcttaacatgtgtgatatttggataattat

SEQ ID NO: 18787 - DNA, 3627 bp, Heterodera glycines
tggcaaaaatgagcagcagtcgaacgaattggcaactgctaatggtcgaagaggaggaggtcattaataaactaattagacgaataattaattaaatgctaaaaagtaacgaccaattttcagcaggaaatcgcacaaacattcacattgatcagcaacaatatgatgagaacagttacttgagcgtgaacagaacgcagaatatttttggatggagtgacgaggagggacgacgagcattgggtgaacagttggggaaaggcacccgcccacgggggggggggggaggggatggcacagaattccgagttgcgacttccgacatttttggggtcggaattccgacttccgaaaaattttagggcggcatcggaattccgacttccgaaaatttttggtgtctcggaattccatcacctattcattaacgtttttgtcttccctaaaaaccaatttgccgaagtgccaatatttggattttaaattttatgaattttgataattagccgcgtttttaaatttaataaaacactcattttggcctttccttaacagcacaacgaaacatcgacgatttactcgcagacaatgaacagcaacaaaatgccatcacaacgctttcaccgttccgcgtatttacgacgctgacgcattgtgaaaacgccgattgggacgaactgagggaagtgcgagtgcgcgagttgtccgaagtcagtgcacggacggacggacagcccctaattaagaaaatgggggattagtaaaatcaaatttagccttatgaccggatagacgccgattcaacaacaaaatctaaagtttaaattttttgaaaattagcacggaaatgctaaaagtaaaaaaagggtcttcaatgttttttttgcccattttgcaaaaattttggtcgaccccttaaaattggtttatttttgactcaaatcactttttttgatcggtgtcacagctctatttttttattgcatattattaatttattcaataatgtaaatagaacagaattgcttttatgcgagcgaatttatgtgtttttttaaactcgagcctggcccggtggtgcctgaaattgaccaggcttactaggcttaggaaagtctggggtttgaaatagagtagcttcggctcaccacatatataatttttataaaactttaattatgtagattgtgaatatttttaaatgatctttaatagtaatttaaaattaaaatacttttttatttttaatttttaaaataataatttggctttaatttgatcacttgcacttttcgtagttcgtctcatagcactggaaaaagcctagtttcggtcgaccgcttttgaaagtccccagacttaatgaaaacaattatttaattttaaggctcgccaaagagttatgtttatggagaatacgatgagatggtaaataatcataattaattttaataaaaaaatttttatttccggtggctctccgccgcggaacattggcgcgaaaaatggctaaagctgaaaagcgagcgaagccgactcagagaggaaaatttgcgactgcgaaatgcgttggcattcgcaaaggcacgcgccgtccgttttctttttttcaacattttgtcgtttttaggttgaacttatcggccaaaaaaattacgagaattcttccggcgaatcggccaaaaatattcataaaaatggaaaattaatttctttttcagcaaaaattgacaatttgcaaaaaaatgcgaaaataattcaaaaagaaaacgaagaatttggaaggagaaggacaatttgaccattggtggaatgccaaaatgacaaccaacaacatcaaaatcgaaatgttctttatcttttgcgctttaaaaatttgaagaaaaaagtaagaaaaacgaaataaaatcttagttttttctcttaaaaattgactaagactacgtcaaaatgagagaattactaagaaaaacaaagaaatattattagccttttctctgcgcatttttattggctttattctttcttttttttatcaccatattattttttaaaattgctttctctgttttctattatcatgtctaaaaatttatcggtggcattatagcaattttattcttatttttaactaaaattttaaatttttgtcggtaaaaaattcataattaaaaatatatgtgtatgtagcattttggctcaaaactgaaaaaggctttctataaaaacaaaataaaaaaaaatggcaaaaattaaaaaaatatttatataattaaaaataaatgcgatttctttcattttcgccttttaatttggctggcgaaattgttattccgaaagcaaatcgccggcagtgttttgactaaactcctttcgctttgtaacttttgtccaccgtctcgtcactttcagcggatgatttgtgccaaaaagggcaccttccatcattttcggcatgactgaatgaatggcgccgcattcagcaacgaacaaaacaatggctatttttgtgtgcaaaaagcgggaaaaatatttggcgattagggaatattataagcacaaaagaaaagagatttgatataattaatgcgtttgaatgcattttcattaattatttaattggaatgactccttcgaaattattgaccattcattcatttcccaattaaaaataaattgtttcttcgcaccaatgaaaaaaaacaaaatgggatcggaaaaaaggagaaaataattaaagtgaacggttagtaagaaaacaaaaaaaaggaatacgaacaatgctaattattaaaaatgaaaagcaatttaaactaataaaatatcataaccgagttttccaaaattttttaacatttccttttaatttaccgcgcggcagtgactcggctaatttttgtcttgcattttctgataacggattttgaagccaatccgtgcacaaattaattcaattttttatgcattaatttttaaggttggttcaatttttttattgtcatatgattattaaatttacaggtgcctacgcaaaatcggagttttatttgcattttctaattgtgggaattgtgaaattaaaaaaccattttcgtatttattatttattgtttgaaaaaacaacaacgaatcctcaccatgggaacgaacattttttgtttgtttgttcacctttcacaaaatgctcaaaaatggaaaaaataataaaataatttttgtgccttccctcaactaaatttttgtttgtttatctttcctccgcgaggtgccgaaaaatttaaatgaaatggtcaaaaatgctataaaagcaaccttaagttgttgctttctatcacagccaactcatcattaaagatactaacaaataagcttggatttatctgcaaatcattaggaaattaaaaatgcaattctttgttggctccaagctcccattggcctttctgctgctgcttttggcatgttttaagtgctagttttgaactgtttattttttaagttgtcttttgtgttttccaatgccaaaaaccaaaaggtaaagtaattaatccatttacttatgtttaattttaagaaattattaatttaatcaaattattttgtttaatttaatattaatttctttag

SEQ ID NO: 18788 - DNA, 2264 bp, Heterodera glycines
acatttcaattaatctataaaaaagcaaaacttataatctatatttaaacaaagtatttacaacccattaataaaagagattaaaaaatttttaaatatacgatctttattcacatttcaaaaaacattaaggagacacagttgcgtaaaaaagctaatgacatgccattttgtatcatcacaatgcaaataaaacatagtataaataaattaaaagaaaaagaaatttgatactttaaatcatttgcatacgaattagttttaagtagacaggcacaaagctcaactcatctcgttatttatttataaaatatttaaaaatatcgatcttcagataataattaatgctatttaattatcgtaataaaagtatatataatattaaataaatgaaatatttaggcagaattttaaaacaaacattttacttagtactaaaaatattttcaaaaactataaaattaaatttattgtttcaacaacgaaataatgacctttagattaaaattacaaagcaaaaatttatggattggagtcggttagccgacttttgcgccgcgaacatttgcgccgtgccatttgcgccgtaaagcgaaaaaagacatttgcgctctcattaaaataaatttatgtgatttcgagtaagaatcgattgatattcattattaattccttcgaagtctttcatgcaattctatatgattgatcaaatcttgtcattttggttttcattgggaccatatgcgataacaagccttagtattgcctaatcattaagcggcggcttttagggcgaaaaaaatcaaaataggttttcaataaattaaataaaaatcgatgtaaatatcagtagtatatgacccctaaaggttgcgggttggttgcgggtgtttaccgcacaaacccgtgcctatgtgaggggtggaaccttttgaagatgccgccaagagccaaaacctatgggaggggtgcagccctttgaagttgccgcccgctcacatcctgagcctatgggattttctttgaactctgccgccttgtggatttaaaatttccccaaattgttgcgggtgtttttttcacccgcgccgcgcagcgccgcgggaaggtcatcaatcatccacctgtcaccaaaagtgacaggtgtaagaaattcaattttttcttttgcaaatttaaatcccaaaccttttggggctgtattattttctcaatcctgatttttttatgatgaattttctgaattttgaaaatttgccaaaaccatgcatttcctctccgccccgccggtgcgccgcgatgctggcgcgcgcgaagtaatcgataacaaaataaatacccaacagaactataaattgggggaccgtcccaataaatgaaaaattttttatcgtctccctaacttcttttgagccattttcagatagggaagaatataatgatacatttcatcaattccagaattgttttttgttcccgtaattacgactttaccggtccagaaaattagcgctgtcatgcttttaccccgcttgaaatttaaaccgcaaaatatttcgggttcataaaaggcacgacgattttttcgaaactcgttcagttcaatttcatgtccgaatttaaaggtcgaaacaatattttcaaccgtgtgtccggtgtaagaagcccccggacaccccgagcccttaattatttctataaattttttaatagcattttcgcagtctatcagacttttcgtccccagacatatcatttttccggattcccataataatgccggggctttgataggagttgtacatttgataaccgcggcattgaattttctagggttatacttaaattcgcattcggtgatcgtcagagagtttagtttaattccggtaccgagattagcgaaagcaattatatttacgattatcagtttttgcatttttgatacaatgtatcaatcaaatggtcctttcatccctttatataccccttctataaatagcaacccaaaataaaattaaattgaaaaatgaactgcccacataaaattaagtgttgtcattactgtccctgtcattacgagatatgtaacagatgtaaaaaacacagtcttttgcatttcggtacatcattatttgataatttctggctatgccccaaatgcgcgaaacatgttccctatgaaaatataaataggtcaaataaataagaggaattaaaaatgtttcgcggttcgttcactctaattctctcggggggctaccggg

SEQ ID NO: 18789 - DNA, 996 bp, Heterodera glycines
  misc_feature (161)..(161): n is a, c, g, or t
agttttaaactaacgaccaaacaaaaaagaaggttgcacaatacgccgatttatagagaaatgttaaatctcgttcagagaaaacggcaagaaaaaggatagaacaggggagtggtatagccctgggagctgtcttgatacctgtcctgagtgttttagcncaacatttattagaaaaaataacatcatgaaatttgcaaagaaaatgttaatgattcccgaggcggaatatttggctctacggagtgcgatgaatagtggtgattatctccaaaatgaaaaagcgagtttagacgcaaaaatttctcagaatttacaagaacccggcataagcgaggacctcaaggcgaagagacacgattggctctataaagaaaggcgtacggtaaaggggatacttgaaaatagaccacagaaggtagtgattgagaatcatgtacccggtccgaatgttgcaccatatctaggcctcaacactcaatccaaaccacaggagaccgatgaaccccggaaaataattattcctaggaaaagacttgaagagcaaactcctgatcctgaatcagataatgatacaataaatgagttaactccggagccccaaacaacatccacattaaaaacacccattccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatttggggacgtggaaggaaaaaggcaataaaatctataaaaacacccggcatagtgcgagagaagaaacccttcaaaccactaatatgggcaagactgtagagaaa

SEQ ID NO: 18790 - DNA, 1104 bp, Heterodera glycines
cttcgacgttttcgaggaccaaatccgcgaggcgttcctcgttttcgggcccatcaaaaccatcaacatgtccatcgacccgtccacaaacgtaaggcaccaaagctcggaatttgtttttcattttgggtcaatttgttagcgataagtttgttttagagatacttttttgagaaatttgctcgaaatttgactcgaattctctaaggcaatgatccattttgcggaaaagccgacaaatcccgcttaatgaattcaattctttgccaattattcattaattgcgtgtcccctcttccctttcagcaccataaaggcttttgctttatagagttcgagctgcccgaggcggcattcattgcgcgcgatacgatgaacgggcgcatgtttggcggacggaacatcaaagtgttgccggtgagatcggggaagggatttgtcatttcgaaagtagttaaaaatcacgtaatgatcatacacgaacaaagggtgtgccggcgcacccccccccccccccccccggcgccaatcgtccgtcgtatgggcctcgccctggcgcaccccttgttcatgtgtatgctaatgataaacatgtttattaggtcggtcgtcaggacacaatgcctcaggctcagccgatcatcgacatggtgatgagcgaggcccgccagtacaaccgcgtgtacgtgtcctccgtgcaccccgacatttcggagcaggacttgcgcagtgtgttcagcgcttttggggatgtcacaaagtgtcaattggcgcgacaaccgtccggccgagggcacaggtgaatgaaaaaacaaaatatttagtaaatttgggtgcatgcaacggaaaaaacaatcaaatagttttgaaaattgagacaatttcggagccccgacttttgctgctcctacatttgcgcctatggccaaaatcggattcaaagttgcatttttttcaagccctgatagcctaattgcattaaaattacgaaaactctgtagtttattaggaacattaattctgtttgtttgaaaattgtattgttttttcaaaaattcattgacgatcaaatgatcggatacaattactttcaatcacttattt

SEQ ID NO: 18791 - DNA, 1620 bp, Heterodera glycines
  misc_feature (1608)..(1608): n is a, c, g, or t
tccttgggggtatagtcattttcagaatttttaaatttccataaaataagataaaacggaaaaaaagatggccaaaggaaatgaaaatggcattttatttcgatttttaatatttgaattatgggttttcttttttaaaatattccaaattaaaatagtaaaaacatttcccggtcacagattagcgacaaagcatcgcccggctcatctccgtcccgacatcaaacgccctcctcgccgacgccaccacctacggctgaaaccactcaaaaagctatagctggttcttccgcatccacttctcccgctgcgccgtccgctgttgatacaacaacggttactgctgctcgacccgcggcgcgtcgacgcggctttggcggcttcgccgccggctcgacagtgccaccgccgaccattgtccaggcgttgccggccccgccggcaaccaccgacccaactccccacgcgacaacgacggcgcctgctgctgtctttgccgctgcttcaaacgctgttcaacaaaatgtgttaacaccgccgggcatttttcaaccactgccaccgccgtccttggcaccttcgctcgtcatgccgaaattacaccagcaaacatcagcatcaatggcacagcaaagcccgggcaatacggtggcattgcctttacccgcttcagcaccggcagcggacacaacagcaacagtggcatcaccgaccacagcaattacgtcgatggcaccagcggaagtaccagagaaaccagtgattgcaccacaaccaccgaagaaggccaagaaggaaaagcgcaacattttggacagaattggggacaaggcacacattggcacgttcgatgcaagcaaaccggccactttcgccccattggacccacatgtggcgccgcgagacccaaatgcggtcgattccgatggtttgtactggcaatttagttggcccattatttgttgctctttcattcagatgagcaaggcgatacgctggccattggcgggcccgattcttggtatgcgttggcacttcgtgataccggcacggtgctgaagaaggacaccggtggcactggcaaaggcaaaaagcagggcaaagagagggacccgaacgcaccgaagcggcgccggacaaagaagccgaaactgtcctcgggacccaaggcaagggataaagcgtgaaacctatatttagccattgctattttaaaatatctcaccaattacaaattaaaattttcatacaaaacccagggacataatttaaaaactgagtttcagttaaacaccgcgcaaaaaatcgctgccgcgaatttggcgggagtgctcagtgatcagctgtcggtgcagaatgacaaaaacgatgaggccactttggcatcacaggtaactgatattaatcaaattcaaaatttaaacatcatttcctatttctctccaggaacatgtccaaatccgcggcaacgacgctcgccatttgctcatccaaaaactgatgcgcaccaatcgttcctctgtcgtggtcctgcgcaacatggtgacgcccgagggcattgacgagtatttggaggacgaaattcgggaggaatgctccaaatacggncgagtgaccgat

SEQ ID NO: 18792 - DNA, 2759 bp, Heterodera glycines
  misc_feature (2296)..(2296): n is a, c, g, or t
aaaggcttcttccaatgcgctcacggacaaatgaatgtgtgcataattacgcttaaggcttctttgcccactcattctttttcgtaatgccatttgcccttgccaaaaccttttatcttaacaaatatttcccgccgtattttctggccaccgtggacggcaggacggacactcattcatttttttggcacggcactgatttttgctgattaactcttcttcaccataattggaatgaaagtccaaatccaacacagtttttttttaatttttttgcaaaatgtatggatttccaatagtttctttctttttttttcatctttcaatgcatttaatttgtctgtttaaataggttaagaatttgagaagccaattagccttcaagaatggaattgctggtgaacgacctctgtgaggcgacccccgagcttttcagccgcaactcaacactccaactgaccgtaatccaatggttggccaccgtatcgcaactgtacaacaattacgtccatgcttgcctctgtctgctcatctgtccactgggcattttggccaactttgtccatattctggcaattttcttttagattctacaatataattaattttggtgtattaaatttatttcttttttaggtgctcacccgacggcgaatgcgacggtgtgccgttaacaactgtttgatgggcattgccatctgtgacatatgcacaatgtccacctatttggtgtacattttgtacttcgaagtttatgcaaaagtatacgaaacgaatattaggtaaattcggaggggagggggataaattccgatgaattaaaattaaattttggaaatgaatcccgccccaattcgttcagccatttctgggccacttacctgcatttccatgccaccgtgtccatttgtctgcacacaatcactttgtacacgtgcgttacaatggcactcattcgttggcgcgtgatgagccaaccgtactcaatgattgttcagccggcaatggcctggtaacaataaaattgttagactctgaaaattaatttttttgaaatttccatttaattaatagtgcacggattaatgaattttcctatttattatttgttttattttaaaataattctattaatactgattgctaaatttttggaggaaaaatgttaaaatagaagagaaaaaaaagtgcgaccctggcagggatcgaacctgcaatcttcagctccgtaggctgacgcgttatccattgcgccacagggccgatgtcctagaatagaaatttgtcttatttcaatataatttttctttcaaaaattactacagaaaataacaaaaataaatcctaaaccgacatttaggaaaatctttgtgctcgtcactgtgctggtcgctctgttctgtgtgcccacttacctcgtccacgaagtggtcgaattccgttactctgacggcacagtttttttcaccgtggacatttcggaatgggcgcggacggaccgttgccactatttgaagacgaatttgtttattattggcattgtgcttaaggtgagaaaggcccaatggaaaattgaaaattcgctaccccaggcgattccctgctttttgcttctttggttcaccacggcactgatgttcaaactgagggaaaacaatgcaaaaagggcacttctgttgagggacaaaagcaaaaagatgcgaaactatgacagaacgacattcactctcattgtgatgctgggcgttttcttggtaatttgggatgaatttcaagaaaaaaacaaatcacatttggtaataatttagatgacggaattgccgcagggcattctgacaattctgaatggcattttcaccaacgatgtccattccgtgttttacatgaatttagccaatttgctggacattctttcgctgatcaattgctacgtgggctttatggcctattgttttttgtgctcaaaatacagacaaacatttgttatgatgatcctaacaacgtaaaatttaagttggcgtacatttttggtattctgtccattcagtttggactcctaccgaaaattgggttgctctgaaaagtgccggcagcaaaggcatcggcaacactcacagcacggcacccgaaataggcataacggactgctggggcgggcggggaacggcacggcccattccgcatcaaaagtgccgatcttcgaaccgacaacgattggatcggctcaaagcagcagcatacaatcaatagaagatccatcagcaggccaaattgggggtaaggaaatggcgggggnggggggggacaccgtcccggccaactcaattaaaacgcataaatttaattgttggcctatccataaaactaatgccgttttcttggttcaaatttataacttttaagggttgataagtcgtaacggccgaaataaaaatatcctcctaaattcgaatttaaaaattttttataatcatttaagaaagagaaaagaaaatggaattggtagtgacgatggatgggcgactaccggacgaacaaattggccaaatgacggacacccatctgtaaaagtcaaaaaacaccaagggaaagaaacgtactactgtaaaaactgaaccatccattaaaatatatatgggacaattattttaattatttatcatttaaaagatttattatttattcgtttattcgaaaataaaatgaaataaactttttacccaacataaaatataataaaatgaaaaggaatgaaatga

SEQ ID NO: 18793 - DNA, 1657 bp, Heterodera glycines
  misc_feature (13)..(13): n is a, c, g, or t
ctttcaactcacntggatgttccatttgtttttcattttgttgctgctttttctcttcattttccattccactaaatccgctgtccgttttcgaaatgccaaaaaattctgtttttattgataatttataaatgtcctcgccgccgcacgatttgtcccctccgtgcgtcaaaaatttcacattgtccgtttcatttttattggaaaggcagcaaaggccgaagctgctgagtttaggcattaaaaatgaacgttgtgaatgataatgataagtaaatgactaattagcagaagcaacacaccgatcgattgccgtattttttttactgtaaaattctgattgtgagaaagagaattgtatgtaatgagaaaattgttggagtttattcaattattgttttttaggccccaaaaacgggactgcatttgatgacaaaataaagttttcgggtcagacgctgaattatttatacatctttttttgacagaatatgaggttgttttttagggtgcaattccgttaattgtaacaacgtaaaatgaaaagcaagtaccaaagtgcataacccagtaaaatcagctggaggccatcggcaattatttgagttttgttattttattgcataaataaagaggaagaaaataacttataaatgcaattttccttcagaaaatgaattcattgcaaggtcgaccaaagacattaaattttgggctttcaaatatcctgcactttaatgtgaatgaaagggtgagataatcgggagcatttcgcacaggcgaattaattgattttgtaatgaaatgacacacaaaacagaagacaaactggtttacacaatcgaaaatgaaaacaaaactttaataaacctaatatttaccttaaagataatgattacaattacctatcagtagggctggcaattttatgtaaatacatgtttttttcctggattctccatgctctaaatagcaggaaaaacattttcttttttgtgtttgcgaacaaaagttgggacttttatttacatatttttacatatttcgagatttttatacatatttatcatatttcgggtttttttttacatatttggtacatattttggactttttagcatttttttctaaatttttttgagaaattttgaaaatttataaaaatttcttgtgaaaaaaataaaattttttgaatatgtactagggttcgagccccgtgggcgggggtggcttttcgcgggggcgggggttggcgggggtcagagtcgcgggggcgggggtgagaaatttctcgcccccggggacgggggcttgtttttaattagctcccaaaaatctcacaaaaaattatgtcgaactcataacaaaaagtagtgttaatgttgaagcactaaccactaaaccacaaatattttaaaaaatataagcatatttactttatttcataaaaatttgtaaaagatggttaaaaattgaaaattgtataaatttttgcctttaattccacaaatatgccattcttaggggtgtttttttcacccccgcgggggtgaaggtcgctggggagggggatgcgggggtcagagtcacggggacgggggtgagccccaaaaacctgtcccgcccccggggacggaggcggggctcgaaccctatt

SEQ ID NO: 18794 - DNA, 1263 bp, Heterodera glycines
  misc_feature (1184)..(1184): n is a, c, g, or t
  misc_feature (1192)..(1192): n is a, c, g, or t
  misc_feature (1208)..(1208): n is a, c, g, or t
  misc_feature (1246)..(1246): n is a, c, g, or t
  misc_feature (1252)..(1252): n is a, c, g, or t
taaaatcattttagaaaaaaaaacacgatatagcttaaaatttactcattttagcgaaaaatcaacctgaaaagcaaaatttcgctttttttgcttatcttggacataaaacgatcaatttttaagaaattttaatttagtcaatattttcgacaaaattttgctaaaaaatgactttttcggaaattttttcggtctataggggtcaaaaaggccaatttacccgataggggccgttctaataggggtattttgaaaaaatgcccaaatatgcacataaaatatgcatgaaatgccaaaatatgtacaaatatgcataaatcgcgaaatatgcaaatatgcatatggaagtacggcctagaagcttcaaaccaagctaaaaacatggttttcgtgcgtttcaggcctcccacagtccaggaaaaaaaatatgcatgtgcatataattggactccctacttatcatataccgatgaattagatatagtcgagaggaatcgaatggtccttgtttcggggttctacgatttctctatcaaaagttatagcccaacaaattttgtactggaattgggctgagcacttttcaaatgaagccaaggtaagcattccgggctgctccacggcactcggggctttttctggatttttagagatcctagacatgcttatgggtttaaaaacaacatattttttctgctttttcgaaaaatcattgccaaaatcacacgataaaaatcattgataaaatcataggcaggttcttggtcagcgcctaaaactccctggaaaaatgctttcctttgtagggatattgacattttgatgagggggagggtaacaaaacccggaagtacctaagaattgacaaaattttaagagtgccaggtttccatatttaaatgtttaatttttcaagtaaaataaattattaagcgttaatgatgaaatcactgcataatttagttttttaaaattaatatcatagtgcccaaatttctggtgcctaaacttcatgtcgcctcttccgttgttccttctcatgtcgatccgttgagtaataattagatgattagcgagtgaaattagacattattggctgttggtattaattcagttctcatgattctgatttcgcgctattgttcttatcgttttgatttcaaaaattcatttgcttttanaaatcgcncaatcatccagaattntttctttcacggcaaatttttcaatttttatcctttcngtcccnttcattttttg

SEQ ID NO: 18795 - DNA, 1799 bp, Heterodera glycines
gcaatggcaaacccgaaggtgtccataagtcaccctaattggggtcgatccaaataattaattaattgtctgtagcctcagggggaggaggagcgggccgaacagcttcaggaattgctaatgggagaggagcagaaaaatgacacaaaacgcgcaaaaagctttgaggaagtgaaatcgaccttcggacaaatcgctgaggaacggcaaaaggaaatgctaatgatgcgcgaattgacgacaatgatttacaggtggttggcaggcaaaagggcaattaacgaaagttggcattcaaaaggctgttctcggctgactctttcactaaacgacttccgattggactgcaacggatggacaaagtgttaaaattagccaaaatgtacgaagaaggccaaatgaccagagaatcgtgggcagaacgaatgcaaacgcggaacatgcggcacttcctcgaggaagacatttacgaggtcgctaagaagccaaatggccactcgctaatgagttaaatggccaattgctaatgaaccaaattgtcaatcgttaatgagcaaaagagccaatcaatgagtacacaaatgactaatcattttgctaatttaaattaaaggattggcacaatttgcttgtgcgcgacatggaacaaaatgtgcttgaactgatcaacaaaattgaagaattgtccccccaaatttatcaaaagtcttcaaatgggactgcaatttcggtgctttttcccgttaattgtttttgtttactcattcctttgcccttcttttcgaccggctctgttcttctcttcggcaatgtccgacgcggctcagcaaacgtcgaacaattggccaattttctggacgatgccttcgaatgcattttcaatggcattcgtaatgaaacggcacaaatgctgaaggaattccaagtccaagattcgcttttgcttcccccaatgaatctctcccctttagcgtgccatgttggaacttcattcggcactggcaatacttttccgaaaggaattgcccgaatatttgcaaaatatggaatttggaccaaaatttattcggttagcttattcagtcattcattttggcgttatttttttgcagggaaaacttcgcccaagtcaacgttttcctgcacaaaatgaacattgagtattggcgtcaagagcccacttacagcatttggagctttttctgtgccctccccttttaattgctctttaaatgtttaattgtgcctttaggcgacattggcgccacaatgagtcttttccttggcgcaagttcgctttcacggcatttctcataaaaatcgcaattaatcattttgaaggtatgctgaccatcatcgaagtgctttactttgttctgcgacaatcgcgcatttacagaagcattgcggtatggagacaacgaaagaattcgctaaaaatgacaacagaagcagcggaagagaatgttggcacaaaaaacgaaggaaaagagagaaggtgcactgagaagggagaaggaggaaagaacgtcgattgggcactgatcagtgggaggaaaaatagggataaattggaaaaaatttggcactgatcaatggtgatcgttggtataattgaaataataggggataaatttggcactgatcagtgggaggggaaattggtataatttgaagttttatggctggcatttttaagaaatgcattagcaccgtgactccaccatgaaaattgcctaatttagaacctccacgtttatatgggtgtgaagaaagaagaggaaatcgaaatcgaaaag

SEQ ID NO: 18796 - DNA, 2776 bp, Heterodera glycines
cattttgaggtggccattgattcaaacacttaatcactcacccgtttcacgctttttaggctatcggcggaaaagggatacgaaaacagtgatgagcaagtgaccattctgagctacgcccctaaaaaaggtcgtttgtcccttttgtccctttgtccgttttgacccctcttcagatagcatttgtggggtcaccagcaaaggtcggctcgccacttggcgaagagttcgcgactctttgccaaatgtcgcaaatgctgggccaattcccgtggaccagcaatggaaattggcgggtgcaattgccctaaacacaccaaatgtaagcaaaacattcacttggcaatgtacttgctaattttgttacgagaatccattagcggattaattgctgggaggtcattgcttactttttcgaacggctttttctgccgccgacgttggggtttttctctcccccccccccattccattcattaatcctttatccccctcccccccccccccccttaggtcattggcatggcttggtctcacacatccgcagcttttgcgctcaattctgacgattctgtccaaatttttctgtctcaaagccttgatttttatgtggactctgaagtgatttctttcgaattgcataattaataattgtcaattaatttgtcctttcgagttcgccgtcatccaagtcagtgcgcaacttctcactttggtaaaaattacggatcccgtggaaacgcaagaattgcaattgcacacgaacattcgtggattctttgtgatcggtaattatctgctgctttgggatgacacaaaagtaagtcactaaataaaaaaagagcatttaaaattcaaattatttcgcacaattacagtgaaacattcactttgtgtccgccgctttccaaattaaattaatccgtctgtttttgatcagatttaattgatcacttttccaatattttttagatcaaataattttgtttaatttttcattgtttctttagtttattactatcacatttactttatcagattcacattgcctttttctctctctgtttttcttgatcacttttccttgttcattctctattttctgaacatatcattttgaccactttttcaatgttttcaaattctgtgtcactttttcactgttcatagttcgatcattttgaccaaattccatagttgttgtttttctaatcagattcaactcgatcagctcctttgtccctccgattcgcccctccaaatctctcacatcgccgctttcgatgtccaaaatgttcgtcaggctgcttatcacaatcaacacgtgatcaccataattggtgaccaacttttcgtctatactcttcaagtgcgttgtctctctctgctcgtctctttcttttcccaatttttcttcttcgaaaagggcacagtgaaaagagcgatcacttttcgcgagagcgaaggtcgtcctgaactgatcaatgtcaagggcaattggctttgtgtggccacttcgcttggatatttgcgaatttacgacctcacagaaaggtgggaaataatgccaagtggcgatgacaaaccctttgaacactcagcatgatgaaactgacattccattcgtccaatttgtttaatgtgatgcccaattttggcaaattggcttcaattaagctgaattccacgggcaatcgcgtcagtttcaccgttcagcaggcattttttgtcaaattaagcatttgctaacataaaaaaaggctttttgaggcaggcgatgagggcatttttgagcgtctatttgtgtgggaggcggaaaatgattctgtcggctatttttctttccacgagggcatcacggaccagcagaagtacgaagcggactctatgggggtcaacggggagagcggcaccgcggcacggccaaaaacggcggcaattcgcaaaatcgaaagcgaacagtcgcgctttcggatgccaaaccatctgccgggcaaccacttttgggatcaaatggacccaagactgctgatatgcgaagcgaactccgtcgggacgggtgacaaataaaagaagcgtcgttgtatgttgcgaatggcacttttgccttttcccccgtttagggcaatcgccggctgctccgtccgctgcttttggtgctttttggttgaccattttcgtcactgctgagcacggtcttcaaatgcatgacttgcacaagaagccgccaaaggcggattcgctgctttttgtatcggtgccgcatttgttctttttgcgaaacatcgaagtggaagaggaagacgaccctcaggtgaccgaccgaccatccctcattagcccgttaatcattggcatttgagaccgaacgttgcctttctcggctgattttgcgcaggacaatgcgcgagtttgttggcatcgatccgcgcgaggaaaaggccgtccgggcgatgctcgacttcgcctttttcctgtgcattggccaaatggacagcgcattcaaagcgatcaaattcatcaaaagcgaaagtgtgtgggagcacatggcacggatgtgcatcaaaacgcgacgcgtcgacgtcgcgcgcgtctgtctcggccaaatgggaaacgcacgcgccgcacgggcaatccgacgaacggtcgaaagcggcgagggcactgaagagcaaattgcgcatttggcagtggaattgggcatggcggaggaggcgatcggcctttttcagaagaaagaaggatgggacgaagtcaaccgattgcttcaagcaca

SEQ ID NO: 18797 - DNA, 903 bp, Heterodera glycines
aagccctgattactggaacaacgatcagttgtatttgccaaattcccattataattccattgatcaggcgttggagtgtccggtatctcgggggattacagtatcacggattgaattgcataattccacaaataagccctgattactgtaacaacgatcagttgtatttgccaaattcccattataattccattgatcaggcgttggagtgtccggtatctcggggattacagtatcacggattgaattgcataattccacaaataagccctgattactgtaacaacgatcagttgtatttgccaaattcccatcataattccatttatcaggtgttggagtgtccggtatctcggggattacagtatcacggattgaattgcataattccacaaataagccctgattactgtaacaacgatcagttgtatttgccaaattcccattataattccattgattaggcgttggagtgtccggtatctcggggattacagtatcacggattgaattgcataattccacaaataagccctgattactgtaacaacgatcagttgtatttgccaaattcccatcataattccatttatcaggtgttggagtgtccggtatctcggggattacagtatcacggattgaattgcataattccacaaataagccctgattactgtaacaacgatcagttgtatttgccaaattcccattataattccattgatcaggcgttggagtgtccggtatctcggggattacagtatcacggattgaattgcataattccacaaataagccctgattactgtaacaacgatcagttgtatttgccaaattcccattataattccattggatcagggcgttggagtgtccggcaccaggccatccattttccgctaa

SEQ ID NO: 18798 - DNA, 1958 bp, Heterodera glycines
  misc_feature (1936)..(1937): n is a, c, g, or t
atgccagcatgccaaagaaaatttgatttatcacattgtaaaacattcgtattttaagtattaaaagggtaaataataattaaaattcaagttttacccactcataacgctcacttaaaaacttcaggattggtctttcttgaaaatttttattttaattttatttccaaaatttccccgaggcgcgcgccattcgacttttaatcaggcccataaccaaaattttagccaatttcgtgatttttgagtccataatttcctttaatatgacaaaaatggaggattcagatgatgccgataaacgccgccctggaaaacttttgaaattttaatgaaatttgttaataaaattgagtaaaatttcaaaaaactatccatttttcttgaaaatttttcattttggtagggtggaaaattatcagaaaaggaaattttcgcataaaatgcccatttagtttatgattcggtgatttgcgccaaccaatacggtgtttccgccgcacattacagtaaccaaacaacactggatggaacaatgttgacaaacaggtacggtagtaatagtatgggcattactgtatttaaatgtagctcaattttaggtattcaacagaaaaattgtggttccaacgtgtgaatttcacccacaattcggaggccgtcatttgggtacattcgcctgaccatgccgtactggacggtactcagtttgccgagattggatggcacattgacaattgttcaattgtcgagaatcaaggcccaattttggacacacatcgagatttggtaaaaacgaataaataaaattcaatcaaaatttgaatttttgaaacacaatttttaaatttaaaaatcggtgcgtacagaaacggccacaaaactataaaaattcgaaatttacgaaatataaaagttagaggttcaaatttttaaacccataaaccttaagtgctcttatgatcacttttttgatgtgttatatctgcaaaataatcttataataaatttaaatatatatatatatatatatatatatatataaacttaaaattaaaattaaatcaattttgtttttcacagttcgccagtgccaatgtgttccactggaatttttggtcaaatacatttgccaacaattcaaatggcggtgtccaagtccatctgccggatccgtgggatttacaaaatcggcgccatcattctttttggatgaccgaaaatcgttttgaggtggaaaatatttttacaaatattagattttaaaaaatcattttataattttttaaatttttcatttaaatttgcttaaagttacaacaaaaaaaaactcataaaaattggaattttgtatcttacgaaaattgtacccttagtattcaaaaaaaaattgccttcttataaaaatttttctgtaaaaaaaatatttactacaaaagccattttgctgaaaatttttgctcttttaaatgggcttaatgattttccgggaaattttttaatcctcttaagttttttgcagaatcggtacgacttttttttcagaccttatgaattttttaagcgataacctatcattgtggcacttctgtataatatggtcttacatttgtaggacgcagaaattattttattatttcgcatttctaaatatttttaaaaatattttttaattttatttttacaaattaaattttgtcacatattaattaattactttttttccattcatttagcgcaattatgatttcatggtgcagttgtcaggatattttacgtttgcaaatatttcttccaacaatttcacggataattatgcatctttggaccatgtaagaaatgcaataatttcaaaaaattttttttttgttttatcattttgtttttttattactaaggcctggaatttaattttcgcttttgtttttcctaaaanntatagcctccccccccttaat

SEQ ID NO: 18799 - DNA, 2891 bp, Heterodera glycines
ttacagtatagtatgacgttgttaaattccaatataaaatttaaaaaataaataaatttaaagaatagtgtacaagcaaatttaataatttatctttacaaaatcaaatgttaataaaataaatgtatcctttttataaaaacaacttgttattttgtatttcaagatgaaaaatgggagttaatgcaattaaaaattttggtgttttcagaatttaaaataaattgtaataccttattaaaaaatgcgaattctatcattattctaacatcgattttatatggtcgtccacggagcttaatggattttttgcgttcattttattatattaaattgtgcactctttgatttatggtctcattaaacttttttaccatttatttaataatttaaattatttattaagtattgcgtgtatgtaattaaaaattatgtccttacatttcttactttctttacaagtgatctatttttaagctccgtaacgaagtatacaatatgccactgtaatatattttttcttttaataaatgaaacatatgattgttatagttttaaaatatttattagtaaagaagaagaaatcaattaaatacgtttttataaaaaagtttttgtattatgatcttccaaaatttagattttataatttaaatatatcttttaattgacgggaaatggcttgtcgaggttatacatttatggcaaatttggcggtctctattcgttcgacataaatttccgaccttgtgatcccctctcaatttttatttatattttatttaatttgactgaataatcacgcttttgtttgtgcaatttaatttgatagattatttgcacaatgctatgataaatcgcttagctgacaataaattttggtttgaatttcgttaccccattggttgataatattatttaaacaatcaattgatatcatcaataccaaatttgaaatgcactaattatttgttcaaatattgacgcataattcattgatattactgaattttgattttgtgtggtttggtaagaaaccgatagcaacaggttttgggattattaccaaattaaattgatgaattatttattgaatcaaaactgaataatcaactctcccaaatcatattatcaaaactgattagtttggccaatttgataattggggattgatacttcactgccctatcacggtatgtcgccactaacgaaaatggccatatgcgattatggaattggcaaatatcctgtttctatattaatatattttatattttattgaaaaagtttgacattctctttttaaattctgttttcatattccagtattatttttcgtgaagataaataaatccaaagagagttgatttaccttgtttttcaaaatccaaatttgatgtgcatcaaagagattaaagttaaatttaaacaaaaaatttcataaattttattatttatttcatttcaaaaaaacatttctgtattaaaatggaaattttaagaatatcggttaattattcggtttatttttataagttttccatgattaaatatatttgcaatcagaactaaagatttttaagctttggattacaaatctcatgtatccgtgcgttatgcagcaagcgctataaattttttggcgattcagtgcttttacattttaataaatgttgaaattttgtaaaaataaattctgaaaaatatttaatttttgattttaaaataaattataattatattattaaaattgacaatattcatattacaataacatgaagcatataacactgttcatttgcattgtcaataaatcattaagcaaaatcaaattatgaaatataagactaaaattttgcttgaaatttaatatgaaaagaagaatttgattataaattctaattacagagttaagttaaaattaaattttaattttttatacatcgaaaatatttttaaatttttataatgttttttagttaccagacttatcgcgaatttgtcctttaacatgtacaatctggagttcaatgtataatattcttttttgtatatatgagaaggtataaatattgtttttctatttttaaaatattttaattttgctcttttcactaaaacttattatttgatctttttaaataagcaaattattattttttttaaataaactgatttttattatttatcattaagaacctagaagacagtataatttcttgaatgtgaaggaatttaggcgtgaaaatgcatgataaaatccgaaaattaactgaatatacaaattaaaataatattcgataaaatctcgaaaaatattatgcaaataatataccaaactaatgttttgttataaacttaaaaacaaaaaatatgaaaaccaaacaactacttgtcataaagatgactaacaaatgagaagttaaatttaaaaaataaatattatattgcgaattgaaaaaatgctataataacctataaaaattttatttattaaataacgcccattaagtaaaaataatatttacaatattaatatttattcaactaaacatttacattattcgagaaaaaaatttatcgtatgcaaaataaaattgattctattcatcttcaattagatatactctgattctgtaagaaaaatacaagaaaattgaaaaatatacccctaaaatcaactttcatgtcatttcttaaaatattttcaaatttttttttggaatttttaaacaaaaaaagacacttaattttccaattttttcatttttttaaattatttatagtaaaaacaaaattaaataaatatttaaatttaatcaaaaataacttcttttatttgataactttgattgttataggtatggttgtcacaataagaaggaaaatga

SEQ ID NO: 18800 - DNA, 1420 bp, Heterodera glycines
  misc_feature (1412)..(1413): n is a, c, g, or t
ttttgagcatttttcgcgttttagggcatatttgagggattgtagtgaatattttatgcgcatatttgacattttagtgcatacaactataaccctatttattagtattttttactgttcattttgttttttttaaatggtgtcatacattttcttagtaaaaattctacaagaacctccgagccacaccttttggtagttcaatttagaactccgtcgttttacttacgcacatttcgcaagtggcccattaattttgtttctcgattttgctgttcacgaacaagcatcgccatgtcgtctctgatgctgttgaatgtggactcgtagtgaactcttacaaaatcagaaaaatgaattttacaaagattgatacaaatagattctaaatcagcaaaagctacgattttcctagcctaaaaaagcggtatttttaaaagaataatgtttgtcattttttactcatgagctttttttccgcaacttctttttaattttctatagaatatttaatcatggctcgaagatgtgagacttttagctcattgtcagtttgtagttttttgaggccaagaggaatttttcaaaatgggggggggggctttgaatttgtcaaaatggtgcaggattagcgatcccgaaaccctcagaaacaaattttcattttggtaatattgtcgattgcatcacataccttttctaaaaaattctttaattttgaaaaagcataaaatatgcttctagggcttttcggggtcgttaatcacaaatctggccctcatttcgtgcaattcaaatcgcggaaccccgaaaaactcacgaagcatgttttatgactttttttcaaaatttcagaaaggtatgataccatcggcaatattaccttcattttaaatatttgatcattttacatttagtgtatgaatttaaattattttaattttaaatttgtttatgaaatttgttggtaaataaaatactgactttattgcttgcaagaggttgggaatctgctggtatttcgcaatgacctccctcatttcccggttttgtctgctgattttcctaagttgcatcatcaaaatgttttgtcggcgcagcaacaccaccgaatcgcatttgcccctaattaaaaagagtgtcgatcgaaatgttcatggaacaaaacctatcgagggaagaggattcgcctgcattcaaagcggacacagattccaacaacgcgccaagttcggcgtcggtttgcaccgtcgcctcgcgaaactttggtttacgaccaaaaggtcttcccattttagcaccaggcagtagtccatttggacgcttttttggtggcatattatgtattatttagaaattaatcttttctaaattttaaaaattactttcattgtgtatattgtagccacaanntatatag

SEQ ID NO: 18801 - DNA, 1263 bp, Heterodera glycines
taacacaccgtttcaattttggcctcccagttccaaaaagatttgcatgtgtggcgaagtggtttttgtaagatagtaaagggacaaagggtggtggttcgagtccgttgtgcaacatgaatatttttatttatttttgtccaaaatattaaaaaatgacgaattttgggaattatttttgaaggtttttcccaaccaaattggaaaaacttgatatcattcgaaagctctttatgagaagaagctttttctaagcaactgctaagcaattggattgattaggaaaaagatatgagggttcgaaattttgtttctcgaataactttttagttaaccctttttttgcgtttaaaaacccttacattttgtttgtaatttttttctctttcaatatgcaaaatttgaagtggatctaacaagcagaaaaaaagttaaacaggatgaagtgaattcagtttttctctattgacagagataaaaaatagtatgccaaaaagagagatgtttttttctctgcgctctctctttattggttcatctctcgttttttgaaacggtgtgataattagcagctattaattcaattaataagccttcatgagccttttgcttattgtaactaacattcgttaaattacgttctaagtaacgcagaaatagaaaaataataaatttataaattaaataaaccaactcagagacatccagcgttttcctcatcatcttttgttatgtttccttgtacagctctcaaacatgcgcagcagaatttttgaaaataaaaaagtaagaaaccaaaaaataaacatggaaccgttttattaaaaaggcacaaaaatgatgcaccaatgtaattatggcgtattaaataaagaagttaaataaaaaaattaaattaaaaagtgagatagagattaagagagagggaaagggagagagggataaaagagagagagagaaagagagaagagattgagaggggagggggaaaggaaatgagagagaggtgggggatgggggagaagagaaaagggggagagagagattgagataatttaagagagagacagggaaagaaatcgagagcgagagatagaaaggagggagagaaaggaagggagagagagagacaaaagaaaggagagagagagagcgggagagaaaagagggagagggagagaaaggaaatgagagagagagagggaaaaggagagagggataacggaagagggacagagagaaaggaaaagagaaagaagagat

SEQ ID NO: 18802 - DNA, 1202 bp, Heterodera glycines
cccatggacggcgtcgtccggcaacaacagtttgatcaaagaaatgccgccgtctccccccgctttatctcattagtatgatgatatgatgacgcgcagcgtggacaacaacagcataaaactcattaggggaagcagagacagcgcacggcacgggtgccatttttggcattggcacttttgccgccattgtttgtcggcaccgccggtggcgtccattttcgctcatttattttttcttcggcatttcttctattccaacaactactgccttttcgtgttcagaatgcagctgatcattctgatcagcactacggctgaacgctcggcagcaggtgagtggagagagtggagaggagaatgtaaaatgaatgtttcccccattttagtcgatggtttttattggccaacaacaacaaaaacaacagcagcagaaaacagcaacaacaacttctgggccaacaattacaataacaacaacaacaacaacaacgacttcaatgttggcgatcaacaacagcaacaacaattcggagcagtacaacagccagcaagcggtggaggaggaggcaaggaaaacggggacaaagaaggagaccgggaaacggggttgtgctgtctgtgtgcaagtcccgtcattacggaatccataatccgtattatgcagattttctaaattacggaagtccctaattacggggtccaaaaaagcgtaattctctgaataaaaataaataaaatttaacatataaatttattgattaacaacatttttggcaaatatgtattgtaaattcatttttaatggtttttctaatttcttaaaataattgtccatttgtttcttttgcacagtttttggaattattttttgtctatatttatgtccttaattggcatttttcagattcctccttcaacactctgtcctccctgttgtttgcgtccgccggccttggcacagtgcctgccgccagcgctgtcgtcgctccgggcgctcccattggcattgtgccgttgtcgcgcggcgtcggcggcggcactgatctcagcccgatatttggcaattttgaccggaacggacgcaataatttcaattttggtggtgctactggtgcggaggagaccaccgacgacactggcgaacagttcacacctttcccgacactaatcccggccgacaaagtgcgccaattggtgat

SEQ ID NO: 18803 - DNA, 1441 bp, Heterodera glycines
tgactgattgctggacgatttgatcatgatacatatcaattgacgatcattaaatacgaaatgagaaatataaaacgatcaaacatagaagtgatcagatcataaattatggtccatttgatagattaggcctataaattggacaccgacggaagaagagctgatttttttaaattagattatttcttgaaactaaaataatgggattaaagccttgtcaagagtgatcaaacggctttatccgttttattttccattgacacagatctaagcatgatgcggagcatccccgtgttcggttatgcccggcgcggcggtgccatggcggctggtggaacccaaggaacctttggcggcactttttctaacggtgccccgaccggctttggcactttgccaataaatggtgcggctgggtttggcggcaacagcaacaataatgataacaacaacaacaacaactgtttttttggtgccggtggtggcgaatgtgccaatgcgtggaaccaatttggtggtagtgccaacaacggcggcaacgacggggcgccaggcgatggagaagaaatgtcatcggcatcaatggttggcggtgccggctcattttatgtgggggacggagatggcggtgcgtacgaatatccgttagttgacgagaccgacgcatttggaggagcaccggggcgacggcaccagcagggacaaacttttggggggtcagtgttatgggagaacagcagagttgccaagttggccaagaaaaactgggatttttgaacaagttttcgggctcattgcccggcacttttgggttcactcattttattttgaatttaaatgaacattttgccaaattttttaaaattctaaaatgccgagggtggactgaggagcgggagaggagttgatgctttgtcaaatattttggtatttatttgaaaattttgttttttcagttacatgcgaggaagtgccgaaatgcgtgggggacagatgccgtcgccgtcctatcccaattttggcggctttggaggaggaggaggaagaggaggagcatatgggggaggagggagggaagagtcaccggaagagtgggaggatgaaatggtcggaggaggagaaggagggacagaaatgggacaaatcgaaaggggcggcggaatgccattttggatgggtggcacaatggcggcaggtgagacaacagacggcacgagaacggacagtgaagaacagcagcggtacagccaatatttggttggtcacacatagagcatttattatagagcgtgagaaagagagaggataaagcgagagagggaggaaagagaaatgatagagagagagagatagagagagagagagagagagagaaagaagatagtctctattgatcagagagagacatagagaaaactgaagaaagagagcagagcaagtt

SEQ ID NO: 18804 - DNA, 2247 bp, Heterodera glycines
ggccaagtttaaaccgaatccaaaatgacttcgaaagaacatgtaattttgttggacgactaatattttcaaagcgtttgccatttgggcaacaaatgaactcattagtaaaaatgttagcatcattaaagcagccatttgggatcaattatttttaatgttgcgaaagaaatattcaatagaataattaattaatcaagccgtttaaatatataaaatcattcaaaattttattttattttagccaacaatttccgaacattgccaatttaatgaaaaaaccaaattccgcctcatttccactttgcttgattggtgtccacgattttccaccattaattggctgaaagtctccatttgtcacatttttactgccattacgacaaattcccgggaaattaaaaaacaatttgtcattgactaaaattaaaaaaaacaatcatttccgaattaaaaaggaaaatattcaataaattaatgagaaaacgagaatataggcggtttaagagaattaattgttggcttcgaaagatttcacttccctcataatttttttttacatcaatttcaccggaaatgtaattttttatatgtcttttttaaaaattcaattttggcaatttttgggcaaatttttatttaccgaaacattttagggatatattttttgaatgttatttttaatacagttcttaaggatttattttctatttttattggatttttatctgtttttcgtacgtttcagaccaagggcataaaattttttgatattatgaaaaattataaaaacgataaaaaacgcattccctttttatcaccgaaactcgagacccttcaattgttttagaatttattcgtggcattacccgaaatttctgacccaatcggacttttaagtggtaataaattccacagatttctaccaaatttactttattagtctcattaaaaaaacttcatttcggagcagaaaaaaggtacatagttcaattttgttttttataacttggtttttgatataatgcttgtgcccatgcccaatacatatttcgtaataataagtttaattcattgttccgaaaaggaaaacaatacatatatttgcatataataaacgaatatagagatcgaaagctaaaaatggttcaagaaaagaaataaatcatctgcatgggttccctggctctccgccgcattagcatcgcttcggcgttttgcctgtagggcggcctctgctccctccggcacgactgctaccggccttttgagctgctgctgcaataatattatacatgaaacagtagggggctcggccgggtcaaattgtgccaaaaaagcgtgccaccaaaactccactggccaatccgcaacagcacacagactcaccctgttgctgctgctgcaactgaatttgttgttgctccctctcggccgccgcctccttggccttcaacacttgggtcacacatcgccagccggccaaccgatcgccatgccgttccaccaatttgtccaccaatttctcccgcttctgctggtcgttgtcaaccagttggagcagaaattgcagaatttcctccacttgggcctcgccgtccggctccagcgcctcctcatttgtcaacagtctgtcaatgatggccggcacgttgttgtacagggcgttgtgctgcaatatttcaaaaaattggttttacaggcaaatgtctcagggcgtaagtgtcggaaggttcggacaaaaaccgacctttttgctcagttcacagaacagtccggtggcaactgtgacaatttgtggagggttcgcgtcgcgcttcagtgagtaggcaatgtcggcaacgcaggcgctcactttgagctgatccttcagcaacaaatgcgtgcacatcagcagagacgtgtagcggacgccgttgttctcgtcacgaaccctttggaagggaatggagaaattagtaataaaattgaaattaatataagacggattaggcaaggaaggagtcgggaccccaaaaaagcatttaattattttaaaattgaggagcattgcattattcgggataaatgataaattaaatttgcacttttgaatgaatgtgtcgttgaacttgttgaacacgttggggaagcggaagcacaggtcggtcatcatcaccagcatgttgttgcgcattcgtaccgaagcggcgtcataaaaggagaaaaaagcgggcaaaaatgttttacaacagcgaacactgaaat

SEQ ID NO: 18805 - DNA, 825 bp, Heterodera glycines
cagcagtgtgcggccaccttgcgggacgctcaccgagtcgtcattgaggcgcccgcgtgcctcccagagcaatccgagacggaattggacgggcggaatggcgcccttcttcgacgccaacttggcccacaaatgcaacacacgggcacgcaccagtgccgacttgtccaccatgtgatcctatcgggggaggagattagcacaagagaacaaaaaggtaaatatttaaaaaaaacttaaatttcgtgaattacgctatgaagtatgtctaacgcctcggcggcattgaattaaaatttacccagccaaaatatgaaacaatggcactcaccagcaaatgggcaaaaagcatgtcccgctgatcactcatcgtttggtccaactgctgacagtcgaagcaatggaggagaatctcagtgaacacaaacaagacggagttgcgcaacattgggggctaaaaaatggaaataaaaaagcaaattaattgacaaaaagttaaaatgcaaattaattaaggggtgaataagtgataatttgttgaatttaccaacatcgcttttcaagaatggcataataaatgccaaattccgttgcatcagccgtgggttcaactcgaccgtcgcactgatgaacagcgcgaaggcacgggtcgccgtttcggttgccgcacgaccgcccgtgccaccaccaccaccaccaccaacactagtccccgcacctgctaatcagaaaataacacttacaagtagaatatttgagtgcgaaaaatgcattcaacaaaaaaaggcgatttttttttgtttatgaaattcatcaaaatcatta

SEQ ID NO: 18806 - DNA, 2564 bp, Heterodera glycines
  misc_feature (42)..(42): n is a, c, g, or t
  misc_feature (112)..(112): n is a, c, g, or t
  misc_feature (140)..(140): n is a, c, g, or t
ataagggtttttaagacttaagtggtaacaaattgatattcncaaagggtagattaatcgcccaacaacctgaagctgttcaaatattttgtccaatttctgaataagttcnttcttcttcttttcttttccaatcatgnaaggcattctagatacaaaattacataaaacgaatgaccttttattgaagtaatatcactgtttccgcagctcggcaataataaaggcatgcactttggcaagtcgcgctcgctttataaggtcgttcaattttctaagaaccgcattccgaggcaaagactaaaataatttgaaatttttaaattcaactcttgtatgcctgtaaatcgacgaataagtcgtgttgttcatcttggaaaagccgtcgatttatgtcatagtgcaatggatggtcccaaaaagtgccaatgtaaacacgcgcaacttcaggcgttttgaacaccttgaaaagaaagtaaacaacaaacttcctgtagtgttcacttttccgagggaccacatcagtgcgccgtaaacacgcatcagttgctgatggtcgaccatgtccgacttgtttaacacaattcgaattttgtcttcattccctggatttggttgagttaagcaacaaaatatagcaaaatgatgcctgaaagtgcctcaatacagcgtttgaactcgtcggaaatatccaatttatgtgcgtcgaaaagcaaaataatacgatccaccttgaaaaatcacgttccgaataccgaactccaatgttaacaaatatttaaaaacccactcgttcagcgaaccactcaaggacgccagaaaaatcatagccacgatcaattcttaaagaaaaaagtaaatggaaaaaatgtcttatagaaaccgctgtttttcgccactcaaaattccgggggtgtcgattattgtcacaccatttagcacttcattcttcagcatcgaacattgaaaacggtttaagaaagcatttccaaatctgaaacgccattaaaaccattctaatgataaagtattaaacaaatactttgtcagtgctctgaattgtttagtggagtcgacgacaagcgcattgccaggaataacagcttcttctaaagttgctcaaatgaacagaaacgggcaaagttcaaaaccttcgccgtacatcaccacctaaaatcatttaatgtcgaagtaaatgttttatgttatgctggtcttacgatgaaacgatcggtggtcggctctggaccaattctaattccaggaaagttctgttccaacagatagcgaatgaatcttaaatcttttgattgtcataatcagtttaaaataaaagacgtcgttttcccagttgaatactgtccgaccaacaaaatcatcggtttggcattaaagtcgggatcatctgaaatggtaatgcaaaaagatggaataatgcgtatttaaacaaaacccaaagcgggcgaatggaactcgtgaaaccgataaaaatcctccaatggatacagcttctgcttgtagattttcttcaggccctcgctgacagtttccagaacatcttggtcctttttcttagtggtgtttttgcctagccaagaaaacattattgaagctgaaagagagaacatatcaaacaaaaccaacacgttcaaatgatggaattgcgaaaattttcaaatgtcattaaatcaataagaaacggttgatggggagagaattgaaatagaaaaaatgtgatggcaatcgggagaacacacgttttttgtgcgtttcaggcttttttagtataggtatatgatggaaatttcgatggtttaccataggtatgtgtttaattggtgtaatgaaattacctaacgaacgattgggtgagtaataacgaaagaggacttggagaagagtgaatgactggacctccagaagaacaaattcaaaaaaatataaattactgataacaaaagatacactaaaaaatggtgtacggacatttcgcctactcgacatctcgcctactgacatttcgcctactaagccaaaaacattcatttcgcctactaacctaaaatacctatatatattttgacaacgaatttgaccatatatattctaaattggttcatatttagctattcttatataataattaaatttaacctaaaagtacacgtaagaaaatagatatttattaaactccaaagaaaaaataaaaataaaatgttgaaaatggtaaaattcaatttccattggcatcatcagtttcttcatcactttctttatttccacggatgtgatcatttgagccctggggtgcacattccaaaacgaaatcggaaactgtagaggacattctgttcgagcactgacaacagctaaaattaaactgaattagaaaagaacataggtatgggtaacagttgacaccaccaacgaatttgttctaaatattgtatcatcattttctctgaattttgtcgacctgttcgccatttggtcgagcgcttcatggtgccgagcaattcgaagactgtcagtccgaattttgtgcgcggagttgacatgggttc

SEQ ID NO: 18807 - DNA, 3469 bp, Heterodera glycines
gaaggccgttagggactgtgccccggtccgtcccccccaaccactcccccattcgtttagacttttacaattagcaatgcatttcaggacattactttcgtgttccatcaaaagtcccatgatggtgagacaaacagatcaaattcaccgccagcagacaacgggaaaggacggagagatggggcggaagaagaggacagagaaagcgagggatgaaagacagtggagagagaggagaagggcagagaaggaaaggaaagacggcgttaaaattttaaaagttatttataaatttaaaaagcataattttaaataaattattgtactatgtgattgatttaatggaatgtgcgcagttatgaccctaacattccaatttcccccagggtttgaccgccgtcgtctgtctgtcccgtagattctccgtcaaagggggcgggagggtgaaaagcaaacattcgttcgctgttttgcccccgagggcgggtgactcatcgctttgctttgcttcttacattctctcctccctcgcccctatctctccccattttccgtttgctttaaaattctcccccccccccatttattcgtcccaatctctccttcttcaactcgatcaatctgtgcttcgttagcttcaatcggtcaaacgcaattacatctttgaccgtaattaattttcaacccttaaataccattgtaattgctttttcccgcctccccccccctttctcctttactcttttccgtctctattctaccgcccagggatgtgcgaaaatcacaaaaaaaaattttcgtatacgaaaacgaaatgaaaaagggcattctacacgaaaacgaaacacgaaacgaaaaaagaaattttgaaaaccgaaaacgaaacacgaaacgaaaaaattttgacggacgaaaacgaaacacgaaaacgaaaaaataaccattaaacacgaaaacgaaaaaataaccattttcgtacgaaacgaaacgaaaaaaccgaaaattttttacatattcaattttaattaagaactttacaattgtatcctcatcctctaacagggaattgagatcctagtaggtggaaaagcggatgtggctctaggacaggggtgtgacgaaaaattttcaaaataagaacatcaaggacaaaaaataagatttagggtcaaaaaaggcattttgcattcgaacagttattttaacaaatattcgataaaaaggcattaaattttatgtcttttacggtaaaaacccaactcgtaccgtttcccaaaaaaaaaaatcgtcataacttttgtcaaagttaccaaatggttggttgacgccaaaaaacagccgatgtgccctcgaataaggccgagttcaaataatcggcaacttgctaaatttttgaataaacgataagacaaaaaataaataattgacattacccctgcagcttttgctttggtatcaattagcgacggcgtaggtgatggaatgcttcgaaatacaaaattactggtggactgttcgataaggaatgctttaaaagggtcgtcgttttcttcagtgaactccaaatttgtcgtcccatcggttgtttcttgttgttcatcaataccacttatggccacacgttccacctcttgcaataacatatccttgaaaatttccatgtaaatgtggtcaaaatattgcactttgtatgcagggtcgagaattgtagccaataacaagtccttattccgctcccaatctatacttaaaaattacggaattttccagaattaatacaaaatacctttcattctttcctctaaagattcggcaattctttttctaatttctggaaaatcatccacagccgtccagtgtgtcaaattttgtttcaaaactttgtataacggaagaacaccggaaataccgcttttccgattctgaatgtgcattgttgcgcgttaaattggttggagtattttgcataacgttctcatcattgtccactcgatactggtaaaacaagggaatttggcatcttgggctggcatcatttcaatggcctatttgttttcaagaaaacggctgaccattaaataagttgaattccaacgcacttcgacatccttaatcatagattttgcattgttatttatttgaattttattactttttgtaaagtttttagtggaagatcattttcaatttgcaatgctttgaaatcgtcagcaattatgcgcgattttcttatgcgacggattgcttttttcattcgttcctttacatcgaaaatcccaccaaggagctttaagccatctccaacagccttaaaatagccaaatatacacaaaattaaatgtattttatttaccaattgaattttgtgggcaaaacattgcatggaattataaccgagcaaattggtcgccaatttcatcgcaccttcgtcatcacgtagaatcaagtgtaattttttatcagtaatttgataagcgttcaaagtcttaaaaacacagacatacattttaagctttacccaaaaattaacttttgaaaccatgttggaaaaagttgtgtcagaggaccacgaatcaacggcaattgtaatgtaatcggtgctttcaattcgccttttaacattttgcaacatcaaggaatagctgtactgtaaaacatcatttgtgaaatattttctgcccctgaaaaaagttgatcatcgaaagttttatttatcaaattaatacctagttttatagtgaggaaccaatattcttaataaattttttagcccaggttcttccacaagcaatccagcagtacataccaaatcgttaattgccttgtcaattttcttagtcatttctccgtcgggtgtccattgagctgaaaatgttatgtaaattcatttaaaattaaattcctacaaaaggttttttcgatggttaattgcgacgagttagcagattcagccctcgctatttttttaatcactggacttgaagtcgcaaaaattcgttttaacgtcggttgtctcgggttcgcttccttatttttgaggctttctgcagccttatctttttcttccaattctttcaattttggttgatggtgattttttaagtgagaacgaagtaaagccattggatacccagacaatttttttgattcaaatttgtagctgcaattttcagaacggcaaaaccataaattgccgcttggaattatgtcgcaattaaaatactggagatatttgcttttggaagacattaataggcctaaaaaagactttgatgtgtagtaaaacggaacttataacacggaaaaaacggactaagaaaaatggtaattctgtagtttgtcccccccccccccctttttggaaaaaaacggaatgccaatgaaaaatctaccaacggggccagtagtataaggccccgggggcgggggaccagacccctgcccccgcttaaaaaatcatacatttcac

SEQ ID NO: 18808 - DNA, 2970 bp, Heterodera glycines
cattaaaagtcggtgggagggggagagacgggagggaattgggcgaaggtcaatttgactgactgaatatttgatcagttacaaaattataatgcatattagaaaattgaccaattgaacttctaggcatttgtggttttgggcttcagttcgttcgcttgtgcgaagaaggggaggggattttattgagaattcccttgggagtggggcactaattccaattgccctcattccacaacgagacccaccattcccggccatatgaacatttcggttaaaatcgaccaaattatctctgttcccgcttcgcagatgtcttcacatgatccgacttcgttttccgccgtgtcgctttcccgacctgaacttgaagccggtgttcccgcctccgcttgctgcccccaccaaaccaaccaccgcttcaacagacaacagcagcagcactgttcaaggcactcctaccgttgtatgttgagcatataatcacactaatgactttgtcttggtttattcgccttttgcttttttagctcgctctgcccgttggggtgccgtgcgaggtttacgtttcggcacacgttgacgctgggcatttctttgtccaattgcccacccatccttctttttcatcactcgctttgctcgactcgtacatgctcagcgtttacactcagccgggcggagctccggatttgccgaagccgtgcaacagtaattttcaacatcgcatctttttaaatcgtttatctggctgtttcctttcagtcggcgtgctttgcgctgccccggcgtacaacggatggttccgcgccattactttggcatacgaccaggtggaaagcgttctccaatcattcccattttaataatattttacctgttcattgtcaggaccaggatgagatgttggtccgtttcgtcgattacggcggcttcgcccgtttgccccgggccgatttgcgccaaattcggtcatttcccccgggggttttccagctaatgtcatcatctcttcccatttcagtactgactttgtgacccttcccctgcagggcatcgaatgctatttggccaatgtgcagccagctggtaattaattgtccctaattgggccaattatttcttagggcattttacctttcctttccgttcagatggctctttgcattggagtgacaaggccaacgagttgttccagcagttgtgcgtgtccaaaatcattcaggcggcgctggtgggctattgcaaaacggacggaattccgtgcgttgagcttttcgtgatggacagcgccaacaaaaaggtgggatcagagggcaattgttgtttattgctcaacgaattgagtccgttactcctcaaaaatccaggggattctcgggcgaaaaccctggactctagcaaatccctagtgctaatggactgtgggtccgttccgttctcaacggtgccaatgcctttttcatgccgtttcagactgtgcgcattgaccaaattctgttggagcgtggccttgccaaacagatggatccgactttgatagtgcgaacgccgatgctggtgtaagaaggggacctccgagaccagcacaacaacaacgaaaccaacctccggtcgacaattgaaattcacaaaggaataaatgatatgtttttgcattcggtaaaaatgtttttggacttactctctttttcctaactaaaaggatttaatagtcggatttggaaattcgcttcctatttattctctaattgtccgttcaattggcacagttttcaccactttttgctgaatgcattcatttcctagaaaagactccctcctctaaaatattgctcgttcattgtttctctgttttgttttgtttttgctgttcgttattattataccgtattatattttttatattcctttttaaaaacaaaatatttttatcaaataccccccaatttttactatatgatggtttactttattcctctcgacatattggacagatgttgttgttaggccaggcctcccctccatcacttttcaccaatttgaccccctcaccgtctggtggcggtggtcccctggccttcgttgtttctgttccatctcttcccccccccccatttgatgccctttttcgtttgtttgtttctgttttttcttcctttttgtctgttccatctttgctcttcttttgcttcttcgtttcctctctctctctctttccaactgtcgtttccttctccgtttttcttttccctgctactgatggttggttggttggtgatggttttggcaaacaataaaaatcatattttcaaatgtgaatgattgctttttgagtgtttgattggcaaattcaaatgtgatttgatcatttgacgggcaaaggggacaaaacgaatcgaaaaactcgtcattttggctgctttttggcgctgtgtttgtatttcaaattacaataacataatttgccaatttctttccccccccccttaaaaattcgaattttcttcgttataattttaaaatttccttcatttcgtcccttcaaaaccttcgcctttccccgcggttttccctctttttgtgtaaagttttaggatgataagaatcttttgatgggagtgccaagggcagacgcactgcgcagacagaacaaactcatccctcattattttatgatggaatgaattggttggcccgcgaggtcattcattgttttgtttgtttggacgccgtctgattttgattgggaaactgaatgaaatattggaaaattgccaaattggacgcgtgtttttcaaacggcaacggaatccgccgtttttgccggattttgcggtgcaactgactgcttggacttgtctgggataacagcgattcttacgagtattgggccgagtttttcgacattcccgagtttcgcgtcggaatgttcgaatatttgccgagtctcgacttctctcgatttaa

SEQ ID NO: 18809 - DNA, 1024 bp, Heterodera glycines
gcctggtggtgggcccccccccccccccccccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaattttattcatctcccttttcgatagaaaaagcatcagagtgcctaaactaacatgtaaataaaatttggtgcgtttcagagcattttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatctggtgcgtttcagaaccctttctgaaaaaatatttaagaattaattttgcaaaaaataaataaaaacgaaagactcagattttcgaaa

SEQ ID NO: 18810 - DNA, 1599 bp, Heterodera glycines
gtaaccaactcaaccaggtcccccccgccacagttttcccgcccggagtaccgtaaccaggggcatagcacctcagacaccattccatataatgccaatcccttgtcactttccccatttttcaccacaactcttcagttgacttcgttcatcgacgggtcagcaatttacggctccacccaatgcgaagcggccgccctccgagcatttgaaggaggtcggctgaacacgaccaatttgggctcagtgaacacgttcgttttgagttgtcttttgtttcttgcatattcacgtgccactattttccagcgaggcactgccccagggggaccaagaacaggactgcaggggaaaggtcggtaagggggtgagggatttggaatagtttaaaaaattcgacattttatttttaatcggctgactaagtttaaagtagggtttcccccgacccagccccgaagcggcgaatctcgactttttaagaaaatttactcccgaccaaggggttgctccccgacattttttaaattttctccagccacccttgaaacaaatttgtcgtggcatttcctccccgatccttgatttttctctccccgagggtcggggagcaacccatcctagttcaaaggatgccaagaattgtttcagccccttttcccgtgttttttggccggcgatgagcgcaactcgcaccagcccggccttaccagcatgcacaatgtgttcctccgggaacacaaccgaatcgcgcgacaattgcaggttaattaatgcacacaaaataagagacaagagagtacggtactcagtcggagcacagcatgccaaataaagggtgacgtaatttatttgagaaatacgctactataccgtatctacctcaaccaaacacagaagatgaactcggcatggaatgacgagaagctgtaccaagagacgaggcgcatcatcggcgccatcttccagcacattgtcttccgcgagtatctgcccaagctgatcggccaacgcgaaggtctgtaaattattgtattgtaaaatgtatactgtattatattgattataccgtagtttctaacctcaaggcttaattggccaatttgattaaaccgcttaaacccttccagtggaccggcacgacttagccccgctaagtgccggctattttgcccgctatgatccgacttgcgacgcgtccatttcccatccgtttgccaccgctgtaatgttcagaaaatgccaaatttgactgctctaaatcattccaaaggcatttcgcttcgggcacacactgatcagacaaatgttcccccgactgaatccgtccaatttcgccaatttcactgatccggtggatttggtggagcacttcaacaacatggaatcggtgtacgatcagagaaggggtctgcataaagtcgagactattcgagaatgggcctaagtgttggtttggcaggtggcatcgacaccattctgatgggtttgttgggtgcgcgggcgatggcatttgaccggcacattacggacgcggtgcgcaaccacctgttcggcttccgtggccagcccctgtccggacttgacctgatcgcactg

SEQ ID NO: 18811 - DNA, 1176 bp, Heterodera glycines
tgcaccgcaaacattttcaatttgaaaggcacatttataatttcaatcaaattatttaaattcaaaaaaatgcgtttagagcagttggaagagatccgtaaggtcaggctgggctccctcttttgtcaggttggcattggcacttttctccccttttccatcgttttttttgtccaatttcggcgcccctttgtttcagaatgtcaaatcgttgtccaaaatccaaccggatgtgttctccgtgcccgaccttttggccaacagtcaaattccatgcgccgattttccacgaatgaatttggccaaatggatggaacgacgtttggcaccatttgaactttaaaatttttattttcccgttctttcagccgtttgttcgattggcaacgcccaagtgccccgaggggccaccaaattgaggtggaattgttttgtaggaagtcataataaaaaaatatgcaatttgcatttctaaactatacataattgataaattttcagttgaaattctgaatatatttattaaaattaatcaaaatttcgtaaattttagccaattaggcacagaaagcgtaaaaatgggtgaatttttgcgccagaattattttttaatgaaatttaatttgcaattaggtcgccatgcgtaaagtgcacgtgcacagctgacggaccaaagtgcaaagtaaagaagagtttttgtatttgaatttactttttaaaatattttcctaatgttaatttacaaatcgcttttaattaaattattttttatttcgatttatttttttcattttgccccaaggcaattcgcgtgctgaactgtcagaatttgttgaacaattttctgttggccgacatccgcgaggacaccgtctgcgtcatgcaatgcgcgtcgattctccgcaacagcagcaaaacagcagatgaaacataacactcatgatgaaattgtatatgtatatatatgaacgtcggataaataaataaaaagtaataatcaaaatgcccgaaaaagaaacacgcaaaccggcaacatatggaccaaaatatagaggtaaaacctgcctaaaatatatcttttaacccctataaaattccgaaaatgtatttatattcaatatttgttaaaacagactaaaaaatacactaaaaactgccaaaaaatggatttaacat

SEQ ID NO: 18812 - DNA, 3011 bp, Heterodera glycines
  misc_feature (2965)..(2965): n is a, c, g, or t
agaaagcgaaagttgagattgatggggggggggcttactctcctccgaggaattcggggggaccaaatgtttatccgagcccagcggagacggctggtgggacagccatccattcccccgggggcaaatctgtggcaattaatggggcggctgtcatttggcccaagggacgggggaatatgagagggaaggatgggccatcggataaacaaatggccaaaagcagtgattgatgatgggcccgagcaaatagtggaaaatgtgaggcaagcgaaacgaaacggcaccgacggagggcaaagactgagggagaaaaagcggggcaaagcaaaagccatgctgccgaaaaaacggcgccgatcagcgaaaggaatgacggaacggccaaagagcgatttgtaatgtgctaatgggagaaactcaccaaaaaaacaaagcgaaagggcagcgatcaaaaattacacagggaaatcaacataatgtgaatgtttttgttgagcaaatgcttaacaaagtttgtaaatctgtggcacaaatgagtgataatggcaaagggacgacagagcgtaaaagtgagagccatcggcggacggatgaaggattaaattaggcatcacaataataataataacaattaaacaataatattaaacagcggtgccaccatcatcacattcacacgcaattgcccaaaggcccgtcaattgttggaacagtccctccagcgcagccctaaaaagcaaaacaatcagtccaccaatgccacagattattaatccgcatttaattaatcattggtgcctcggcactaactaactttgtgccttcaatccttttgatcaaatcgttcgcctgttggcgtttcgtctccgtactttcaccgggcgtttgcaattttcgcaacagaattctgataaaaaaattaatgtagtttaagagggaaattgggcctcctcacttcagttgtccgactaatccctcgtacaaattcattatccgtcgactttgctgcaccattcccagttgagccgttctcagttcggcttccaatttgatccgcacattttgcgcttccatttctcgtagcagcgcatttccaagcggaaaagcgtcgccgtgaacactaaacgaaaacaaaagaataatcacttcgaacccgaataaaagaatgggatttagtatgatttccctttgttgagttactcaaaatagcaatttttgaagaaaattctcaattttctcccggcggcatcgccggaccccaaaatcctaaactttctttaaaaattgtctcaaaatcgcaaatttatcattttttagacaaaaactgttaacaaatagcattacaactacaaaatttccatggcggtgcctatcggctgctatgagaatcgtaggtaaaaattttaatgttcgcttgctaaatcatgtgaaagttaataaaatgggacgaacatcggccgatcagtgacagtttctcttcccacggcgggagtcagcaacaaatcgacaaaactcgtcgttttggctgaaaaatgaaaattagttaagctaaaattgatgaaatctaagcgccaactactgaagctttatgcaaatggattcagtggggacgggggaatgaatgaaaggccaccccctgcccctacgcttcgtttggtttcgcccctcgcgcttcgttcgccacctttctcctccattccgggcggcggcggattcgggttgaccgtcgcaggcactttgaaacgctccgagtcgtcgacaacgattgggttcagaccgtggttaaagcgacacttattgcctggaaacaaacaaaatgggagagggacaagtcttcataatctgttgaaattgaactgaaatcactaacctcgcaagcaaaatccttttcctaaatgatgcaaaaactaattgtaagcaaattaaattacaaatgtatccgtaccaaaaaagtcgcggcattgggcgcgtcggtgctttgggtgcgcaggcttacgtatgagtttattagtcattattttgttgactcactaatcaaaaggcgagcgttatgctcattttaataaatgacaaactctaaaagaaacaaagttaaataaatgaagaagacttggcaaggccaaaagcagaataatgctttgatttggttttcgaaatcaatgataaaacatcatttttgaaaatcttatacatacatcatacataaggtattcatggtcagaaaacccgaaaaccccacagaggttggcttttcaccagattctccaatattaccgaaatgaaaattcatttgtccttaaaaacgatgttttctttctgcttgattttgtttgtccttttttagctgacatattcgtatataaacaaaattttagattaattttgatcatttcttattttctaatttgctcgtagattttcaaatttcccattttttgacattttgtacgtacctattttggtttttataatccgggctccaaaaaactatttggcttaattaggcaaaatccttggtcaaaattccataaatttcattttgttttttgcatttaagatgtacataatatattaaaatcgtccgtggtttttacggttggcttctccgttccttggattggattaaccggcaaattttacaccgactctctctgctcataatcgcgtaaattaattaactgattttttgttcattttaattttctgcatttaggaggacatgataatcgaaaagtttccagcagatcgtcaccctggactgctccagcgtttgaacgaattgaaacggagcgaaaccgtttacaacggcggagtgttcatcttgttcacaattccttatcggtagggcaaaaatgtgaatgttgatcattaattctattacccaatgcaaattgacagatattatgaggactacgcgtccatcactgtcaaccaagcagttaacgacatcaacgccatggancaagacgggcgttttgcagaatctgaagattgcgtacatcgaatgc

SEQ ID NO: 18813 - DNA, 2859 bp, Heterodera glycines
  misc_feature (75)..(75): n is a, c, g, or t
  misc_feature (86)..(86): n is a, c, g, or t
agaagatccgtgaatacgtgtggcactgatcactccgtcgcatcgcaacaaaaaaaatcggcaacacaaaaatgnatccggatcanaagcagcagcaggatgaaaaaaagacagcagcggcaactggggactcaaacagccgctaccaccagggatgggccgctttgcctgaatacaatgtatgtcgtctaatgttcatctggaatcatatactttcacgtcaaatctaatgatttttatgctcacatttcccgggtcatctatgttacaaaatctatgatttttccaaccggtccctcttaatgatttttccactgtcactttccctggtcatctatgttactaagtctatgatttttccaaccggtcccttttcccgtttcatctggaatcatatactttcacgtcaaacctaatgatttttccactgtcactttccctggtcatcgatgtcacgtgaaatctcatgattttccaaccggtccccgtttcccatgtaatctggaaatcatataattccgcgtcaaatctaatgatttttccatggtcccatttcccgtgacatcgatatcacgtgaaaactcatggttttaccaaccggtccctaatcatatactatttcacgtcaaatctaatgattttcactgtcagatttctcgggtcatttattttatgtgagatctcattatttttctaaccttccatcaatgtcacgtcaaatctaatgattttcacaactggtccttttttccgcgtcatctatgttaaatgaaatctcaattatttttctaaccgattcaatcaatgtcacgtccccgtgtcatctatgttagatgaaaatctcatggtttctcaaaccggtgtcatctatgcttattttagccgccttttatctgcgtggacgcgtccttccaacggcatttgcatcggcactccaacaaaatattgaacagaatccaacaattacatttcctgcacacaattattgtcacgtcgacgccgacttcggcgacgccaactgagtccaaggaggctggcgctgaactgtcacataaagatgacaaaaaagagtcagcaaaagttgctgccaacaacagcagcagtagcagtggctacgagttgaaagtggaattgcccgacgcgttggacaaatggcaaattatgccgaattgggacagggattgtgatcgcgatctgttgatcggtgtacacaaacatggtaaataatgccaaataatcaatcagtcaataaattaattcaatccatttttagtcttagtatcaattttccgttaaaattatcggaaatcggaatcagacggcccaaaaaatttcggcaatcaaaaatcggatttttttttttttgtaaaaacaacaaaatgttaaatacttaattaattgcttcaaaatgatatttttcaaatgcgttttttgttctaaaggaatggaaaattgggagcaattgcgcgcggatgaaaagctttgttttacccaaaaaagcatccaatttccgaacacgatggacctgaacaatcgctttaaacacctaattaatgtgctgcaaagagttgccgtcgagtcatcagcaaaagcaacggcaaaagccccaccgcccgaaacaccaccatcagtggtgtaagtgttgctggggtgtcgttagagcccggacgggattggaattttgtaggattttcccgtggtccccgtcccgattttttttttgaagaaatgcctggattggaatcatgaaaaattggggtttgaattagggttaagccccgactccgagcccccgacccgacccgagacgttttttggacctattccccgacccgacccccgacatgtcgtcccccgaggtccccgacccccgactttttgccccccgaccccccgacactaattcgggggattgtggactcggagcgttttaaaaaattcatctacgaaggcggaaaaatattgaaaatttttgagattttgaacaaattttcttaataaaattcattaaaaattacaaaaaactttccggcggctcctatcggcacccggcggcccctcaaaaccatggtttcgatcggtaatttttcaaaatatgaacaccaaggccgaaaaataagattttagggtcaaaaataataacattagcaacattttttcaaatcagtaaatttttacaatttatttgatcaaaattcccattataaactaaggacaaaacgaggttaaaacgaagattttggacccaaaaataagattaaaaaaacggctttttacattgtaaaaacagggctgctaactgaaaattttcaaaacctgcatttagccaacaagaagcatcatttggggtcaaaatcagcactttggaaattttagtcaaaaaggaaaaacatgctttttttgtgacgcgctttttccgaaaaaaatttttgtacacaggtgccggcgggagaattttttgaaaatttgagttcattttgctcacagattttcaccaaaaatgaccaatttttgcgcaattttgagaaaatttttaagaacaattttgcggactggctgtgccgataggtgccgccggaaaaaaaaattgaaaattgggagtttttgatagcattttttacataaaaaaaatttttaaaactataaatatatttaagaaatttgaacaattttcgtcgctaccccaaaatcagaacattcttataaataacgtactcttgttggcgctaaatcagatgattaaagtgaaaaaaggaagatttacgagcatttaaaaataaaaattgagttttttgttaaataatttcgttgatcactacccacccgatcggggtccccgactcccgacatttgagctcc

SEQ ID NO: 18814 - DNA, 2964 bp, Heterodera glycines
  misc_feature (2869)..(2869): n is a, c, g, or t
ccaatatgtaaaaaagggtaatcgagaagtcatgggataattaccatgataagaggtcattaattaaaaaaaagataaaaaacaatgatccacaatgtgcggtttttgccactttacaggattatgtgctaaaaaatattttttcaaaaataagctatttttcaacaacaaaaaaaccctaatatttaaacaagggatgcgcgcgccttccatattcattttttggcatctgtgaatcacattttggcaaattttaaaaaagtttagaatttcgcgttgcatcaatttttggcctcccgggtatattcctgatattataaatacaatttttaaattttttgcttacgactgaagctaatagtcagaatgccaaaacaaaataccgtacattatgtcccattccacggatggataataatcgtccaaatcaatgccatcctcgaccagcgcaagctgttccaactcgccccgttcattggtcacctccatttgagtctcattaacagcatccattagcgaaagatgaagcagcccggaagggtaggtccatgagccaaactatttttaaaggttaaattaaaatttggcaaaatttaaaaatgaaaatttgtgcctatttcgatattaattccatccatatttagtcattcgagatttttaacttaattttaactaatttgacaagttttaaacataatttggaaaattttggtacctttcgattgtgctccttcctatagctcaaaattttaaaaaatcaacaaaagtgcatgcggtaaagccatttagcgctcaccgctattttggtggcattgataaaaaaatttcacgaattttatgtcatttttacataagaatgaatattgctgcatccaattttattttggatatattaggtcatctcataattataagcatccttcgattataatcggtacaaaaaatttctgaattttcacattttttttgacatataattggtgtcattctaaagtttcatgggtacgtttgggtgtgcgagaaatgatttttaccgagaatcgagaccgagaaatgatcacgagaaacgatacgagaaccgagacccaaaaaactctagagatttctcgactcgagaatcgagaaatcttaatgaaattaatttaaatgtattttttaaattaaaaaaaaaattgctcggtttccgaggcaaaaaacacgagaccgagaagcgaaaaacccgagaaatttcccggatcgagaatcgagactctcctctacatccctatgggtcaatcagctaactttgagaacgcatttttcggaaattcttttcataatttttttaaatccaaactagacttttggtaaatcggggatggtaaaaatagtaaaacgagaaggaatagggatcatcattaaacaccaccgattatttaagcgtaaaacggagagaattgaaggcggcttttttgatcgttccgctaatttatgcagtgggaatggagcaaaagcttcattcccatagattgtgctttacgcgcgcctttttgttgattttaaattctgagatataggagcaaaaccgaattaacttcgatttttatgcatatttcccaattattttgcatgcatgtgcaaataattagtcatcctatttttgatattaaaatttattttaaaataatttgtataaaaaatccatgaattattttaaaattaataaataatttgatagctttttcaaattgtatattttgtcaaatatttaataatataaaattgactgactttgagaagacaattctgttcatcaaatgggaacctaatttaatgagaatttaatatctaattttttaaataatttaaaaccgataccattggatgtcaatctaaacaaaaaacaaaaaattaataattagtttattttttgaaaacgtttttgcctggcaaagtgacttataaatggctggcggttcccatacaacgcgtccatttggatgcaaagttgcctaaaaaatttaaaaattacaataaacattgtgccaaaatttatttgctcgggtgccaacaattggaaattcaatagggctattcgagattgttaggtctcgatctcgagtcgagaattatctcaagtttttggtgtatcaaatctcagaaagtctctatctggcgagatttcgagttttaatttttattagagatttacgtaccttcgtgtcaattgtgatattgaaggtcccttttgcattctataatttaataaacatttaagataattttaaaaaaactaatttttaaatttattaaaaattacaaaaataatcttaaaaattaaaattaaatttttaaattatttaaatttacaaaataatcttttaaaattattaaaaacaattaataattttggtaaaattaaaatttaataaaatgcgaacaaacatttttttatttactaaagaggataattttaaaaaaattacattgataagcacaatgtcaggcacctgaaaaaggaattaattttaaatttatttatttttgtttttgttttgcttaacccaaatcatttcgtatggcacataaagtaccgatacgccaccgtaatcgtccgggtcccatgcaagtttacggtcggtccacgactgtttgagccaaacttggaatttaatttaataactttaattacttttttcagacatattcatatttaaaatatataaaatttaattatattatgtgccaaagtttaaaaaaaagctaacacaaaaaaaaagttttttacaaaaataaaaatgccaaaaaaataataaaaacagaaagtttttcataaaacttaatatttatatgctataaaaaaatctatttattaaaaatatcgaattanattgtttttaattaaaatgaacctggaatagtcataatttggtccaattcatgctaaaacttggcaaatgatttaagaatttaaaatttgtttcc

SEQ ID NO: 18815 - DNA, 2019 bp, Heterodera glycines
agattattctgcctaggaacgtcttcaatttccgttacgtctaacgttcacaaaattaacaattcaaaatctggaacaacctgtagtttgaaaaccacgacgtaagcgaaatacgggaggatcaaattgtcgatggattgaagacaaaaatttttggctgtaaagatgaaaggtctaaataattattgccatgtttctcgatccgagatttaaagacaaagtttctgactttccggatcttttacggtaaacattgaatacaatcacaacatcacaacaaaatgattgacagcgcacgacacatacgactaccgtcgacgccgcttgcgtccaagaaaggccgaaatgctgatttttttgaatcgaaatcttccaaaaattcattggcgctatgtaatttcgacactgggtaaattcgacactgagtaatttcaacattaagtaatttcgacactacattttcgacacaaagaaacactgaactatttcaaaaactttcactgttttcctgcattttcgacactggaccatttcgacattgaggaaattcgacacttagagaattttttagaaagtaatataaaaaatttgaaaatgttagtatttataataaatttcctatttcattttctaattttaaattaactccatctcattctaaacggttgaactaaagccatcggatttacattaaaaaatattctaaacacccgccttattgcacaggaagagctacagtccaaataccaaattttttagtagcgtttgtggggtgggtgattgtttgggtgatcggagtttcagcggcacagtcacgatcacaactgacctaaatagacatggacaatcaatcggacgtttcttaagcacaaagagtgtaggatttaacacgaataagcactaaaatgccaaaatcaacaccaaaaggcgataaaaagatataaaatttggcatgtaatattttttaatgaggatcacagagaaaaggcgtattttttcttttgaactttagacaaatatcgcttctcgtacaaaggcagtttgtacaatggcagttcgtacaatggcagtttgtacaatggcagttcatacaatggcagttcgtacaataggctttcgtacaatagcgtttcgtacaatagacattgtagaataaaaaattttacaaaataaagcctaagattaagcttatgcctaagcccgagcatgcctaagcttaggactaagcctaggctcaagcctaagcttaatccgagagcttatgattattctaagcgtttataaaatgtcaaatgtacgaaattccattgtacaaaccgcccattgtactaactgcctattgtacgaactgcctttgtacgaactgccctgacccggcttctggcaaagaggtgagatcagcgatccacatccccgctccccgacctttttgggcctgcgccccgagctgtcctccctgactaataaccaatccccgattgcagctgcaggcgtgactttgacggagtcatggagcaaaacacgaacgctgtcttgtcaaaatgaagcgacatacaatgacaatacgaaaacgagtgtgaacaattctccaaggcgcaacatgggtttggcgtctgttggccttgggtacccaaatttcagcaagatccgaattttcaaattgcgcatttcgctgcggagttggaactaaattttttgcagcacaggatcacgcaggattattcccgcataattccatatccaaactttcttattaaaattttcttaagtataggttcattgtcttcttaactcgagatttttttccatcattttttgagtcgaattttgtttaggttttattcgaatatctcattatttacaaaccgattaccattataaaaacatggtggcccaaataacataattacgggtaacatctgatttcgtcagtgagtgatttcgtcagtatgggatttcatcagtgataataattattaagtacaaaaaacttttaatatatcataaattaaaaataat

SEQ ID NO: 18816 - DNA, 710 bp, Heterodera glycines
atattattcaaagccaatttttaaatttaaatttggtatctttaatgccagttaatgattttttctttttattcctttgttttgtttagagttgagcggtaatcggtaattgtaaaaaaaaccggtaccaacctgtaccaactttttcctccggaacggtaccggtaccggtaaaaaccagtaattttccaacattataaaaatttattcattaaataaaaaaataactatatgtatattcagggtgaccaaactttttttaaaattcaggataaaaaacactaaaattcaaatttagccctaaaattaagatttttgcaaaacaagtatgtcagcggccaattttccaattttcgaagggttccggccaagtaaaaatagatgaccttttttttgctttcaacaccgctttttcgcggcgcgttttttacaaaacttcttgggattaatgggggtccagcggtgtcaaaagtctccgccgggaaaaatttttgtaatttttaatgagtttattaataggttttatccaaaaaataacccattctttggttacacaatttgaataattattttgtttaattataatagaatacatattgtcttttttataatttcctattgcagtaagaattaaattttgtttttatcggtaaattaatgttttattaattattttttaattaacacttttttagttactcatggacgaa

SEQ ID NO: 18817 - DNA, 2517 bp, Heterodera glycines
  misc_feature (2431)..(2431): n is a, c, g, or t
  misc_feature (2479)..(2479): n is a, c, g, or t
attcatttaaaatatctttataattaaatcattttttttgtttaatattgaattattttgggtttctattatttttttctattgtcgtttttaaattcacttttattaatattatttagaatataaatttataatctgcaaagaaaacgcttattcattaactttttgtattaattttatttttattcggcattttatttttgcaatattcgtcttcgcgatcatctcatcggtatgcattctcgatcagtcttcggtgaatgattgggcttttatttattaatttttgtgaattacatatattaatttatgtttgtattttttattacttatttaaacaataaataatctttctatcctataaaaaaaagaatgtattaattgtattttttaattattttgttttctcatataattcttgttttctttttttaaaaattatttatgagattttttacataaaaattaaaaatattatttaattttaattattccattcacatttaaacttctttaattgtttgatttatataaaaaaatattaatattaactccaattgaattttgcagatagtgcctatcgtataacaactcagaatttattagtcaaaaaggtagccaattaaataaaaaattttatgaatgaaataacctaataatagattgaaaatcatgggtagaaatcaactgcttgtttcaacaatatcaattaattttgtgatttatattaatttttaaataaatagcgttttttataagatttttaaataaataaatatatagctgctaagtcctcaacgtttactcatttataacttataagtattattttttataattttaaataaagttctcgaccatctttgatttaattaattactattttaaaaaaatttaaaagttgttatttcataaatatttttatttattataaaaatgaattaaatttaatatatttttataaaaatgtaaggttttttaataaaaaattttttgtttttttaataatagtaaaaaataaattattcagatcattttttttctaaaacaaaatattatgcttattatacaaagtttttattatattttcaaattttgtaattaaacattgttttattttataattttttcataagaaatactttattagtttattatttttatatttcatcttttaaactcatgttgcgtgtacattagaatgatttgaattgacaaggtgttttgttcatcaatttcttatatttataattatgtttattagtgtaataaaataaaatatttttgtaaatataaaatttttatgtaattttttacataagattttgattaattgatttttcaaatgaaaaaagtatttaaataaaagcgttttatttaatttttagaaaataaaaaactaaatcaaaatatgatcaccttaatagcccaaaggtaggtgtcctttattgagatcctgcagatgaactgccttatgatcaaataaatgcaaacattagccaaaaccggcttgatctattcttttttccttaaatatagatttaaaagtttttttagcacataaaaatccaatccatgttaatatgtaattaatataatcaatttccggatagtagaaaggtgatttgatttagataattattaattttattatgcttttatttatctaaatataattttattttagcaagaagcatgcaaatttttatttttggaagaatatagaaatatagaaggaaacttagattttacagaaaaatttcttgaatattgaatattattcatcaaaattcattaaaaaattgatttaaaaaatttaaaatatatgaaaaatttttaaatagacatatttttattatcgttcagaccatctttaattcttctcttttataataatttttttaatttataaaattatttttccaaataaaataattaaagtattacttattttcattgatgcttttaaattcgacatgacatcggaatgattgaagttcaaaaatttgattttttaaacttatttttaaaatataagaataaatcatatctttttaaatttacttactttttaatgaattctttttgtctttgctttcgaataaaaaatataattttaatcgaattattgtttaattatatattttaatttatttttttttataaatccagtgtatttttttttgtcaccgagtttagcgctattataaaaattgtttaattcataaagtaattttaaaagaatagtttaaatgtatttaattctttaattctacaattatttaaaccattattttgtgtttggtttagcatcagataattaaatttttatgaattatttcgatacaaatatatttaaattttttatcgtgctcctccatgaataatttctgaagatataaagttgtttaattatgataaatatttttanatttttatgtcagtttgaccacacaaaggtaacatgatggtatacggngtgtactattttgactttcacctctgatttagttttaa

SEQ ID NO: 18818 - DNA, 1673 bp, Heterodera glycines
gaattatatggcattccatatttttttcctggactctgggaggcctgaaacgcacgaaaaacatgtttttagcttggtttgaagcttctaggatggatttatatatccatattttcatatttttccatatttcgcgatttatgtccatattttggcatttatgtccatattttggcatgtccatattttggcatttatgtccatattttatgcccaatttatggcatttttccaaaaaactctaataaattattcacattactgaattttatttggcatttgagaaaacattcaaatgtgagcaactatgttccataattttttgagaaaatcacttaaaaattttatcgaattttatacaaggagattgcataaaaatccacaaatcaaattatcaaatttttgaaatcgtgcctaaatgtactcaaaagggattcttgggatttcagggtcgtaaaaaaattcagcctccgtttaaaaatatgaataaatgaaaataaaataaaaaacgctaccaattaaataagattgatcaattaaaatgacaatttagaatataaaaatttattttaaataataatttaatagaaaataattattgtttagagatttttgtcccgattgatgttcctttaatagcggaagtgcaaccagtataaataagcgcccggcactatttgccgtaatgttgttcggtaataaatagtaatttataaattcataaatattattttcattttaagcaattttgttaatatttgcgcataatttgcggtacgcaaaatgaaaaagaatgaaaaaacaacaccctaatccgcacctttttttgtcattaacgagcaatgatcaaaggcttttatcccgcctcttacctttggcttttgttccttcgatggaaaacattttacgaattcattttgctacttaattgatcgctttatttaatgatgtgataatcgctttattttttaatgtttcaccaccatttttatgcatttcactgagataaacttataaactctcgggacttcactgttacatttgacatttcgaagtttccgaatctaacctttggagattttgagggtcctaaaaaaatcaactataacattaatgcataaaactttgtcaaatacgaaaatttctaatatgagatacacaaaaaataaagggtgctatgtcgtaagttaaaaaccgtcataatgggcattattttaaaactatcaaaatagaaaagttttttattaaaaacttccatatgatggtttgttgaataacgacctttacgatgtttttttataatggctccgcaccaataaaggtacaataaaacgggcaaagattttccatttcagattttttacagagctttttatttcatcaacttttttaatttttcaagaattttcggaaatttgcaattattctgcctttattccctattagcatgatttgtttaagtttttttgtccatattttaatccgcactcttttttgtcatcaaagagcgatgatcaaagccctttagcccccttggctttcgttccttcgatgggaaacatttgatgattcatttcattctgctattttaagatcgctatatttaatgatgtgacaatcgctttatttttgaatgcttccacaccgtttttatgcattccactgagataaaa

SEQ ID NO: 18819 - DNA, 1586 bp, Heterodera glycines
  misc_feature (10)..(10): n is a, c, g, or t
agtcaccgtntacaaaaagttgaacacacggcgaaaatgtcaaaaatgatttcttgctcaaactctcatattttttttctgaaccgtaacttaatttttgtaaaattttcaatatagatgcatgcctggaaactggttcttgttagccagtattttccttacatttatttttctaaattttgcataaaaaataagtgtacaggtacaacgaggaatacaagtgctagtacaaacatttccaatttcgaattttttgcaaagcttttttctttcctaaaactcttttttgatttcgacatcaaaaaatctgagaaatttcactcggtttcagcccgaaattccgaaataaacaacgattttgctcgtacatttttgtccatgtattttttgcagaatattttccattctgctggcagctcaattttgatatcattttcgcttgggtctgcatctttcattaaaccatagcccaaaaattggcaaaaatatttgactaaatttggcatgccattgatttgggccaatttttgggccaaattcatttcaccattagtgagaaggtaattaagcaatgttgttccgtaatatcccaacacattcaattgatttcggtaaattgttgacaatttggtgaatcgttctacaaatatttcggtgacataacgaaaaaatgctttgatgaaaaatgcttcttcctccgttggcacggcattttgtattagccaattgtccaaccattcgtttactctttgctgatattccaaaaaatggaacatgaatagaacttctttgtggccatacaaatgcttccatttctctcttttcattttgttttgtagaatggtgcctgattcgtttgtggaagaaatcaaattcttaaattaaaatttacttttattttttataaataattaaattttaatttaccacttgtttgtcaagtggaaatatgtgaacattaattaagtcttgaacattgcttgacattttgatctcaaattcgccatctccatttgtttggattgtgtaaaaatgaacaaaacaatcgcttaaattctccaaaacaattccattctcatatttgaaaaatggcactttaatttccttaacagcgtatctttgcgtgatgtaattaaatttataggcctttaaaattaattggttgattaattaattagatattacaataaaattaaatttattatatccatactttaaagaatgtttattatagaaatattatttattacttttgtcgttatatttttcaaaatgaagtaacattttgctgcagtatttttgcttatttcatcccaaataacaattttataattgccaggaggtgtcacttcgccagcataagttattgaaaacgcttcatttttcattgcaatttgccccaaaaaagtaataatcaaaattaaaaaatagacaaaaatttttcgaagcattattgaaactgaattttatatataatttaataaaaatatttttagatatccatcttttgacaaaaattagttttaatttatttatattattaattttttttaaactttaatatattaatattaaataaaaaatta

SEQ ID NO: 18820 - DNA, 1882 bp, Heterodera glycines
tatgacctttgtttttcgtttcagattttttggaattctttaaaaatttttgaaaattcgtcaattttttggccttcgggattttgggttagttttcgaaaattcataacaaatcgaagggtggataaattttcatgcaattatattataaaaatagagaaaaatcaggagaattttatgggatttatttgggatttctatcttaaaaagaaaaaaagttattccagaatttctgaaaattttcgatttttcagaaaaaaattcataacccccttctgaaaagaaatttttgaaaattaaaatactacaaaaatccgcaatttttttctttataatataaattttatttaacatttttatcactttcttacgaattgttacaaaaataaaaccgattttgggattcgggaccaaaggggtgagcataggatttttgagtttaaaaattttttcaccaaaaatcttcaaaaaatatgtctttatgggttatttgggtccctgatcacgaatacgtaatcagattttacttttgacatagttaagacctcagaatccctgtgtgattggggattctaaggcacccttatgaggaggggagaggcaggttcggacccggacggtgtacattatttttctatgcatttttgggttattttcactgtttttaattaatttgaagatttgttttaaattatttaaatttattttttttaaattaaagaaattattttttgttttattattaataacaaaataattttaattaaatttaatttttcttttgataaatagatttatttttaagcaaaattagatttaaaaatttggatgcataataattcatttcaaaataaagtaaaataaattattccgtttattaattaaaaaataaacttttacattttttattattttgtttttttaaaatttttaaataaacctaattctataaaattatatttaaaattatgaaattatttttgtacatctcataacaagttagacttttgtacctcttctaatcactgttgtacctttctaatcacttttgtacctcttttaatcactgttgtacctcttttaatcacttttgtacctcttctaatcactgttgtacctcttctaatcacttttgtacctcttttaatcactgttgtaccttttctaatcactgttgtacctcttttaatcacttttgtacctcttctaatcactgttgtaccttttctaatcgcttttgtacttcttttaatcactgttgtaccttttctaatcgcttttgtacttcttctaatcacttttgtacctcttctaatcactgttgtacctcttctaatcacttttgtacctcttctaatcactgttgtacctttctaatcacttttgtacctcttttaatcactgttgtacctcttttaatcacttttgtacctcttctaatcactgttgtacctcttctaatcacttttgtacctcttttaatcactgttgtaccttttctaatcgcttttgtacttcttctaatcacttttgtacctcttttaatcactgttgtacctcttttaatcacttttgtacctattctaatcactgttgtacctcttctaatcactgttgtacctcttctaatcactgttgtacctcttctaatctctgtaaggccaacaaaatttgaataacgggcgcgaagcgcccgtatgaaccaacaaactttaaataacgggcgcgaagcgcccgtccaaggccaacaaatttaaaaacgggcgcgaagcgcccgtctgagtccatcaaaatttaataacgggcgcgaagcgcccgtccgactcaacacaatttaaaaaacaggcgggaagcggacgaaaagcacaacaaaaattaaaaa

SEQ ID NO: 18821 - DNA, 2472 bp, Heterodera glycines
  misc_feature (2455)..(2455): n is a, c, g, or t
tctgttcctcttccactttcagttcctcttccactttctcttccactttctgttcctcttccactttctcttccactttctgttcctcttccactttcagttcctcttccactttctcttccactttctgttcctcttccacgttctgtttctcttccactttatgatcctcttccactttctcttccactttctgttcctcttacactttctgttcctcttacactttctcttccacgttctgtttctcttcaacgttctgttcctcttccactttctcttccactttctgttcctcttccactttctcttccactttctgtttctcttccactttctgtttctcttccactttctgttcctcttcttctcttccgctttctgttcctcttccactttctcttccgctttctgttcctcttacactttctcttccattttctgttcctcttccactttctcttccgctttctgttcctcttccactttctcttccgctttctgttccgcttacactttctcttccacgttctgtttctcttccactttctggtcctcttccactttctgttcctcttccactttctgttcctcttccactttctcttccgctttctgttcctcttccactttctgtttctcttccactttctgtttctcttccactttctgttcctcttcttctcttccgctttctgttcctcttccatttctgttcctcttacactttctgttcctcttcttctcttccgctttctgttcctcttccactttctcttccactttctgttcctcttacactttctcttccacgttctgtttctcttccacgttctgttcctcttccacttttgttcctcttccactttctcttccactttctgttcctttccactttctgttcctcttccactttctgttcctcccgtacccggtttaaaaacttggacccggacccggctttgctggacccggaaatatccggacccagttttgcccaaatacccggattcgtctaatcctaaaattaactcattttgagatttataaattatttaaatttttattaatatttgtttatttttaatttttattcaattaattttaatatttaatttagactttattattctattaattaaaaatatttattattttattaattcaaaaaatcattatcattaatttaaaataacataaagttaattaataaaaaaaataaatttaaaaaacaaaaattagaataatttcaatataatatttgctttaaaataatcagaagaaatgggactcgaacccacaacaccccatgaccaaaggcaagcacactaaccacttgaccaccgggtcgcttgcctccttttaatttccttttcactttccttcttttttggcataaaatatttataattttatgtttaggtaacttattaatttgtctccattttttaaatgattttgcacaaaaaaggtcaaacaatagatttttgggttaaattaggaagaaagaattaatatttttaatatttaaaataaattatttttaataaacttaattaattaaaaaaaagtaaaatcattcaaaaaatgtaataaaataatggatgaaaacacccagaaaaggtgggacccgaaccgtcgcccaccaccaaaggcaaaaactaaaaatttatgctattaaaacagcaataatttagttggaaatatttattgaataaaagtaggagcagtaaaaaactgatgatgtaaatggaaacaattgataatgaactggggaaagaaaaggaggagacattttttgcttattgaaaaggcgaggttaaagaccacttgtgagtgtgcattacatataaaaaaaggaaagaaaggaaagtaatcaatttttatccaaaagtactttgctcctccatattttttattatgcctttctttctcttttaactcactcataaaattcttataagaaaaacatttaaaaaataaaattttaaaccgaataatttaaatataatatttgacgggaaaagcccataaattaatgggactcgaacccacaacacccaatgaccaaaggcaagcacactaaccacttgatgcctgccggttctcggcacagcaaagcactaatacggtgtttgactcacttcaaaaaataattcattacccaaaagttttttacaaccacatattgccaatctaatttcttgcagattgaaagccatccattgcataccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccatacccaaaagttttttacaaccacatattngccatctaatttcttgc

SEQ ID NO: 18822 - DNA, 2471 bp, Heterodera glycines
  misc_feature (2444)..(2444): n is a, c, g, or t
tcgtaatattgctaaattctaaaatcccgctctatacgaatttggacaaaagtttataaaacatatattcgtcctcttttagaatatgccgctgaaatttggaatccgacgtacaaaaaagatatacctagataaattagaaagatgccaaaaatatttcacaaaaattgcgctatctaagtgcaggcttctttatataccttatggacaaagacgatctctttaaactacagacacgaagaaaggaggaaaataattgatttagttcaggcattcaaaattattaatggtcttacacaccttaaaaaggatatatttcctcaatgttctggtcgaatcccctacaatcttagacgtaaagttgtgttaaaatcacaatccagtaaaaccaaattcctttatcaacagaacaaccttaatatggtccaaacttaacaaagatataacagatgctccatctgttgacagtttcaaaaaacgtataagcaaatggattgagttaaacaaaaatttagtctgtaaaagagctccttggacttgatatttattactttactaaaatctaacgtgtaagtggtcaccccttcgttggatatttttatttcttctgaataaataaataaataaatggataaaaagttgcattatttttcatatctaattgcagaatgactattaaatgctttttgaaaatttatgatatttaggagccatttaattttgatctagcttcataccgatttatattatatatttatttgattatataatttgacaaaaaattaatttgcagataagaaatatttatatatataaataattcgtcaaggattttattctcattattattatgtttttttagaaatgaattaaatccatttttgttttaggtattgtcttaactttcgagtttttaaattgctgaatattcattttaaatgttaatatttagtaattaaatgaattttatttatatttggaaaatttattgcaatgattaaatttgtacaaaatttaaagtcatttattaaatatttacaaaattttattttatattcttatttttttcttataatttaaattataatgcatgttatttaaaaaaatattaaattttaaagttcaatggttttagtcttggaaaaacattttggtatcttattgttatgcaggaggcgggagttagtagattgaaaatgccaattgcataaaattactaatttgccatttctatcgattatttttacttttcgaaccttatattaattaattttctttaaaaattatttggccttataatatataaaattaattatataaataatttataatgaaagctaaggtaatatttcatagttttagtaaatgttttttttattactttttgataatcagcagcttaatgttttaggttgaacctttataatatttaagtaattttaagatttcttattttcagattacagaattaacaacaatttttctcggcgcaaataacacacaaattgaaattttacttgaattaaaatattttgcttttattattataaataattttgagataaactcactacctgtctgtatttgcgcacttgcgccttcattaaacacgaactttagcattgtaaattaatttacaattaattttaaaaccaaaaaaataaaattattaatataataaatatatttcgatttattaaatattataaaattattttatgataatttgaaagataaaaggcatagaaaataaatttacaaataaacccaaggacagaaaatttagttaatttatagaaattcttattcttaattattttaaataataatattggcaaataaactctaaaaactgaaatattaaattctttagtggacttttttatagttttgatatgattttattagttttttatatttaaaatgaattataaaaaatattttttttattcaaaaaaaatatttttttttatgagtcttatcattaataattcttttttattattattttatttgggttaaattcataaatttcatattgaatttttatataatcgcacaaatttatttaaaatttgattgatcagcgtttttacacggccgaagccgtagcttgccagttgagtctggcctggtgtacccaacacggtctgtcgttcatcccttcggccccaagctgctcaaaaccttctctccactccacactttctatcaccagagtatcgccaatttaataatattttggtttttatgtgttttatttaatttttattttaatgtttattattatgattattatgttatttcttttaattttcatatagaaaaattatatagaattggtaattttatttttaaatttatgggctaaacttgggatatttattctctgatttgcataggcatttccattattgttttgttgaactatctttagtggactnttttatagttttgatatgattttatta

SEQ ID NO: 18823 - DNA, 3340 bp, Heterodera glycines
  misc_feature (103)..(103): n is a, c, g, or t
ctcgtgcgcaatggattctcggcgaaccaaaattagttagatggctttgttcgagtgacgaatgaagggcttaattaatcacttttttttttgtcagttgctntaatccgaaaaattggtcattcttacttctttagagtagtgatttttaatgaatgtcaaaagaaccaaggacgttagttgactggaatttaaaaaaaaacgataactcaactgagaatttttaaatttttattctacagtcatggtcaattattgtcccatccttccttcaaagatgattattaaattaaaagcattttctatattttctatgagctttcaaatgacaccatttattaggcaagttaagatttggtgccagactttgattttatactccattttcgagagggcataaactggcaggaaaatagcaaaatgcaaatttgagtatttcggagagaggaaatgttgagatgaacatttgcttgatgaaattggggcccaggtacaaaagcgtattgaaataaatgaagtgaaaaagcggacaaaatggaaaaaaaagaaggcgatcggagagcagatgccccgcggcggggcaacaaaggaaaacattaaaggatcattcccactccatcagtcggattccgtctcctgtctgaaattgccactgattgactctctccacagtccaaatccgttgttgtcgtcccatttccaacgcagtgcatggctaactcgtctcgtccgcgcattacttttgccaacgccgttccgtggtcgagcaagcggattacggtggtaggttacagtacccaaaaggccattagcgccggtccatccgtgctttgtccattgtcatcatttggtgttgcgaaaacggcactatttgtacggagaattctgagctgtataaactcatattgttttactattacctaaattgttttattgattaattattctaattgtatcttaattttttaatcctactttgctggggtttattttttgttttgtatttgctatttttattgaacgatggaagaaggacaaatggaaaccggagaaaatgctgcagttaaactcgtggatcaaaagaagtcggctaaaaagaaagtgcgtataaaacgaagaatttaatcgctatcggttatcacttaacaggtttatgtgccggggaattagccgaattttgaaggcgagcgaagaattggtatacgatgagaaggcgtatttgttgtttcacacattcgaaacgagtgagtggtcacttttggggtgtgccctaagcctagtatttgtgcaattcgttcattttcgtatttattttagactatccgtgtttaagttttgatgttttgcccgactctttgggcgacaatcgctccgattttccaatgaccgcttggcttgctgctggtactcaggttcattttgtgaaatgtttaattccaaaaatcttttttaggctgaccgagcaaaggacaacgaattgctggtgcttagactgtcgaatttgcacgcaaatgaaaagacattggaaaatgcaaagaaaatggcccaaggaaagggcgacgagtcggagagcagcagcagcgaagacgacgaggaggaggaggagacggagggcggcgcaaagagtgcgcggatgcacgcggcagtgatccctcaccacgggggcatcaatcggatgaaggcgagcggagggactgacagaacgggcgaaaaagacggcgggggggggggggggggtaaaatggcacatttttgccactaaccttagaaaataaattctaatggagtcgaaggtgataccgaaaaagtttgtagattttttgcgggagaatatctccttccttctttgcatggcatctgtaaaggagtccaatttttgcaatttatccggtcgtgagttacaataaattggtcacagtcaaaactcaatccggtaatctccgactttttttttgtcagtgccaaacaattggggctagcaatgtgtgcgccgtgtggaatgaccagcagaaagtgcagttgtggaacttggacccggccattgaaacagtgaaatccattggtacggaaagtccgtcgaaagtgcaaaaaatggagaaagacgcggtcaaacaaaatttgttgtttacctttgccggacactccgccgagggatttgcactcgcatggtctccgattcgtctcggcacacttgcttcaggggacctccgcaacaaagtgagtgatcggttggcttttcagaaattatggcaaacatttcgagaatttcatttcgccggcaaaacacaaaaagaaaactgaataatgttgtttgcagatatttctttggagaatgtcggagggcggccaatggttggtcgaccaacgtcctttggcagaacaccaaagttctgtcgaagatttgggtaattcgccatcggtggccaagcaaaagaattcgtttattcctctctttctgctaatttagcttggtctccaactgaagaagcacttttaatgtcctgttcggcggaccacacattgtcagaaaaaagtgaatgaattgtaagcgaaagtcttttaggcgcctttgggatgtccgagcctcccacaaagattcgtgcgtttgtacggtcaaagaagcgcacaatggcgatgtgaatgtgatcagctggaacagcggcggcgagcctttgatcgtttcggggggagatgacgccaaactcaacatttggtctttgaagacaattcaagtgcgtagaaaggggggggggggcaaagttaaggcatacgaacggaaaataagacatttattgttttaaaatgtatttgcaaactgatcaaaaagtgaagaggatgcaaaaacatccatatttgcccgaaacctcatgattttttttaatttcaagtacaaccaaccagtggcacaatttcaacaccaccaaaagccgatcaggttgaaaaattgattttgttattacaatttcattcattgtcagttcggttgaatggaacccgcacgatgggacagtgttcatggcatctggggaagatgaccaaataacactatgggatttagcacttgaagatgacgaattgcatggggaagtcgaggggggagaggagaagacggccccaaatgtcccttctcaactgctatttattcacatgggtcagaaaggtaagtcaacagccaaacgcataaccgaattatcattttaaatggcaattttcgccatttaatagtactggtttatatcgaattttgttcagaagtgaaggaagttcattggcacaaacagtgccctgggttggcattttccactgcgttggacggcttccacgttttcaaaacaatcaa

SEQ ID NO: 18824 - DNA, 2959 bp, Heterodera glycines
atggcagttgggggtaagccagctttataccatgctttacatagtagtagacgcgcacctaaagtgtattgtacacatagattggttaaatttaaataaatcaaagacaaaccgtaatgccaagataaccgcgcatagcatatgcagtttgagctggatgaattgttagttcgttgcaatggacgcgaatgtttttccaggcagggcgcagatgattggtgcgtaaatgaagattggaacgcaacatttccgaaatttctctacgtttgctcagcgtctgcagcagaacgtgaagctcattcattgaacatttgtagtgtttgcagagaaaatcaatcaacggcacactcttctgcttttcattgcaactgcacttgttttgtggttgcgggtgctttggcaactcaatgttgtctaaatttaaaaaactgtttttaatgtctaaaaataactaaataaacctttcacttgttccagttccatttgatcattttgcaattccctcgcccgctcctcctcctcctcgatgattttaagccaactcatttgtccttcctgaaaatttattttatttttttactaatatagttttatttataaacttttttcataaaaaaaaatacttgtgttgctttatcttcttcttcatttcctgttgtcatcttttgttccgggtacgcattgtggagccaatcggtcgcaagaatcgcgtccatttgtttaatagttaagagattattattattatttctgtaaagctttattgtgtatatataatattttttaaacatggataatataagataaaccgttttgcaaaaaaaaaaaaaaatggcagacaattttcaaaaatttgatgaaaaacacttacaactcagacacccgtttacgctgacaatctcagggagcacggggagtggaaaatcggaatgggtgctacgaatgctgaggaatgtgaatgcgctagtttcggaacccatctcggagattttctactgttatggggagttgaatccaaatataatacagcttcagaaaagtggacacatcggcggttgtagggttattgtacatgctggaagcccaaccgaagagcaggttaatcggcgcgcaaaagagtgtgatggaaaactgttgatggtgttggatgatctcatggttggattgggccaacaatttcttgacactgtgttcacccggggatcgcacaattggggggtcagcgttgtgttggtcactcaacatttgttcgcaaaagaactgcgggttgcgcgcaacaactcccactatttggtgctgatgcgtaacccggcgggcgcgctccaagtgcggacgctcgcctctcagctatttccaacgaaaagcaactatttcacggaagcataccgggatgcaactgaaaagcaatttggctacctactaatcgacatgcagcccgagagtccggaattgttgcgcctgaaaacgaatatatatggagagcagggtggtcttcccccattggtttatgttgcaaaatgaagcatgtcaaaagaagaagactaacagataaacatactatgaatgttagcccgctgatgttgaaaaatgctgacttcttacaccactttcgctcaaaatatcgctcaaaaagcagacagcgcaaaatgatagagaacgctttggatgagcagttgctctgttttgtggagatgggtttcaatgtgttgaagggtcgtgttccgttagggaagcgacaaattcaacggttgggtgcattgaagcaccagttgaggcgcttagcacgcgcacgttgcgcaaaaaccgcgcgcagagtactattattgaatcgtcaagaccaacaagtacaacaacaacaccaaaccggtgctggctttccggtggtagccagtatgctgacgagcattctcttaccaatgttaatggacaaattactgccaaaaactaattgataaatagataaaaaataaatatataaaagcgaaacagctaagagcactcgtttaattaaacatttagaagagcgcaaaaaatgcgtcacgcaatgcgaatgtttctcgtcccggaggacgtctttcagtcggtatttgttcaaccccaagcagcagcagcagaatcagacggtgccgacggtacaccaattgggcttttgcgctcacgcatccaacaaattgagcgtagcagggagctgaacgaagagcagaaggccgcgcaataccatcaggaattcaaacggctcaacaaactggtgcgcgagcaggaggagcagccgatcaatgttcgacttcagcacgaaaaggagaaagaaaaaaattcagcaacgccgccgccgccgccgccgcaaacgatcgatcattcaacgccaaaaagattggagaaaaacattgtaccatcagcgtttgggttgaggaggcagagacaccactacacacaaaaggcgggggcattatcaaatcgcagacctgcccaaaaacaacaaagaaaagcagcagcagcagcagaaacaccaaacagcagtggaaatggagaaacggaaaaagaagagggtgatgtagatgatggggaacagtgggacgatgcacaatcatcatcgtccacggcgtcaacaggtggtgccgcagcaaaaagagtgctcagagcaagagatggggaagcaggaaaaggaggaggaggagaaacggctgatcgccttcaaacaaaacacaactaccagatgaccaaaaatgcactgatcacacacattcgaaaaaaggggcacagtctgggagtcagtgatcagggaaaggttttgcgcgcagatgggtccgagtttaaaacgagcaacgtggaggcaattgtcagccatttgttgaacagggacaagcgaagcgaattcaaagggccgcctgtgggctataaggaatttgctgaaaaggcaagagaggatccgttgctaaaaaagtatttgtttccggaacag

SEQ ID NO: 18825 - DNA, 2918 bp, Heterodera glycines
cttttttctgcgcacttttttcgatatattaatcataaataacacttttccacctggtttgaagcttctacgttgacttttattatgccttttcgggatttaaatgcgttttttggcttttttttaccgaaaaattccattaaaaatgaaacaaaattgggaaacccctaagaaatgactcgaaaaaatttcagaaatgcacccctaagaattgaaaattttgtacaaaaaatttcgcaaaatcaatttttttttatagataaaaattttaaaattaaaaattttcgttattcgaatttataatatgtttaattataatcattaaaatgacaaaactaagttgttgtttttgttttgctccctaaaaatcattaataaaataattttttaaatgtccaaaaaatgttagtttttgctgcctttttgttcattttttatacctttacttacttttttcgtgcttattttaaaaattttggtgcctaaaattccgatctctattaatcacccatcgccgaatccgtcgtctccgatccaaatgtcaattcggttccatcgttcacccaattccttaatcgtctgctgtctctcatcgggcaaaattggacaacggatgaacacaaaacaatttgcatctttttgtaaaagtgccaatgtctccccggagaattcgttggtcagtttaaatggcacagcgaaagaaagtgaagaggacggcggaattaaaacagaaatggcgaaataaacaggagaagaagcagcggaaaaggcctaaaacgaagacaaaaaattaaaataaaataaaaagaaatattagtagtcaatcaataataccgctttgattcgctccaccatagataaccactggtccaccgctgaattctcaattctgacatacagcaccttcatcaaattgtcgggacgaggcgagaacagccatttggccaccgcttggccatccgacgcattggcactgtcgtcgggcggaaattcgggcaaaattccgacaccagccaaaccaacaatacgaagggctgggcaatcgttgagcattgacgggaccaattggcggatttgacgaagagtgatggggttcaaaatcatgtcgcgaatggtgtgcttgagcattggccaaatggtgagcagaaggaactccgaaattcgaacattttcagtgccaatggtcaatgacgttgcacaaatggcgaaaaaacggtgaaaatggccaagaaaagtgagcacattttggtcgatgaagctgaaaattaaatgaaattgtgattggcacaaatcattacaaaaattcattttttttttacaggataaaaatgcttccgaatccgatgactttgttcggcaacggattttgtgggattggcaattcttttccatcggaattgacaattttcatttcatttgcgccattctgtccaattttgcgtcgaattttcattttgcccaatttccatttgcgcgttttgaaatgttcgtcaacgaaatagtcaaatcggtgactgatcatcgcaattccgaggccaagttgagatggcggaagcaaatcgaacacctccaaccaacagtcggcagcgatgaagctgaaaacggaaaatgattagcatgggaatacaaatttagaatatttacatcgctttttccatttctttattagcttctttcggattgtcagacatgaattaaaaaagacgaactaaaaaaatttactctaattattacagttaatgaatgaattggtaattcaaaatttagcccgttaaaatgataaatgttgtgtctgacgattccggatcaagattaatgacggacaaattgggagaatcaaatgaaagaagtcattaaataaacaatttcctgtaatgatttttgaatgtactaagtattggtaaagcctaactcgttttttatggatttctaagcaaaacaaatacaacaacaattaaatggcaagtccaacaattggatcaaataataatcgcattaatcaatcaaaacaaatcaattcatttcttctgctgtttctgatcaccactcggcccgggggaaccgtcaagaagacttaaaaaagacaaaataaaaatcatagaattagcatttggatttattaaagctgttctcacccatcgtcgacaccgccgtccggaatgaaaatctcaattttgttctgttgagcagtcttagtcaagccatcatacatctcctccttcaaccattttctctcatcgcctgcagcaattggacaacgtacgagcaaaaaagcatttccattttttgacagtgccaatgccaatttctctccagtcaatttgttggacactttaaatggcacaacggcaggaaatgaaaggaactgcggaaattcaattaaaatgacgaaagcaacgggagaagaagcagatgaaaatgcctaaaatgaagacaaaaaaataggaaaaagcaaatgaaattggacaatcaaataatctaatcaccgctttaatctgttccaatgttgaaagccattggtccacagctaaatcctcagtgctgacaatgagctgcttcggcaaattgtcgggacgaggcgagaacagccatttggccaccgcttggccctccgacgcattggcactttcatcaggcggaaattcaggcaaaatgtcgaaatggaaagagacaacgcgaagggatggacaattgcggagaatggagggggccaattggcggatttgataaaaaccgatggagtccaaatccatctcaagaatggtgtccttgaatgttggccaaatgttgagcaaaacgaactccaaagtttgaatatcttcagtggcaatagtcaattttgttgtacaagtggcgaagaaacggtgaaaacggtggagaaaagtgagcacattgtgatcgaagtagctgaaaatcag

SEQ ID NO: 18826 - DNA, 3022 bp, Heterodera glycines
aacggaataaaaattatggttgcgccgtcagttgaatcatacgatgcagccatcgaaagcctaatggaatgcttccaggactcaagaaaaaattaagtcaaattggtgctgcaaagcccgtgcctggcacgttccttatttttctgctcccccccccccctccatcacgccatttttagcccactcccggctggcacaattgctcctaggggaggaatactgaacatcggtctttggcaccaaccactttgtaggcccgtgcctggcacgttccttatttttctgctcgcccccccctccatcacgcatttttagcccactcccggctggcacaattgctcctaggggaaggggagggaacatcgttctttgcctccccccatattgtaggcccgtgcctcttgcatgttccttattttttggatcacccctcatcacttcatttttagcccactcccggctgtctaaaatatttccattaatttaaaaatacctcttctaatgacttgaatctcaaatagcgggagattttttatataacttataaatattccttcagaaaatgagtttttatatagataacgataaagaaggttgcaacagaaagcttcacattccacaaaactccgtcggtattcacaatcgatcaattgctggcctactatgacctgaaagcaggtagtttcgagcagctggatagcaaaaatttttttttcaaaaggtggcatcatgaatgaacaggtgcaccatggagatgtgaaaggaggaaaaggtgattcagttacgctccgcaacatcgcatacacctgggttcgtttttgcaactattcttaaatattttttctataaaaatgttattaacttttgaatacttttcttaggtaaaaaaccaattccggcaaacggaaataaaaattatggttgcgccgtcagttgaacaaaacgatgcaaccatcgaaagcctaatggaatgcttccaggactcaagaaaaaatgaagtcaaattggtgctgcaaagcccgtgcctggcacgttccttatttttctgctccccccccccctccatcacgccatttttagcccacaatgaacaggtgcaccatggagatgtgaaaggaggaaaaggtgattcagtcactctccgcaacatcgcatacacctgggttcgtttttccgatttttctacaaaaatgttaatgttaacttttgaatattttcataggcaaaaaaccagttccggcaaacggacataaaaatgatagttgctccggcagttcaccagaacgatgcagccaccgaaagcttaatggaatgctttcaggactcaagaaaaagtgcagtccttttggtgctacaaaccgatgaaatgaaagccaaaactatagaggtaaaagtattagggatgtgcgagagtcacgattttttccttctcgtctctctgtcccgggtttttagtctcggaaacagagaaagtttatactgttaggatgaaccattttgggggatggggtcaccggcgaagggtaaaagaggaaaaatgctgaaattttaacaaattctcttaccaaaattcattaaaaatcacaaaatttccccatcggcgtttatctgtgccgtcggcactccaaattcccttaagatttaaaactgacctaaaattaccatttttctgtgactgaaaaaataaaaacgaaaaatttggtaatttttggacaaaatctgttaacaacttgagcaaaagctttcggcgaaaaagcacatcgaaattgcgtttttgaaaaaaatttcgttaagtttgtattgaaagcccctcgcaaaatggccgttgatcccccccccccccctctacagattccttcgcaaaattcccattgaccttttccttttttatagatatttttgttcatttaaatgaattttataaattcttgattttcgcgacgagaaatttaccgatttttacccaaaaacgggagtaaaaatgcactggtaagaattgattttttttggtaaaaataatgatttttcattgaaaatctgttaaatatatagccaaaatttgaaacaaaaatttcccggcggcgcctatcggcaccgccggatccttaaaatccttaattttcttaaaaaacttgctcaatttgcaaaaattggtcatttttgaacagaatctaacaatgtattgtagtaaaattttcaattttttcccggcggcgcctaccggcaccgccggcctctctcctcctccttggtcaccaaaaagttttttcaagaaatataccgcaaaaaattttgcaaaatgaataaagggagtcaaaaatataaagttaataaatgttttgttcgaattacctaattataaaaaataatttatttaagcaatttgaaaaaattttctgatttttgactcaaaaataagatttttttatttcaaatttctctttataaatttttctatatatttttaatttaataaattgattgccctttaaatttgtgcattaaaaatatttttgtgagtttttaattaaattttcgaattactcccgctcccgcccgggactcccgttaaaaatggacgggattttaacgggagcgggatttttacgggaatcccgttcgggactcccgtcccggaaaattttgaactcccgatcccgctcccggaaatttttttttaccggactctagttataagggtacaaaagcactttgaacatttagaatcaatagaaaaaagaataaatttagcattttggttagaaagagctgcctaggacctgagttataacatgataagaatttgaaagtatcacaacttttttctgagatgacagattacttaacattcgcttagaaaaagattctccttttcaaaaactttttttagataccaaatttgttcagtttagttgggaatgaagcgagttatggcagatcaaaataaaaaatacaaaaaaggcattttccagtgtaaattttgaagtaacgcgcaaaaatttacgccaaatgcgctatttgg

SEQ ID NO: 18827 - DNA, 2046 bp, Heterodera glycines
aaacaatttttggacggttttaagcttttgaatccggagcaagaccgtgaagtaccatctatctttatttataatgaaagtggcattcttgaacccgagcgtttgtctcagaaatctatgacgaattaacatttaaaaattagcggaatttattaaaatcgtaaaatttttactgttatttgattatttatggttataaaatttaaaaaatattttgagtcacattaaatataaataagaaaccatgtgaaggaaactaaatttatttatttaatataattttctgtactgaaatgaccccatccctctgaaagtctctcacttatatttttgtcacttcgcccacactgatgcaaatacggtacctttttaaaaataaaattagatttggggacgaacgacgcaggaacgaaatgacagtgcgcctcaaatattgaacaaataatccatttaatttcaattattgacagtataaatgctgtaaagccataacaattctttgacaattcttcattatccggtcaacaattgatcaaattgatgatttgttcaatctttggttcttttttgaaaaatatgtatgggtactttttatgatcagcgctctggctctggaatatccttagaaactgattttaggaaaatgacctacatttaggtaattttatatacgcatttataaaatttttacaaatttttaatgggtttttggtccaaaaactgggtatataaatgctgactttttcctccctcacaacataatttgtgtcccagcaataatgactttatactcctccgttatctttttgctgccagttcaatttctgctcgttgtcatcggcgctgtgttcatcatcctcagccaatgctgtggtggcggttcgaagaagaaaaaggtgccagtttttgacccctccctattcacaaatgaaacgctccctttttttcagaaagccggagcagcaccgacgccaacgccatcaatatcggcgagcgtaggatcggaagcgccgtcgtcactgaaaacgcaagagaaaagcgcaagcgccagctcaaaaacaggtggacgaaacaacgaacgatttagggatgagaagaaaaaaatttgtcaactttaagcaccaccagcgaagaaaggcgccgttgcacaaaaaaaaggaccgactgaagcaaaggcagggaaagcgaccgatgaaaagacagtgaccacaaaaaagaaagaaaagtcgagcaaatcagcgaaaggaaaaccgacgagcaaaccaaagccagagcgaactgagccttcagttaaagaagattctaagccggttgcagcggagaaaggagttgaagtgccgcattccatgatgtcgaaaggagactcagttgtcgatgaggaagacgaggtgggctacaccaccaccactgatgtgtaatcttatcatcttaatggtctgtattgtaaatgtttgttcccaagaattatgtatgatctaatgtcttacccttatccaatgttgttacttgtatacatttattatgtcgtggaagataaagtaaatgccactttgctatggtgtagtcttctaacaaattaagtttttcatgcacataatatgtccccaagaacattttcttggttcgatttggtttatgaatgcgagataataagaaatttggtccgatcgatcaattctctttgccaaaaatcgatctctaaggtacgttataatacccacacacacccaactaatagctgttagcggagactggcacggagaggtgacattgagattggtttcatctttagctttagagtcgctggttgagtttggtgagagtgatggatagctcagcaatttctatttctccaatatttcttaatttaaaatatctgctgatcaatcagtgttctccttcatatttagtctgtctgtgattggatacctcaattacttccctgctttctagcaatcactttattatctcatatgtatcagatgacatcagtgaatgaaaatgttgctttttattacatcaaaacaaaacgaatgaaatcatcag

SEQ ID NO: 18828 - DNA, 974 bp, Heterodera glycines
  misc_feature (912)..(912): n is a, c, g, or t
tgaaatgcccaaaaagtacaaaaaagcgaaaaaggacaaagttggtcctgcccttcctcctgctcctcccccgtctgtcgaaccaccggccgcggccattcagtacgaggatttgacctctgatgaggatttggactcaaaagacgccggaggcaccgccacttctcaccttgttgatcagcagatggagtcgcttttggcactttcacccgaaaacagcggcgttttgctggcactttctcccgattcggttgatcgcctacttgaagaccaaaatgccggagaggtgaaacaaaatccagaaaaaataatgaaaataattgttaagtctgtgccaataacagcggagtccaatgaaaaggccctcgagtcgacagttttgaatgaggaagacgaatttgtccaagcaaattcgggcgaaaatgacaaaacgaatttggaaattgtcaaaattgtgagtccgcttgaaaccatgggggcgctaattggggtcatttcccaaaaggatgatgaatcggtcgagaaagggcctcaaggttcttctgaaaaggcaaatgccggagagatggaagtggaaggaaatgaaaaggccctcgggtcatcagttctgagtgtggaagtccaaatggacccaaaaccaatggcaaattctgaccaagtcgagaatgagaatgagaaagcggataaaggcgagaatgagcaattttcaaaggaaaattctcgcgaatcagatgaagaggaaaatttcggtggtggtaagaaaatggtagtttgccaaattcgggaggacggagtcatggtgattccttttggtgaagacgaaagaccgggattcgtctttgtggctaatgatttattaagtgaaatttgggaaacgttgaccaggttttcggacaccgcagtgaaacttgnggacataatttgggtcactaattggagagtgtttgcagtaaacgaatcatggggattggatc

SEQ ID NO: 18829 - DNA, 1084 bp, Heterodera glycines
cccttcagtgccgcaactgacattcatttagctgaaaaaggcatcgcagcagcattgtcgtcttgttttcttaaaaatcggataaaaatggaagagttcgccattgagacaactctccacattttggacaataacggtaggacagttgttgccacttttgaacattttcttgacaacaaacgtaagtttgttgatttggttgaattttgggaggaatatgccgcaattcaagcgagattgaaaggggtaagaaaaacttgtgccaatggacggattttagaggtgaataaatatgtccaaggggggatgcacgtctttcaggcaagaattctgctggcatatcaagctgccaaaagtcacgactccgatggcgacttcgaattcatttgtgaaggccatgaagttgtacttagcccttgtgaatccgcaacggccatggtcaatcggatgacactgttttattcgaattctttcagcttgacttcgtcggagcaaagtggaaccggacaaatttagagagctttattatcatcctcggatgaacagtccttgcctgctcaaatcacggagacgcgactcatgcgtcatccggcattgaagcgccttgaaggtggtcaaaagcagtcggcaatgctcatgcttgatgatcagccgcgcattgttgcacaacaagcgcctcctggcagcggcaaaacttttactttggccgccatcgttgctgctctgctcgaacggcccgatgcaaaatttttgtgcatggcaccattgaacgttgccgtagtaaaaatttgtgatgaattggttgattctttacgggtagaaggggttgccgtaacgccgttagccctatttttaggaaatggtaaagggaaatacagggatcagcttgatcgcatctcggacaatttgcttgaggcagcagccacgtcagaggaattttggaaaaaattgaatgaaaaagagcaaaaggaggtaaaacggtaccaaaaacatgcccgaaaaaggccgagaattgccaaagaggcgaaaattgcagaaagtgtgctctcatttgagcaaagaattttgtttgcatattgggttt

SEQ ID NO: 18830 - DNA, 2572 bp, Heterodera glycines
  misc_feature (2540)..(2540): n is a, c, g, or t
acatttgtatggtaaaaatttctcgcaaaaaagagatagtcatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcacaaaaaagagatagccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagctctctctctctctcttcgctgccgttcggtcccttcccaagggggtggaatggagagaagggtgggaggcaaacaagaagtgggctgttgtttgaataacggcaccaccgactcaatttgggggagaagccggtgctcccaggttcaactgcctaagtccgagcactcctgtcagcacttccggcgtgccaactcctgtccgatcgttgcgctcgggagtttcactcccgttttccctctcgctgtccgattcgctgtccaatcactgggggtgattggaaaaggagagaggtggggttcgagtgggcactcctgagagctggagtcccgtttgacttgctgaatcgctccgaaatgcacaggcaaaggggccggagaagaaggtgagttgcgaatcgggagtcggctcccttttgaccacccgcccaaattgatgaacacaaatgacagaaaaatagtttattaacggagcgctcaaacttgggtaattaaaccgtgggaggggggtgggcaaaaaagtgacaaacgggaaaaaatgaggagtaaaagtggatgccgtgattgagtggtgaggtgagagattaagaccaaaaggaacaattttttctccctggaggggagtgagacataaaaatgaatgaatgaatgatgtgacggacaaattagtgatgaaaaggggggggggatggtgattggtaaatattttccccccggggttcggcccagataaatgcaaattggacaaatgagcgaaagaacgatgcgatgagaaaaaagaggagagtcaaaggccggggagaggatggctccctggcatagcaaaatgcgtaaacattgtgaatggaaaaatgtgaatggtccaaagtttgaattaacaaaacaaagggaaaaaatgggaaaaatcggaaaagaatcggagaaggccggaggggaagtgtcggccaaaatgaagacaaaggtgaattcaaaaataaatggcaaagcggcgggcaaaagggtaagagcagacgcagatgtgaaaaagagaagaaaaagggggcgaaattgaaatacgacaaaattgaataaaattacggtagccaaagtggagaaaaatgggaagaaaaagaagtaaaaaattagagaaaaatgcaaattccgatcattttctcgccgcttctcgctcctgttcctcaattgcgacgggagttgctcccgttcgaccacttctttcttttccctctcttctcccggcgggagagtgccaccgggtgatcgagcgcaccccctccaaaatagtcctcctcctcccgcgacagcacccggggttttccgtcgccaacaccgaacaccaaaaagccttcccacaaattgcctctctcgtcgcatttagcgacactgcccccgccggccggcaccacttccatttccgaatcagcaagtgacactccatcctcctccgggaaattgtctccctctctccatttcggctctctggcccccgttaatgaattagcaacgcagatcgtccccaaaatgacaacagtcaatgggggaggggcaaacaaaggtgagatgcgatgtcggggtgtccaaagcaggcggcaaaaaaggccaataatggtgaagtacaagtaaatggcacaaatgatgagggagaatgctccctctgaaaaattgttaggatctcccttggcagtcgtttgtggcgtttcagtcccttaaaggggcccnaagtgccacgaaatctgtccacggttgtcacg

SEQ ID NO: 18831 - DNA, 1402 bp, Heterodera glycines
taactttttttataaataaatttaattaacaaaaaacattaataaataaaattaaattgtaatctttttaattttgttttccaccaagtataatgaatctttttttaaattaaaattttacacatttaaaattctttgtttttgttttaattttaaataaaaattcaaattaaggaataagcctaaaattaatattgaataaattgaaaaataatcaaaactttgctacagaaaagtttataataaataatatttttaaaacataaatttagtagaaatatttccaaattagaaaatcaatgtttaataattgttattgtcaatcgccctataataaccttaataataattattatcaatgcattagtaaatttacaaaacaatcagggatatattaaatattgaaaaaaatttaaacttattaaatgtgaaaaatttttgcaatttcttttgctatttaattaatgttatgtgataaaaaaataattagctaatttttgaaaacaaacatgtattcaattagtacattatattagggatagcaaacatcccaaaaaccaattaaaaaaaccatctgtagtgatttaaagaactaaagtaaagcaataattttatttaaaattttttttatagttaataatttcgtaaaagaaccaaagcatgaccaattaattaatatatccaattcatttgaaattactgattaattaaataaaattaatataaagaaatttaaataaaacaaaacttctgacaccatttatgtcgactcaactaaatatattataaaataaatgaaattaaatacaaagaaaatcatttattcaaaaaacaaaaaataaaaggaatataattttccactttatataatatacccgaaataaatttttgtcacgagctaaaagtttcttccatcattgtgcaagtttatttaaaaaaaaacaaatatttttaaaaaattgacaaatattatataattttaatttaatttatcaagctagcccaaggttcattagtgctcttaaatgatgcgacctaataaataaaacaatgaaaatgaaacaaataaatgaaatacaaaatgaatataaaataaacaaatcaaatcttaaattcacaggtgattgattatatatagtgtaaactagcgggtgcgtgaaccgtcggatctggcacaggataaagcgcttcgcgcttcttgagcttcgctacctagattagctatcgggttgtgaaaagatttggaatttttaaaaaattatcagcgatttttaggccgcttcgcggcctcagacgggcgcttcgcacccgttttttaaattcggtgatttttaggctgcttcgcgcctccagaacgggcgcttcgcgcccgtttctaatttttgttgggcttttcggccgc

SEQ ID NO: 18832 - DNA, 1470 bp, Heterodera glycines
aaaagtgattagaagaggtgcaacagtgattagcagaggtacaacagtgaaaaagtgatagaaaagtgattagaagaggtgcaacagtgattagcagaggtacaacagtgaaaaagtgatagaaaagtgattagaagaggtgcaacagtgattagaagaggtacaacagtgaaaaagtgatagaaaagtgattagaagaggtgcaacagtgattagcagaggtacaacagtgaaaaagtgatagaaaagtgattagaagaggtgcaacagtgattagaagaggtacaacagtgaaaaagtgatagaaaagtgattagaagaggtacaacagtgattataagaggtacaacagtgattagaagaggtacaacagtgattataagaggtacaacagtgatcagaagaggtgcaacagtgattagaagaggtacaaatttgatgaagaggtacaaacaatgattagaagcgtacaaaagtgatagaagaggtgcaacagtgattagaagagatacaacagtgactaaaataggtacaacagtgattataagaggtacaacagtgattataagaggtacaactgtgaaaaagtgatagaaaagtgattagaagaggtacaacagtgattataagaggtacaacagtgattagaagaggtgcaacagtgattagaagagatacaacagtgactaaaataggtgcaacagtgattagcagaggtacaacagtgaaaaagtgatagaaaagtgattagaagaggtacaacagtgattataagaggtacaacagtgattagaagaggtgcaacagtgattagaagaggtgcaacagtgattagaagaggtgcaacagtgattagaagagatacaacagtgactaaaataggtacaacagtgatcagaagaggtacaactgtgaaaaagtgatagaaaagtgattagaagaggtacaacagtgattagaagaggtacaacattgattataagaggtacaacagtgattagaagaggtacaatggtgattagaagaggtacaaaagtgattagaagaggtacaaaaattgaatgaaatttattataaattttaaaaaataaaattaattattcgttttattaattaaaaagagaattttaaatgtacaagaattgaatatttaaatcaatatgaaattaatttttataaattcaattaaaaaaaaatatggaattctttattaaaagataattattattttttacataaattcttttattattaatttacaacaaatctttaaatataaattaaacgcactgaaaaataacacaaaaataaatagaaaaatttaaaagtggtacaacagtgattagtaaattcattaaattaaaatgaaaatattttttaacaaatttaatttaaaaaatacatgaaattctatcaattaaaaaaataattaatttaaacttataaaatgtattcatcaaaaaaaaaatt

SEQ ID NO: 18833 - DNA, 3514 bp, Heterodera glycines
catattttgttaatgatataacgaaaattttacattaccgttgagaaaaagcaaaattgcattaaattactttttaaactacttaataacaattaatctcaaaaaatttaatgtaacaaatgagatgttaaactgtcatttaaatagaaaaatagtgttgtatttacatattataattaataaataaatcagctaattttaaaaataaaatgaaatactcaaatataatttagtcattcttattgatagtgattaagcttaactattgtaaacttaatttgcataccaaaaaatgtataaagaaaatactcattaaaaaaatttaatataaaggatagaaaaagaaataaattattatacattttatatagaaattttctattaattcattttgaaagtaaaatttaacgaatataatgatcccctcacgaagagaacaatgtcgaaaacattgcatgatactaatttaaatattatttcaaatcaaaaactaaaaaaaagaatttttattatattttcatttcatattttaaaggatgttgcgagaactgtaatgtaaattatttttacaactgtttttgtgtcataattttttttaatattaaacattaaatactttgattatttaatttaaatgtcgttattgttacaataaggatagcatgtatttagttcattccgtaaattataaaaatcaaaaaacgaaaataatttaaacaaaaaaaagcaaatttgataaaataaatgattatgagtttcttatgtaatatgagtattgaagaaattgtatgttgaacaaaataacaaaatttaaaaattcactgaatactgtttaaaaatataaaaatattaaatctcaaaaaattgaaagtaacaaatgagatgttaaacattcaaaatttcaaccataaaactgtaaaaatacattgtattagataatttataattaggtggattcaacaaaatgaaaatgcttcgccaatagctagttaaggcaagaagccaacatttaattctgattaatatagtttgatgaaaattatctaaaatattataaacaaattgtccgaactgaatggtatatatttgtttatcagtttagcctttgtaatggtactgcacaaattattaagataatatagattaaatataaaatataactagtatttcttttctcattcttcgagtgaaattttttgttttcttgttaatgattgtgatttgaaatagtttctttcaaattgggctcaagatcttttggttattaaagttgatttttttataaatattgaagtaatttaaaataaagcttgcatgtaaaatatttatttcatgataatatgtaaaatagcattttatttttattttaatgtttttgtcaattcattctattaaaaaattcttagatttattcaacctaaatttattattatatttttttgtttttatataattttttggcatttttgccgaacttaattacaattttcttgaaatttagaaagtattaataatcatttgtaatttctatttatttattaaggaattcattttttgaaaatctaattttcaaaattagatcatttaaattatttctcatttattttctcttgacgctgcggttgattcttgatgaaatttcgtcgatttttgaaaatattttctaatatttttgttgagttttttgcaaaatatgtatttgttttttttcatttattaatcgctttttatgtggataaaccgagtaaaatttcttattttttttaattatgctttaaatgacgtggtctctgtgcgcacggcggggcagcaaggcagctgaaaataacaaattcatcgtatagttattattttttgtttttttatttgattttattttgtaagaagaattgataattatttgttaaataaaataaattcaacatcgatttttatatgttttatgtattttcattttatagtaataaaaataaaagaatttgttattatcaattcttctttccaatcattcttggtaatttatttttataagtatgttctagaaaagcttagattattcaatttcgaacacgaataaataccataaattttgtgattataagtttatcgtaatttaatataaaactatatgtttatacattatatcgtaatttttttttggttacatatcaaaatcattagtaatccttatcattctgcagaagaccctcgcgcctctttcttctgccaatatctgttcctcttcaagttctcggaatattgcaattttttcggatgaaaatttctagattttcaatattaattattatttgtttatttgaccatttctatttctattattattatttataacgttgactaatactaaaactaaacttggtattttcaaatttcgtaattttaatcaaataaacatatattaagttaatagtctcattaaaaaattattgtaatttcacactttttcaattcttttttgcttttttgcgtagcttattttttatttatggtaatcaataaaatataaaaaaagtgtaaagaagttttatggttggttttaattttgtaaagaaaatttctaaagttgtttgtgtatgttcttgtacttgaagaatgttattgacgcaaaaaataaaactcaagtacgaccaagattaacttaaagtattgggttgggctgctaattttacaagaaattttcaaatttttatgtgagttcaaaaagcacaaataaattttcaaattaaaagtgaaaatttttgcgacgattcaaagcaatttcttaaatattttggtgacagaaaattaaatctaaaatagtaaataaaaatgcaatttatataacaaaaaatttgcttttaggaaaaaaacatttaaatttctaaaagaattttattggataaatatatgtgcacgttatttttgaaaaataatgcaattaaattaaaatatcattgagaaaattgaacaaaaacttgatccaaatgatgagtttaagaattaatttaatgaaatttaatttaatgaatgaatttacaacgaatttattttattatgaatattgaaggatataatgcaagaatatatacatttaaaagaataaaataacaaaataagaaagatttaaatcaaatattttaaatgttggatttagatttaatactaacctttttaaccaaaatcatcattttcaaactattgaatatattgcagaaaatgattgtgaaaaaattataaaaatactaattggaatcaatgtctgtgaaaaaattataaacatttctaattggaatcaatgtcaagtgaaacgaaataattaataattataatacatgaaaatggtgatgaatagggttgtaaattatatggattaacatattttttctgcgcatatgctatgacgaataaagtttataaaaatcatgatcatggttctccttcctaatgatttatgtaatgctgccaaacaaaaagggacactatatataaataaatagaagctaattacttaatt

SEQ ID NO: 18834 - DNA, 3343 bp, Heterodera glycines
atggacatgatttaattaaattcaattaaataatataaattaattataaaatcatttaatgagtaactaagtaataaatcagtaaagcataatcaagaattaactcttaaaagtgataaacaaattaaaataattacatttaaaaaaaataaaaaggcaaaaattaatattttaaagcaaagcatttaaaaataaattttaattcgtaaatatagctaaaaatcttagaataaattatcatgagacaagaatttaatataaatgaaattgccaatattctcctcattatcaaataatgaacaatacttaaaatatgattatttttaaatagtaaaaattaaaaacacaaaaaatttaatttacatttaataatattcaatgaccaatttattagttagctttaataaatataattaataaaaaaatatattgatatatatctaaaacaacatttttaacagcaagcaattatatggagtcaagcagacaattaaagttaaaaaacatataatttaagcaaaatgaaaagtttgttaacaaattaaataaatacattgtaaaaattaaaataaattaacgaaattaaaaggcaattaattataaaggtaaaataataaattaacacaaacggtcaacacaatcagcgaaaatttaaaaaaaggaattttgttaaaatttttaaattttcaccaacaacaaaagaataataaacaaaaaattatgcatttttagcgcgccggacattgtgacagaagaatttatcaatagaaatatattttatatttaactttccaagagtaaattaacgaacaattgcttttccgaggcattgatcagtcttaagctagtttattgaattgacaaataaattctaactagataacacatattgtctgtttaaataaaagcaaaataaatttatttattattttaggaaaatataaagcaaataaacagtttaattatttaaatattataaattaatggcacagaaaacaatgtttattttattgtaaacttttaattaaaaaataaacaattcatttaaagcatttaattaaatacagaattgattttattatgctcaaattaatttattttaattacctttgttaaatgatattttaattattttaaaggattaaagcagtaaataaaaggatgaaatggttttacgaaaaattatttttaagataatataaaattggatacaataaaaaataaattatttaaaatacatcgaaatttcaaccggcgatgttttgttaaatcatttaattaaatttttattaattaagtaccattacttaaagaaattagcgaattttgagctctttctataaaaataaatataaattctcttcagcaacaatacaaaatgattgaagagatcgtgcacgagaagattaaaaaataaaaacaaaataactacacaacattgccattgaattaaagcattttaaattaaaattaaaaggttttctaaacagagaaacaataaccttattttacatttatataaatcaaccaatttagcctcatattaattttgaatcagataaattaattaaacacgcaaataaaaatacgaaaaatgagatcacaattttattttttgaatgtaaatcccgagagaacgagcaaaatcgggagtattctaaaaactttgaaaaatgataaaaaactcaaaagtttttattaggttaaatttcaaaaacattaaaagaaataaaaggaattaaaaatacagtgtaaaaatgattttcccggcagcaggacgggtcagttcagtttgtaaatttagaattataatatttattttacttaaagtgagtatttctggggttttcgtgaataaatgcatattatgacatttttggaaatttttggaaattttcacaagaaaaacgcaaaaaaagcgaaagaaacacctctaaggatagactttttgggaatttaggtcacggcccggacccggtcaattgtctaagccctgtcacgggcccgcccggtactttcaaaactccgggctcaactaacctaatgatgagagtttttttctttctctaaaaatatgcctaataaaataaatcgaaaatacaatttaagttgggaaatattaatgaaaaaagtatttaaatttaatgaatttttattcctttggatatttttctaaaaattctgggttgtttatcagtttattttttgtttttatttcatcgtgaataaatttaaaaaccaattaattgtattcaaataatatacaaaataaaatcgtaaaaatataattatttaactaaatttaaagataatataataaatttctacgaaaataaattaactttataatatataaatttattaataaatgagtcaattaatttaatacaacaacaaaaaaaaataacaacaaaaaagtttatggtaggaaaaaaataaaaatttttaacttttttaatttaaaataatttttatagaaaaaaacattttcaatcatttcaatgagattttgactttgaaatttcaaaatttagagatttttttgcgtatattaacaacacatttagaacatgcattttttgaattattcttgtttttatttttttatccttccgcacggctcccggacaatcggacagtaaatcacacgaaaagataagaaaagccatcgctgaagggaaccgattgtgccatataaagaaaaaaggaaaataggcaaataaaaaagtgcgaatgtagtctaaaacattatttcattgctaattagtttaagtttggcatttcataaatgatggttgctcatttgaagaatataaaagctttttcttgccattactcgcacacaatgccgtcttctggattatggcacaatcggtcccatgcggcgatggcatttaaatatcgtttttgtgtgttttactgtcggattgcccagtcacgctctgcgccaccacctcacaaatcagagttattcccttaaaaaccattctcgaggaaaaccttcaaaaataataaatatcgactgaaaaatttaataaaaaagaaaatctcaaagcacaaatcagaaaaatcaaataattatcaatcgtttcgattcgaagagatggagacataatgaaaaataaaaaaaaataaaaaattaccaaatcgaaatatgaaaaaattaaatttaattaattatgcaacaaaaaaaggatatattatttctttaaaattattgaatctattatctcatataattttgtcttatttaaaaaatggcttaagtaaaataaaattaagattaatcatagaaaattaatatatgtgaaaatgctgaaataaatcaaatgaaacagcaaaa

SEQ ID NO: 18835 - DNA, 2409 bp, Heterodera glycines
cttcggtgacgcgctttttggcattggacaaaccaaacctaaacccacggagacggttcatccaattccttcacattccaattgctgaaggtgtgcaattgtgcggttgaccagttactgatgccaattccaattgagacgcccctttggacctttgctatgacccccaatggttggccattcttcgcgccaccgaccaactcaccgaattcactgacaaagtgagcatttccattgctcacaaattcagaaatggaaaataaaaatacccccccccctctccaaagagtgtgtttatgcccagcgccgttttgcttccaactacggctgacattgactcacttctgcactcttttggcgccgacttgcgcattccttcgaactttctgcacacagcgccacccgaaagggaaccgtggaattgtaaaggacggccaccatcgctttattatcggtgggaatcgaaggatcaaaccaaaatgaagataaaaggaccaattagtatttttgaatttcagcattttacttcctcccaactccgttctttgacttggccaatttacagtgccattgctaatggtttcactttgttttaagcaacccgcagacacaacagttctgtgaacgccttggcattcgtgacctgaacctaatgtttgcccaggcatccgccgattgtctcggaataccgcactttctttgtgttacacagccattggaatctgtgcaaaatcccgccgaaacaacaaaagtggtgccaaaccccgacgaaatcgacttgggcgaggacgaagtgaaaaaggaaaacgaaactccaatacaatttattttagtttgatggcgaagattttatggttgacattccgtcgaaagaagcggccaaatgaaaagcggaaaaataatgattttcatctaacgaaaacagctgtaaaattatcatttaaaaaaaataataactggggctcgaaactatatggattaacatattttttctgcgcatatgctatgaagaaaggggctcaaaaatagcatttctacgttaaaattttttgatttggcgaaagtttttagtccatataaatccatattttaggggttttcgggaataaatccatatttcgccatttttgcctttttaatccatattttggccattttgtggtaaaattacacaagaaaaatgcaaaaaaaaaaaaaacgcgaaaaacaccccactaaagactgattttgtctatgactttttgtcaagtatttgattttttcaaaaatttttaatcttaaatgaatttggggtaaaaaatatgctgatcacgaattgagctctgatttagcaagaatcttaattttgtcgatgatttttcatcagatatcataaaaataataaatctcagccaagcggactcgaaccccagcccccgtctcatatgacccttagggattaataattaatttcaaaaaatcatagaaaattaaatacttgacttctcaatagattattcgaatgctttttttaagctctacaacatctgtgtattgagttttttacgcccattaattttcataaaatttttgggaaaatcagtacttgaaaaaagtcatagactaataaatcaatgatttttcaaaatctgagttcagattcgtgatcagcgtatttttctaccccagaaaaatgctttttaaaattttactattttttcctatcgggaccacaattctgcacctttgcccatttttggtagttttgtatatttttaagttcgtttaagcaaatattgaatatttttgaaattttttaggggttaaaatttaatttttgtcagtttttagtccaaattttggtccatattggacatttttgagctttttactccatatttctggcatttttagtccataatagggaccggacaagagggccggtcggtcggtaaaaaaccgaccggtccgatctctactccatattagacttttttttagtccatataatttcgagccctaataataactataccacactcatttttgagaatattcatttttcaacaaatggaaattaaatagcaaatattaacatttgacgcattcaaaaataactactgggaaagaaaaatttgagcacaaatcgttgggaaagacgctacagaaccaattaagttgggacggatcattttcacttaaatatagcatttttccatcaaaatttcttcgaacaaaagcaatttggtctccataaatgccatttctgaagtagcaattgtattgcgcacgaaccgaaatattgtgattctctgtaattaggggaaacataacatgaatttcaccaatgtaaagtcgtaagataaaatttcaaaatttggagacgatttgctaactaacgaattgtcaaatttcaaaaaatcacgcagc

SEQ ID NO: 18836 - DNA, 3380 bp, Heterodera glycines
cgttttcgcgtggccgttttcgcgtgggccgttttcgcgtggccgttttcgcgtgggcgttttcgcgtggccgttttcgcgtggccgttttcgcgtgtccgttttcgcgtggccgttttcgcgtggccgttttcgcgtggccgttttcgcgtggccgttttcgcgtggccgttttcgcgtggccgttttcgcgtgtccgttttcgcgtggccgttttcgcgtgtccgttttcgcgtggccgttttcgcgtgggccgttttcgcgtggccgttttcgcgtgggcgttttcgcgtggccgttttcgcgtggccgttttcgcgtgtccgttttcgcgtgtccgttttcgcgtggccgttttcgcgtggccgttttcgcgtgggccgttttcgcgtggccgttttcgcgtgggcgttttcgcgtggccgttttcgcgtggccgttttcgcgtggccgttttcgcgtggccgttttcgcgtgccgttttcgcgtggccgttttcgcgtggccgttttcgcgtggccgttttcgcgtgggccgttttcgcgtggccgttttcgcgtgggcgttttcgcgtggccgttttcgcgtggccgttttcgcgtgtccgttttcgcgtgtccgttttcgcgtggccgttttcgcgtggccgttttcgcgtggccgttttcgcgtgggccgttttcgcgtggccgttttcgcgtgggccgttttcgcgtgggccgttttcgcgtggttgcatacaaaatagaataattactcacactatattttaccaaatttgttgctcttatttctttttacttatgtaattcattttataattaagtgagtttataaacttaattaagactgtttcaattatataatatggaccagcagcaaaaaattaaaacaaaacgaaacaaagttaagttagaacatgacggcgcactctatgttttcgaccaattgagcgctggttgggtatttccaatttgctactgtcttttaacatcgaagtgtgccgcaatttatacgcgtatgttacagcttcttttggaacgatggccgaatttcgcgccgcagacaatttcgatggacttcgagttggcaatggtcggtgcggtccgaacagtgcttccggcatgcagtgtccgctactgtttttttcatcttgtccgcaacatgaagaggcagatcagaatccttggcctcacacatgtcaattgaatttttcagatgataaatttttttcttagtagtttaggcttacaacactgatcctgctttcgccgagaagtctaagatgatcacttcattggcctttctgcctgtgcaccaccttcaaaatagccttaatgttcttcaaggacaaattccaccacaacttaacggcgttttcaattggttaagtccgaaggcgaattttataattatttttatttttctaggtttttggacaactacatgggccgaatgcgtttcaatgttccaatggcggcgcctctgttccacccgcacgaatggaatgttcatcagcgcaccttagatggtgctgttcgtaccaacaacttcgccgaggcattccatcgcaaacttcagcggcaatttagctgcactcatccaacaatttggcgcttcattgacacgatcagatgtgagcagaaggcaattgacgcggacatttcacgttgtgtcatgggagaatccgctccacaaaagaaaaagaagtatcgcgaagccgacgcacggattctccgactcgtccaccgttataacgaaatcaataacattcacctccctcaaaatgatcacaattatgccaatgccaatgtgaatcccgaaaacattatcaattttctcactggtgtttcccgaaactatgaaatgcgaccttagtttgttctgaaatttgttattttttgttatatttttataaaattttaattattttttccgtttgatgcacatccgaccaaactgacaaattattgtagaagatactagccgcaagaaataaaaaaattaaaaagtcaagaaatttgtccgaattcgggttcgggattcgaaacatggatgttttgcacaaatccgaccaaattcagtcctaaacaggtactcacgcgaaaacgtccccacgcgaaaacggccacgcgaaaacagtcacgcgaaaacgaccccgaccgccctattcacgtatttaggccatttccctagtaaaaatttttcgaaaattcgtcgaaaattgaatatacataaggggaatttaagcggttggatgcttatcattagggctgtgaattttagtgacgaaaaatcccaaaatagttaactaaaatagtgagtaaaaatgccaaaatagtgaagaaatagtgacaaaaagtccgaaatagtgacgaatagtgacataattttcagccaaaaattgagcaaaaataatttttattcactgattgcagttgcaaatgagtaggactgggaattttaagaccaaaaaaccccaaatagtacctaaaaaaatttttaaataaaaatttttgccaagaaagtaaatttttgagaaaatttttttcatttcataggagtatattttgagaaaatttttgctcgattcttaggggtgtatttttttgaaaatattttaacgcagaaatgcgttttttgagctcctttcttcaaaacaattgagcaaaaaaaaagttttttcactaaaagttgcttccctagtgataaaggttaatggaatgaaaaaattggcaaagttattacgaaaaaatatttaaaaaaagattttttttaataaataaattaataattgagacaccgagacaaaaccgaacattgaacaatagtaagggaattaaaagtcccgttccgaattacgatgcagacacagattcaaaggttcaaatgaaataattaaaaataaatttatttacttaagtttgaacctttgcttcggaattacaatacaaatgacatgcaaaataagcatcatattctgcatggtaaaccattattcgaattgtatgaaaatataatatgccattaagttggaagctcaaaaattaaagctgatgcaagtgccgaggaggaggaaattgaaacaaaagtgttaaaggtaaaaagaataaatgtgtaaaaatcatttaaccataaatggtgatgaatatgggattcgtttttaggcacaaaaatcgcgaaataggcatgcacctaagcattaattaggcaaaaaaaaaaatcatcgaataggcgctaaaataggaattataaagtccatcgtaaactcccaaaacaatgggcaaagcgcgttttcgtgcttatctgagcgtatcaagagcgctgaaatttttaggcatttgcctaaaaaagaatccctaatgatgaagaacaaataa

SEQ ID NO: 18837 - DNA, 2601 bp, Heterodera glycines
aaaagcgcgccgtaaaaaaaacccattttataaacaaaaaaagtcgtcgcatggcttaaaatcgcaaaaattaggcagtttttggtgaaaatctgttaacaaattgcattcaaattttcaaaatcttccccggcggcgcctgtcggcaccgccggacccccccccccccccccctctgtcccacaaaatttttggaaaaagcgcgccacaaaaaaagcgtttttaacgcagaaaaaagtcgtcgtaaatgaagaaaatgatcagcggaaacaaaaaaatattggaaaaaaacaattccggtgaaaaatacaagccatttgaataaatattaaccattttgcattgcatataataaaaattttaaatgtccttggatttcatgaattttccccactatgttcttgcaaatcggcatacccgtccttggaaacggaggatggacgatgggagccctggtgtatgagctttttcggcccattaattttcgtgggagtgcttttttcaccccattatttgtcctcctcttaaagatttaaaaaatacatttttaaatatgaaaaatgcattaaaattatttctttgtttaaaacaaatgtaatctgtcattatgaagtggataaaaatcgatgtaaagtgaaaaagcttgaaaatgagccctcaagcacaaaatttcgacttttgaggccctgtaactcttgaagaaagcaaaatgcaccgctaaaattaaaaattcacaatagaagtcgaccctgctctatccaatgatatgtcatttatatgcattttcctagttacagctcggaatgttccttgtaagtataattccaacgaaacattcacaattcgaaatatttccttgtgaacagcgccagcataataaaaaattagcggtaactgactttggagaaaatgaaattgtgaaatattcgaacgcagtcgacgtaattctgaaaagtgatggccattttaagacggatgactgtgatttttatttgggctgatattttcaactatttcttattgtaagtttggaactcatgccgtgtgctggtccctaaatgcgttccgttatcatttccatccgccgttttgtttagtgcccactttgaatggcatatcggaaaatgcatttcgacactttggacagaattcaattggcccctcagcgaagcggtgatgttttcgtgcacttcggtgcctttgccaatgtgccatagtttaaccgcgtggtccatactcgcagtggccaaaaaagcgccggacgaatcgaaatccttgtgaattgcaacaaaataagtcattaggaaaaattgatggacgactaccagagaaatcacttggtcacggtgtccgttggtccccccgaggatggccaaacattgcgagtaagtgacgttcctcaaatcaatttactgctcaccactcgtaaccaaacgaaccaaattcgcactgtcagatccttactcgctgaagcgacaatcatcggagagacgggcgaagtgcacaattcgttgatggagtcgccgtgaccgattaatgcctaattaacagccgacacaaacataattaataaatatgcaacaaattttgaattacgcaatgaagtcgcccattgagtgggctaatcacacggatgattccgcgaaatccgccgacgaccaacacatgttgtgctttttcaaggttataagcccaagtgaccgtgtaataaaactcgtccttctgagaaaatgtgtgaaacaaagcaaaactccaaaacaaaagaaagtccaaccgaccgcgtcttggtcttcgaattgccgcaccaattgaaagcccttttcgggtggacaaaggtacacagacacctgaataaaacaacactcattacgtatgaatttgcataaccaattacttcccattccaatttgctcaccctatttttccctacagtggcaaaataaatgggcgcttccgagtgagtaaaaggattgaaagacacggaataaacagtgccacgatgattctcctaaagacttcggctagaaactattttaaggatggatgctccaactgattattttcaacttaccacaaaacttcctgctaattcaaaggtaattgtataatttttcttatttaaaaatttgccgccgttataaagcattttataaatctaaaagtcctagaaggtacggtttactttaagtatgaaaaatttacgaactgctttcctcctcactttcttgttttgaaacaacttaaaaagaaatttaaacgcatctaatggtttgacctttaaactctaaatgcgaattagtgttaaattccgactttttatttgagttttcgacttttagctgcccaattaatgaccatcctcatttgtcgttttttttatttgttagggcactatgggtcaagcccagtgttagacaaaacggcgcgcctatgattcgtctactcgacgattcgtctactcagccaaaaagtgacgattcgtctactcagccaaaaagccacgattcgtctattacacgattcgtctattcgacgattcgtctactcagccaaaaagtgacgattcgtctactcagccaaaaagccacgattcgtctacta

SEQ ID NO: 18838 - DNA, 903 bp, Heterodera glycines
acgaccttttccccggattacggtagcctcccataccctagcgatgaaatcaatacttatggaaggggtgcatggccaactgagcgccagccatttgagcgccagacttttcagtactgaagacaaaacctattgcgcgactttttgcaaatcccaactattgcgcgactttttcttgcaaaccaaacctattgcagggggtgcgcgacttttttcttactgcgcgactttatgcaaattattttaattaaatttatttaattttaaatgtcttaaaggtcaaagacgttgaatttacattcatttaaaattctccaaaaattccccgcaccaagcggatccgaaccccagagggggcggccagactgacgcactaaccactcaaccacattggcaatggatgataaacattaatttgctctcataaagggaaaatttgacgtaaccagcagggagaggggggcgagagcgggcggcgcgaaggggagggggtcaaataaacaaatcaattatgaagggagcggggttgttggaacggtgccaaataaacaaatcaaattttttaattggtcgcgtactttgtagtgccgcccacactcccgcacgcttattttgtaatctgacaccttcagacaataaacaattgtataattgattttttgtccatttggtcatttttcatttcatttaattcactttacggatggaaaatccaatcaataatccattatcatttatttatgccttaatttttccttctttggcatttgtttacccatttacctattactttttgacatttatttatgtgccagattggcattattctgccaccgttttttgtgccattttgcctcaatttttttggcatagttctgccccctttttttcatttttatttgc

SEQ ID NO: 18839 - DNA, 2535 bp, Heterodera glycines
  misc_feature (13)..(13): n is a, c, g, or t
ttttctcaaattnaaaaatattttaattattggcattctgttttctcaaatttaaaaattattttaattcttggcattctgttttctcaaatttaaaaattattttaattcttggcattctgttttttcaaatttaaaaattattttaattcttggcattctgttttctcaaatttaaaaatattttaattattggcattctgttttttcaaatttaaaaattattttaattcttggcattctgttttctcaaatttaaaaatattttaattcttggcattctgttttctcaaatttaaaaattattttaattcttggcattctgttttttcaaatttaaaaattattttaattcttggcattctgttttctcaaatttaaaaattattttaattcttggcattctgttttctcaaatttaaaaatattttaattcttggcattctgttttctcaaatttaaaaattattttaattcttggcattctgttttctcaaatttaaaaatattttaattattggcattctgttttttcaaatttaaaaattattttaattcttggcattctgttttctcaaatttaaaaattattttaattattggcattctgttttctcaaatttaaaaattattttaattattggcattctgttttctcaaatttaaaaatattttaattattggcattctgttttctcaaatttaaaaattattttaattcttggcattctgtttttctcaaattaaaaaaaatatatatttaattcttggcattctgtttttctaaaattaaaaaaatatatattttttcatggcattttgtttttcttaaattaaaaaaaaatatatttcaactcttggcattgtgtttattacctttcttgtcattgggtttttaattttaaaattatttattttaatttcggcattaataaataataaacaaatttataaaaaaaatttaatttgatttattatttttattttatttttacaaataagaaaaaattttgttgtgattattttcataattcgttaagtgttatttgtttaatgtttaaatttatttttttcataatattctactatactactataaatcttattccaaccatttaaatatttttctatataattgtaattgcaataaaaaatataacataatttatttttaaacgttaataaataatttgcgattttctgaaaattcaaatcatttatatatatgatcaagtgatcatcagcaatttttatttctcattattgagttatattatttttatttaaatttatctcatatcagattatttttcttgcaaaattcggtttatatttatttcatattacattagaactgatttacaaaatttaaaagtaaaattaatttgttattaaattttaaaattaaacaaagtttgtgaataaatccattttcattgtgatgtaatgacgagtgagattcgaggtattcggcaagcttaacctaacccaatttttcttacttattgaaaagtgatagacttttatattgtaaaaccaattatcttattttaatttttatttacagttatctagcagtcgaatatatacaaaagcttataattagtgatagtaaatttttcaatttacttttatttttgcacattgaattttttatctgtactaggcagataattctgttattcaatatataattgatattttttaaataaatttatccctcaaatatgatgattcatattactccaaccaattaaatttattttccatataaattgcaattactataaaaaatataatttgattcatttttaaatgttaattaataaattgcgattttcttgaaaataaattgtaatttttttaattcaaaaaatatctatttgttttaattaatttttcaataaatttttttttgttgttttcttagcattttttgtgttgttgcttttttatgaaagaatttaactttttgaaatttaattactgaaatgttttgaatattttaatttacacatattttatttatttacttatattagtggctatttgaaacttattaaaaatttttgcatttgaaatttttatgtttagattgacttctttattctcatgttagcaatgtttgacctgataaatgccatagacaatcaacaggctattcagaaaaatgaaagaaacaacagcagacaaaaccccaaacgtaaaaataaggaactcggacatagttagctaaaaaaacataagaaactaatttgtataaaaaataatatctaccttttaatttttctttcagctttaactataaaactttaaaaatagttaaaatttaggattcaagagataatttgtcattttcaacaaaaaaatcaaaaatatttaacaatcaacaatttattcaaattaaacactcaaataatcaaatgaattgacaattgatatttcaaagtcagtggcgtttattgagccatcctaaaaaaataaaaacattaaatttaaaatttttcttacatttttaaataaagacgaaagaaa

SEQ ID NO: 18840 - DNA, 1158 bp, Heterodera glycines
ttttggaaattctttgaatttaattgaaattttttcgattttccaaaatcccgcaatcccgcacgggatcccgcaaattttaaatgcgggatttgcgggattaatcccgcgggatcccgtcccgcaaaaaattttgagttccagtcccgcagcgggatccgcaaatttgaaatttccggtctctaaccccgaccccctctctttggcactttgaccccatttcattttgccccattcaaatacatgtgtattccttcattaatttttttttcgcaaggtcctaacaaatcaaatctcattttcaacaccaaatttacgactttcattttcgacacaatttttcgcactcacaatcacaagatggagaacaacaggcaaaatgaagaggtcaaaattaaaaagaaaatttaattattcctttttaagcatatatttattttaaaaaattacattttagactcatttagaaaaaaaatgttttttctataaatccgattttttagtcgtcaacttcggcagcgagtgctcctgaagcagtgacaaatggtgaccaccagcgcgagtcgaccgcgccaattccatcggccagcggttgtggtcgacagccaggcagcagcggaggtggcggcggcgagtcgtttgtaaaattttaatttataattaattgattaattaactaattaattaaaatgtgattaggtgaagcaacggtgtcgtcatgaagttggtcggctggaggaggagcttcgacgtgcgcagcgcgtcaacatggaatacaagcgaatttgcacggtacttcgcctcactgttgatgaacaaaagcgcaagctgaacgaacagcaaaaggcggtgaaagtgagaaaaatttttaattcatttttttaatttaaatttattaatttatttacacaacattttaattttgctgatgaccctccccccatcccccgaaaatttagaaattaaaaaaaaaatcgtagaaaattttctcatacacgagttttatgaaaattaattctcatcagaatttttttcctatttctgtcgaaaattttcaaaatttcgatgtaattagagtttgtttctgaattcataattgcatggagtttatgggaatgggttttctcttatcttgctcttgaaaaagcttgccacccg

SEQ ID NO: 18841 - DNA, 2411 bp, Heterodera glycines
actagggacgtgaattttaggttttaactattttttttgctcaattgatttgaagaaaggagctcaaaaaacgcatttccgcataatgtgccaatgcaaaattaccatcactaatttttgggccaaaggctcaatttttggtcataattttccaactaattagtaattgcaaattatcgaagcaaaaagagcaacaaataacgaatgataataaataagctcaatctcggctgtcattcaattgcattcccgttaatgaaaaataaataattaggaaaaagcaaaaactctcaaattactaattcacctattttttaattaattctattatttataccttataattattattataaaaaataactagccgctctgagggcatgcgtggggagcgtgcacttgcttgccctagcccgtcgaggcgtagccagtaacgggtgcacagtccaggttgttagtgcagtagcagctcaggcgcagatgcgtgtctggatgttcgtgcagcagcagctaccggcacatgcgcgtggcacccgtgagcagttgtaattggcatgcgtggcgcccgtgctcagttggaacccaaggggcttggcgaatgggcatgcgtggcacccgtgagcagttgaaatgggcatgcgtggcacccgtgcagcaattggaacccgagggcttgttattattataaaaaataatataattaaaataattttacataatattttattataattcacaccttagtctttagaagggcccagattaatatggatttttttttacttatttactttttcatacatatttttcgacatttgcacacgaaaattcgaaaaatactgcttatagattagaaatcctaaagaaatactctcctattcagtgaaaaatttgtggtaaaattcgaaattgtcaaaatgaaaattacgttttttcaaagagaaaaaattgttttcataaatttaagcatactgtagaattgagttaattcattgtattgaactaattaaaagttgcaaaaaagtgttaaattttatttaatgtttttatttgatcattagtgatcacttcgtcgcccattctcttccatttatttctttctccagttccaccaattggtattgccaccgctccaatagttgccccattggtcataatattggcctaaataatgaaaatttcaacaatctctgctttaattttgacaattataaaggcaaagaattaaaatggggacaatggaaatcttagttttaataacggcgtaaagtgtcaaattatggtgaaagcattgaaattttggttcaaatttgtcagggaaaatattaattatcgagaaatcactgtgatcattttagtgaatgttgaaaaagccgaaattttatttttaacaatttaatgtgccaaaatattgaagagagcttacgacgagcgcgaataccagttgtgtcaatttgactttcgccaacaacgtgggccaatgccaaacacaaaaaggctgaaaagcagcagatgaccaacagaagaaggatgtgaaaacggggagagggggaggacatttttaattgtcgacaattaattaaaggcaattaaatgtgaggagagagagaaattcaacaccttgggcggacttttataggcaaaccgaaattggcagttcaaatgcgcacccggcaaaataatagcacaaaaataatcaaaaacaacaacaaatcattccacacaaaaaaggaaattttcagcaattttcgtaaatatttacaaaataaaactctcttgccaaaggcaaaacatttgctgatcagcgagaccaattaccaaccacaccaatttaaaacctgtttttattttgcaaagaattcatggcttggaaattgtggtactcagagataagagttattgtgaacaaattaagtaagaggaatttcaaaaaaacaaagcaaaaaaaatgttaaaagcatatgcctaaaccaggacctgctgggttccatgttggacctgtttttctggacaaaaatccaggaaacagtccatgaaaaaccaaaataacaaattctctaatattatctaagaatccataagaagtcagtctcattatttttcatattaagtgggtcacttcgagtctcctcctttaacataatattcttaccatccctattttaatttaaatctttaataatttttttgcattaaatttaattatttgcactattcagacttcgtcctggcagccatattgacatttacttttcctatcagaaaaatatctcagccgtggttggtcgattcctaaaaagtgcaaaaatcaaaaatctgatttttcttacgattttttatcaattaattaattaaaaatatgttaaactttaattaaattggtgcttaaatacacattcttctacaagttt

SEQ ID NO: 18842 - DNA, 2477 bp, Heterodera glycines
ggaagaattgctggtccataaaatttcttcactttttcatgatggactttttttagtttgccttttccttcaatttgttgtaaaatgacattttttctgtctttatcaattccaacacaacgcaaaggacccgaccatcgctgatcaaatttatgttttaaaacttcttttttgagcagtaacaattcaccaatttcaaattctttctcctccgcttttctgcttttatcattctcttccttttgtgtaatttgtgattttaaaatattttctcttgctgtctcccaagcccttgaggcattttccgcgtgctttcgagtgtaaattgaaatgtcagacgttacttcgttttggctagggagtttaagcaagcgatcagttggcatttttggatgacgcaaatacaaaaggaaaaaaggtgaatattttgtgactgtatgtattgaagaattataaacaaaaatcgcatgtgggagagctttatcccaatcatttcctttctcattaactaattgagaaataatgtttgccataattctcatacagccttcgatttgaccatttgactgctggtgataggcagtcgatgtctgatgctcaaaaccataaattttagaaagatcactaaataattccgaggtgaatagccttccttggtcagttacaacaatctcaggtgtagagtgttggtgtaccataatttccacaaatgtttccacaattgtttccgccttttggtttgggattgccttacccattatccattttgtaaagctgtcaatggccagaaaaatatacgaatttccattttcgctctttttcagtggtcccattaaatcacaatgaatacgttgaaatggccctttggcaattttgattggtacactgggagcacttttaacatttcctggttgaatttttcttttttggcatgcttcacaagtatcgattaacagttttatgtcctctttcatcccaatccaatgaaaacgatttttaatttcgaaccaagttttttcaaaaccaaaatgtccttcattatgtatttcattgaaaattttttgtcttaattcatagggtataaccaattttgggttttctgcattttcttttcctttttgaaagtaaattgctccgtttaataggcaataatctgtcataactcctttccatttaaaaatttctttcggatattgtccagtcttcaggatataaaatatttttactaattctttgactttacgttgagcatcaattatttgcattaaagaaattctactttcgtccgtttgtccgtttcttgtactatttttatcactattgggtttattttctgtacttgaaatttttattttgttttcttttttaccctttttgtttgtgtcttcggactcattgcctggtatattataacgtgaaagaaaatcggccgccttgtttttgctgccagggcggtaaacgatctcaaggtcaaaactttggagagtgatctggtatttctctagtcgcccttttaattctttggctttcatcatgctcgtcagtgcgctacaatccgtaatggttttagttacgcctgaaccaacaatataaggcgaaaattctttgaccgcatacactaaggctaatgcttctctttcgattgacgggtaatttgtttcatgtctgtttaaagcgcgcgaagcatatgcgactggaccatttgcttggagtaataccgctccaattgcttttttggatgcgtcgcactcaattatgaacggtttaccaaatcttggggattgtaaaaccggggcagaagtcaacattttcttaagtgtttccagagcctcttcttgttcatttccccaattttcttcgatttttccctcaaatttgtcttgtgttaaagtttggagtggccttgctatatgggcaaaatttttaataaatcttcgaaaataggtaagtgcaccgagcaacgattttaattccgttaggcttttcggtggtctaaaattttggactgcctgtacttgcttagggtccattcgaattcctttttcacttagcaagaatcctaggtaacggatttcggccattccccagtggcacttttcaattttcaatttaagtccgacttcttttaagagtttcaaaaaattttctatgtctattaggtgaatttcctcattttcacttcctattattatatcatctaaataaataagcattgctgctgtcaagcgtcttctaagggaattcattacacgctgaaaagtgtctggtgcggcagttaaaccaaaaggcatagttataaattcattaattccaaggtgtgagataaatgctgttttttcaatgtcctcaggtgccattggtatttgcatgaaaccactttgcatgtccattgctgtataaaacttttttgaacccattaagtctaaaagttcctgaatatttggtagatggaacactcgttttttcgtcattttatt

SEQ ID NO: 18843 - DNA, 1239 bp, Heterodera glycines
tctagatataaaaaagatttatttgttaacaaaaactaggaatatcagccttttaagtgatatggaaaagtttgctagtattgaaaacagtggaatataaaaaaattatcgtaattttaagcaaaattaaagatgagcccaggggcataattgagaaaaattgaaatgttgagggggtttaagcaacaacgtgttaatgttatgaatgataattaaccacattacatatgattaaacactgtggagtaattagagttatttttttaaatgtctttctaaattttaactatttaatataccggcaaaaaggaataaaaaatttgaagatatcaaatttgtttgaggatgctggctataacatagacttaatgtaactgctccaaaacaaggtgcagaaaaaagtaaaatatttgattaaaacattttcatcctatttattcaacgctctagatataaaaaagattatttgttaacaaaaaataggaatatcagccttataagtgatatggaaaagtttgctagtattgaaaactgtggaatataaaaaaattatcgtaattttaagcaaaaaattaaagatgagcccaggggcataattgagaaaaattgaaatgtgagggggtttaagcaacaacgtgttaatattatgaatgataattaaccatattacatatgattaaacactgtggagtaattagagttatttttttaaatgtctttctaaattttaactatttaatataccggcaaaaggaataaaaaatttgaagatatcaaatttgtttgaggatgctggctataacatagacttaatgtaactgctccaaaacaaggtgcagaaaaaagtaaaatatttgattaaaacattttcatcctatttattcaacgctctagatataaaaaagattatttgttaacaaaaactaggaatatcagccttttaagtgatatggaaaagtttgctagtattgaaaacagtggaatataaaaaaattatcgtaattttaagcaaaattaaagatgagcccaggggcataattgagaaaaattgaaatgttgagggggtttaagcaacaacgtgttaatgttatgaatgataattaaccatattacatatgattaaacactgtggagtaattagagttatttttttaaatgtctttctaaattttgactatttaatatacccggcaaaaggaataacaaatttgaagatatcaaattttgtttgaggatgct

SEQ ID NO: 18844 - DNA, 1597 bp, Heterodera glycines
  misc_feature (84)..(84): n is a, c, g, or t
atttagccgcgactgtccgatgatcggacagttgtcgaatgaaaagaaatgcgggggggagagggagaaaaaaacaggagaacngggaaattgggcgaagaatgagaaaaagggggaccgcaagaggggcttttgcatgtgaatgggaagaaagaagaagtgaaaaagcggagcagcccccgccgcgcatgtgaatggtgcctaagggcagaaaaagccgatcgagcgatcaacgacgacgaagaagaagaacgaccaatcaacccaaatgatcaccccatcatttttattgtacccgcccattttctgatcctatataagcaacacaaattgtacatttcgatggcttgcgacaaataaagactaaaaacccgtccattttgggggtttcttgggtagtctgggcagcccctctccctctccctccgctttcaccccaccccgaaccaatggacgacgaaccgtcccgttgcggcttgtgggccgagccgcttcatgtggcgaccctggcagggattttggtggggttttggggtttgtgagcaagggtagggggagcatgccggccccacaggtttttcgtaacctgtggcgtctggcattagcgctattccattttgcgttccgcgtttctggccccttgggttttttgtaacccaaggcgcctgcattccgcgccatagggcccctcgggtcttttgtgacccgtagcgcctcgcctttccgcgccttgcattccgcaccgtttggcctcccgggttttttgtaacccggggcgcctccattccgctccattccgcgccatacggcccctcgggtctctttttggcccgtggcgcctcgccttccgcaccacagcccctcaggaaagaatggtcatgcgcttaggcagcgagcctatctcgcactcattggcggcattgtgccgagctcacaaagagggcagtgagcctaatctgcgcaaattgttgaagcgcattggagcagcgcatgttgaagcgcaaattggagaaagcgcattggagaagcgcattggagcagcgcaaattgttgaagcgcaattggagatgcgcaaattggagaagcgcaaatgagaagcgcaaattgaggaagcgcagaccgaggcggaatggaaaattatcagaggaagcgcaaattgaggagtcgtacctctccgggtgcgggataggaaaaggggtgggactgactgtattttggacgattggggaaggaaatgggggtggtcaggtaattaaaactcagaaacacaattacggggacaagattgaatgcttagtcaagatttaacggagttgaagagaagcggagagaagacgaagagaattgttgccttacaaattggcagcacctcgtagtcaaaaagtcgtctgatgacaaacactttgtgatcagaacaaattaaggcgatttgaagaacaatttatttttaaaacacggagaaaaaaagacaaaatcggagaatatcaagaagtaactaaagacgaataaaaaacctcaaaacgaatatgaaatttaaacacaaaataaacgcgaaaagtcatcgttttaaaataattaaattgtcattcccagtacg

SEQ ID NO: 18845 - DNA, 2348 bp, Heterodera glycines
aaatccccaaaaaccccacatactccaggcgtgctgcccttgttggactggatgagttcgatgagtgggtttttgtccgccgatttgttcaacagctcgccccgtggttgaacagcgttttcatgcacaacgggctggccgcccgcagcgcgaccattgacggcgtttcgcccgcattgttccgcgaattgatcaacgccttgcccgcctccttttcaagcagtgtctccaacatttgggtggacacccgggcagcatagtgaagctaaaaatgggaaaaatatgtgaaatttgtttgaaaaaagcaataaaatattgaggatgtgctgccattcccaccgatgttaccaaatttaaaaagtaaatcgcaaaaattcgattttacaaaaaaaacgaaaattttctatataaaaatattaaattttccaatttccaagtgccgcctatcggcggtaacatatgacctccagtttcctttttaaacaggcaaaaaatttaaattaaaaaaatgtttactcccagtcatccaaaaaaccgtaaatttttaagactttttactaaacaaaatttcgaagagattaagaaaactaaaaatagaatttatagatgagaaacggcattgggcgggggcagtgtcgtgcccctaaacacacagccttttaaattacaaaaaaaaatttgttgtccgactcaccgcattgttcccaacgtggtcatgcgcggtcaggtcagccccatgcttgagcaaaaagcggacaatggagtcctggtttgtctggacggccaacatcagcgggtagaagccctccggggagcatgtcactttgaccaagtcggtgacggagtagttaaaccgttgcaggtaggccagcccgtcgtccgtgaagatgtccacgcgttggcacaaaattgcaatgtgcgccatgcgcaacagcggatgctccttcatctgaaaaaaattgtgggaaattttgtgggaaaaatttaaggcattgtccctcaaaaaaaaaaatttgggaaggtctaacccgaaaatttagtttattgttgcctaaaaaaagttattgagttactaagactttttttgctgaactctttttatgaaaatttactcgattttctcatgctatctccgacaaattttgtcagagaatttgctcccagagggtttcgaggcttaagcccaatttttaaaaattttaaaacaattgcgccagtaaagctggatttgttaaactgatccctattataaattgtatttctttttatacataccataactgtgacgtcccaaatcagtttgcgcaaatccattttcatgtctacaaaaaataataatttttttttaatttttgaaaaatcctctgccacctgacgtccgaaacagcacaccgcactccccgtagcgacgacaaaaatcgatcgcctcctcctcactgttcgacctgcagagaaacggaaaattttttttaatccagtgacgaattttttttttcagaattcgaaggaaaaaaattgaaattccatcaaaatgcaaaaccaaaaaattactgccataaatttgaagtgtcattttgataaagtacaaaatttcttgagaaattttcttatttgcgagggatccaccgaaaaaactggaaaatttctcgtattttgagggaatatacaaaaaaaaattttgcgaacctaaaaatggtgaatgctcgccgtcttccgccgttctcctccaccgtgtacaccacgtggttgtccggctcgttgtcctcgacgcagccctggacaaccatcagcggtgagctgacgccattggctgcggtggtgtcctccactgccgggaacacaacagaacatgagccgagcaactcggagtggaaaccgaccacctcgaaggggtcgcttgggagggaaaaaaagaatagaaaagagaaaaattggtacaaatgtggaaaattaagggcatagatacaccaaagagagggggaaggaccggaaaaaattttaaatgggggcgatttttttgaaatttgaaatatttttgtgtcagcgtcgaaagactcaccctcaccaaaaaaaatcatattttttaaatttatattagtttcccagtcagttaataaattgcggcaaaaattgcttccaggccatcgacaaaaaaacgccagaaaatttttcgccgtcaaaaaaaacacagccgccagacgaatgcacggcaggatgttggcaaggcttacaatagcacaaaatcgaatttaccgccctttttttacaaaaaaaacgttctccaaacctcggaatccagcagtcctcgccgaaaacgcgctcctttgcgtttgaccaaagttcattga

SEQ ID NO: 18846 - DNA, 1742 bp, Heterodera glycines
agtttcgattttttgttcgaattcgggtttaaggttagaattttttcgaaagggggagggggtaccatcggcagctgttactttttaaaatttttctcgcaaaacttcacttaacgcactggaacctgtcatggttaaaaataaacgtcagattcgtaatcagcataaaaaataagcctagaaaaaatttttgaaaaaaaatttcaggtgggtgacaaaacctacaagtaccgacttttatgcttattttacaaatttttttttttttgcatttaaaacctgtcaataattattatttttttttcattaaaaaagttctatctaatttttattgtatgagaagtttttaaaactcagaaacttattcttaaatctattcttttgatttctattttaaaaacccattatacaaaaaaaaaatttcataaaatataaagaaaactgaatgggttagttgaaaaattgttaaattaaattttatgaatttttacgcacattttttgtgaatggtcgtgagcgtgggtgcacaatttcttacaaaaaatgaaaaaatttattttaaaaataattaaattcattttaaataaatatttttccaatttacgggtgtatgagatggtaaagtgatggcaaatcggaagaagtgacggcggttgggaccaagcggctcagatggaattcggcactgttttaacggaaatggaatttttaggtgctaaaaaatgccaaaatcgtttccttttttatggatttttaaacaatttagtcttgaaattttaaatttaggcaaatttttgattgaaaatttgggattttttaataaaatttctgttaaatttttgttcaaatcgccaaaatggttgaaaatagttttttttttaaatttaatttttgcaattttcgaaaaacttcccagaaaaactctaaattttttcgtagtgccggcatctttcaacacgacaagttttttccacctacttagcgccaattttaggtgggtttcttggaattttagtatcctttttggcatttttttagcatatttaggtgtaaaaatccgttctttactgatcagacacgtgagcagattggctgatcaaatcaaatgccaatttttgctaattatgccaatgccatttctcactttgtgcattgttgcacaatttgcaaagccggcgaaaaccaaagtcgaaaagtgtccgggtcggtgcttctctcgtcgaccaccgtaattcggacagctgcagcagcagcgtcacgtacggtagtgaatacggtagttctcaacggtcggcaaagtgccgtgaacaacacgcccttcggtgccgtcgccaattgggccattgttttgtcggcgtcgatgaatttgccgaccagcagagatggctttaaattggcaaactttattttaacatgatgaattcatttttttagtttttattcaaggtttccacgtaaaattatatttaaaaataggaaattttttggaaatttaattttaatatttttaattttggaaagcctgtttttggaccaaatgaaatattttattttatttttttgagttgtaagtaagttttttaatttctcgtttttagggtattttcaaaaaaaaaattttttgaatttattgaaattaaaaatataaaaaataaaaattagtaattaaaaaatgaaaaatatacaaaaaaaaaacaaggataaaagtgaagagggcaatttatatctttatatgtaatttt

SEQ ID NO: 18847 - DNA, 1276 bp, Heterodera glycines
  misc_feature (1055)..(1055): n is a, c, g, or t
aaatgcaaaaacaagccccaaaacaacgttttaaaaaaatgtacttaatttgaccccaaaaacttattttttactactgattttacttatttcggaaaattttttgatgcgacctctgttataacttgaattaaatcaattacgaacaaatgccaccgcgggtttggcattttgagcttcgattaatgtgtgtgacaatgtttgatggtcccggggatcgaccagatcgtataatgaatcgccttgggcaacaaattcgtcctgaaaatatgccacattttgcatttatatgcctaatttagaatctttgatcaataatgagttatttttaaaaaaataaccttctaaaaaataacaaaaaaaaaatcaccaaaaccattaactgaaatattttcttgtgttcaatctttttttagttttttttaagcgccgcaaaggaattttttttttgaaaatttgagttaaatttttaaaatttttggaacttaatctgcccctttcctctagcgatcgacgaatctcaaattattagagtcggtagatcaggaaaatgtttaatcgataatttgttctcgttgctaatgagtgatcagatttacagtgctaaatgttgggtcggagtggaaattgtcgctcagagtgatcagtttgccatgatcagtggtcacgagtaggaatcgatcatggagaaggtcggcaagtaaggctgcaagatgatggtttaccacggatggcactttcggtttgagcgagggtaaaactttgcaaaaaaacaaaaaataaaatttcattttggccaatttggccaaatgcatacttgtgccgttgagcgcatgatgctttcgaatccacacacagcaaagtgccatcacctgaattgttttgtttttttttggcatttgatataaacattgtggccgtaatttgtaatataaacttagagttcgacctggacttggacccaggcctttctcgtagtccaggtccagtccatttttcagcaacctagatttttcatggacctggattttgctgaatttttgtgtaggaaaccnagtcaagcattgaccccagcccagtcccattaggcttttatcaaaatgtatactctaataaaaggtggttttaaatttaaaaaatttagtaataaaaaacaaagcataatcatttttagaatgccaacttttagcaaatgatacaaaattacctttttggaaggtaatgagggggacaaatgaggtaaaattttattgtattgaagcttggaattttaatt

SEQ ID NO: 18848 - DNA, 1667 bp, Heterodera glycines
  misc_feature (12)..(12): n is a, c, g, or t
  misc_feature (1611)..(1611): n is a, c, g, or t
cgtccaaaaaanatttcggaaaatccgaagctttcatcaataataaaaaaactaaaataaagaattgattgcataaaacgacaattttttgatcattttttttcatgtctaatcgttaatcagcgaaaatcggtgattgaccgaattcacttttccgattcaagcagtacacccaacgaccgctttcttctgcgcacaaaaaatcctccaattgaacaattccatacacacacacacacataatgaatgacctggaattttaattgggtgctgcaaaaactttaaaccctattttaaataagaaaaaatgaatataattttttagaaaatgtatcatacagtaattttactgatcatttgccatctacttcatacagtaatctcgctggcttctgtgctcgtttcatcgccgtttgataatttccgaattgagtgcccacagtcatcgggcgcacaacggttgtcaattcgtatggtcgaatcgcaaggccagaagcgccaggacactgtattcgtgctcagttgtcagcacattgttgaggtaatgtgtagtacggtatacggtagtttacagtgagaatgggtggcagtttttccaaaataattaattattttaaatttcttaataattgcaaatctctgtgaaatgtgcaaatcaggagtgggtttgaggcttactgcaccactcttcttaaaaattaacacaattttttaaaattaatcattttgctaaaaaatttagaaataaaagaggaaaagtgcaaataattttaattgctaatctttaagtcccgctttacatttgaaatcatttaattcttaatgtcatcatttcaaatctattaaaccaaaaagtaattagccgattatacaatattttaaattcatgaaaataaaatcagttatattttgcaaaatttgtcaagctttatccatggctttgtcttccacaagaaagaaaaaaggaaatatacaaatatttttaattaataatgaataagtcaattttttttattaaaatcatttaatagttaatgtctatcatttatcaaaccaattaataaacagtccccaaaaacaattagccgtttccataaaatgattgaaaataaccaaaatttttcaaatttacagctttatccatggcttgatcttccgcaagaaattgctgaccaagaacgcgaagattgtcgttacactaaacaatttgacattttgttggagcaaaaatttgatttgacgtgcaaagagcatgaatatttggcaggaattgctcgactggccgataccaggtcaattcaacagcgggatttgttaatagattttgtccaaataatgactaaattttgcgattatgagtttttttttaaagaaagttaagcatttttcagctctgatccacacagctaggaaattttgggcattttctctcagtttttaaaagattttcgccaaaaattgataattttttagattttaagaaaaatttcgcgaaattttttgggaattatgatgaagtagatatttgaggggtaaaacaaaaaaaattgaaaattttttacaattatttccccctcaatgaatctaaaaatctttgggagcccctattanaactaaaaaaaaaaaagaaatagcaaatattaaaaaaataaatccatttatttttt

SEQ ID NO: 18849 - DNA, 1454 bp, Heterodera glycines
attagggcttctttttttaggcaaatgcctaaaattttgcgcacttgatacgcaaagataagcacgaaaaacgcgttttccgcttggtttggggtgtctacgatgacttttataatgcctatttttgtggtttttgtgcctaaagtgcctattttaggctttttgaaaaaatccataagaaaaatgcaataaaaacgaaaaacacacccctaagaaatgacccaaaaaaaattcagaaaatagacccttaagaattgaaaaaattttcaaaaaaatgatcccaaaatttaatatatttttttcttaataaaaatttttggtttaaaattttgtccttatttaataatttcatttgcacttgaaatatttaagtttttacttgttttaataccaaaaaagcgttaataaaaaaatgtttgcctatttttgtgcctatttaatgtctattttgcgatttttgtatgcctttttatgtgcctatttcgtgattttttgtgcctaaaaaaggaagccctagtaatgattgtttttaggcattcaaaaatgcacccccaatatctgaaactttgaaacataaaaaacggttttggcattttgaccgaaaccggtcaataattaattttctcggcacttttgaaggttggccaaaaaatttttaatgccacatgtagaggaccgatgaggctagtaaaatgacacgaaccagattttccaatatttatgcgacgtggcacccagtaatgtctttgggcttttcaaatttttaaaatttaattttagataattggaaattttcaaaatttcgtaacaaaactttaaataaaattttttaaataattattattcagatgatattatggaagaaatggcaaagacaacaactcgactaaccacaacggcacagaccaccacttttggctggtggctaaacaaaaatgatgaaggtgtaattatttaaaattattgtaattgatgattttgataaattaggacaattagcaacgaattttcagacctataagtgccaaaataagaccaaaaaaggagcgaaaattgtaaaatttttgatttttacatttttggacaaaattatttatttatagtgtttatttttcatttttttcattttttaaggaattttgaataaaaagcccaaaaaataggatgaaatacgacgcccaaaaaattattttaggatttataaacttaaaaaataatccaaaaattattaatatatcgaagatggtttaaaatagtacttaaaaaatttaattgttttattatttttcaagaaattcctggccatccgatattgaaccatccaaaattgcgcaaaaaataccaatggccaaacgatgatcagttgaacacaattggcccagttgcacacgtgccaattccaatacaaacggcaaatccaacattggcacctccgttgcatccaacacttcaaa

SEQ ID NO: 18850 - DNA, 3105 bp, Heterodera glycines
tatccattccttttccttcccctcccattcactttctctccgctgctgcttctgctgccgattgtgccgtccctttctcggcttttccctaccgcttttgtcggctcttttctcacttcatcccccgcttttacttttccctcctccatccgtttttcctccttctcttgtgcttttccaatggctttttgctttgtcctttcttttgattccgtaaattccctcattaatgccacaagtgatggaatattcctttcgtacgaatcgattaagctattcggggtggaaaattggccattttcatcgccgaaagacccatcggcggcgattattgttcgcgcatttgacaaacccatagacgaggcaaaggcaattagcaaaacagcgacggaaaattgggaagagagcagcagaacggacatttaagcataagcataaaataaattaaaattaagagagagcagtgaataaattaatgatcggagtgattggtctgtcaatccaatgccatggcaatgcccaaatgaaagtccggtcaaaaaggtttttgttgaccgccttttttatgctccaaatgacaaatcaaatccatgctgatcatccggcttttgattatcataagtgcaatgcttctcatgggatttacggaaggagtttggcgttatttgggcgccggcggtgttaaaagggtgccgctttagcaggtcgagggcagaaatgcttccacccaccccgcctcgcgaagggagaaatgcttttcaccccctccccaccccctctctttcgtttccgatcattccaatttttgccctttctcattccgccagttcctgcgcttctttttccgttcccacccaagtcgcacactttgataattttctgcttgctaatgggattacgctaatttaaaaacttggaagcgaaaggagaaaaggcggcacttcggatcagccaatcattcattaattcattcacaacgccatccgccggttgagaagagaaagagacagcgaacagcagaaagtgcaatttgcgctggttttcttttgggtgcgaaatgcgatcactttttagaagatttaacttttttgagatatttacaagttgtactcgaaaacaaacttaatgatttatttgaaatgaaaaagaaaaagacacgttaattaagttaattcattaagcatgcggatttagttgctttttaatttgtccatttcttttgctgtgctcatttgtcttcgttcctatgcgtcttacgtcaataaaaaagccatagcagcagaagagtcaattaacaattaattagttcgattgatcactcacattcccattgaccgcctcgacggactgttcaaacattggctccaatgcttctcaaatttgcgttttccattcaaaagtaattaaacattcattaaattaacttattcttcttcaccaatgtttaattattttttgctttttcttctcctttcaatcgctttcatttctttgagtaggttaattaattattattaatccaataaaaaattgacatttaatattttaatttcagtcagtttttctgagcaaaaatcattttttacaaaagttggcgatggtttcaaaaaaaccgctaataaaattggcaaaggatcgcataaaacgtggaacaaagcaaaaggaacagtaaaaagaggaccaaaaaaagcatgggagaaggcgaaaggaacgatgaaaaagggatggagaaatgtgaagaggaaagtgggatgagaatgaaggaaaagcggaagagagaaaaggaagaaaagtgaaaggaagagagagagagagaggaaaaggaaaaacggaagagagaaaaggaagaaaagtgaaaggaagagagagagagagaggaaaaggaaaagcggaagagagaaaagaaaaacggagggaggaaaaggaaaagcatgatgtaatttgcatttttttttttggcttgatgctattctgttttaattgtccattttattatccgtcctcattagtctcatttatgtaatttgtttaacagtgatttatttttttattttattgtttgttttctttattacttgctcttttactacaatttcgatagttacagattaagtggtgtccccgcccttctgtgacttatttttcttgctgaaattaaataaattaaaaaatatattttgaggtttggcacaaaaaggatgtgatttacgcccttttgccctttttaaaattttcatttatttttaacaaatgccaattttttaagtaaattcacaacagtggtcctttttaacaaaatctgttaataatttttgccaagtaattccaaatttttcccaccgccggttaccactcattaggcactgtcagagaatactgtagactaaaaatccgctacttaaaattaaaatttgttctctattgctcagatttcacaaaaccttataacgctaaaacattgtttgattgtttccaaagatacacataaatataactgctgaacatttttgatgtaaattattgagatttaacgaataatttttttttgaactaaaagtgatttttatagtacaaaagtttttttaatgtccaaattagttttttaaaaattaagagatgactaaaaaaacaacaattctttcattgattcgtttaatcatcttccgttccatcacatcccttatcaattgttcgcaattactgctaattagccaatcgatccgtttgcgtgcaattttgtatggtaacagcagcaaattgactgttcattcgtttctggtcccagtgattgctgcttctcctccccctcttttaattttccgtgccattccctccgtcgagaaatgtcgtcgccttcgcttcgcatttgcgtggtcggcgcgggggccgctggcctttgtgccgcacgacgcgccgtcgaacaattgcccggggcggaagtgagcattttggagcaaaatgaccaattagggggcacgtgggtgtacacggagaagcagcagcagcagggcgcccagccgacgcactcgtcgatgtacgcctgaattgaggtggtggtcggcggaggttaaagaagcacggtagaaaacaacagagaccggaatt

SEQ ID NO: 18851 - DNA, 870 bp, Heterodera glycines
  misc_feature (848)..(848): n is a, c, g, or t
cacaaaaaccttcggataggcactaaaataggcaaataaaattttttattaacattttttaggtagcaaatcacgtgaaacctaatcaaaaaattaaattttcttatatttcaattgttttaaagttttttcgaataaggacaatttttagtcaaaaacttttatcatgaaaaaatagtaaatttggtgatcaattttctgaaaatttttttcaattcttagggtgtgtattttctgaaatttttttttggtcatttcttaggggtgtgtttttcgtttttaaaagtcatctgatttagacttaattttttctaatttgcaccatttagataaattacggtgctgcgccgggtgccctacggtacgtggaactgatgggactaatcgaaggtctcttcaacatgggcgccaaataccgccaattgctcacttacatttcaaatgtgttggatccgaattttgaccgagtaatgcctcccgtgctggccaaaatatgcaccaaagggcccgtggaatcgcacaaattgttaccgtattaaattgaaatatgctatttctaacattcgggcttaggtccgacatgctatttgtgcttatttcttcattattttgattttaaaaacaaaaaatgtgattttaaaccaaaaatttataaaattgattattttggtgcaaaatctgttaacaaatcgcataaaattttcaaaaaaaacaaattttaaattgctctttccgatggacctaatagtttttgtattttataccccagtagcactgccgtgcgcggtatacgtgctggcgttgggatttggagcttcaatttggtagggggaattgggtgcattggnattgcacacacatactcccgac

SEQ ID NO: 18852 - DNA, 2261 bp, Heterodera glycines
  misc_feature (19)..(19): n is a, c, g, or t
  misc_feature (44)..(44): n is a, c, g, or t
  misc_feature (55)..(55): n is a, c, g, or t
  misc_feature (2194)..(2194): n is a, c, g, or t
tcagggtataatatatgcntaaaaaaaacaatatttcaaaggtntagactgcatnttcttaataatattgtattttcctcataatttcttgaaaaaatttttttacgcctaaaatttattgttattagtaaataaatgatggtatatggttacatcatcaaggcggtaaaggttcccaaataaatcactaacataattattcttttaatggactctaaatgtttttccccaatttaatccgtatgacgtgttgtgtcatgtccttaaccgtgtgtgtgtgtgttgaaattcatggccattttcttgacgttgacgaatttattgccagcacgaaaaaggtgttttctaaagtcgctgtcgaggatagccaaattacgagagcatttcggtttgcctcttcttcctcgtctgctcatcacgagatgggggacctggcttagtggagcggatgtactattgtgaacattttggtcaagttgatgcagttgttgaatgtttctacaagaacgattctgacgccataataaagtctcaaattacattctaaaagcccaatgtgcaagcagatttggcaattttctggaaaagctgtactcgggcgtgggctcggtttaaaaatttggacctggaccagaaccatgcgttttttgtcacggaaacccggacccggttcttcccaaatacccggtctcgtgtaaccctaataaaaagcgcgaacccccttagttataaatagtaaagttgcttatttttgagatttgtgattttgataagcatgggaacaatttaattgaaaaaactcacgctcgacttgaatctaaagagaaaatgttccaaaatgtcaatgcaactcaaccggaaaagccgctcccattttcccttttctctatttcctaattaattacatatgtcatagtctaattacgtgctgggtcgtttcgtaaacagtgtcactatgggcgtttcgtaaaaatgacaattttacagctcgagaaaaattcgttaaaatttttcaaacactatgtaaaattggcacttttcagaaacgaccaagcaccgtctaattaccgctcccccgccccccccccaccacattatggaaattaaataaaatggcttaatttgctgcccaactatcaatccgtccatttgtttatttattgttgacttttagcacaatgtttggcccgaccaattcgtcccatttggacatggtccaagtcaaatggcactttggctttgtcctgcttcagctgatcacttcctctctccttatgcttatgcaattgagcattatgccggtctttttttccaaattttaattgctttacttccatttattttgtctcagctgtttctgatctatgccgacctccgacgacgcattctctaccgaattacgttgtgagttgaccagtgagtgagtgtttgcatgtgaccaatgtgttgatttgttaattgcttcgttccattttagttcgctagcggtgtttacattgttgcttgggaccatttgatcgttcagcactttttgctcgccctcaaccgtctgatcatcatcgtgcgcgcccattattcgcctgtctcatcctcgattcagttttttcccttcctctcctggctgattatgttcctgctgatcattcatgacgccgctgtgcggtggcgtttgggatcatcaggtggtcggcttcttctacgacactcgttttgactgcagcaaagtgtacatcgatgtggagctgtatttcacgatcgctttcccggctctgtccgtgctcatttacctcgtcattgtcgtcctgttaaaaaaggtcatcctcatgtaacaccaataaattcgctggctactttaattaaattaattattcttttatttttttcccttttacttaatagttgacaggctactttagcatgagaagcgcattctgctgctgtctgtgctgcagttcgccatcatcaccgcgctgatcttcgcttggtacaacaactaccgtagtccgccctggactttgtgttggaaaattgttgtggccaaatggcaacgaatgggatggagcgggcggtcggagcgcagcggaacattatgaacagaacagggcgggtaaatgatgtggaaggactgttcatcagacgagggcatccggtgacggcacaaggcggaacgaacggctcaaaagcaaacagatcncagcctcagtgaaaagaatttccagtacgagcaggcccgtatctaggggggggggggaatggggggg

SEQ ID NO: 18853 - DNA, 3263 bp, Heterodera glycines
  misc_feature (1767)..(1767): n is a, c, g, or t
  misc_feature (1815)..(1815): n is a, c, g, or t
tttcttaaaactgccacccctctaatttcaagaaaattattgaaaaattttgaaaattgaaaaatatctttaaaaatttttggaatattataaaaacatgggaatattaaatattattagtaaattaataaaaaaaattaatgaacttttcgaaaaaaatctttgatttgcattttaatgatttgaaatttttggattttaaaacttttgtataacctattaaacattagaatttcaaaaatttcaatgattttcaaaaggtcatggccaaaaaattttaatttaaaatttttaaattttaatacaatcattttttatactttggtaaaatttaaatattaatattcttcttataaaaaataattaaagctattgaattatgccataaaatattggttgcagttaagtaaagctatgaaatttttttttaattttagaaataattcttcaaatattctaattttctcttataatttttcgttgaaatttttcattgtttttaaaaaaaattaatttttgaaaattttttgaacaattttcaaggatggcaattttaagaaacgcgctgacagttttagaaacgcgcatctttagaaattttaagaaatgcgcatgggtggcagttttaacaaacgcgtcagcacgaataagaacaaatggaagatctggtttaaaaaccagcttggactcactcttactggcgctagcgaaatcaatgattaaagtgaaattaaatatagttcatgagacataaatttaaaaataaaaataatttaccagaaaatgttataaatttaaaaaaaaattcgttaccttttactgattacgttgtgctatttgatctgaccaacgaattgcctcggtaacattggataacatcgtaccaggagtgtctattataaaatattaaaaaaagagactttaaaccaaaattgaattttaaaattaaaaaaaattataaggaaatcaatcattcctaagacagtcacaatgtacattgttaaataaaagtaaataataaaaaataaattcacttgaatttgttcagttacgagctatgatcaaaacaaaacctaataaaacattaaggatagccaaaagactaaaaatgaaaaaataaacaaaatatgaattaaataaaaataataaaacccaagtaaaaataaaattttggttataattgttataatgccaaaaaatgaaaatattttccaacaaaatggagcagaatgcagttttattctattttggctaagaaaatttaaattgaaaaaagtgctaaaagagattaattatcataactacaaatttttcaattctagaaaaatatgagcaaaaaaatttcaaaaatatatttaactttttttatcgtgatgaatttttaaaattttacaggcaaataaaaaattttctattttttgataaaccaatttcaagtaaaagcaattcatattgaaaacacgctactaaataagaaaaattgtacattatttttataaaaatagttaatgggaaaattagatgttaattctttaaaataaaataacaaagcctatgggaggggtgccgccctttgaaagtgcccgccacttaatgggggacaaaccgaacctattggctcctttgaggctgccgcctcgtggatattcattatccccaaatccgcacggatgttttttttttgcacacacaatccgcgccgcgcagcgccgcggaaatgttcatcaatcatccacctgtcaccaaagtgacaggtaaatgaattanaaaattttttctttgcaattttttgggagggttattttttcaaatccntgagatttttttttttataatgttttttctgatcctgaaattaaaaattcattttgaaaattgccaaaaccgtgcggttttttatcatccccccctccctccccgcccgcccccgcgccgcgatgccgccgccgcgcaaagcaatcgataatggaatttggaagaagtgtgaattaattaatgccgataaataaattaccgaattggacaatatacttattatttaaattcaatataaaaataaaattgacaatgaataataaatttaaaaaaaactttttccaaaagtaggtcacctgtcaggtgaatgatgggtttttatttctcttccattgatttcgcaatatgcacgtgactttttgttccaattatttcacaatatgagaccaaattgcaaacatgtcaataaaaaatgattgattggttcttcatttatccgttcatttcgcaatacgcacgtgactttttttgtaaataatttcgcaatatggacccatttttatttgatatggtaatgagtttttatccgtttcaaccattatttcgaatgtgcacgtgactttttgtttttttggctcaattgtttcgcaatactgtcccaaagttaggtcacctgtcaatcaaatgtagtattatgtagtgtcaaaacagcccaggtacaggaatgacccctcaaaatcccgagcctattgaagaggtgttttcctttgaagttgccgccccgggataggttcccgcaagatcctaaacctattggagagttgttttcctttgaatttaccgccttgggattttaccgcaaaatcctgagcctaatgcttgagtgtttctctttgaagttgccgcctcgggatttttccgacctcttaagcaaccctttgaaggtgccgccgcatggatatttattctcgccaaaatcgtgcgggtgttctttttgtccacatctcattctccgtcggttctccgcgaagtcgtcgtggcgcgccccgccgcgcaaagataatcaatcatttccctgccacaaatgtgacagtgaaaataatttcaccaaacttcaattttttgcacactaaatcccaaatatttgtcgctgttttctttgaatgccgctcattaaattttaataatacgtgtaaatttccaaatcctaaattttaaaagagtgcgatttaaaaaaaatgttcgtaaaccgcgcgttttttcttcacttccccagcaccttccccccgcctcagccgaccggagcggtcatcactcaaacgacatattatagccaattgcgagaaaagaagagcgaaagtgttctttaaatgaactataaacgtaaagaaataataggccgatgaaaatcttaaaaccaaattaagaaaatagacgaaaaaattaaatttataaattcaactagggtaggactttcaattgatgatgagtgtaccatttttctttcc

SEQ ID NO: 18854 - DNA, 1275 bp, Heterodera glycines
ttactccgaattgtacaaagaaatacaaaggagaagcggaaaaaaaggaaaaaaagtgccattcccgtcggaaaaagcggcaaggtgccacctggagctaaagttaaggggaaagggtctatttggcgccagccgaatattttgatttaacttttttctctgtcggccaattccaacatcttggtatcatttgaaagctcttcgcaagctatattagcttttcaaaaagctacatttacccagcattaaaaaatttattaagaaaaaacttcaaaaatttctattttttgtaattctcatgttataaccttttcggtaattgtctaatctccaagcaatatctggaaacaactcgggctggcgccaaaacgtgggcgacaaaacgacccctactctgagttttaagtgccactattctcggaacttaagctgcagcaaattttattgctggaggggtaagaatcggcttcatctactctcgagcaataaaagcgttagggtacgacatattatcgagctaagacagcattgaagcggagtgtaagttcaaagaacacacgcacgcacacactctcgacggacgacgacactcgactcactctcgagcgagacaaaacacaaacactcaccactcttgacccctatggggcgctgctgcacggcaccgcgtcggcagtggcggacaccattcttgaaataggagaagcgattggagagatgggaggcgggggggggaggcgggaggcacctgtgttaaaaaagaggaaggggtaaattggggggggggagaggaggaaaagccaagccaaccaaccgacggatttccctttgaacgaaaggaactccgagaggaaggagaatgtggcacacacagcggggcaccaccgtctcgaagttggagaaaaagtgccgaaatgggtggggtttgctcgggttgagtagtgtcaaaaattaagggaaaattcgaattgagacggtttcggcatcaaagaaaatagaacggcattccgtctcaacctgaaaacacggggaggggtgagcctagactcaagaaatgagcccctgaatctcgagaaaatctcccaaccccatggaaatacaatagcaattgaaaatgccaaaaatggcatgggatttttttgattttggcaaatttggggggaaggagctgagaggtgcagatattcttggcactttagaggggacaggaagctgatgagagacgaggatattcatttccctgaaatggaaaacggtgaagcgcggcacgaccag

SEQ ID NO: 18855 - DNA, 1807 bp, Heterodera glycines
  misc_feature (237)..(237): n is a, c, g, or t
  misc_feature (271)..(271): n is a, c, g, or t
ttcccccacctctggctacgggcctgaatgaaagtaaacaaattagagtccgataatgaacaaacaaacaaaaatgaatattattttgtaatatggcagctcctataataaaaatggatattattacacattgtcatgtatgttccggttaagcatcgattaaataaaaagcaagctaattgatttaatgatttcataaaaacaaagcaccccatacagcggggccccccccccccncccccccggggggggggggggcagcgcccaattncactttcaattacccgctcgtcccccacatttttctatgacttctctgtgcgctctctcctaacagcacactctctccccctatgccaattatctcgcatgatttctctgtgcggctctctcctaatagcacacactctctccctatgccaattattcatctgatttctctgtgcggctttccccctcagcgcactttgtcgccatgccaattatccctccctctctgctttctttgtttgccctctctattcacagtgcactttctcgactaagccaattacccattgtcaacaaccgcagttctcgggctcctccttcaaaattttctacagtccgagtgaactttgtccgctgtggaattatcgccccttctttctatacacacactctctcccgccaatgcactgtctcgcctatgccaattatcgctctcgcttctctgccttgctctccaccgtcaatgcactctctcgtcgacgcaactttttgtcctccccccccccctctcttcttttgcgcagttgagggagggggagagggcactctctcgacaaaaagttcctcccttctccttctctgtgccgctctccaccccataacactctttctcgctcgatctctcgcctcctcttcaccggatgcagcactctctcactcactccctaataaatatttatgtgtacgaatatgtgcaacaataaaaagcgcatttgtcgcgctcttcttctgtgccgccaccgccctccggggggacaaagcggcgccgtcgccgcttgtttgtgtgtttatcacgcccgagggcattatgcgcccatttatgtgtttgtatgtgtgccaccgccagcgccgaaagggtgccgcgctcattagcatattcgcgcagggcatggcatgagtcacccacccatccatacatccaacggcaaataatgagcagagcatttgataatttgttgccggttggggcagaaagtcagttaacgagcaaacaaaaaaaaaagcgagagagacaaaatgccaaaaaaggaaaattcaaaaagttttacgcctaattgcccacgagaatgaagcgaaaacaagattaattgtgaatatgaaaaatattttcaaacggaacggcatgaagacagttttggcattaccatcatatttacgccttaagcaggcgaacagatgggggataaaaactaattagtgattgtccaggcaattttgcattttttttaaattcccgaggcaattctcgacattagctttcctcgagtcatttaagtgtcattatttgtcaaaagccccccccccccggcttttaaaatttctgtgtttaatgggtaattaattagaaataaattaatcaaaaaaatcaaaaaatttcttccgtaagaaattaggccgggaatatgtggaaatgagcagcagcagcaaaaaagcttaaaagccttgctccccccccgtccattaaacttttctcgtcgtcctccgaatgtttgtttcccgtccaccgaccgccgctccgttgacatttttttttgat

SEQ ID NO: 18856 - DNA, 2849 bp, Heterodera glycines
cttcgaaactaaattaaaattaccaataaaatataatttttcgtctatttaccctttcggaaatttttggcaatttgtttgtttcccgctttcttctgccttggttttttgaacattctgtttctgagtgcttcgcttcattgcaaattggaatgtttgtgtcgttcagtgggaattcttcgttatctctataaatataaaaatatgaaggcaaaagaatttttgaaattttcattatttcttttgcaatgttatgaaataatttatagaatttacagattaataaagaacagaagctgaataaagggaaaacaattgtaccgcagagtccgttggctgttggtttcggcttcaaaattggaaagctcatttttagcttcctttgtgagtgctgatggaagtggagatttggaagcatccgaaaaagacgccgatacttttggtatagtaaatggaatgggaaattttgtgtccgatgcaacctgacataagtttaaaaaattgaaatttcattttgttcaattaattacttgagggtgcacagaatttgatgtagcgtcacttttcttgtcacttttgttgcaatttgaagtgtttccattcggtctttgtgcatttgaattgtcacttttgtgcccggtcaaaacagaatgttccatctttttgcctgacattgcgttctggtcacaatcggtcttctttgttccgcttttttttaatttcttcatttgtcgtgtgttgtcttgttcttcgtcatttaattttcgcttttcactttttttgtttgctttttgcagatccatcaaaattggatcagtcgcaagaaacatttcagctgcaacactgtgctgtaaattttattcagaaagacttcaataaaatctttaatcacctctttttgcatttgattttgacggtttgcattcactgaaggggaatgcctttccgtgatgtcctttttgcaagaagtagaaatcattgtacgtgaaacggccaacggatttggagccgtagatggaacactaaaagtttgtagaagaaataatttggaattgtagttccccagtaaacaaaattaacaatttatgaacaaaaagtcaaaacccaaatttctcgaatttcgttttttgattttcgatatattcaggtcgggttcagaattggtcaaaatgaatgttatgcatatttgagctcgatccaaaaactgtttatgcagaaaaatttaaacttgaaaagtttagctctgacctcgattggttctctttgtggtaatgaggtggagatgccgtaaattgcaatcttggcgatttaccattgatgtcttggaaggagtttttggagatcttgtttgtcgtagagatcgtcttaacggcaagtgaggaaaatggaacatcggacaaatgcgaaggggatggagaatatgaggaagacgatgttgaaatatccattgagtcagagtccatcggtttaattaggtcggcttattatgcttaatatgtaaattaaaataggtcataacaaattgtaattaggtacctaattagcaattctaaataaataaatataagtgatgaaagcatctcaaaaagatattcatacatttgtattacctatatgcagaattacaaattggtctcatggttttatgcttatcagaaatttgacaaaaacaaaattaatttctaaacaagagattaaaatttgaaaattaaaaaaatataggttttaatttagtttgattcttagcttagggataggtgttagccgatttccgaaattttgtgagggaagcggtaaaaatcctgatgtagagaagtagataagttaaaattatttaaaatgctgctactaaagagtttgtgaacggatgataaaaaagtattctattaatgtctctctctgtccatcagaattatgtattatttttttcatatttttctttaattttcagtcaaaatgagtgatgatggtcctgcttccaagcgatccaaaaatgacgactcatctcaaggagcggcacaggttgtgtaaacaattgtaaaaacaaattaaatgtttttaaattggttaggattgtctcaccgagtctcagaaagcgcttgaggatttggacaaagtgcagacggaacttgacactttaaatgaaacagccagcgacgaaatattaaaagtcgagcagaaatacaatcagatgcgaaagcccttcttcgaaaaacggacacacttcatcaaacagataccaaatttttgggtgacagtggtgagtcactacgagcaattgcccattttataatgcattttgtcagttcataaaccatccacaaatcagcaatatcctcgaggaagaagaggaagaatgcttgcactatttgacgaaagtcgaggttatcaagcccaaaacattaaatttattacttttatttcaagattgaggaaaatgaagacatcaaggccggttataagttgaaagtaattaagggacagacgctgaaaagttggaccatcaaaacaaataaattctttcttttagttttctttcgacccaaatccattcttcgagaactctgaaatagtcaaagaattcaattggactgcagcagaaccgaacagtgtgacaactgaaatcaaatggaagcaaggaaaaaataaagtaagtattttcttgaaaattggctaaaaataacaaatgttcatttttggacaaaacttgttagaaattactcaaatttcaaaatttttcctggctcggactcccaggtggggggatatttcgtaaataaattttgaccacccccttgtccgttataatccctaatgacttttgaaatttagaatctgggtttactttt

SEQ ID NO: 18857 - DNA, 987 bp, Heterodera glycines
ttaaatttcgtcacttaagtctatgcttgttttactattgttctttagatccaagtgaggtgcaacttcaatcgaaacgaacttcgtccaaaaatagggctggattaacgggttccgctcggggtgccattcagccaccctctaaggaaagtgccgaaagttctccggcaccatcgtccctcgccactcatcaccaatctgtcgcttccatgactctgtccatttctgccaacaatttgcttaatttcaacataaattctcctcgctcttcctcctctcgtgcctcgccaatggcaaacggtttttgttttaaattttaccaaaattacgaaacattaattatattgtaagtaaaattggaaaaattatccgaatttccatttgcctgcgtccgtttgtgaattatgccaagacttttatgtggattaaaaactcagggttcttgaccccgacatttaataaaaggtggctttgcttttcagtttcaaagttgcgcttccatagcacgaagggagtgaatgtgtatttacagcatgatgaaactgttgcagttcggaagcacggcgaatattaccagggatacgttttcactgaaaggccaataaaagtcggagaaaaattggttattttggtcagccaaatcgaggactctttttccggcagtttggcgtttgggctgaccagctggtgactgacgacgtcgattgtccgttgtagataatactgatttagtgacccgtcaaaagtgctggcctccagactgcccgtggacagcgacgaactgttagaaaggacggaatattgggtgtgcatcaaagatgttgccgcgacaccgcaagtcggggacacactctcatttcaagtggacgcggaaggtgatgcccgagggtctgggatttaattcaaccaatatttgtagggcgggtattttttcaaaaatgatgcaccgtcgcgagtgattatgcacgtggacatcagcattccctt

SEQ ID NO: 18858 - DNA, 2040 bp, Heterodera glycines
tcttcctccatccgatcgttccttccgcgccgagtgcaacttcatcctcagctccttcttccaccactccgcctttctcctcctattcgtcgattgttgaccctgcggagttggcacagattcgggccaacattgctctgcgaaggatcaaccgaaacagcgacacttccaccggggaaagtgtggcccaaacttcgtcagcgactgcgggtgcgcctccatttttattgagtgctctcaattcaaatagcagcgcaatttcggcaggttcttccgccaccacttcaacaaatgttgacttggcgcctggtcgttcaccgccaacgctcaacgaactgttggccaatcgacgaattcagttggaggcgcgaatggcagcattgacaatactgagggacaaccaatcgccgattcgcgaggacagcagtgcgtattcgcaaaggaaccaatggcacttcagcagtgctttggacactccaaatacgaccttttcgggcgcatccgttacagtgcgtttgtcctcctttatttagccatttaattgtatgatatgtccgaacttacaatttcgcgatgcgtttatgcttttctcattttcttttaggctcctttgcttcctccaccgcttttctctttgggagtctctgccgagcggtcgaatcggccgatgcgtcgccgcaacttatcggatttgagttcctcgagcgattcgtctccgactggacgcttagaagcagcagaaaattctgagcaacagctccagaacaatgggaacggcgatgaacagcagggcagcgaatgttccatttgcatgaacaacagagtgaacgcggtcatctaccggtgtggacatatgtgcatgtgggttcagcagttgtgtgaaacgattagcacaataaattattagacagggaatttaatttgggttcactgatcggttttacgcattttcttttttgattggaattttaaattaatattttgtattatttcttcgttttaacaggtgttttccttgtgccaaagagacgcatcgtcgttccggagattgtcccatctgtcgaactccgataagtatgttttttgttgcttattgttcgttgtttagtttagatgtttccccttccagtcgatgtgatccgttgctaccccgtttgaagaatttgacagtgtgcgagttgctggcaattgccttaattcaccttttctttttcgtgcggcctattctttttaattgcataaatatctctcggtcacttttcatttaataatacaaaaaaaagcacactcattaaagtttttatcctaccaaacatcgatgctttccttaatcattcatttttgtcttggctgtcattgttttttgcaatgttttctcctgtctgtatttgtatgccaatgtgacttatttgtcagccaaaagatggcgaatttgatgtattttggtcaaaatatgtgatgttgagaaaatggcaggtgaaatttaatgagcgtataacattgatccacagaatataaatattttattttgatgttttaataacaataagaaattattaaaaggctgattgaataatgcttttctatttggggtttgaccggcgggctttgttttggaagctcttcattaaatgcatcaagctcaattattgtggcataagcgttgtgattgtttgccgaatcagcgccatccttccaacgattctctgagcgaagaaaatgccaatggcattggccgttgtttttacctttgtgcttcgatcaatggcattttctgctctttgtttgtccgtctcccaacactttcgcctccaattggccttttcgcgtctgacgacgataatttgcttctctgaggcggtgaaaatggcgttggatgggactgaaagttccaatgggcgaccggcaaatcgggcggttggtggtaaatgggcggcggagggaggggagagacggaagctgaaaaggggggggggggttaaaagagcaaaaaacagcgagagattggccatttgagtggaattggccaaaaatagccaa

SEQ ID NO: 18859 - DNA, 1653 bp, Heterodera glycines
cgatcgagcagaagaggacgatgtcagccccgagtatgatgtgacgtcttgggatcttgtacgacaaggcgcaatgcaccgtctgtggcgttgttcgattttggtacctaattaggtacccaatcatccgatcaccagtacctcaaagatgaggaagttctcagccatgtaaaattagcgagaacggggatttaagaattgaaatgcattttatagattgggtataccctcgctcgtctgatggaagctgtgtatacccatgcagctgttgccggtgccatcaacataacgagagcacgccaaatgtgaggaaattggggcgaaaatcagcaaataaacatcaggaatttagcgaaatagcacgggtcggtggtgcccaccctgagaactttgaggtgttcgggctacgcaatgcagaaagggtacccttggtaatgatgagtcatgacatggcaacagccaaatttttgatttaggaccaggttttcccccgggttccattgcccattgaggaggtggtagtgcgcatcgaggggaactctgacgaggaggaggaggaggagcagcagcagcaacatgtcgaggaggaggaggagcaggagcaacatgtcgaggaggagcagcaatgttgtggatacaattagggatttaggcataaatattgataataaattgcaattttccaatcatgtcacacaaataataaagaatgcatatttacgtatgcgttctttatttcgggttattaaatcaaagtcttctaggatttggattattttgtacaaaacttatgttagaccgttattggaatatgctcctgaggtttggaatccatctcttctaaaaaacattaaaaaaattgaaaaaatgtcaaaaatatttcaccaaaagagttcttttcaaatgcagccttccacccattccataccaacaaagattagaataccttcaattgccgacacttgaaagcaggcgaaagctgtctgatctgttcatggctcataaaataatttatggccgaacagatctgaatccctttgaaatacttaaaccttctaaacgctttaacattcccttttatagacttaactcgaaatataaattaggcaaaaaatttataattcttattaagatttatatattcaaattttgagcagttgcctctgcctcaggtgcgtatagcgtgactattgaatgctatactccatatttttgatcaattctgggatggctaaaattaaaaggatttaaaccttaattctttgtttaaatattaaaaataactttaaaaattatattattattctgctttatcttttttttcctttgttgaaaagcatcacaataaaaacaaatagaatatataaatatattttttttgcagtttttttacacacctagttattctaatagagtattaggttaagtaattaaaatttgttatgattagaatgttatattcaataggtatatagatgctgaataggagcaatgggtattttcttatttatctatgaaaagtttactttttttttatctcgtgcagctgtccgtttttgatttatgatactaaggtcacattaaatattttgtgtcataaagtgattcattaaaatcaaatatttatttaatttcttattttaataaaattca

SEQ ID NO: 18860 - DNA, 2718 bp, Heterodera glycines
ggttccttccgacaaagggaatcgcctcattttcgttcgacttatggtccaacggattacccaatcattggcgggagtttgtctctcccttcctttttgaacaaaccgcccaaatctttaaaaaggtaagtaatcaaaggcatttctgctccgttcatcctaaataaatttggtttgcgtcattttcagtcgaaagattgccaataaaagaaagccatgcaattgcacaaaatcaatgtgtctgaaattgtactgcgattgcttttccaatggcgagttctgtttggactgcaactgtaaggactgtcacaacaatttggagcacgacgcggaacgcagccgagcgatcaaacaatcgctggagagaaatccgagcgcattcaaaccgaaaatcggtcacccatcgaacagctcatagttagcaattacggattttctacgctttaaggagttgctgcaaaaaatatcggaaaagcaattgacatggagcgtttgcatcagcgcgggtgccattgcaaacggtcgaattgtctgaagaattactgcgagtgttatgaggtgggaggagcagcgaaattgtcataaaaatagaaaaacatggacaaacaatggtttaacgccctgtaagccaaaacatagactttcttaattatttcgcctattttctatgccgacaattggttggcattctgtgcctaatttggcttttcttttaggcaaaagttccgtgcaccgaccgttgcaagtgccaatcgtgtcggaacactgaacatgaccggcataataagttcaaggacaagttcactaccaccgcgggtggcctcgcccaactcgcggcagcagcggccgccgagtcgcacgcgcgcgcgggcacgccattgagcgaggacgacaccagcgacatttgtgtaggcgaagacgaaacgacgagacaggcaaacccaaaaacgtgcgaatcgaatgtttggcattgtccattttgagatttgtgattcagtcagccgtggttttatatgacagaggacgtaatcgaagcgacgacaatgtgtttggtatcacaagcacaggaacttgtaaatgaaaaacaaaagatgtcaacgccaacaggcactttattttcaggagcaaagtctttcggaggaggcgttggaaaaaagcgttttgcgggagtttggccgttgtctcgagcaaatcatcgaaagtgccaattcgtgcctacctcagaaaagtaatggcgctccgcaacattttcaccttacacccattgaaaaagctatttgagggcaattaacagactgacttttttctgcgacgccctcttaatttgattgtcacttctcatttttggtctccctcaacccaacattcgtttttctgctattcaatttattttttaatgatataaaagagagtcagtcagccatttgccaatcactcccaatattttcgggtcagaggcctttttttttgctttttccaactcatcgcggaaaacgaggatacaaatcccttaattatcgtctccgttttgctttttatcagcacacatgattttctctgtatttgttgtccgaggaaatcgtcggtcttcgaaatttgccaatgttcggatggggggggaagggattatgtgcctttttctttcgccatttgtccgagtccgccgctgcttattccttccttcatcacatcagtggctcattagtggataatgaatggggcggggggtgtggtgcgatgccatcgggtttaatgccggcgagggaggggcccctcttcggcggttagaaattagccaccacttcttttcctttgccccccaccccttttgcattgcctttggctatgtcttcgttacgccatcactttttccccaattcgagtcgtccggccacttccttctcttcctcttcccctgctctcttccacagtgcttcttcctcctcatcctcctcccattccttcttctcttcccccaatttgtccccccattctttcctcccccctccaaatggaaatggcgatttgctgtggctcagtcttttgctcgttattgtggccgtggtgatgctcatcgttggaattggtgagcagaaaaaaacgaaggcgggggaggggagagaaagcgacggaagtgtcgttttattaacaagcgaagttaggaagaaagaggatggaatattttaattgtttcggtgatttttaaaaaccaacaaaaagtagtttttaattttggtcgtcgagcccatccttttggttttaggggtgtatttttccccgtccccggcggggattgagtgcggggattcccattttcggggattggactttgatttttgattcacaacttttttttttttgcaatttatctgggattaaatctgagtgggggaagggggggggtaattaattcgaaggggattaaaaaagcaaagacagagagataatggtacggacggaagagctaatgatggaggtacagaaaagagaaatgaaaaagaaaaaaaagaaattgcaaacgcaaaaaaggcagctgctcacgcacttttcagtttggagtgcctttttctgccacagtaatttgcctttggacgacgaaatgcgaaggaaaagggcacaattttgcgaaggggacaaagggaggcggcggagggcgacgctttgctgggggaaaatgaacggaagggaaacggtggccgaacacgcagccgacgcgcg

SEQ ID NO: 18861 - DNA, 2794 bp, Heterodera glycines
gttacactctctctgatcagtccgatcactctattcccttttttgttacactctctctgatcagtccgatcactctaatcccttttttgttacactctctcggatcagtccgatcactctaatcccttttttgttacactctctcggatcagtccgatcactctaatcccttttttgttacactctctctgatcagtccgatcactctaatcccttttttgttacactctctctgatcagtccgatcactctaatcccttttttgttacactctctctgatcagtccgatcactctaatcccttttttgttacactctctctgatcagtccgatcactccaattcctttttttctctctcttctccgttaaatcccccccccccaatttctcgtcgtattttttccacttctagctgacttctgtgctggtgatgctctcgctcggctccgccgtttatgagccgcccggcaccaccttcgtttggatcaccgccgttttggcactgatcactgactgtctttccatgttggcactcggcttcgaaacggaaagcgcactgttcaggcccgactcgatgatcggatggccgctcattgtcagcagattcactgcccaatcattagcattcccgaaaattgaaaatgccgagaatttaattggagagaattgacccccgacgacattcgaaaatttaacaaatcaaaattacccagaaattctgtaaattttccgaaattgggaacttttctaattggttttttaaatttttcttttattcatttatgttttaggaatgtgtgttctcctcattcttcgccatcaactattttatctcaatttggctttgcattaataggtaaacagaattgaaaaaagtgccgttgatggaaatggatttggcagagtctcaaaaatggctaaattttgggattgaaccaccagaaaagaggtcaaactgtggtaaaaccgaacagaaaatttagcaaagtgttcgcaatgctcgacagctcaatgccttactcattggcagcggtgggttcaaaaagataatccaaaaatcagaataaaatggcaaaataactttaacattctaaattaattagttcatattataacaaattcagaagcgaattcgtaaaaatgataaattaaaataaattattatttaataattttaaattatgtgaaaatggaaaataattaattatttttaaatcattcgaataaaaaacgattaaattgtttaaattgccccataatttggccattttccgcttagactttctctttggtcgcctttgtccaatatgtgcttaacgtgcttttctacgtacgcatttgggccactgaccagcgcagacagtcgcaggagatcaacccgagtcggcacggctacacaaattacggggcgccataggaaatgggggaggagcactaattgaacaataattggcccattgaagggctaattaaccaccggcgcaatggcaacaattagggggcaaattgtggaaaaaaattttgcaaactggagattttggctaacaaaaggccccaaatggatgggccaattagctaaattttgtttacttctttgtgtatgggttcctttttaaataatcatttaaatttgtaaattatattttaatataattgttttttaccaacaattaaattgtcaaaataaatattcattatttttaaaatatttcaaatcaaaaattttacaattagactttaatttgatcactttacaaattttattttcatttttaatgttaataaattcatttttttaattaacattatttttcacaatgcatttgatcggcatgtaaatcatttgtattttattacatatattttaataaaattcatttattgtttttcctcttttttttaaacgcaatgcctaaaattgtgccaaaacaacaaattggggccaacgtgttcaacatggtcagtttgttggtgggaagaagccagacgaaaaaccgaaaattgagtgattgtatgtatatcgcaaaaactgaaatgtttcgatcagttcgcccctcccccaatcgattatggtcaatggtaactcatataaaaggcaattagtattctacagaataaagcctaagcctaggcttggcctaaaacttaggcctaagcctaacctaagcaatgtacgattgccttttgtacgagttgtcatgccaccatcgattccgatccctctgatcaatcccgatcagtccaccgccccctccatcaaaaattaaccgatcactcacttactgccccactcttcgttggcacagatgctctccttctgtcttctgttggcactgtcctcggctgagctgttgcccgccacgctcggcgtcgcgctgttcgtcggcctcgcctcgttggcggtttcctctgtggcggtggccatgatcacctcggggctgcattggcaggtggccaaattcggccttttccacgcgttcgctccctacggcgaaattcagtggcgacatttggttgttccatttttggcacttttattccctttccatacgatgacaatctcccgcccaatttccccaccacagcaattcacttatgcggtggcattggcctcctccaatggaatcggctttctgctgaattgggccatcgcctcgtcccttccgcgtcctttccatcggtcgtattccatcgcagcggttggcacaatttggcatttattaatgaatcaactaaaatgtctcggcttccgaaggtctgaaaagcgggttttcggtcaaagttagccgaaa

SEQ ID NO: 18862 - DNA, 2799 bp, Heterodera glycines
  misc_feature (45)..(45): n is a, c, g, or t
  misc_feature (55)..(55): n is a, c, g, or t
  misc_feature (132)..(132): n is a, c, g, or t
  misc_feature (1972)..(1972): n is a, c, g, or t
aaaaagggacgaaaaatgggaaaagcatcagaaaaagtggacaantcatcacaantttccgtacaattttatttcattttccgaccaattgttggggaaatgtgttggcaaatgaaaacggaatggacaatntagcatcaaaaaatcagtttatatttttcagaatttttggtccactcggtagcccaatgaataagctaatgattggtataacgatctaaaatctgctaatagtagaaaaaagttacggtgaaatttataacaattttttggggtgcgttaaacatatgaccatgactgtaccaagaattattggcttcaattggatttttacattgctctcagtcatggcacgcaaatccgtacatttgcgtgcggtcggtagcatgaatgacagaagacgcatttttgtgattaatcaaaaagaatttcttaaattaattttcaacatgtccagaaattattttagtgcaatttgtttaataaattgtccaaaatggccaattttgcgtcaaaattttgataatgccataaaatttgaaaaatttatgactaattttatgaaatcagaataaaatttggtcattaccccaaaatcaacaatatttctaacaaatcagtacatttttattttgtcggatttggaacatccaaaaaaaaattgtcagtgatatcagaaaaaaaatcagatcattgatgttcaattgatattggataagccaatcaatcatttacaaagtctcaaattcctttgacagttcgtatttgaagttgggaccaaagttggcctcgaccgcggccaagtgatcaaacaatgtaacggtcgggtaaaggtcagccgttccctcgtcaacgtacaaattggtgatgtcttaattaggcaattagccagtttatttatgtgaattgccatcatgaacacaaactcaagcgttgtccattcttcgtgaaaaacacagcgtgttgcccaattcagtccgcatccgaccacatcgccagtgcgaaatgatggcacattgtccctaatgcttatttcatttccattggcatttgtgcttataatctcgccaaaatttgcgtaaccgtacgaaacacggccatttccaacccaatggtccaatggcacttcttttgttgatagtccaataagtatgctgaatttaaattttttttgtcataaaaaactgaaaataatttttatgaaccgaataactaaagacttgcgttaaaaaaacaaaaataaataaaatcaaattttttttattcataaaatttttgatttcttgtatttccccggttggtcccgggttttcaagaaattcttgtccagctcagctgcttttacaaaaaagattaaaaagaaattcagactgtaaatttttgattttggtagataatggagtttatatatttttttttgctgttccacaactcacagtagatttttagcaagaatccgaaattccgtataaataatgccaatgcgaacagcagcagatgacattttaattggtcctgctcggcatgaacgaggattagccgtgccatctttgatggaaaactctaaataacatttaaaaatagtgaaaatgattcaattccaatgatttttagtcgtgctggcgcgtttgttaaaaactgccacccatgcgcgtttgttaaaactgccaatgggtttgaaaacaaaaaatgggtaaaataattaaattaatagcttggctcaaattcaaccaaattaatatttcggggtatcattcaatagctttaattgttctctttcagaatataattttcttatatttttaacttaagtataaaagaagttataaagcattgaacaggctatgttttttgcaatggtaatgcatatataataataaacatttaaaattttaaagtctttaaaatgaaatttaaccaaaattaatttatatttcgatagccctaagaattctctatttactagcggggnacttaaacgtcccctctgactaaaccggccagactaaacgacccctcccggtctatcttttattctttgattctctactaatttccgaataggacgattcggtgccgccgattcggtgccagggtgggttcactgccaatacttttcggacactatattaaatttataaattaaatgaaaacatattattaaggggttttgaggttgctgaacacggttatgacagcttaggggtaaatgttttttatctgcaaaatcgaagacaatctgaacttcgcaaaagggagcatgcgaagacggagcaagtagtgggtccaccactcgccagtgggggatgatgatagtcatgtgctcatttggacgtgcatggacttaaaactcacctccattttgcaaagaaaatttaaatcattccaaattaagccaaaaaaattctttactctattaaataaactcacttattttgccatggaattaatcagaggcgtgaccgacagaatgtctgcaatgttttcggtgttggtaattgttttatgcaacataatacagaatataatattgatttattaagggccgcaacttttagtgacgaaaaaacccaaaatagttaactaaaatagtgagtaaaaatgacaaaatagtggcaaaaagtccgaactagtgacataattttcagcccaaaatttgagaaaatatattttttattaactggtttgcagctggaaatggagtaaaaagggctgggacttttaagaggaaaaaaccccaaacatagatacctaaataaatttttgccaagaaagtaattttttgagaaattttttttt

SEQ ID NO: 18863 - DNA, 1024 bp, Heterodera glycines
  misc_feature (943)..(944): n is a, c, g, or t
catcgctctctgtttgagtcgcaagcgtagtaatctaaacggaaaatgaaaaagaacaaatgacgagacagcccttctccacccacacacctttttaacaaggttgaatattggatgtttacaatagtagcaagctgaaaattggagaaaacaacattagttcgacttggtcggacgggaacctatcagacactccggcctttcgacattggccgcgtcggagattatgtaacggttgaagacgagagaattcttttcagcatcgaattggacggagctgaagcgagtggacgatttgcacttcttcgcttaaagcttaacaattggatcgaatgatcatttaacttacaattccatggggtcagctcatcaatgggcaaatctttgatgctccgtaccactgctccgtccattatatacacaaaagactctctccctttggcatcaggcgggcgatttggtcgtaattggagcactttgctgaggtcaacacttaagcaaataaatatttttgtttgaaatttgatgtggcgcaacatacattaagccaatttaatttattttaaaaattatattatgtaaaatcaaaaaattttgacaagcttccctctcgatcatgtaatgaaaaaccacaaactcactcaccaattattaatgttaaagacgagtctcgctgcggtttgtgaggatgaaataaattctttagaataccaattttccattttaaatactttaaaaaatttagtattattatgtacatatgtaatataatgtacaatattataatactggagaatctgggctccacccaaaaaaattgtttttttctgtttggaaagaccaacccgggggtttcggggtttcgatcacgaatatgatatcagatttgaaaaatcattgattctttcattgatttgaacatcataattttgtcaatatgttnnaaatgttgcacccttttttcgaaatgagtaaccatatatgagcagcactttttattagccactgagatgatgatagaaca

SEQ ID NO: 18864 - DNA, 1053 bp, Heterodera glycines
cttcccttttcacacgcacatttgcaagacacctttggaaacaatttttaatcatacatatatttctagagcaacaagtcactcataaagtggaaaaattaatactataataaaaagaaccaaattaaaactttatatatataattacataatttcgttatttagtcagaatctatgctttttctttttttattcatctcccgtttttccgggactcccggtcccggcctttgttcaaaatactagaactgggagtcctggccaatcctttcgggctcccggtcccatccgagctctagtatttatgacccataacaattaaatttgcattatctattgttatatatacggttaaggattaaaaaatataattcggaatgggattttcgacaaagccaataattattgacggaaaagatcatttgcttggacgtttggccgctgtcacttcgaaacagcttttgcttggccagaaaattgttattgtgcgatgtaagttttttctttgtttattctaaaatactattcgatcaaggcgaatccatcaacatttctggcaacttccaccgttccaagctcaaattcctcgcatttttgcgcaaacgctgcaatgtgaagccatctcgcggacccttccactaccgtgcaccatctcggattttctggcgcacggtttcttttcatatttaggctaggctaagcgtaggcttgtttgggcctaggcttaggcacaggctttgtaaaaaaaaaattttattgcacgagttgccattgactcctccggtaaaatatgatagaaaccaagtaaattttgaatcttattcatttaggttcgtggaatgcttccgcataaaaccgcacgaggtatggaagcactgaaaaagttgaaatgttttgacggatgcccgcagccgtatgacacaaagaagaaattcgtacttcccaattctcttcgccacatcgcattgaaaccgcgacgcaaatattgcacaggtgagaggcattactgctcccccacataatcggaggtataaaataaattggtattactgg

SEQ ID NO: 18865 - DNA, 3852 bp, Heterodera glycines
  misc_feature (1407)..(1407): n is a, c, g, or t
  misc_feature (3791)..(3792): n is a, c, g, or t
  misc_feature (3843)..(3843): n is a, c, g, or t
tataaaaagaatttttacttaatgaaataataaaatggatttttttgaaaaaaatacgaaaattatctgtggtggagggcctgtcactcccaaagtaaatgatgaaaacccttcgacaagctttaaataaaagattcaattacaggcaacttatctatgaagtaaaaatagaaataaaatattattaatatggctaacaaagtgtaaagcaaatatacttaaatcaaatatggtaacagtctaaaaataataaaaatagatgcttataaaactaatttttgcaagtattttttgataattggttaaaaaaacaaaaataatgaatatggtccatttaaaaatcaataaaagagaatttattttttaaaactactatttaaaaaatatgaatagatttttcaaataaattaatagttattaaataatttatcaatgctataaaatattcaaaactaaaaaaatagaagtatttaaaaaaaagttgataaaaaataattaagaataaatgcttactaaatcataattaagaaacttttaaaaattatcatttaataaatgatgaaaacccttcgacaagctttaaataaaagattcaattacaggcaacttatctatgaagtaaaaatagaaataaaatattattaatatggctaacaaagtgtaaagcaaatatacttaaatcaaatatggtaacagtctaaaaataataaaatagatgcttataaaactaatttttgcaagtattttttgataattggttaaaaaaaacaaaaataatgaatatttgtcagtattttttatctcgaaatataattcaaaataatggaaaaaaccatgatcaccgaccacaaattgaaattgacctaccatagcaacaagtgaaaatattattaaacaaaaataagcaaaaagaaaaaaaatcaacaaaaaatgtaaatttaaagagaagataataaaatcattattgattaatatcaaaaaacgattataaatttttaaaaaattaaaattccaaagctgtcgttactgatcagtacaaattgaaaagtttaaatcataaaaaatatattaatcaaaaaataataagaaaatcaaatattagaaaaaatggaatttcatttaaaagcaattgtaaattatttaataaaattaaagaaaatttttttattcaaattaataattaagattttattcatttcaaaagataaaaataaaaatcaagtaaactaaaataaagtagattgtaacaacaacaacatttttatttttttaatttttttatcctatactgcctaaaagtgactaaattttgaaataaaataataaatgttttcattaaaaatctagcattttaaaatgtttataaatgaatagtttgaaaaaagaaaaaaaataatgcagcattanaaaatatttctcataaaacagtttaattgcccaaatttgaagttaattaatgagaattgtattaatttattaaaatatttaatgtatttttgtgattaatcttgaattaaaaaatgaattatcggaaactgtaaaatttttatgatttttttacgaaatttcttccaatttgatgctccaaaagtgaagtaatgaataaaataatgttatatctataaatatactaaaaaaatattcaaaaaatatttaaagaattattaaagctaggatgatcccataaaaaaatattaaaattcaaaaatataaataagcataaagaaaagcttatttcattaaatagaattttaaaatatatgaatagaattttcaaatataataaaaccttataaatttagttaatgctttttaaaattcaaatatacacagaaaaatgaaattttaatgtttatattaaagaaagtgaatttcttttcgaagaaaacgaaacttgtggaaagatgaggagctttcaagcttgttgttcgatcatttttagcaaattaaagatattcaaaaaataataattatatttggctcaagaaaataatttgcataccaaaattaatttaagataaagagaagtgctttagttaaatgcgatataactaacatattttaaacaaatttactaattcagattattttggtattattaaattagttacatgaaaaaataatatgaatattaaatatattttttataaaaataataaaaaacataacttaaaaataatttgcacttttttataaaacaattttaaaagaagaaaaatattttaaagttagtaattcaaatagaaattaaaactaaataataatgtttctcttctatcttattgtgctcactctaaaatttacaaccaccctttgtcgtactcgcattcatggagtttattaaagcaattccgttcaaaaacactttttagtaaaaatttaaaaatagattaatgtaaatacctaaaaaaacgtaagtttttctcataaaccaatccgagattttattcatgtatataaatgatgataatattattatacaaatattgatgtcatataaatttgtttatttattgtgagatgcgttttggaacaagattttaatagcacatttaatattccctttcggaaacaaataattaataatttcataaaatttagtcaaaaataaaattaaattcccttaaaagggttagccgactttatattcatgaattaaaacatcatcttaaatatatttttacacaattattaaagttttattataattttaattataattatgtgtttttaggaaaaaacaataagatttaaataaaaaaggtttctgagaagcttaaataaaaaattcaaaaaatcacattcgacttataaaagaaaaaaaaacaaagtcttatttacggttgaacaaagacatattaataatgcaaaattgatatgaggtaattttttcattaaaaagatggggtaaaaatagattcaaaaccatataaaattttttatcttaaaaccaaattaaattaaattttatggtttagaatatccattataagttttttttattactaaaagatacctacaataggaccagataattaaagattctattgaaatttataaaatgtaaataaattttaaaataaattaatcattactataaattaaaaaaactaattaatagctttgaaataaattatttattaaattaataattatatctgcttctgaatttacacaatgttcttggaaagccgaaacaaatttagtcttgtggaataatgaaatgaaaattaaaaaattatgaacaaagcggcgaggatggccaagagatctatgaggttgaggccatcttggccatgtcggtgctcacaacgagcgagcggttatactactttacgtggaaagaaaaatttgattttcattgagttcaataatttgacgtcaaaacttaaaaaaatcaatataatcaaaataaaacttaataaaaattaaaaatatatacgcacggaaaattaaaaataattaatttttaaattatcatatataatgttattgaaatgaaaattatataaatttaagaaagcgtatgataatatttgtaaattcgaaaatttataagaaatatattttaaaaaataatattgttattctgaaaataaaactgcaatatatgtataattgagctaattttgcatgatgaataaaaaggtggctaaaattaaaataatggaaataagaaagttttcttttatttaatataaaagataaaatgaatcaatttaaaacacacacaaaaattatattttatatttagaggctttcttttacaggatttcatcctaagaatgaannttcaaatatggacgtgacacagacaagaattttataataatttatttttantataattaa

SEQ ID NO: 18866 - DNA, 3131 bp, Heterodera glycines
agagaaagcgaaagagggatagagagaagagatagatagagagagagaaagaacaaagtgatatggagagcggagagagatggatgagaaagagaaaaggataaggaatatagagagaaaggataaaagaaaaaaagtcttccacggtcgtactgtccaattgtctggttccaactaaatgacttcattatactatagtaatgccactgtcaacttagactctcgaacaatgaattaatgctctatggaaatttaaaaattaattattttaagtgattacaaaaaattaagaaaagacccacctaagaatatatttagattgaaaatttcgttttttaggcggaggtttccattttcagtctcttgactcattttttggaaataattcgagctaattatttcttcggccatttctagtttatactctatattaaattatattaatattttttactaattctgcaaaacgttttgcgcccatcatgtggccaaattttattctctcatagtccatcaaaatgcttgtaaaattttcaatttcatcctgtaaaatttgatgcgaagatggagcgatgtcaaccgaagctgaaagtaaaacaaattaacaaattcaaacattaatacaaaaatttcaacgataaaatacgaaattcatttttgcaaatatattcaataaaaagagtgaaaaattgttgaatttggattaaaaagtaaaaaattaaaaattggagccctagttacaactaacccaaagaatttttggcccacaatttagctttgtttttattcagtactcaaaaacagtttcggggaattttagtggatgcggagcatgaatctaaactcccatttgcccaataaccgaaccccggagccgaattcaaacaaatattgaaaaataattggaagcttttaaataggaaataagtggtaatacttgccgtcagtgccaagcttaaaatcacaaaatcaaaaacagatatccccacgtatttcaattgggctccaggaatatgaaagcacccaaatttttcgtttaaattaaatagttgaaaaattgctaatgaaaataatattatttttaaaactgttatgaccatgttgaagcaaaatcatgcccctgaggagaacaaattcttccatactcaaattaatttctttgaaacacttaattgattcgcaaaacacgcgaatcgccacattaaaagtgcccaaaaaaattggagagaatccgctgggaagagttagcgtttcggcatttggacaattgacgcagctgtagaaagttttgttgaacacagcggtcagaattatgttgttgagtagcagagaagtctaaaaatgaacactttaagctcattaataaataattattattttttattacttcagctaattatatgatggatttataacctcattaataaataataattttttaaattgctttcgctaataattagatggatttacttagcgtgtcaactcagttatgtcgcccttcgatataaaattcaacaaaacataagcatgacttaaataatttccatcacattcgaaaaaatttgccattttcaggtatgacatcaataccatgaacatagaatttaaggaataagagttaaccaagtaaaaaaatcgaaaacccacagaacttagttgacatcctaagtaaatgaaacgcgtcagcagggattaccatagcagaaaaaatgtaattatgtagtaattagtcaattagattagtgaataattaattgcctgatcaatcaatgggagttgccaaattgctggtatcgttttggccatttcaatgcacaaaaagcagtcaataaatagccatcgcactgcctctttttgcagcggtttgtcgtcaattgttggcgcatttggactccaatcatttgcaattaggtcaagaaagaattgcttatagtagggaacgcgtcttttcatctttttaaataaaaaaaaattttcataatttaaaaagacagagacatttttgagtgctagcaattcaaatctgaaattttgcacttttatgactagggatacgatttttaagtgctaagaactctcaaataggagctaaaaatggaaaatagtctctaaaaagtcttaaatttaggggtgtaaaatgacaaaatttattcaaaaaagtaacaaaatcaatattgagattattaatttttaaaaccaaaaatttttgtcaatcaaaatttttttagggtgctaaaataaggcaaatgtaaaatttatgagcacttgatttttctcagataagcatgaagaacgcgttttccgcttgatttggagtttctacaatgactttttttaaaaatttcagaaaataaattatttttcacaaaaattcgtcccccaaattttttttctgttcaatatttgctaagaaaatattttgtaactgcaatcagtgaaaaagttgtttgccttattttaaattattttcaaattaaaaaacagcctatttaaaaaattacacccctaaatttggaacttgttcgccatttttttgtcaatatttagttaattattttgggattttttgccactaaaaatcctcgccctacacatcaattttcctctggcttttcgcatttcatccatcccttctcgccaatttgtccaaaatttactaacaaaaatgcaataaaaaagaacaatacacccctaagaaacgagctaaattttttttctaaaatacctctaagaagcgaacagaaaattttcaaaaatttgcccgtttttaacacctaatttggggtttttttaggacctaaaaattaaggtgttacgacaattgcggaccggcaattgcggacgacaattgcggacgatatttgcggacctgacaattgctgaaaaaataactggaagggtgggcctcgtcagtacggtcccttccgcattacaaattcaaaaacctaagtgtgtttcggcccttccgtagacacaccaaataagaaagctcacagaaataaattaataactaacaaatagaaagcagaaattaggagcagaaaagcaaagcatatgattctaaaatatataattatgtttattttattggcttgctgaaggccctaaggaaagcttctacgaataca

SEQ ID NO: 18867 - DNA, 1112 bp, Heterodera glycines
aaataaagtccatacttttctcctgatttttctctatttttaaggctttattcctgtaaaattgatcaacccttcgatttgttatgaattttcaaatattaggccaaaatcccgagggccaaaaaattgccaaaaaataaagaatttttaaaaaattccaaaaattttgaaacgaaaaataaacatcatattcgtgctcagcacctcaaaataccccagaaaaatatttttgacctcctttttcaacccaaaaaaattttttgaaaatttctagggggcctagctcgaaaatttttgaaaatttccaaacataaaatacaccattcgatagcatttaaaatgctctacaaaaatgttctaagacaatttttcgctaaaaccaatccctgacgagttatgagcccaggactcaaatgtcccgctgaggccaaaatttttttctatttccgggaaaaaatcgaaaattttccaaaaaaattaccaatcgatagagctcgaaaaactatgttttggaagtggtcttcgtttttctgggaaaattcgttaaaaaatcctaaaattcaaaaacccgaaaaccgttttttaggcctagctcgaaaaattttcaaaattttcgaaattttaaaatttggaaaaatcgagctttcgaagctctacaatagtgccgctggctaccctgcgctcaggtcaaaacctaatgagttattcaacggggactgaagtggacaaagttggtactgaaaagttctagaagcacccagcccagggggttagagatagaggtctggaattttttttaatttttagtcaacatttcaacttagggccctcacagcgggaattttttgatccgagtttcagaaaaaaagttatgggccgtcaaacgcacgaaaaaatgagaaatccgtccctgggactcagtcgtccgcgctgaatttttttctatagttttcccggattctcctcaaaaagttgtaagacccttccactactttcagggcgctcccagccttcggccgggagattttgtttttgcaaacgaaactccttgtcaatataacatatatagtaactagcgggtgcgtgaaccgtcggctatttcgctgggaaaa

SEQ ID NO: 18868 - DNA, 1302 bp, Heterodera glycines
ttttaggccgctttgcggcctcaaacgggcgctttgtccacatcgaggctcaagacgggcgcttcgcgccgttatttaaagtttgttggttcatacgggcgcttcgcgcccgttattcaaattttgttggccttacagagattagaagaggtacaacagtgattaaaagacgtcaaaagtgattaaaagaggtggtactacagtgattaaaagaggtaaaaagtgattaaaagaagtacaacattgattaaaagacgtacaaaagtgattaaaagaggtaaacagtgattagaagaggtacaacagtgattagaagaggttcaacagtgattaaaagtggtactacagtgattaaaagaggtaaaaagtgattaaaagacatcaaaagtgattaaaagaggtacaacagttattagaagagttacaaaaatgattagaagaggtacaacagtaattagaaaaggtacaacagtgattaaaagtggtactacagtgattaaaagaggtaaaaagtgattaaaagacatcaaaagtgattaaaagaggtacaacagtgattaaaagacatcaaaagtgattaaaagaggtacaaacgtgattagaagacgtacaaaagtgaattaaaagaggtacaatagtgattagaagaggtactacagtgattaaaaagaggtacaacagtgattaaaagaggtacaacagtgattagaagaggtactacagtgattagaagaggtacaactgtgattagaagatgtacaaatttgattaaaagtggtacaacagtgattagtaaattcattaaattaaaatgaaaatattttttaacaaatttaattaaaaaaatacatgaaattctatcaattaaaaaaataattaatttaaacttataaaatgtattcatcaaaaaaaaaattaattttaaatataattttttatttattaactcaacaaaatattttaaattaattaaaatcattgaaaataacgtaaaaatgcacagaaaaataatgttacaccgtccggactcgaactttgccccccccccaaaaaatgatgcctcagaatccccaatcacacagggattctgaggtcttaacgatgtcaaaagtaaaatctgatcacgtattcgtgatcagcggcccaaataacccctaaagacatgtttttggaagatttttggtgaaaaaatttttcaactcaaaaatcctatgatgggccctttggtcccagaatctacaaaatcacatgaataatattaaaaggaattcttaaaaaagtgataaaaatgccaaataaaat

SEQ ID NO: 18869 - DNA, 2406 bp, Heterodera glycines
ttatttttgggtgtaaaacagagtggccaagtgtccttttttaaagattgtcctttattttaggcttccccactttttaaattttttgtgctttattatttatttcgctgatagaaatgctacaaaaacccaatttcaaaaaaaatttcccggcggcgcctttcggcaccgccttcccccccccccctatctccaagtttttttaagaaaaacgcgcctcaaaaaaagcgttttttaaaaataaaaaaaggcgtctcctggctaaaaatcgcaaaatttgtcattttttagacaaaatctgttagcaaatcgcatttaaatattacaaaaatttctcggcagctcctatcggcaccgccggcctcatatactctaatttttttggaaaaagcgcgccgcaaaaaaaacttttattgattttttaaattttgaatataatcatccaaaaggatgattttttgtcggtaaaatgctgattttgaaaattcagttgacaggccatgtttttacgctaataaaatgttgttttaagtcgatttttcatgtttttattacgtttccttcgcgctactattagttgtagaaaaatcttatttttggggtcaaaatcttagttttagcctcgtttgtcctttttttgaaaaaaaaacttggccactctggtgtaaaatccaaaacccaccaaatctcgcgcttcacttccggcccaatttgcggttcgtcgatttcggcatcgaatttggccttcagctgctccaactcttttcgcttgttctcaatttcctggtggccaagtgcgactgaaaaagggcaacgtcggtttctttaattgaacaaatgttgccgatttgttaaggcatcgaaatattttcaagggcttctcagagtcactgattaatagagatcaggcgggacttcacgtaatgattgtgatacaggtatatttgcaaagtcccataatgataataagagagattttttctgaaattttaattaggaattttttgagtttagagagaaagttccgtctcattgtcagtgtatatgaagtcccgcctatctctaaatatgtgatattaatttgtcattcctaatcaatacgaatccctgaaccaatttggatccgttaaaggtaaagcccatattcatgaccagtgatccggaaactctacagaaggcattggcattataaccgaattcattcaaaaaaaaggggggaacacaaattgcagtctcataaattcactcttccccctcctccccccccccccccaccaaaacaactcactctccgacttgaactcgtcgatttgcttccgcatcttctgcttgaagtcctccatgttcccgtagcggtcctaaaatgagaaagttttttgcattccgtcgatggccccgtcggaacaacttcgtctttgatggtcacacggcccagaatttgcaacgccattttgaatttgtcattgcgttttgaggccgccttgttgaaggtttgcatggaggagaggagttccgattttttcttgtcgaattcggcgttggaccttgggaatgggaatttaacattttaaatgtaccaaattggcggtagtaaacacagagaaatgggacggaattcagacaatttttggttagaaattcgcaatttttgatgcccggaaatccatccatcccataaattttgcattttttgtgctccttactcttcgagtgccttctcatggcattcgagcgattccttcagttggcgcagtttgtgctgttggattccctcctccgtacgcacttccgtcaacaaattctgttctgaaaaaatacatggcaaattcgtctgaattcgaattatggcccctaatttttttttggggggggggggggggttacgacaaattattcgaaaattcgcaatacgaagcctaaaaaatttggacccagcggagtgaaaccgaaccaaccgtcactgagctgtttctgtttttccgcattgtccgcttcaatttcattcagttccttttgcaactgttcaatctctgcgcaaatttttcgtttttattaaaatgaatttttaaaaattaatttacctgcgtccaatagttttttcctttcctggagttgatttgtcatattttggaatttgtagagtaaaaaattgataatttttcctggcaatgaaattgagaatcagaacaaattttatttgacgactattaaaaaagtgatggggatgtgaaaagcggtaggggacggttcggtgccagcccaagttttggactacaacttttttcattgttaaccaaatctaataatcttggtatcattcgaaagctttatatgtttagaagctttttctaacctattgcttagcgataagacaattaccaaaaaagttataacagaaataacaaa

SEQ ID NO: 18870 - DNA, 2022 bp, Heterodera glycines
cggcacacttaatcattttcccattacctccgcttcctttcgcagtttggccacttccgcctccatgtgcacaattttgtgctggtcaatgttggcctgtgttcggatgcgttgcaattccaactcggcattcattcgcatttccgtctccttttgcttctcggcacgcatatagccaatgatcacattcatccggtcactgtgctgctgctgttgttgctcggccatataactaaaaaaacaccaaattttaaatttttagttccgcaattcggaaaataaaaaaaacttacgagccctggttgaccgtggttgacaaacgcctgaaaatagattgaaagagtaaatttttttctaattttcgtttaatcaattttgttccgtttttctgggttattgaatggaaaagttaaattttgcttaaaatatccaattaaatcaaatcaaatatcccaaacttacgatgtgttcggtgtgccagcaatgaatgatgcgttgagactgctgcttgatgtcggcgatgcaatggtttgattgaggcgttccatgaatgaattttgttggaccaactacagaattttttgaaaattttccaaataaaaaaaaaaaactgaccttttgaatttcgtccagatagaccccctgtttctgcacattctcctcgtcccgcttcatgaactccttgatctcgtcattcaaacgcaatttttcttgctccaaaatttgctaaaaggaatgaaaataaataaagttaaaaaatataagaatttacaaatgattgctggtgttgctcacgctcggcattcatcaaattgttggcgtccgcaagtctccgctcaaactcctcagttttggcaatttcgcgtgccaaatcggtggtcaggcgcaggttggcgtcggacagttccgtgaatttagccaagttctaaaaagagtcacgtgccttacaagttttcagaaaaatgcaatttagattggaatcacgaattgtgccgaactaactgacctgctcacagtcgagctgcaacttttcaatttcggcctggcattgtgccaccttgagctgcgcttcgtgtccagtcttctccagcgtcatttgctgctgttcgtattttgatcgttcgtcctccgatttgttgaccgtttcgctcagcgtcttggcctgctccaagaactccatttccttgctggcgagctcattgcgcagagcttcgattgttcggttactgaaaagagaatcggacatatttatttcaaaaaattagtatggaaagtctcaaaatgccaaattggacgcgaccactaacccaacctggatgcaaggtccttctcaagctgttcacgaactgcttgcatccgctggcgttcgatggttccatactgttgaaaaaaaaattaatttaattatataatattaatgtcaatttttgaagaatgggtggttgaaatgttaaaattcgacctcagagatggcatttcaattcatttggtctctcatgtaatttttaaaaaatttgtgagacctcaaaaagagcaaggatatcatcatcattgtcataattgtggggggaattcctgcagtttactggtcccgttttttttttgtaaaattctgggaaaacttttctagggctattttagggtactgagcatgaatccgaccttatttttgacaaattctgaaccccgaacccggaatcgaacatttttcaaacaaaaactttttttgcaaatattgcaataagcataattaataatgtgttttttatgagaaatcaatttctaacgccatattatattatagctagtgttccttatggtatgatcaaattttccgtcgccaacgctgtttttgttattgcattgaatgtttcttcgattcattctttggttcataagatttcataatatttgtttacgacttgattctatccgctcatctgacactgtatcgcttgttctcgtcttcatttttgaccacattgcccatattttccccgagactgcgtgatcactttgaaa

SEQ ID NO: 18871 - DNA, 877 bp, Heterodera glycines
aaactagaaaaaatttctagcgattttttgaatttttttggcttcccgtcgccctcgcttttcccttcactcacttctcattggtctgtctgtcgtcgttcacataggacagcgtttcctgcagtcgttcggcctttgaacgccacatgtacagctcgctctgcagcgtgtcaatgctctcccggcgtttctgcatttgttgcggcggttggtcgacagcgttggtcgttgttgctgccgaggacagcgacgatgcgtttgaatttgcgctgggcgccgtcaaccccgtggttgctggcgttgtgttgtcacccatcatctgctgctgttcgtacagctgtcggtactgctcgcgctgctcgctcagctcacggatgagcagctcctgcttagcatagttgtcacgcagcagtcgcaaatcatcctgacaacaaaaaaacggggctgaacaaattaatttctaaaatatcccgtttttatacacaaatttggggtgcaattcaccccccccccctctccgaaatttctttaacaaatttttttcggtgattttgtaggggtttttttttttgaaaaatagtaacccattataaaacttgaattggtttttcacgataaaatcgcttttcattacaaatatgaaccatttatgcaaaattatatgtataatgaacctgtgattggtgattggcttgcttcagtgactcaattctaaaacaaaatatgggaaatttagtgatgaaaaaaggggcgattcatttttagatttactcggtgttgtgataattggcgatgattttgtcctggttctcctgcattcgctccaatgcctccgacaattcaatgtttttggtgtgcaattcacgaaatgttgttg

SEQ ID NO: 18872 - DNA, 1569 bp, Heterodera glycines
atatgcattgtttcgcggatttcgcgatgcattttgcaaatgggcgtgtcgtcagcttatcaggcaaagatggaatgtgcgcccatatgtattcctgaatgacatatggaactgcgtccaggtctgtttgcgccacaatgtgggcatgtgggcctcctcggccttgaaactccatggattcaccgtaaccaaggattgttccaaagaactttttctcataaagttcttctcggaactcagcgatttttgctggtccaaacacgcatccacatgtcaaaacggtcagtaaatacttgaccgtttttatatatattctctttgaactcaggccattccctgttgttcgtgaatgtgatgaagagacgcgcctttttcgcgtcatgacaccgtgcaaaaacggtgttgcaatcctcatacattttcttccaatattggagagaatttacgttgtgttcggaaagccgaacaacactgccaatgtcatcaacagttttctgttgggcattggggttttgccgtgcctgctgcctgttgtattggttgaccaaatactgcagcagattttttggagtgctgatccgcaggtccatgtcaggtctacgcaaaaatgttgcaatttgccaatcaatttttgcagcctggtcaaggatccagcgctgaccaagtcctccaccacatgaaaggatgtggtggtattgcaactccatattttcatcccttattgcgagataatacttgcaataatctcgcagggagataaattgtttggatttgtcaatccgccggtgctgcgatgaaacagatgctacagattcagcatctgaatttgcgactgacccagcatcagatgatgcaattgactgagtctcgcacgactcattatctgactcggcttccgagtgaaataggccagatgcattctgagcaccttttcgcttacgcgatggtggcttagcatatttaatgccagttgtgtatccatcatcgcccattggcttgattaatggatacgtaagactatcagtccacggactgaaaggagcaatttcatttaattgcccttgtttgttctctacccaaattcctttgggtggaggagcaccagtggggtccgcatgaatagcgaacatcccttcacccgtagaaggggtgattatttggtgtgggtgcaattttgggtctttcagaccagctggggccctgcgctcattcaacaaagtcatgcggaagaagcgaagctcttccggagtttgttgttggagtagctcactgagctgctcacgcgcctgcttatatgcttgcgcagcaggatgatgcacttggatcatttgttctaagatctcaagagtctgctcatttagctggtgaccctgcacaaactcatcttcgtttgtgattttctccccagtaaacctggggttgtttcgacgctgttccatagcctcgactgggtccagaatgtacaactggccaaagccaggaatctgagttgtaccagcctgcatgctgcttatgcggcgatggaattctccgttaagaataacggccatcggaccgccagcagggctt

SEQ ID NO: 18873 - DNA, 2082 bp, Heterodera glycines
cagcagatgtgacctcgttcgtacgacactatggtgaagacctgcaagtgtacctgtcgaccattgcgacggctaaagcgcttgagcagccgatgtcttcgaaaaatgtttttgctttgaaaaagaagcataaaacgcgaaagaattccgaatcgtcgaaagggagcagcgaatcgtcagcaagccagaagagccaccgatcgcaaccgaagtgttggcgttgcggaaaatggcactctcccaagcgttgttcgcatggcaagtccacctgcagaaagtgcaatgagactggacatttggagaggatgtgcgaccagcacaaggcttggcttaaaagaaatagggagaaaaaggatggaaaagccgtgaacacatttcggcttggaggattatttctgccggactcagaaagtcggagaaaactgatcgaggttctgttgaagatgaatggcactgaagtggaatttattgctgattttggcactgaaagaactgtggtcacgaaggacgcacaccgccaaatcggaagtccatggttgagccgttgcactgaacgggcaaaataccacgacggatccactcgccctcttttgggaaaagggcaggcaaagttctcgatcggtgatcgctcatgcgatggacaattctatgttgccaaaggaacaaagaatttgcttggcatagacatgcttcacagtttgggactgttggatagcttcaggaagagcctggaagggaatgtccaagtggcagaagcaaacacgaagtccgattcaactgatgctcaaagtgaaaacccgaagaagaaacaccacggaaataagccaaaatttgctttgggagcaaaggtcattgctagtttgggactgcaaccttggcgcgctggatacgtcgttaaccgtcaagggacgatgtacgaaatccgttttccagatggaacaaccggcaaattcccagaaaaaggtgtagaggcatgtgttttggactcggacgaagaaatttttgatggtttggacctaagagaggcaccatccgatggaaaaacgtcgaagggcttggtcggcattgattgtgaccagcgaaagcgtgaaaacgtgatcgcctgacagccgacgaaccgatgagccaccgccgaaggatgaagcggatggacggatcaattttttttaagggggaaggtgttaggccggtacccaaatgtccgcctcattttatttattttgtatgtttccctcgtcccccttatctctgtctctccctccgtccataaatagcccgctttttgaccttccctcgtcatttgtctcattcgcatcattttcccgcaattttgttatttcattttatttgctccataaatatcgacttatttgtttgccactcaacggcataacaagttctgattctctgttcatcttctatctctcgtataatgcactttgttcagttggttgcatcattagcagccggaccgggaaggtcgttgatctgtcatgtgttcagttcggtcggtcgtttgttcgtccgttgatgttgacgcccgggggtacaaagcaaagctccttcaattttcaaagataaagaaacataagtacagtcgaggataacaacaataaaatcacataatatttcataatctttggttgcaaaatgcaaaaacaaaaatgggcactttcattttgtggcctttggttcaagaaaattgcatcagcaacagaaaattgagaacgcaaaacataaattttgaaatgaaaagcaacaaaaaggaaaagctgcaaaagtctaaaaaaaagttcatcgaggccaaagaataagcgtggattttccaaagaaaattggtaatttgaattaaaaaattttatccgtcctaggtctcatctggtgcctattattaagacattacttttgccgcttgtaagggagtgaattgattatcccctggagaaagtgccaaattggcattttggtgtgtgccatctcgcaagcagctcacaaggattgctgctaattcccgtaaatctgttctgaatcccagatccgattgctctctggacacacgacagcctttctgactcaatgacg

SEQ ID NO: 18874 - DNA, 3281 bp, Heterodera glycines
tcccccaccctattaattacccctttaattaattgcccttttaccgctttctttttaattgccccccttttctgttacttaaggtgcgcccgagtcggaagtgcacaaatatttcggcactttgctcaaatcgatcgcaagtggacagaacagcaacactttggagatggccaacaaagtgtacgtgaagaaaggcatcagagtgaagaacgcgttcaaaaagaaaattgaggaaaactacggtggacggatggaaacggtggactttgaggacatcgaagggacggcggaggtgggaaattgttttattggcatagtgccaaacagttccgaaaatagaaaaatttcgagctaaaaaacgccggccctgctggaatattttccccattttatggtttttttttttgcaaaactaaaaggttttccccatgggtttttgataacggcaatttgcgatcattaaaaaaagctttccacaaattggacagcctttttttgcctttcagataatcaaccattttcgtgaaaagaaacgacccaacaaaaaaaatccacgaattttgtcacccccccgacccactttgaccaaaaaacctcggtaaaagggcaaaaggaaccgcccctattcaccctttttttttaaaaaaaaaacccaaattttttttttcaaatttaccccctcaaaaaaaattttggggaaaaaatggggaaattttttcaaaaagggggagaaaaattaaaaattttttaaattttttttgaggtgtgggggggtgaaaaaaccgccccttcttcttaaaaggggggtgggggggggaaaaaattctaaaaaaaaaaattccccccaaaaagaggggtttttttttttggggggcccgaacacccaaaaaaaaaagggggggggggagaaacaccccctttttttttaatttttgaaaaaaaaaaataaaaatggggtttttttttttttttttgttgggggggggcgggccccccccccaaaaattcccccgcccccctctttttctaaaatttttttttctccaacgcgagaaaaaaatttttttttaaaaaaaatatttttttttttttttttaaaaaaaaaaaaaaaaaaaaaaaaaatttttttggtgggggggaaggagaaaagaaaaaaaaaagagagacgcggtggtttgtgtttttgtttgtcggccttcccctcccccttccaaaaaacaaaaaaaaaaggagtgtgtgttgttgtttggttgtttttgggtgggggcggcgggcgggggggggggggggggaaagaaaaaaaaaaaaaaaaaaaaaaataaatataatttattttttttttttttttttttttttttttttttttttttttttttttcttttctctctcctcttttttccaatccaacaaaaaaaaaaaaaaaaaaaaaagaggggggggggggggggggggggggcggccgcccccccccccccccccccccccccccccccccttctttctttttattttgttaacagatttcgtttaaaagtgacccaatttacaattttgatttttaaaagagatataaaagatagaggtcatccggcggtgccaataggcgctgccgggaaaatttcaacaattttgaatgaaatttgcgatgaaaaatgagttaggtaattaaatttattatttaatttattcaaaaatatttggcattctgtatttgaaaaattttcaaaaatgcaacgcggatccctcgagatcccgcacaaaaaaatcaaatttgcgggtcccgctgcgggataaaatattttaacaattaaaaagaaatatattaattaaattttaatattttaagtaataaataaacgaaaaaagtaaaaaatattttttatattgataaattaacacctgcacaaataaaggacaatcgcatttgatccagcagaagcattcaacaaaatgccagaaatagaaccaacttgccaagctcgaattgggggccttaagaaatttgaaaaatttaaaattcaaattaatttaaaataccccaaaattgagccaaatgcatacagcaattgatatatggccaaattggtcagatatccgccaatattaatggacaaaatgatgatcaatgaccgtaaaactcgtgtgttcgtctgttgggttactgtaaaaaatattttgaattttaaaatgccaaagaaatgaatgccaagatttaccggcatttttgcatctgatgatcacaaaaatggacacataacagcaagtgctacccaatgaaataatgaatgtgccggcgaagaatttataaccaacggggcccagcaaagtttcggccacaacaccggtggttggactgaataaatttaaaattattaattaattttaatttttgatttaattgcgccatactttcccgcattttcgaatgcaaatgcgagcacataattcagtgtaaatgcaccgtaaattacacaaattaacagatggccaagcaaatatgagaatttgtatttagtgaaaatggaggagtgtctaaaatgaacagtccaaataaataaacaattaagtattgttaggataattagggtttgtggcagctaattaaatgagataaattttttaattcgtttccatccgtacttaaatggcaatgcaacagcaaaaagtcggtcaaaagcagcacaaaacattgccattaagccacaattcacagcaaaaatcattggctaaaaattgaaaaattaaatcaaaataaaaataatttgaaattcagaatttaccgtcataattaagtcagcagtgagcaaactgacaaaatttgtgcccaaaatgacaacaaccacaaaaaaagtgtgccacaatttatagcaaaaattggaggctgaaaaataggaaataaaaaaaaaatttgaaattttaaaatataccgtcataattaagtcagcagtgagtaaactgacaaaatttgtgcccaaaatgacaacaaccaggaaaaaagtgtgcccaatttggtggaccaattcacaaaggcaaatcaatgccatcagaaaattggctgagccgcggagggaactgaaaaatgagaaattgaattaaattggtaaacagaaattaattaaattgatttaaatttagaaatgccctggcatttgcctggatttgacagtgaccaccaaaactgtgccgttcaacacaatgccaaccaacgcaaccaaatacaccgcaacggccggcacaatcaagtcggcggacggaccggcgaaacggtaggccaaataaa

SEQ ID NO: 18875 - DNA, 2334 bp, Heterodera glycines
  misc_feature (18)..(18): n is a, c, g, or t
  misc_feature (32)..(32): n is a, c, g, or t
cgccgaaacacgagcgcngaaacgggagcgcngaaacgcgtgggtcccacccatagtgccagtgcaaataagtttgttatttatttagtaatcagaacgccaaaactttgcaaaatctaaaatttttttgtgattttcccttgtaaaaatgcaagagccgatctcgagttagaaaagaaatttttcaaaaaacaaaagagaatttgatagagaaggccaaaaaactagcctaggcaaaatttaaacaaaatcccaactgtggaaaaatttttccaactgggcgaaagttttgaaagatttatatcttttccagctaaaataaatttaaatgttaaatcaaatgaaacttcaaaaattcttcagaattttctacagtagccagttcgtacattaaaaattgttgtgtccgcaacaacagatatgaagaaaagacaaatatttatttggaggaaaaataatataataaataagtcaagggaagggaaaattgcaaataagaaaatgaatgacagaatgaacgagggagtgagggaaggcatcgcttatatgtgggaaggaatgtgcctaagggaaatgagtgaacaaagttcactccacttattgattggtcacaacaccacaaaaataattacaaaataaagcataagactaagcttaggcctaagcccaagcaagttcacacagcggcccaattttgggctccaagtacaattatgctggatttttcgtcttagtggtctgtgagttagtcatcaaaaagggggtctcaggttcaaatcctccttgtgtttgtgtataaatttcaattttttaaagcaaataaataaaatattaataaaacagaacgccaaaagaacaaatacaaatagtggaaggtagacattatattttacccttgattttattaaatttttttagcttataactttgtcaataatagaccaaataaaaccattttatgctcattttgaagggaaaattctgaagaatatttcttaattagtcaaaagtttaaaaaaatcgtttatcgacaaaaaaatgaaccacgtgttattttatatcgttagagacatcggaaatagtgcgtcaaaatgagagaaaaagaaaaaacttcgccctcggaaaaaaatttttcccgttggtattttttctcgaaattttgcataaacacatattttaacccaacctataagatgatgctttgttttttatcaaatgctttttaactcgagatcggctcttccgtttttacaagggaaaatccccataaaatttttaagttttgcaaagttttggcgttctgattactaaataaaaatccagcataattgtacttggagcccaaaatggggccgctggtgttcaagcttaggcctaagcctaggcacaagcataagcttaaaattgaaaaaaggcatgaaaaaggcacgaaaatcccgaaaaaggcatataaaagtcaacgtagaaagcttcaaaccaagtggaaaatgtgtttttatgcttaatatattagaactaatggcgtagaaaaaaagtttatgcctgaaaatggcgagctctatttaacctgggacccttttttggtgactaactcacagaccaccaaaaagaaaaatcctgcttaattgtacttttactcacccgatcatgttttttgccagactttataattggttgggattttgttggtaaatgtttttttttcaattttttgtgccaacctttgtaataggaattgtgtccggcaccaattggctgctgggtgatggtgggaaagtgcacacgccggtatcgaatccttcttgaaatttgtttagcatttagggagtgcttttttaattagcgttaaaatggttggaaaaatttgtgccgtcggccccgttttttaattttatttgtgtctcgaacatttcgagttttctagtgaccacgaattctacatttatttcgtaaatttcgagctccaccggagcccccgaaccaaaacaagaagccggaatcaaattttcctaagcatttcatcaaagagagaaaaaaactttttagcatttgttgaattaccctttttgggttttctaattttaaatttccaattatccatgtattttttttttgtatacaattcaaaattaaggaaatttcggcaaaatgccagaatagatccgtccaaaagagttgataaaaaaaatagctcaagtacagtttatgcgttcaatcgacttttgtgcgtccaatcaattagtttcatccggtggtcatgtttcggataactctctatttcggttgacctgctgtgggatgacacggcttaatcagtgacaaaatcggatattt

SEQ ID NO: 18876 - DNA, 801 bp, Heterodera glycines
  misc_feature (18)..(18): n is a, c, g, or t
cttgagccaaaaaaattncctaagtgtataaatgtgagctcaatttttaattaccctcatccaatcgtcgtcgatgcctttctgttaaattgcttttcggtattttggtcgttttgctaattgccgcggttggcagacgttgtaattgtccaatctgatcaggattgatcaccaattcggcggcacaattcatgtgatcatccgttttggtacaattggacaagtcctgaacactcgaaaacatttaaatccaattacaatttttttttgaaaacttcttgcccattttctaaaaatcgttgggtatctaatatttttgcaaaaagccgcttctaaattgtcccaaatccctttgaatctaattttaatgaaaatccagtccaattttccaaaaatcttcaatcatttcagtttttgacgccctattctccagtgttacccttatccaattttccctgaactgcttcaacttcttcttcttcttcacctgttcgcccaacagttggagtgtgctcgtgtcgttgtccatccgtgcccaaatggacacgtccctacagtcgtcgtccaccaccatctcgttgacgctcagctcgcaattgaaaccgctgccattggtcgcctcgcggcacgccaaattttctggcgcaattggcaaaaagttgttgttgtgctcttcaaaacaaatgcaattatagaaaggcgggaggggatgattaatttaaatatggagaaaattaattatctttattttaaataaatttttgtttttttttttttttttaaaaaaaaaaaattattttt

SEQ ID NO: 18877 - DNA, 2336 bp, Heterodera glycines
  misc_feature (2286)..(2288): n is a, c, g, or t
atgttttcaaattttttccagcggccctgaggcttcttaggagcttttaaaaaaaaatcgaaaatgcatttctcatcaaaataaaactgcagaaaaaaaaaacttacgaatccgcaccctaataatatacaaaaagtttatgaataataaaatagtataataaagccaaatagaatgaattataaattgttgccattatttttaaaaaactgatataaaaactaaattcctaaaaagtgattttaaaaatgttaacaaactcttattgcaggcaacacatcattttcaacttgaagctggaaattatgtgattataccatcaacgtttggaagaaatgaagaaggggagtttttattgcgcatttttacgacagggactattggaatgtagtaagtttttgagtccgagtattttcaaaaatattctccataatgtagtttaattaaatttcttccgtttgaatggtcggcgtcagggatggcattcagaggccccaaaattttctgtaatcggaatcccgggacccaaaaattgttggaaattgaaattctgaccccaaaaagtcggaaattttgaataaaatatcatcaaaaatttaaaagtgaaaggtgatgtcaaaaaatttaggttttttacttaaaaaaatattctgctttttatcagaatctttttcaaattgtggcaggggacccggcggtgccgataggcgccgccgggaaattctgaaattttgcatgcatttgttaagattttgtcaaaaatgaccgaatttttatttgaaagccaaatgaagcagaaattacatacaaaaaactaattgtgtctctattttaaataaatcattttggtttggcaaaaaaaaaaaattcctactttttatcataaatttcagtaacccaaattccggtcaaaaaactttggaaatactgaattcattgccatccctgctggtcagcgtgaccaaatacgaaatggggtattagttttaaaaaagcaacaaaactgcttttggtaatggcagggtaatatgtgtggaggtggaaaagtacaaggggtaaatatattaatctttctcattaaaaaaagtaaaaataaaattcgtaaaaaattcacttttttctcgaaaatttcggaacggagttcggtatgacaaattactttggtatcatgcaacgtgctaggtcgtttcgtaaaatccgccatttttgcaattttttcgacaaaacattgtataacattgcttaaaatcaatcaaattttatatgtaccatgcgatagctaagctttttctctattagcctgcaaaatttcaaacaaaattatgaaatttataccaagttatggcagaaatgtacttattttaatacaactttttctatagttgacaaaattttttaaaattttgcaggctaatagagaaaaagcttggctatcgaatggtaccaagaaggtaaaatttggttgattttaagcaaagttataccatgtttaaaatggcggattttacgaaaagctcaaggtggcggattttacgaaacaacctgacctagcaccgtcaaattcgatgttaaggtgggttcgcaaaaatttcggttaaaccccacaccttttcacgtatttttaaaccagggcttccatcgaaaatttttcaaaataaaacaccaagcccaaaataagattttagtatcaaaaatttttctaatcagttatttttccaatttattcgatcaaattttatttttttagtctcctattatcaattttgataattttggggaggaaaatgcaaaattataaatttcagtaaattcgggattaaaagatcaaaaaaaaaatttgcggcagatcattaaatttcttgaaaaataatgactagggtgtaaaattatatgcatataaaatcgtaaaatatgcgcataaaatatgcaccaaaaatcgcgaaatatgcacataaaaagtgaaaaatatgcacataaaattttccaaattaagcgtaaaatctctcaaaatttcttccaattcgttaaatttaagctaaaataactaaatatggtataaaaaatcattttttaagaaaaaatacaaaataaagcatttatttattaattttggcgaaaattgaataaaaatcgaaaatttccgttttttaacttatttttgaaataaattaacaaattttaagaaaatttaaatttaatcattatttcgacaaaattttgctaaaaaatgtctttttcggaaattttttcggtctttaggagtcaaaaaggctaatttactcatgnnngcgttttaaatagggggtttttgggaaaatgcccaatatgcacataaa

SEQ ID NO: 18878 - DNA, 1572 bp, Heterodera glycines
cgttctcaccgtcgccgtcaaactgctcttcctgcgccgtcatccaaaagtctctttgtgttcgcctcgcaaaagtgcctttttggccgtatttgtttggggctgcgagtggtttgaacgggctgacggcacgtgaataccggcacttttgagagaaatggacaccaaaattgagccatagcagacgacgatgaccagcagagggatgaagtagaccggaaaagagggggagagaaattgtgagagagaggggaaagagagagacaaggaaaagggaggagagaggggagagaaagagagagagcggacctgtacaatgttaagcacggaaaaccaatagacaactgaaggcgacaccattccgatgacatctgccgacacacactgagtgaagtgaacaaagcacggatgatgagcttaagcggaaagaaagtcggaaagggaagaggaaaagaaacggacgaatcgaaccagtgcggaagatgtagatctgaaagggcggacattaattagcaacgaattggggggggggcgaacttgagggatgctgctcaaaaagctgacaagcctaagaggggcagcaaaatggaaaaagacgacgcaaaaggggagggatcaccaggcaacggagagcatccactggacactccgtttggcattgatcacgtaaagagggaacagaatggagtagaacctgaaaatgacgggaggcactgaatgaggggggggaaagggtggccaatcggttgggtttggcattggcacctgtccatgctcagacaaatcaaaatgccggcagaaagtgttacgccgaagacatcgaagaatttacagaatcggcacaactgttaaaacggggagagcacatcagaaattgcattcacctcaccaacactcacaaagtcgccccagagccacgcgatggtcaaattgtgcacaatttctttggggatatataccaaagtcactgaacggagggaattgacagaaaaattggaaatgaaaatggaaatggacgacaattagccaaaacaaattgggacgaaccgagaagctgagcaattgtcatgtggaagagaatggtattcactcgtcgttttttgatgcattggtttctgaacatggattatttattcggtaaaaagcagaatagtctgatcagatgagttcgtctggtcagttgttctctatgcttctctaaaagccattaatttacctgattaacacagcaatcaccaaaagattgccaaacaaagcgatcacaaaaaccttttttgaaaaataaaaaatgattctctgtgtcattctctgagtaagaaatgaattaatttggcactttcattttccccgcccctccacaaataattgcatagttaaaacggacaatggaataacaaatggccacgcttccgttgtgtgtccaacgaaaaatcatttgcggaggaattggggcgtcgccagagcaattcatcgctgggggagaaatgtgaagggaagacgaataagtcattaattagtacggtaactcgggaggttcactaaagggatggtggttaattggtttggcctttg

SEQ ID NO: 18879 - DNA, 1146 bp, Heterodera glycines
  misc_feature (1028)..(1029): n is a, c, g, or t
  misc_feature (1082)..(1083): n is a, c, g, or t
gggagggcgaaggcgccgggggggcacaaagtcaaagtcaaaatgccgttttgccgtgccacttcaatccgactgctaaaattcagcccttctccattcattttttccttaaaagaacaaattgcaaattgaaagaaaatggagagacaaaggaggaggtgaggtgcaattacgacaaaaagagggaaagaaaaaaagccttggaattatttggcttaaattgaaaataaaatcgacaaatgatctcgaaactgtcgtcgctttttattcaaagttccaaagtaattcttgttctcccccggcctctttttgtgcttattccctcgcctcaccgccccatttggcatccaaatgatgacctcattcatccttttgggccctgaaattcgggcattaatcttattgccggggctttccctttatgcatggtccatttgggtcgtccatcgatgagtaacaaaagggagcaaatggaatgaagattcgatagcatccgctcgaatatggcccgaaattcctcttttggtagttaagtggcaaaatgggaaaatgaaatttgggggggggggagatagagagagagagaattgagttaaacggacggaggggggcgaatgacagatccgacagaggaagaggaggaaaagcgaccatatttatttggaacatctgctgctgttcaacggctacaaacttttattttcgaattcgatgattcaaagaaaaaaataaaataaagccaatgaaagacgaaagatgacgaaatagtggggaacagagagagacaatgccaaagagttaaacaagccgaaattgctgctgaccgatggtttttccaaatttgcacccctcccctttcaattttccatccctccgaattctctccccctccaaattgcccatcattatttccgatcactctccgtttgaagtgtctcttttccccatttggccggtccatgcatcagcagcagtgcgttggccagtcggctgttagtccgggcatccttcactctcgagaggggggnnggaggaggagaattatgcacaaaaggacaacgatcggacggaggagaggcttnncacacgacagcagcagcaacaacagaaacgacaaattgtggccactgtcgtccaattggtcgt

SEQ ID NO: 18880 - DNA, 770 bp, Heterodera glycines
cgcggggggggggtggaaggcccaccacgaggccgcgaagcggccgagtgagtaccttcggtgcaggaaaattattaaggaagagagttcattatttatttgttttttgcataattaattcataaatatttttttcagaaactgctctgaaacgcaccaaattttatttgcaagttattttaggcactcagatgctttcactatcaaaaagggagatgaataaaaaatctaaaaatttttaattgctttttaaatatgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattttttgcaaaattaat

SEQ ID NO: 18881 - DNA, 1019 bp, Heterodera glycines
taggcttactctgtgtcggttttgtgtgggtcgtcgctcggacttagcgaatcccttgcaatcggtctgaagtattcgataactgagttttttcgtcgaaccatcttcagagtatccgtttcttccgcttttttttccaaatcctcgcaggacgaagagcgtatttcctctgcttcggaagaactcgtcgaatgcgtcgtccgtgccaatccgctgtcctcggaatcgtcggttcggactgcgggagaggtgttgccgccgcaggaggacgagtccgaaacggaatgaccgcgcgtgaccgtctctttgtcagccccggcaatgacgacttccctttcgctcgcttggcccgtcaatttcttaaaatttccatttgagtaccctcttataagcgatagaaaagacaccttaacaaaagagcccaaatttagacgaaaattgaagtctccaaaaaggaagcaattgctctcgccctctaaagtgcctccgttaaacccctcaaatctgtgcagcgtatgttccaatgccttttgccgattggcgctgtattcgtttgggttcttaaaaaggcattaatcagaattctaattatagcaattaaaaagaaatgtcacttcaataaaattgagattagactcgtcatggaacaagtgaatgttgataaagtcgaagactctgacaaaagttacaattcggaaatttaggaataaggttttgaggtttgttttgagtttaagtaatttttgacttgcctcgcgccaattttccaacgcgtgtgaagaaaacctttgcgagcccatcgaaacgaaggccaaaaacaatgtgagaatttctctttgcgtataaatccaattttgttcagaccattgacaattgttacacttttttgtgcaatcgaacaaaatttttggcgttgaaaattatacaagaaagtgtaaatcacagctgaatgatggacaaaaacagcgaagaaagagcctaaaaaaccaaacttgaaaagactgagaagttaaccgact

SEQ ID NO: 18882 - DNA, 2144 bp, Heterodera glycines
tccagcagccaattcgagacgaaatgatgctccagctgctgtcgcatttgttcagagtccggcatcgtcttccacagttgctcaagtcgccgccacacggagtgcagtgcctcatctcctgaaaatcacaacatttaaaattgaactcaaaaaatgatatggtcccaccctgctcatgcaaaagccccaaaaatcggtgttggcgcgcaaatggaacaaagtggtgaagcagcaaatgggcctttgtcttttttgaaagaagggttcgcaccattggttgttcgtcgagaaatgccttgaactgctcaactgctgttccagtccgtccaaatcacctggggacaatagctgggccttaaattaaaaaatatttacacaaaaaatgaagacaatcactttggtgaaaatttggattttccccaaatgtgccatcgtttggcaaattgttttgccccattccgtctcgaaaagggcctccatttgatcggcgtggacgaggattttccggatgctgttccccgtcatgtctcgctttctgaacgcttccctccttggccctatccgtctgaagaatttctgggcgacttcggcattttctcccgcttccaactccttgatcagagcattttccgaggccttggaagacatggaacggagccaacagcatctgctcaacattgatggacggcagcaatggtgcacaaacaatggccgtaaaatcgccttcatccgcttgtacgccttctgtattccaagttgagcgagcagcaaaagcccatcctcagcgtccatcccctccttccgctccttgcccttctttggcgtgtagtgcgcgaatttgtgccggatatctcggtggatccggtacagagatgcgcggctcgcggaacgtgagcgatcacgatcgatgcaaatcgccgattggtgtgacagatgtcgacggcagtgaaaagccaaattccaaaatttcctcgtccatttccggcgtcggcactggtcctggagttgatggcagcggttccatcgcttcttcgacggatgcagcagatgttgacggccctgcttcgtcctgcggtggcatttcggcattgggattcggctgtggagcggttggaatacaaaaaaaaatatttttaagtaaaaaatggtgaaaaaattacttctcttggccaaataggcttgtctcgccttgaccgtttgcgcttgtcgctcctctcgcttgttccagcgcttttttacagattctctgccgattagcttacttaataattttcttttgccataaatacttaaagaatctatatttttatttattagcacaaaaaaaactctaattcgacctattttaatattaacttgacctattaaccgatgcagaattttttctctatcgatttgcaatatttggtgtggatttaacaagcaggaaaaaagttaaacaggatgaagtgaatgttgtttttcctaataacaaaaatattagatagtacgccaaaaggagacaaaaaattagagaaaaaaagtaatgtttttctctggcactctctatttattggtacacatctcgttttttcggacggtgtgttaacagattttcaccaaaaaattacttttttgcgattttgagatgcgaccatttttacattcaaaaggctttttttgcggcatttttcaaaaaaactttttttaggcggggggagtccggcggtgccggcaggcgcccggaaaatttttttataatttttattgcgacttttttgttaaaaaatatgttcaaaatttaataatttttcctcttgggggggggaaggcaactcgacagattttgttggatagaataaaactaatctgcgtatatccataaaacagtgatttttgtgattttatataaaaaacagaaattttccccatttttagcattcgctgtatatttgaatttaaattatttaaagtaaattcatttgaacgatcttaaatggtttccccatcaactgtgtgcggcaagtgttgtgcgtccttataaacataattattagaaaaaataataacaagagaaaaacatgataaaaaacaagtgatgatcattagggcaatgatttaattcttcttaagaattcctgctgtttccatagaatagtaatttt

SEQ ID NO: 18883 - DNA, 2644 bp, Heterodera glycines
tctctgtctctcgtccctattgttcgtccttcctcctcctcgggagtgcgcacctccgtcccttcccgtcccattgtttcctcgggagtgcccttctccgtcttcctcggtcggcttcttccatttgtccctccgcctccactgttgcggtttcggatccgctgcttcttccattcccttcttccgtttcgatcccttcagaatgctcttcggcgacattcccagcaattctttgtctccgccatgcttcaacggttgatacgcctccccttcctcttcctcctctctctcttcctcctcctttttctgttgtactatcattggtctcctttctctctttctttctactcctctcccccctctgtctgtctgtttctttggcgtctcttctccactcagttccggttccgtgtccctcacttccttctctttttccttcctcttccccccggggtgtctcttcttctcttttctctttgtcggctctttctttctctcctcctttttcctctttgtcattcctctccgtttgtacggcttcatcagcttcttcttcttttccctcttcttcattttcctcccgttgtttggctttttctttttgctgtgcctttccttctccgttcgcctttttctgccttttgtcccccgttttctgtgccttttttgaatttgtatcctcctaattcttctgattatcaccggcagcggcggatggtaaattggaatcatttgcattggcattggtaccaatcgcactcgtctcagttttttgcccttaatcccctttaatgtattaacgctaatgcgccgaagtcgcattttccgtgcccgaattggccgattagttttggtgccaaaatgtgccgatttcgtcggcatcgcatgcgaatgggacactaattttttcaagtgcactttcttaagtgatgccacggccattggcggcgggggaaaggagctcaatttggaagagacaaaaggcactaaaaagggagacaaaagcattttatacgaaaaacaaaaataccaaaaaagaggaaaattaagaaaatggagttgaaagtgacgacaatgacgagaccaatgtgaagggggaggggtcgagaagagggggaaaagcttttcataatggagacgacgaaaggcgaattaccaccggagaaagggcggtcatttcgcagaaaaaagttgaaaaatcaaaagacggtttactctgatcactttgaaactgacttgattgaatgagtgtctctaaaaaggcaaaaaaaaatattttattaaaatacgaaatggcaatgaattgtgaaattaatcaattggaaaagcagagaaaaatgccaatacataaaaaatcagagaaaaatcgatggaaatgtcgatggatacaatctatgctagcaaaaaaacagcacaaaaaatgtttgccaaaatggcattttaaaccaataaacagcatttacagaagagtgccattactcagagatgggaataacttagtccgtttactgtatacttatttgctgttccatcactcgtcctttattctgtgcccacttttcttttctttttcttcgtccgccgttggctaagcaggcgacgcaaatgccaaaatgattctttacattcaattaggtgttaattaccaaattttcaagaacttacgaattttctcgctttattttgcaaatctaaatgcttttgcttagccttttcttcttcccccccccctcccccactaagtcttggttgaagtaattttttgctgcaaagtctccggccccaacaacggtctcaaaatccacgccaaaatgtttctctgcatttcgttgagttgacaccgctacctgtgaagaaaaagaacagtttgcgcttatttcaattggtttcacttgatggatgttgcaccgcttccatttccctcccctcgacctactgatgttacggtaagtgttgtccttaatccgtttaattactcgagagtctcgactcgatcttttttatggtaattctcgagcttaatttaccattaaattttccaattccttgttacaacacatgaacccgtccttgttcaggtagcaggtcggcaccggaaaagctgttacaatataacttttggcaattattgtgctaataaccacaaaagaacgaaatgctaaagaatgtttgctaattgcccaccattttccaccgctgcgcactccccagcagcacatcctccgtaactcgtctctctgagcggaggttggggtggaggatattgtggcccgacttggaccaccgccggtggcggataggcaggcaacgcgggtgtcctcgctggcggaccgtaaagaggcgccgattggggagagggagccggtcctccggcagaataagctgaaccaatgtttaaaatggcaacaattagccattttgaccattttgttgcccatggacgcgagggaaaagcgatgagaggagaaggaggaccaccaattcaatagaacaaaaaagcaaagacggaaagtgttggtggaaaatgcaaagcatcggtggagagattatgggataagcaaaaatgaataacaatcagcagagagaagaagcgcaattggtgatacaagaagaaaagaaaaagccgatggacgcggaaggaatg

SEQ ID NO: 18884 - DNA, 2550 bp, Heterodera glycines
agggaacaaatgtgaaattgaacgcatggttatatggccagacataaattttatttttgcagtgtcaggatagtttaattcatttttgtaaatgtctacaattttggccacagaccataatgaacgaggggtttctggaacatggactaaaaccaattctcctatttttggggaacgttgggaggaaatttttaattttttatccttttcacgaagtgataacagataatcccatttccacttcgaataaaataattgggtaagggtgctaattgagccccacatgtcagataagaatttttggggcaatagaatgaatttgttctttccgtttcaaaatggcgcgtaatttttcttttaaagaatcagtgttccatgtatcatctgattctttggcaataaatatttcatctaggataaaacgggggaggcgttcttcaatggccatttggaaattaacggtgtcatatggaaggcttttctggcccatttgaatacatatggattcaaattggtcaatgagggagcgcaaatcagtacaaaaattttcaccgccgcgcacatgcggcaattttctcaataaattgtgtaatgcgcgggcaatttcctcggtattatcgtaatttttgattaataagtctagagcagaattataagaaaggtcggaaacggggagagaattgacaagagcgagaggtgggcctgacaaacattgtttcagatatgcgaatttaatagagtcgggaatgggcaaatcatggacaccaattttaaaggaagtgacaaaatttcgccagaggcggactggacggaccagactttggaatttccaaagaaggaagaagcagtcgcacccatactggaaagaattcgattaaacgacaccattctcagtcgagacggaattgaaaagctgaaaaacatcatccgacagaacgagagcgcttttgtgaaacctggagaagtcggactctttaaaggacaaacgatacaccgcatcgacctaatcgatggcgcacggccggtccaacagaggccctatcgttatcctgtcgcacttcaacccgaaatagagcgtcaagtcaaggagttgctgcgtcaaaatgtcattcgaccatccacttcggcatggtcatctccaattgtgcttgtccgaaagcctgatgcctcctatcgattttgtgttgactaccggaagctcaaccaattgacgaagcgatcgacatattatttaccgaggattcaatcgatccttgacgaagtctctgggaaaaaatatttctccgtggcggactgctcaagcggattttttcatattaaactggcgaaaggacacgaagaaaggagcgcattcatctgccacatgggactgttcgaatggctacgttgtcccttcggattggcgggagcaccaacaaccttccaacgagccatggaagaagtccgacaaatgtgctcagcgacatttcttgtgtatttggacgattgcataatcggctcaatgactgaagatgaacatcttcgggacatcaatacttttctaagaacgatgactgaagttggattcagactgaaaccagagaaatgaagatttgcattgatagagattcgctatttgggacatttaatttcggctaatggcgttcggatagatccaaaggatttggagccaattcacaaattgaggaaaccgaaaaatatcaccgaactccgatccttgattggaatgctgtcatattttcgaaaattcgtctacggatttgcagaaatactccaacccatttatgagttgacaaaaaatgaaagcacgacagaatggggaccaccacatgagaaagccttggaggaattgaagacaaagctgatgactgctccagttttggctccaccaaaattcggacaaccattcgttgtggaaacagatgccagcataaaagcaattgccggatgtcttctacaagaaaaccgtgaaggcgaagtccatccgatttgttacttcagccgagtgctaacaaaacatgaaaagcgctattcggtggtcgaattagaagccttagcaatttgtgcttccctcaagaattttcgaccatatttggaaggagctggaaaatcaacagtgatcacggacaattcggctttgacatcattattccggcggaaggacttggaagggcgactcagtcgataccaattggctatcatggcattcgatgttgaaatcattcatcgccctggaaagcggaaccaattttgtgaccatctttcacgatacttggacgacaacgacacacaaattaattggctgaaaattgaaccaaaaatttcacaaagtgaaatgcgcgaggctcaaaaacaagagacggacacacaaaagagacgggaaactttaaagaaggatcaaaattcagaggaaccaaatgaattctctggaaaatggaaaatacggaagatcttttgtgtgcaatggaccgaggcgaatggaaaatttatgtgcctaatagtctgaggcaaagagtgatgaaggaataccactctgaccctttcccaagg

SEQ ID NO: 18885 - DNA, 2947 bp, Heterodera glycines
  misc_feature (2867)..(2867): n is a, c, g, or t
ctcaatatacattttgagacgcaccaccattgggtgcaatggaaatacgtagaagctcactcattgctcttacgttgagggaaaacgcaatatacccctttgggttgcgtttgatccaagcgctacggctgcgctttagatttgcttttggcttagaggggatgaatcaccacaaataaatattatttcaaaacaaaattgatcggttaatcaatttttggtcgctttggcgacaataatagaaaaaactgagaatgaaattgttatgtcaaacataattataaatgaagacaatttgttacaattttcaaaatatagaaattgggaaaaaattattcgaacgatggcaattgttctaaaagtttcaaaatattggttaaagaaaattgggaaagtagcaatttcatcacatattagaaatatttcagaagaacaatttattaatccacaggatttcgaaaaagccgaaattttagtgattaaacaaggacaaatgaattggcaaaattatgccggaaaagaccaaattagaacatttattgataatgatgacctgatcagattagactcacgtattaaaaactgcgaaatgcaatattcgtttaaattcccgattgtttttccaaagggagcagcaattctcgagttattagcatggcgatcacacataaaagtcaaacacggaaaagttgatgcgactttaaatgaatttatgtccgagttttgggctccaaatattagagcaacaattaaaaaggttataaagatgtgtgtaaattgtaaaaagttgagtggcccagcattctcattaccaatcatgccatcacatccacaagaaagggtaaaaatttcccaaccatttaattcagtggcaatcgattatttgggaccctcattagtaaaaaatgaaggaaaaacaataaaattttggatagttttaatcacatgtttagttacaagagcagtttatcttgaacctgtcttagatttatctgcttactcatttttgcaaattttgagacgatttgcaagcagaagaggaacaccaaaaagaattatatccgataatgcacaaacattccgattatcagcaaaagttgcaggtgcatatgaagcaagaggaggaaaaggaaaagatgaattagaaaaatatttagttaaaaacaaaattatttggagatttatagctctagcaccatgggctaattctttggcagaacgattagtaaaagtttgtaaagatgcgtttaaagcatcacttggaaaaatggtattaaatttggatgagttgcgcacatttataactgaagtcgagtggactatgaataaccgaccaatcactcatgtatcaattgaaccggaaggcgaaagagccctccgtccgatcgattttataaacccaggattagaattaggaataaatttacaaaatgctgatgatgataaaaatgacgaagaatttactttagagccagaaaaattggaaaacaaattaaaaattcaatggaataaaacgaacaaagttttagaatgcttttggaaaagatggcaaaaagaatatttgaccatactaagagatcggacccaatggcaccacaaagggcctaaatcacaagaaaaaagagagccaaaagaaggcgaaattgttttaattgaagatgaattccatccgaggaatacttggaaaatggggaaaataatttgcctaaatggtcaaaagggatcaattagaagtgcgcaaataaaattagcatcaaaaggaaatgaaacaaaaggaagaataattgaaagaccagtaaataaactttactcattggaagtgaataaagcaattaatgaagaaactaaacccagtcaaaattctaaaagcgaaaaaagtcttgaagaaaataaaataatacaaaacaaaaatacgcatccaatggttacaagggcaaaaactcaaaaaacattcactctataagagaaaaatgtagcctgaaatgacgtttgctaaaaaaataagcgagcggttgctcatagcgggatgcggtttgcgcatccttccggcacttttcgattgcggatcgaatggtgtaaagcgttttttgaaattttcacgtaaaaaaaagtttcttcagaaaatttttgaaaattttcggaaaattttagaactgttcgcacaaaagggtccatatctcggcggggagtgccgaaaccggcttagcgatgttttggaggataaatgtcgacactcgggcggttcgaatgagctattaagcatctttctagcataaatttaaaattgagttttgctctggacacgaattaaaaatttttggaaaaatttttgcctcaagaattaggggggatacgcagggattctgaggggttgatgagtaattataaaaaaaaatttacactggaaatacttaaaatataatattattacgccctacgtgcatttgggcattacatgtcaaatactcaccaagatacttcatgggaaattgtgtccagaatccgaaaaaattcaattttgaaaattaggttaagtaataaaagtaatacatcagaaagtcttaaaacagtgtaaaaagatgtttgacgtttaaattttggatataacttcaagtctcaccaagatactgcatgtgcatcttggtatgtaaaataatcaacttttgaacaactcacgaacaactaatgaaccactgatgaacaactcctgcactactcttgcactactcttgcactaataaaaaatttaataattctgggggtgcaaatttttttggaattttaaagaattttttatactggaaatatttaaaatatagtgaaatacgccatatatacatttgggcattacatgtccaatactcacncagatacttgatgtgggatcgtgtccagaatccgaaaaattttttttataagaacaaagtatacatcagaaactcttaaa

SEQ ID NO: 18886 - DNA, 1413 bp, Heterodera glycines
tccttgggcccttcaccgacggacttggacactcattcctccctaggtcccggcagtgtggaggggatccacccaggaccctcatgtagaacataaaaggtaactcgcccggtgggactcgaacccacgaccccagcaatccgtgccgtgctctaaccaactgagctacgggcgcctcttttagaggttctctcaggtcctttatcccactttctcccacactccgttccttctggcatcacaaaggctttattgggtgtgtaaagtgcaaacattgggatgaaaacgagaaaaagaaatacaaaaagattcattgacgcgttgttcctcaatttgtcactcctattacataaactcggattgtacataattaagatttataccttcttggcaaataatgtaatgtaaattagaggccggaaggctctaatgcactttatgagtccaatcaattgacaatccctggtttttatacaataactttgttcatgttcgaacaaaccctatctttttggtatcattcgaaagcgcaaagtctaacgaagctaaaatatataaaatcgcagcgttcaggcaattacaaaaaaaagatttgattaattaagcacattgttgattattttggtttgtaactttcttgaaatgttagaatgggacaaattcgtttcccattttgatttgctgattttgagtgtcgcactcattttgttgtttggagaatgaagtgccagacaaatcattggcctcctgtttctaaaaatatagttaaaaatctgggtaatagttaaggtagtggtcggtccctgtttttagaaaaaaaaattaaaattattttcgagttgaagttgcttttgggctgttcacgattggataatcaaattatgacacaatcattctgaccacgaactcgaacaaaacaataaatcgaaaatgcaatttttaacaaaattcacagattactactaatttacacaatcattttactcacttggcaactatataaacccagcaaaaaattcgatttttgaggccttacatatcttttcggtttacagtacgggtggttcccttatttattattacaaaatcagtaaaaatgatgcgtacaatttcacaccgccgtcgattttgtatgtatgaaattgttttaaataaaacctcaatcttatcaatggtaaatccgcggccttttttgtcgcatttggatcatccgcagttgagttgaaactgggggtagtggtcccgtttggtatacaaattttttctgtaataattgtgaaaatgcgttcccaatcccgggatttttggggttctattgtgacgaagttgttttttacaccattccaaaaaggagaaaatagagagagagaaagagagcaaaaaaatcattttggcgttctatttgttatcatt

SEQ ID NO: 18887 - DNA, 1462 bp, Heterodera glycines
ttaataaatcgatttttttgaaaatgtaagatgcaaaatgaatatgtgccgctaatggtcaaatgcgtacggcggagtggacagcacaaacagaggaggaggagcggggagaagagagatgaatcaatcacaggccagcggatggagagtattcggcgtttgactacccccccccccctccccccgccgataaattagcaacaaattggggagaagatgaatggaaaattatggcaatgtcagctgggtagggaagcaggtggaagagctgtttttgtgggggacgccggactgtggggggggggggtaattcaatggctttgattttctgctgtcgacgggggcgggggattcaaagcccctttttttacaggcatgccgacgggtgaatggacattacggggaatgtgttggacgtcccccgcggccacttttgtaagtttcgcttcccacattcatttcaaaaaaaatcattttgctcacacacacacacaattttaatttgatttactgtttatatttttagatttttgtaccccaattgaaaatggaagcagcaaagactggcggcaacagcaaaaaaagtcgcgccatgagcagcagcaccgacccagcggaagctgggggcaagaagcgccgcaacatgcatccggtttgtggccccccccccccaaaaaaaattagcaaatcaggaagagcctgaatatacccccaaccaaaaagtagaatttgggtcccgattccttccttatctcggggggggggggtgaatatggaaaatttgtaaaacaccccaattcatttgttttcacatttttttatagcaaattgttgacatcactcaacagcagcagcaaaatgtcgccgaattttgtccagtttcaaccgggagtgttcatcagcagcagcagcagtcggatccgcgcgcaattatgaacgtaattatggggggggacgcttttttttgctcggttttaattggggccaagaaatgttgaaacatgctgccggtctggccgcaaacaaaataggagaagcctaattaacccctccaaaaaggagtaaaatttcgtgttcatttcattcttatccggggggggggggtgaaaattttaaaccgccaaattactttgttttcgcatttttagcaaattgttgacacccctcagcagcagcagcagcagcagcaaaatgtcgcccaatttcgtccggcttcaaccgttagtgttcaccagcagcagtcggacctccgcgcaataccgaacgtaatttgggggagggggggtgtccttttgccatgcttagatttgtaattatgtgcgccgcctatattcagcagggacatgttggggttggcgaatttgcaatggccggcgaccccaccgtacaacaacaacaacagcagcagcagaatttgcttgttccgcgcatttccatttcggttggtttatctgtttccctc

SEQ ID NO: 18888 - DNA, 2236 bp, Heterodera glycines
cttcaaaatttcgacttttggcaatttcatgtataccttttttggtaattgtctaatcatgaatcaatagcttagaaaaatcttctaaagatgttaagctttcgaatgataccaacaatgttggatttggatggcaaagaaaaaaatttatagaaagttatagtggaaaagcatgctggcgaccaacgtgagcgtccaactgagatagaagtaaatagctttttcctcttatcctcacttctcgtgtctttctatttgactttccttttctctcttttctctttcattttctctctcggtttactttttgttcttacttcgccccctcgctctccatttccactttctctctccctctctctctctctttgtctctcctctctctttctctctctctctctttctctctctctctctttagttttctctttttctccgtccatttgactctcttctctcttatttctctcctctttcctttgtacgaatctctttcttctttgacgtacgcactcgcagccaatgggtgtataaataaaactcaatttaccttcgtttgcttcgtttatcttgtcattttaaaatctcccattttattttttaaaacaaataaaatttaatttaaaaacaatgttttctttcatttaattttattcgctcgatttcaattatcttgccatcatttttttattttaagtgtttagcctggaaatgatgcttgaaaatgaaagtaggctggtcaattcgcctttaactaagctgcaaaccaacaattctaataacaacaatggtcaacagttgcatcaaaccaaaacaacatttccatcaattttattgcttccggatcgaaataacgaacagattattgtaagttttttcaacttaaaaaatcaaatcggtttaattgcattatatttattaaactaaaaactaacgtttattgttttagaatatggaaagtcactatcattcacaaattgaacgactttcttcactcactgaggtggaaatggctgaattggtatcgagtaatacgaatctgaacaacgtccaggctttggagattcttgatggcttgttttgtgcttttcttatagaaagtcaaaattcttctaaggtattattttgcttttattgtcatgccaagttcgtctttcagtatttgaactgtttgccttcttccgacatgtgttggaatcacatgctttacaatgccaattacgtgttaattgaagaattctcgtttctcaaatctgaatatcgtcatcggatggttcaattcttggcttacactatcaaaatgaatgttccatcggttgattcttgtctttcaaatttatttcgtgcactttccgatggtaattctaaaaaactcattaattatcatcctatcaattaaggaactgaatttgtggagacgtgcaaactcgtcttttctgtttctcagatactcagcacaaatcagaagtggctgattggcctcaaaaaaaattcattggccctggcggatgcttttgccttcatggcacgttttgtcaccgatgtgcctttggtgatcgctaatgtgtcttccgtttctatcgacttgttcaaatctgctttggtctccacttgtgaattactcatccgcgaacgtttcgttgacctggccaccacaatgggaagagacctgatgatttcgctgatgcgactttccaaattaacgcaattccaaaatgtgtggaaggcattgcttcacaacccgacttccctgatgcccaacttcagtatacaacacactcattttaattacgtttgcaattcatttaggtcttaagcaactgatgcttagtgtaccgactgataaatttctcgggtcgcgtgtttctgtcaatatcagtcggaaaattgatcaattgttaaacgttgtcagaatgctgttggggcaaaacaaaatttccgagttgactaaacactttgaggccttcaaaaacacggtttctgaattttgttatttcttcactttattttcaattttagcatttgtctgagcctgacagtgggacaatgcgtgctgagataatacgccatatttgggctcatttaaaacaagaagagcagagcgctgactgttgcgaagctcgtgcttggcttatcggctggcttttgcgctcgtccaaggtaaataaacacagaattgtcccattgattaactaaatgtttatacaataaaatgcccacttttcaaattcattag

SEQ ID NO: 18889 - DNA, 3190 bp, Heterodera glycines
ttttgaaaaattttccggggaaaccatcggcactgccgggaccccctttttctcaaaaaagtttttggaaaaagcgcgccccaaaatttttttttcatttggggacaaaaaaagctttgcaaaaatctgaatttttttctaaacttggtagccctgcaaaatgcccaatccacctcagtgagcttcgttttcttttcattgaactgctgcgccaactcctccctctttattcaatttaatagtagtgagggaaaaggggattggcgcccagttggcggcgcccagttgggctggcgcccggtcggcggcgcccagttggcggcgcccagttggcatcgcccagtcggcggcgcccagtcgtcccggtccggtcctgggttcaattcccagatcaccccaacatttttgcatttttcaaaattattttggaatgtttttgtttttatttagcaacattttggtttagaagttgtcagcattaagtgtgcttccgattaagaatgccaaatatatgaatatcatatactaaatgttgttctgatatcggcgaaatgtgatttattttttacttgcaaaaactggcatttttggtcgtttctaataaaagttattaagtgtcaaagtgcgtcagaatcaaacggtccgcaattagagatgaccctgtccggcaaacggggactaggtcgtttcggcgcgaggcgagcccgagtttttggctataattctttgcaaaaaaagaaaaaaattacaacggataaaagcattgaaaaatagtttcaaaaatgttattcttataaatagatatttcttttttaggcacaaaaaattgggaaataggcacctaaatgtagaaaaaaaaatcgcaaaataagcattaataggcacaaaaacccacgaataggcacaaaaataggcaatatttttaggaagaataaaacacataaaaacttaccaaaaaaattagttccgttataatgcgcagaactttagacatttgtgatttgaagctttttttataacgactcatttgtcagcaccatttgggtcatctctgctgatgactcatcgataaatgaccccatttggtcagacagagtatcaataaagtactgtatcaaaagcagtaagacactgtacccaatacgattttcattcccttaataaaatgcattttattctgttttctgacttgcatttttataaattctctttgccaaaagcaaagaaatgacccaacagaagaaaagggcatgggaagggacggggtcatttcgctgcccaattagagaagtcattaattctttcataaataaatgaccctaattagtgttctccttcatgactaatcgttaattgaccccacttcgatcagagcataaatcctcccccctcattaaactcatttttctcttcttatttcattcatttttctttgttaaaattatttttcaataatcttggtatcattcgaaagtttaacatgtttatagactatttcgaagataatgcttcgcgattagacaatttctaaaaaagttatacatgaaaattgcgaaaaagtcgaaattttgaagttttttcttaataaaaatattttccagataatattcgatcatttagtccaaaatgattaagtgtttgaaataaatgacctaaatttaatattattaatttggtttaacttttgaatttttaaaaatccccggttgttcccggttccagacgaaaatcgatgtcccagtcccagtcccggcttctcaggtcccggttttggcaaaaattcccggtcccgtggcactctattataaaatgtattaaaactcgaaagaaaataagagcaaaacaaattttggtaaaatatagtgcgcgttatgaattctcttttatatgcaaccacgcgaaaacgaccctgaccgcaaaacttaaaatcaacttgtagatttacgattctaaagatacatacaaacattattcattcatcaattccattttcataactttaaaaatgttttgtttttcgccttgcctctcattattaaaaaacaattctaacgcaattaattattctgctatctgtgtgacagtggcaaaattgtgctcgaattgccacaaaaatgaaccgacggtaagcaatttgaaaagtcacaaattcgtcgtttatttgactaaactgttttcccatttcagttggatttgcaacgacgtttggatggacattttcccctgttttgaccatgctcaactcggcctcaaattggcattgctttcgccacgtttcaatgcgttggtggacaaacatttcaatggcaaaagcgaattgacaatttggagatcaatcgaaattcgtcgcaagaacagtgtcacaacagcggcaccagaatcatcggtgtttatcaactttgacaattcagtgccatttccattgcctgactaccgtccgttgcccagcaaaatccgttttaagcgccttcagattgagtaattaaaatcagagctatcgcaataaaagcattcattcattccattatttttgcagttacatcgatcattctgtcatcaattttcttcgtttaaatcgccaaattttcgacaaaagaggcaccaatttacagttgttttggatttcttcaccacacaccacggacggccagctgattttggacatttttgttcgtgaaatatggccaatttttgcgtcaaacattcgccatttgcgttttctcggtggttatcatttggacaatttgcgtcgtctcatttcgccgacatttctcaccgatctcaaccaattgaattcaatcgattccgttgatttgttgcccgatgcaattggtgattttgataggccaaatgcaacaatttctgctggccaagcgttgtccaaatggttgcactctccaagaaaagatggccaaccaaagcaattgcattgcacacttttgaaccaacaagcgtacttcgattgggtcaacaatttcaaggaggtgtgaccataatttcggcaaatcactgatttttgttttccattgtttagcattttctccgtgccaatgccatttcttccgtcaattaccaaattcatttttgtgtttttgtgccgtcaatgcaactggtgccatttgaattggtgaacgaatggacaaaggaaaagatggcattggccaaagcaaagaaaacggacaatggataa

SEQ ID NO: 18890 - DNA, 864 bp, Heterodera glycines
cattccaatcactggcactcaattcccaccagcatttcaatctctgggactcaacccaccagcatttcaatcactgggactcaacccaacagcattccaatcactgggactcaattctccagcatttcaatcactgggactcaacccaccagcatttcaatcactgggactcaacccaacagcatttcaatcactgggactcaacccaccagcattccaatcactgggactcaacccaccagcatttcaatcactgggactcaacccaacagcatttcaatcactgggactcaacccaacagcatttcaatcactgggactcaacccaccagcatttcaatcactgggactcaacccaacagcatttcaatcactgggactcaacccaccagcattccaatcactgggactcaacccaccagcatttcaatcactgggactcaacccaccagcatttcaatcactgggactcaacccaacagcatttcaatcactgggactcaacccaacagcatttcaatcactgggactcaacccaccagcatttcaatcactgggactcaacccaccagcatttcaatcactgggactcaacccaccagcatttcaatcactgggactcaacccaacagcatttcaatcactgggactcaacccaccagcatttcaatcactgggactcaacccaacagcatttcaatcactgggactcaacccaccagcatttcaatcactgggactcaacccaacagcatttcaatcactggtactcaacccaccagcattccaatcactggcactcaattctcctgcatttcaatcactgggactcaacccaacagcatttcaatcactgggactcaa

SEQ ID NO: 18891 - DNA, 2154 bp, Heterodera glycines
tttttcgtttaaaccatcccctcccttttttgtgcactattttcgttttcaccatttttatcaattttttggttgtcttttgaaataaattgtgaaaaaatatacgaaaattattttcgcttttaattatgatgtacaatgcttttaagccccgccgtgaggcggctcctttttgtgcactattttcgtttttaaaattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatcactccctttttgtggagtcgggggcgtttgggccccagtttttgggcccccgcgtttgggcccccgtttttgggccccaagtacagaaaaatttctgttcttcaaaattttcaaaaaatcaatgaaatcctgccggatcctgcacaaaaatcagatttgcggatcctgttgcaggatttgaattcaaaatcttttgccggaccggatccggccggattaatcctgcaaatcctgcattttcaaaaaaacgcaggattgcggattgggatcctgcaaaatcctgcgcaggatccggtcctgctccggtatctaataattaacaaagattttggtgcaaaaccgaacgtgtctgtacgtgttgatgacaaatttgtggcttttccgttgccggaccgtccgctgcccaacaatattcgctttaacggactttacattcagtaattttaaacttgtgtgtgtatttttgaggatattaaaactaaatttttaaaaaaaatgaaaagaattatgtggtgcgataaggtacaaaaacaaactgatcatccattgccatttcgaaaaattggaattttctaatttttgttcgaattcgggtctgaaaatcggaatttatctaaataaatgccggattcgagatcagtgaccccgaaaacccttataaaattattttaaatgactcttaaaagttaaatgtttttacgaaaggggtgtcctcaataagggtgctaggtcgtttcttaaaaactgccatggcgggatgcattaaaaggggctgatgggtcgactaagatttttcgattggatccgacggtaaaaagctgatcggaaatcaaattagtaacggttcataaatttgactatttttttcttttcaaaaccacttttttgcggtgcaatttttcaaaaaactaggaacagggggtccggcggtccttatcagggatggcattccgaggtcccaaaaattttcggaagtgtcggaaatcggatttccaaccccaaaaacgtcggaaatcggaaatttttcaaaaaatatacaatataataaaaaaatttctaaatattttaataggctaaatttttaattcttaaccaagtaaaaggtatttcacaaatgtttttagtatattcgcttgaaaaaattattcaattattttatcaaaatctttttttgtcatttttcattattttagaacatttttgggaaaaggagtgactatttacacgttttttagcgcgcgattttttcaaaaactttgggaacttggaggagggtacggcggtgccgataggcgccgcaggggaattttaaaaaatttcagttcaatttattaacagaaattgtacaaaacttactagttttttgaaaaaaaaaatttaaaaaaattccgacttttcatcaaaaatttcggaagtcggaattccgaccccaaaaatgtcggaaaccggaagtctttccgtgccatacctggtgcctatcgacatctgcgagaaattttatgaaatttaatgcgatttattaacagattttgtctaaattgaccaaatgacgcagtttttgactcaatttctacaggattattaagtaaagcctatccgacggtgccgataggcgccgccggggaaatttcacaattttgaatgaaattgcgatgaaaatgaagtactttaattaatttattattta

SEQ ID NO: 18892 - DNA, 1551 bp, Heterodera glycines
  misc_feature (1535)..(1535): n is a, c, g, or t
cggcgccgttgctaacaactttttcctgatcacccaaaattaaaaatttttgttatcattcgatagctcttcagattctctattagcctgtaaaatttcaaaaaatttcgtcagtttacaaaaaagttatgcccaaaaaccctcaaaaattaactttttcttggctttttcggcgccgcgtggcataacttttttatttttgaatcattcatttctatttttacatgtaaatatagagcacacatagagctttcaaatgatgccagattggctaaagctaactgacaaataaaaaagttatagcatttcaaaatttgcggcgccgaaatggtccgcgccgaagtgaccccgacccttgtgaagtttcataacggaatattcgttcgtaccaggtgttttcgacagtacttttaaattaattttctagataatttcttgtatatatgtatgaattaatattaatatacaacttgcataataaaatttcttattgaagtaaataataaataagacttgtatgtttatttttgtcaaaagatttatcgctttcaatttttctatgcaaatatctcttgctgaactgttgtcaaaaatacaactcgaatcgtgtgggaaaatatgctaactaatgccgcgtttttgtggcaaggtgcaaatctgcaggctctatcagaattcgaaaagcacaagcccctctacaataagagcctgtgcttaccatttaattttcaaaatgacaatacttatacataccacatagaacatgtttttttcctaaacaagctttactgtcgaaatcaatcactgtcggaaccagggctgggcgaagctcggcttagcactcgaagccgaaggcgaagcccaatttttttcgaagcacgaagttcgaagcccaaaaaccgcgaagttttcgaagcacgaagctcgaagtttttgaaaaaataattttaccctaacaaaacttttttttcaaaaaattttcgtattcactaaaaattaattaaagctttctataaattaaaaaaaactaataactaatgtttttcctaataaatttttccttttttaattttgatcagggctaccaactgaaaattttcaaaatcagcatttggccggtaaaaaatccgcattttgtaaattttattccaagtttaaaaaactcaataaaacgttttttgcggcgcgctttttccaaaaaactttttgggaacgggccaacggcgccggtaggcgccgtcgggaaaaattttgaaatttgagcgtatcttgttaacaaatttaagcaaaaaatgtaaaaattttgcgatgtttgagcctattttttaagaaaaattgggggcggggtaggtgccgccgggcgggtgaaaaggtgcgaattttcaacttatatgataaaaatctacacttacatcatatttttaaagtcttaatttgtgaaaaattgaaagaaaaacaattacttggagggaactgatctaacgcaaaaatcaggaacggatccaagagaaaagcaaaattgtaatgagatttanatttaaattcactata

SEQ ID NO: 18893 - DNA, 1427 bp, Heterodera glycines
  misc_feature (1417)..(1417): n is a, c, g, or t
ttacttatgtttgttttttgtcagcaacaacagcagcagtgtcaacctcgactgggccaattgtctgtccgacgtcgacggggccatttcccctgcccattcgtcgtcgtcttcgcctcgtgcgtcgtcaccgtctgagcggaagcaaaggaaatttactcttcgaattgatcgagtgacttccgtcgattcacttccttttaaaatccgtccattgcctggaaagggtctttttgtgagcgaagtttgtgccgagaaaatgctccattgtcattcagtcgctttgcgtgttggcgaccgaattgtcgcggtgagtctctttgaatttaagcaattatttaatgtttcacaggttgacggcatgtccgtgataggttacgcttgggagcaagtcgttactgagatgatttgtggtggacccgaaaagactgaattggaattaacggtcgaacggacccttccggacggaagtgaccaagcggaggagcaaactttgacagtgacacttgacaagacgcagaatggcgcaatcggtaagtatttgactcatcttcctcgtttaaatttttttaaggactcagtttggccaaacggatgggctccgacggtgttttcgtgaggaatattgcaccggactcaatcgcagcgcgagacggcactttgcgagtgggggacagaatttggcgggtgcagggagagcaaatcgctttgggagaaagtccggcgaatgtcgtcaaacggctcaaagatttatccggggaattcatcatcgaagtgcggcggaaggcgtaatttggattatcagagtcaggaagcgacaccaccacctctacccactaaaactacttaacctttgcttcgttttcactattgtccatctctgccttttcactttacatttttcaatgtgctcatttctcccctcatcagttctaattgtgatataatacttaattccagcgcattaagataactaataatattatctcgttaaattcgtcaataaattaaataaatgctatccttcgctcaaaaaacagatattttccgaataaatttacaaaaaattcaattaaataaatgccatttttcatcgtaatgcacccaaaatttctgaattttcccgtcggtgcctaccccgggccgggctccacgttattaactctaaaaaattggcttaataagcaaatttgggaaaaagtgaagaatactgatgtaatggctgatcgaaaatagctgtgggagctcaaattgctgtgggagcaaaaagacagggggcaaaatgaaggaaagatgccccataacaacagtcatccctccagcggtggatgtggtctagtggctaagacaacggatccacgtaaggatccccgagcggcggttcaaatccggccttccaccccaatttttcgcctanataataactg

SEQ ID NO: 18894 - DNA, 940 bp, Heterodera glycines
  misc_feature (48)..(48): n is a, c, g, or t
  misc_feature (60)..(60): n is a, c, g, or t
  misc_feature (92)..(92): n is a, c, g, or t
cagagcgaaagccaaggccctccggggggaaattgtgctgttcattgnccatctgtgaantgaaaatgtaagagtatgcgatttgcctcttntagggggcagaacgcttccaatgaaaagctccattatgttcaaattaaaaaaacaaataaattacaagttataaaagtgcaaagctgtaaatccatttcctctttttgccgcttttggtcacttgggaaaacacggaaaactaagccatttttcgaccattttgaatgaatcagggaccataggtgttaacacctgtttataggcgagttgttgctgcccatggacggagggtacgccacacgtcggcgattctgtcgagccaaagtacggggtcggtcttcaacttggcccagctgtccgtaccattctccttattgtcgtcaaacgaagccgacgatgaagcgacctgtggaggcattgagttggccagagaaggtcagtgaataatcagctaatctgggtggaattgaatttcaacccgcccaattcatggcatgccattcggggatttgtaatgattccataaaaatgcgacgttttttcttcgatttaaaaattgtgtatatatttgttataagaattctttcattgaataaaattgcgaccaaacctgagtaactcttttttcaaagtaagttactactttttgctttggaaattcgaaacgtattttataagtaatgtaattttaaatcgcctttttggataagaaaccaaaaaatttctatctaaaataatattttgaaaaagtaaaatttttaaaataaaaactcccaaaactgaaatggaaaaaagaaatctggcattatccctgacctctccaaggcgggcgacagaccctgagcaaatgcgactaagacacgcgcgtagttggtgagcaggcaggtcgttgatcagatgggcagat

SEQ ID NO: 18895 - DNA, 2678 bp, Heterodera glycines
  misc_feature (2659)..(2659): n is a, c, g, or t
cctaacttcaatttgcatggatattgctccgttaacaagtgtcctttagcgttaatacacttagaagtgaaatggcttctcgacccttggtctctatttataatgagaaaaatgagccaaccggcaagcaaatcaagcttccggccgttttccgggctccaattcgacctgacattgtgagcttcatccatgaccaaattcgcaaaaacaagcgacaagcgtatgctgtgtcaaccgctgccggtttgaataaaatatcaaaagcccaataatttgttgtctggtctcaggtcatcaaacttccgccgaatcgtggggcactggtcgcgcagtggcgcgtattccgcgcgtccgtggcggtggcacccaccgctctggccaaggagcgttcggcaacatgtgtcgtggtggccgtatgttcgcaccgaccaaagtgtaccgtcgttggcaccgccgggttaatgtggcgcaacgtcgttacgccattgtgtccgcaattgccgcttcggcggttcccgcactggtccaagcgcgtggccatgtgattgaccagctcaacgaaattccgctcgtcatttcggacaaaattgagtcgttcacgaagaccaaggaagcggttggctttctccagcgagcgcatttgtgggacgatgttgagaaggtttcatttaatacattttcgagataagtattaaggaatgctttttaagtaaaacgaaaaatatcagttggagaaataaggcatctacaggaaggaacaggcataaatagtattatttccaataaattgttagcattcctctcgaaaatgggttcagataaaggcgttgcttttctgtgcgtggtttttgttaatctctgcacaaattatatcttttctttaggtttacaaatcgaaacgcttccgcgccgggaaaggaaagcgacgcaaccgtcgctacaaacagaaattgggcccgctggtcatctacaacaacgacggtggcattgtgcgcgcatttcgcaacgtccccggcgtcacattgctctccgtcagccacctcaacttgttgaagattgcgcccggtggtcacttgggtcgtctcgttgtgtggacagagtccgccttccgccagttggaccccctttttggcacatggactcggcagagcaatgtcaagaagggctttacgttgcctcgtgccaaggtatagtatttaacaacaaaccctttgttggtaatcatgttccttcgtaattttatttgtctgttttttaagatgaccaattcggactttgcgcgaatcattcgctcggaggaaatcaccaaagtgttgcgaccgacgatggcgcgaaaagtgcgccgggtggccaagattcatggcaacccgctgaagaaaccctcgctgatggccaagctgaacccgtacgccgctgttctgcgccgtgccgcggtgttggcatcgtcaaaagttaaaaaggcggaggcaaatgaatcggagggcaaacagaagcagccaaaacagcagaagtaagcggttgggctggttatgttaccatagatttttatgactatttgttgaatctacgtagtttttaaaaaattgttaagaacactgcatattgagtcgagtcaattctattacaatattagtaaacccttgggataagaacaattctctctctgggtttgtttgcgactaaaaaagtgattaccattcaaaccgacaaattatctatcttccctttaattttagagcaactgcctaattgaacgaaaacaacatggaacaactgattggcgatgctgactttggcaacacacatttatttttgttgggcgataattgtttttgttgagtggataaatgttgattttgtttcgttgggacttcttataattggttttttgaatggtaattccgtaaaataaagaatgagctgtaggatttgagttgagcatttgaggaaatgataaaatgagggttggtctgtcatgttaaaagagtggtcgtctcttggccataatcttcctcacatgatgagtcactttcgaacgttccattcgttcggatcaaattgtatcggttggcccgaaggacgcttgtccgaaatgccatcccatttccacaacttaattttagcagaagttgaaaaaatccattccgacagcataaaaatgggttggggtttgaaggaggttatattgctgtcctgcccatttctcggattatcattagtttattccccctattctctgggttccgcggagttcaaattattgcacaatttattttttaaaagggcgaccattttgatcaaataaagattgagaccatagttaaaaaaaagtggcaaataaaaagatttatcatttttaattagctgtgatcgatacaataatacacaaaaaaagcatgaatgagtttcaaacggttggatgggttttgggttagtctttgagttggcgatggtcacacacttcccattccctctgttctttggttcgttttttgcgggtattttatgccatcgcccgggctacaaaaaacagaattttaaacatttttgattgaatcaacattaaattggttttattgaatggaaaaattctttaaaaaccaaggatattttaaggtgtaatccttttggttttttcaagttttgctgtttttcgcantagttttgaagtgccgtgt

SEQ ID NO: 18896 - DNA, 3132 bp, Heterodera glycines
gtgcacctagattggatggaggcgtgggttcgattcccacccgatggctaacattttgtcaacaaatctgagatgagaaaagcaaaaaccaaataataaattttgaacatctggactcaggtcagggaagcacttgtgaataatatgcagcaaaagaatgccaaaacgtgtagagcagcagaagatgaaccaaaaaaagctgctattggaggcactggagatgaactggatttgttgagcttgctgatcaagggtgatcgaagcaaaacaatcggtgaggacgggttcgatttggagctgttcgaccaggacgacaacaacaacaacgacggggaagagcagggcgtgaataagggcaaaacgacgacggcaccgcagaaagccaagcgaacaccgtcccagccgaaggaatcgtcgttgagcaaagcgatgaaagaggtttttacgggcaacttcgagttttttaaaattagtctcgagacaccccgagcctcgaaaaatgagcctaaaaattcgagacttagactattcaaaaaccgagacccaaaaaacccgagactttctcgagtcgagactctcgagcagcactagtaattaggcattttaaaagtgccatgttgttaagatggacttagaccggagcaagcaaacaccatcatcaacagaaaagccgccgtccagaaaaggttcccgtaagggagcacatctgctggagatgatggaccaagaaactgcagccccaaaaacgacccaagcgagaaaggggtccgttaagcggggcaattaacacactaattgcgtcttaatcattggccattgtgaaaaaaaaacaattttagcgaagaaaaaacaacaagattttgaattcaattcggttgtcagtattaaagtctcattaaataatgaatgtgatataatttgaaagaaaaaacacagggaaatttaattaatctggcaaaattatttgttcaatgttaatattatatttaattttaaaattccgggattttgtttcggcttttctgattccaatcccgtattttcctaaaaatctctatctcctcccccctctctacctgtaatatgcaagtgtcgggttgtgcatcttctgtgactcgaacttcgtacacggactggacaaaatgcacgcgttgagcaggttcggcatacacgaagcggatggtgacattggcgcgagagtgaagcggcgacggatggccaaagtcttcggcttgcacttgaaatgtcgacaaatcgtccatcggacaatttggaagcttaattatgttaatttgtaaacaaattaagaaagatttttaaaaatacactcagtttccttaaaaaattttaaatcccctttagggaggatctccccaggttagggtctgtccccgaaatccaggcccacccaagagctcagcagaagttctaccttaaataagaatttattaaaaatgaatactcactttatcttcgtcaatcagcaaaatgccttgttccggttctatgctaaacatatcagtgccgattaaactgtaacgaatgcgtccgttctctcccgcgtccgcatccgttgccacgaggcgaatgtaattaacgtaattagtgccggtgctaatttgtgtattcacatattcatttgatgtaaacccatcatcatcaaaattgtcatttgaattctcattgaattcgtaaatgccaagtgtccattgaaattggaactgtgtttggttccatcgtggagcattgtcattgatgtccaaaagagttaagctgaaaggatccaaatatggaagacgagagcccaatttaatacagaacacgacagggatttttgaaatttggaatacagtagagaagatatttatgaaaagtcgggattcggtattgggaatcatgccgatacaggattaccctatcggatttaaatccctatttgccgggatcctaatcccgacctttttcttcaaaaaagcgtcaggctctatatcaggaggatcccaggaaaatcccgacgggatcccgattctgtcctgtctcaagacccaattttctcgactctcattctcgagagcttttggaaacacacgaagatcaatatataaacaataaaagacaccatactgaagtgggtggtcaagcagtacatcggataagtttcgcaccaacaaatccatatgcaatgttggcatctgttctcgatcaaatggtccgcagatgatcagcaagtaaatgtgttcagtgtcagtttcacgaagacaaaccatggattgtgcgcccaacaaagacaaactgacaaaaaaagaaatcatgggatagaatcactgtccaatattgatgcccccaagttgcggtgttggaactctaattccaaacccaaaaatgacgtaagtctggattccgtctcatccctgattttcgacctcgggatcaagtctcggtaacccactaaactgaccctgcgctgacctaataggccccagggagaaaacgcactttaagttatccgtgaaatatgcttgttgatcctttctaatggcatcggcaccaaaaattgagaagggtcgttcgatggcaatacgtgccaaaacataaccaagaggcaatctctctggcacattttcaccactgccattgtccgtcagccaaatgacgctgagcgacacagctaataaaccattgacaaaggagtaaaatatcaaaaaaaaaattggagaaatgaattttatgactaggcactggatgctaaaaatccacaaaaatgtgctaaaaaattttaaaaaaatgcctaaatctgcaaaaactagacaaaaagggaaaaaaattttattagatcattttttcgtttaaaatttgtatgataaaattcacaaaaaatatatttgttaatttataaaaattaaattaaaatattttacagaataaattgtcaaaataatagtttttgtaaaaaaattatttaaattgtttaaactttatgttttgccaaaaaatatgagaattttttgttccgacgaaaattagacggagaaaatagtaaaaaaaaacatataaaaaatataaatccctgccgtatttataacatatattttaggctttcaccatttgaagtgccatcgagcacatcgcttt

SEQ ID NO: 18897 - DNA, 2294 bp, Heterodera glycines
tccgtcagcctcagaattgtccgcgtggtcgccagcgggtcgaactccgttttgctgtcggtcggcatcagccacaacatgttcagacactgctccatttcgtcgaggatggccaaacggtccaccaaatcctggacaactcccaactttttgtgtggcgcattttcctgaaattggcagcaaaaatgcttttccatgtgataaagcaaaccttgagtttgacaatttccttctccgcatttgtcaatttctcttccattttaattacattttctttcccattttgcagtgccatttggattttatcctgacaatcggcgagaccgatgtaacttggcacaaagtcccggtatttgagctccaaatccttggccacttcattgattgctgaaacaaatggaattaccaaaatattacaattacaagagcaaacaataacatttggaaatttcctgttccaattcggcaatttccttgtcgatctccattatatttcacctaaataagatgaaaatgaaaagtaaataggtatatcgaataaatcgatggatggggaagtatgataaaagatgactgggcatttcggcaaaggacagatataaaaatgaaaatttatggttttccccggcgtcagagccaataattcgttaatctcctaaaattgactcaaaaactagtcaggtgagggatgggatttggcaagatcccagctagcaatcccgaattttttggaaaagcatgattaatcctgcgggatcaggtcccgcaatttttgaattccaatcccacatcggacggacccgcaaatttgatttttttttttgtgcgggaaacgggctcgttgcaattttaaaattaagacagaatgccaaaaatttcaaacattactaaattaacaaaatttcattcaaaatttatgaatttttccagcattgatttcggccgcaggccattttctggcaatcatgtcttttactggtcccgaaaaaattgttttttaaacttttctgaaaattctaataacacatttcttggggggtattttgaggtgctgagtacgaatccggcctactttttggcgaattccgaaccctgaacccgagttcgaacattttcgaaaaaattttttgtgtgctaattgacttcatttcaattttaaattattaatttctgtggcgtttcgtatatttttaagagactcaatatattttgtgatgtttttggttgttgttttatgatttaattttggagagaaattgtgctggattattttattttgtttgtcgtcgctattttattttgtttggtataaatttatttgtgttttgttttgttttgtaaagacagatcgcagagaactgttgacaatcaccgttttgacatttgaattgggaaaagtggacgcaaacaagcttttgttttcaacttttgttttgaaagccatgaaaacacatttccaagggttttcggggtaactgttcacgaatccggcatccatttcgaacaattcacgaaccccggacctaaatttgaataaaaagtcgaaaatttaaatactccgaattttaaaaatggttaaaatatgtaaataattaatgtcatccatcaatgcttcaataaaaaaatcatttaaaccacttttaaatttttaaaattaattccaaaaaattttttcgaaaaatgttcgaattcgggttcggggttcggaattcaccaaaaaggaggccggattcgtactcagcgcgtcaaaacacccctagaaacatattattaaatttttcttgaaaactaaaaaattttgttcgggaccagtaaaagacatgattgcccattttctttagtaatcttttttaaatttttcaggccaataaatactaatagcctcttgaataatatcatgaatattttattttgagggatgcggtaggtacataaaattcatgtccatctttataaataatgtattaaagcattattatattaaaacaacaaaatgggaaaaatacaattatgaataaatataaagttaacaatatgattaaatggaaaaaagatcatcaaaatttgaacggagaatattaaagagacgtccgtataatttgtgggggcggtttgttcagcttgacaatgctctaaattaattattcaataatataaataaaaaaaataaaataattttaaagctaatacaacagcatttaccaaagaaaataccgacataattagacatcacttataaccatttagcatttattcaaagacagactgacttcgacggctcccggacagggaca

SEQ ID NO: 18898 - DNA, 1722 bp, Heterodera glycines
  misc_feature (16)..(16): n is a, c, g, or t
acttctacttaaattntggtgtatattttctaacccttttcatgcactttttggtgctttttatgtcccaaatatcagcgctgattttgaactacttgaaaatatttaatgttttactttctttcaaactaacaataaaacgaaaatttgtaatttcacatttggaggagatcaaacagtaaaaaaaggcaaaaaaaaaaaaatcattattttttgctgaaaatttttccatcagagcaaggcttcgtccttgaaaaactctctccgaatgtccttggaaattaatgcacttgcgaatcgttaaattctaagccgtgctctgattttgaacatttatcactggaaaaaatctcctcgcggtgcatttttttgctgaggaataatcggcacattctgctgaacatctttcagacccattagaagtgccaccaattgcatttgcttataaaaatgattattgttattgttgtacggtggcatttctaaaactgtaaaaaaattttaaaaaaataattaacatttattttaccattaattcgtggaaaatgggcaccatataaattcggcaaaagttggtcaggcaagttcagattataaggcaaatgactaccagcagcagtctaaatgacaaaaaattaaaaatccattgtttaaatacgaaaattgtcggttaggagccaaaaaatgatttgtttcaataaatgcccatgggtgcagggctgcatgaaaactctaaaaaaaaattttcgtatacgaaaacgaaacgaaaaaaggcattcgatacgaaaacgaaaacgacacgaaatttcgtgcagccctggaccggaaccttttcgggttgaaaaaccgggactttttggatgggaaaaccgggaaaaaaccgggatttcggtactcagttgtccgtccgtgttttggtcccggtcccgctcaactcttgttttaagacatttttcgttcatttttgcatcatccatttttaaccaattgggcatcagcgaagacgtgtcgtagatccatcattcaaaggtcattttgtagaaaattttgtcctctttctgatcccctaggaatttttttttttcaaaaattttcccgatttcaagccattttcgcgttttcagatcactaagaaggagtgatctggtgagcataatgtaattgcttttttgttaagcttcaaaagttaggcttacatgaattatttcagattttaggtcgactttttccgatattatgatttttttgaaagtgaacctgtcattttgttacactgtatgatgagactaattaataattattactgctttaaaatctttattttgtagaatattttctatttaaaatatttgagtttcttttattttatataaatatttagtatttttaatagaatttaaaaaatttcaaagaattttctattttatttgtttaattttcttttggttctattatactattattttttgaaaataactcatgaccagttgcgcttgaattactgaaaagaaaacaaacaattattgcttttttatttatttatttatttttaaatttatttatttatatcgtcacgaatttattatgattttttttattatttcattaatgtctttttaataatttaaatctaagtaattctatttggtaaatgctttttatattattcattttatttttatttagcaaaattatttctgctaattatcttatgaaattgag

SEQ ID NO: 18899 - DNA, 1441 bp, Heterodera glycines
ttttgaattttttggctttttcaaattcgtaaatttataatttaattttgaaaaaaaacatttacatttttgaaatttaatctgttgatggatataatataaattatttctatttattgaaatagattttgaaaaataatccattaaattactattaatatgagaacactcttttttaaaaaatttattttttttcgcttaattcctttttttcttcatatttttaataatattattttattaataaatttatatttttataactcatatctcgtagactaccttcaaataaaaaacgttacgaatacaagtgaaattattgaatttcattagaaaataaaaattcaaaataaaaaacttttgaattagattttcttttctttatttataatgtatttttataagtatttttctgttttcatttcctaattagggatttttttcgattatttatttaattaatagtaataaaattttcctttgcttattcattagtcactcttttttgtttatttctcttcttgtgtttccaaggatcaccgttatttatataaggttactatttcattttcattaataaagtattttattctcgtaatttaagtacctaattattaacttttaaatttaatgtccatttgcgctctttctgtccgctgtattcgtcttccacgaaaatttttttccaaccccctaggaattttaatctgaaaatttcccgatttcaagccatattatggaacacccgatttttcaaaaaaattttgtaaaatttttttgtcttgttcgaatattctttttgagctaaaattttatttattttttaaaattatatcttatttttttttacataaatattttcaatacgctttgaactttttttctttactattttaggtttttattgtgcaaagttttaattaatttaatgaaatcatgactcacaagatctgtagagacattattggtgccgaaagcaccaacgggaaatttagaatgttttgattagttaataaatttaaatggcgattttaatttttgatttgctattaaggagtatttatttttctatgttgataaaagtaatcatgatgaattttttttttttaaatttcagaacaaatatttatatacatatattttttcatctataatgttttttacgaatttatatagttgtttttgatttatttggtagttaaaattatatttctttaagtcatgcaaatacttacaataaatctgtatatttttcagaataatttataattgacggatttccatatttaggatatgtttaatttttactttgaattatttttaaattttatgttaaatttttactttgaattatattaaattaattttttttttttttgcgattttaaattagttttttgtcgatattgaattaggtttttattttacttttattctcgtt

SEQ ID NO: 18900 - DNA, 3283 bp, Heterodera glycines
ataaatcacccatttgtaacaccaaaagcaccccccactcacccctttttttgtgttagcatcgctgattttgattgttgcaccagggtcattctgatcacattttgtgaagttcatatcaagccgaatgcatgaatataagtcattatttgagcgttttggcgtatctttatcaaggtagtacgacatgccattcttatcaatgcacatcagttccccaatataattcaagacagtgtttggccttacgcatatttcaatggacaaattaggcggaattaaaaaacaaatgatagtggtgactctaatgatgagaagcatgctctagaagatttctataaaattattatttttttaataagtgaaatgggtaatcactgagtaaaccgtgagtaaaaaagaaactatagatttattattctctaaaagaatgaaactaaaaattttcataaagcaattttcgaaaatatttaaaaaaattttttgaagtttatctttcttaggttttcgaaaaaacattcaaagatgtttgattgcatggagcattcttttggaattgtttaatataaacacaaattttagacattttaatttccaattcgtaaatttcatttgaaatgaatttcgttttaaatttcttaacttttttacgatggatttgcaaattttttcaaaattatagatacctaatttttgtgaaaaatcgttagcaaaattcatataatcggttaaaaagcgcaaatttgttcgataaatctgtttaacaatttgcaatcaaattttaaaaaattttcccgccggcgcctatcggcaccgccggactccaaaaactcttgtttaatgttcgtaataaaatttagaacgaatctatattagtattttagtaaaaaaaatatggtttttattgattaaaaaacttttcaaaaaaccctgatccgtatacgggtccgtatttttcctgcatacggacttatacggagtaagggttttccgggtttttagtccataagtctgtagtccgtatggatgcctagtccgtagtcctgatcctgatccgtattttcgccaaatatcgctctctagaaaaaactatcaacatttcaaactttacatacaatttcctggcagatttaatacaatacttcaagaaatatcttattttttcttaccaaaaaagtcattcttaagggtgtaaatattttcgtctttttcgtccaattttgctctgacgaaaacaaaacacgaaacgaaaatccaaaattaaaaaccgaaaacgaaacacgaaacgaaaaaactttggtagacgaaaacgaaacacgaaaacgaaactcaaaaagtgccgaaaatgtaggacgaaacgaaaacgaaacgaaatttcgtccatccctgggggcgagagtgtacagtcaagcaaagttttgtaagcaaacggcttagcagccttaatctccgttgagatcagaggaaaaggaaaacagagaaaaaggctaaacagccaaagcaaaggccgatggacgatagatagagaaaacggctaaacagcagggatgggccaaattgaaaaataaaaagctaaatgcgaaaagcgaaattcgcgaaactgaaaaatgcgaaatcaaaaaaaagcgaaatgcgaaaagctaaaatatgcgaaaatgcgaaatgcgaaattttttctacaactttttaatagttaaaatcataaagcaaaaatcattttttaaaattttattccaaatttaaaaatcaataaaacgcttttttgaggcgcgctttttccaaaaaaaaaaatatgttgatccatataatttatagtttaaaaaaagaaaaatatttaaaatttttataaggaattatttaatacctttttaaatcaatattttgataaaaagtttaattttttttatttatctttttttaactgatttataaattatctggaaactaaaatttttccaattttaatccagggtatttatagtataatttaatttttattttttatagtttttcaagtgatttcactagaggctgagtggacacacatctaaatgaataagtggtcacattcgctgacagtgcgatttatttattccttatttgcttgttattttaaatttagtttaaatatttatacaagattcctataattttataaataatatgaaaataaaattatttttaatagtttgattttcaagaattaaaatttttaaaataaatattcattttattttttgttgatataatttgttttaataaataaaaaatcaactaaaaattcgtacttgatattctaattatagtgaaattactaagtaaattctaagggaagaaaaaaatataaaagtctgaaaacataaatattaatttttttgtttttaaagggttctaattaacaaaataattatcattttttccttggagtagcttttcgcatcctcttcgatgtttgttagagccatatattttttgactgtttgtcaaatttaaaattcttgtactcaaattttttcaatatttgttcaattcaacttttacaaattttgttcttgttttcggaaatattcaaactcaataaaaatattattttttcttataatactattttttacataattatttttatttttttatgcacagaaaaaaagccttttaatattattttaaagcactttatgcttaatatcttgtggagttagtttttcaaaagaaaagtaataattacctaaaaacaattagcagttattattggtctatttcttatatttaatgtgataaaacatataaaatgattataaacattacagtaaataggcataaaatgtcaaaaaagcaaaaaaaaaaaagtgcaaaatcgcaacgaaaaaaagcaacagaatttttttaatttaataatgaaaagtaaaaatataagacgaagattgtttgtaaaaagaataagaaattattaatttaatataaataatttatcaaaagataaaaatttataataaaaaagtattttaaataaaaattagttaacattatcaataaacaaaacttctctcaactttcctggtaagttctcgcaaatacatgtaccgattttgaataaaaatattaaaatcattttatataacaactaaatctaatcaaatagcatgtaaatcacaattcaattggacgaaaaccgaatatttaagatgaagtgatctaattatttatttgcaacgccccaacagatgtaaactattatttaaaattaatttcgaaaataactaataaaaccttatcattaaaa

SEQ ID NO: 18901 - DNA, 1279 bp, Heterodera glycines
  misc_feature (1087)..(1087): n is a, c, g, or t
  misc_feature (1192)..(1192): n is a, c, g, or t
gtcattggatttcggagtttctctgctggagcttttaatttataaaaaaatttatcggaaaaaaataataattttactttcgagcaccttgaaatgtatttttttgcaattgtgctggcgaaaataataaagaatatgattttttggaatatttatgcaaaatacccttggttttccaatttttaacacatattatggaccagcaccactgttcgacacccccgcccgagggtagtgccaaacagaggtgccgggaaaaagaaaaatacaaacaagtaaccgcccggacggcgtaaatgagtgcaaaatggaaatacgtacaaccgcatccgggtgcggagggagaacaaatgggatatgggaaatacaaaaatggaccagcaccactgttcgacacacccgcccgagggtagtcggtgccaaacagaggtgccatgataacccccgccccaacagttcacaaataataacccccgctcccgatatcatcttcagggccttcgtcaccgctgtccgcctggcctcctgcattgaatgcgttcgcattttcaagtgcgaatctctcactttcaggtggacccccgaagaccctaaaaaagcaaagaaatttttagactaagagtaagagggacagaaacccctatggattgacttatttgaaattttcaaaaaaatactgcaaaaataggaaacgttgagattttcaaggaagatatatttatatttgatagtaaattaattccaaaattttaaatttttcatgagtaaatttgaaaaattaataattgattttatccattctttgaatttcaaggaccaattccttcgaatgataccaagactgtgagattttgtttagaaaaaagttatatccaaaaacttgggttggcaccaaaatagtggcgctgaactctcccattttgaatatgtattcagcatactacagggtttttagttgatccatattttttatcaatacaaacccagaccctagtcctaaaggtgcatttaaaaaaaaaaaataaatttttgcttcaaaattcagtattttgaatgaccaagtcaaaatgagtatttttcattttanaaaatcttctcatttttgtaatgaaatttggccaacacaccagaaaaacagaaatttcaccatttttgctgaatggcttgagcagcgagaggagagagaaagaanagaaagagacattggagaaaagagggataaagataaagtaagagagaaaggagcgagagagagagagagaagagagcgagaaaaaga

SEQ ID NO: 18902 - DNA, 932 bp, Heterodera glycines
ttttaaaaatttaaaatgttaaaatcattaaaattcgctcattaatcaatttaccttatccatttgcgtgaagtaacgcgtcaatacggtcactgcctttgtgtgtgcgtccttaatgcaacgccgcttcatgttgccaaaacgcgcatttgttcggtggccggcggggatctgacgccaggcctgcgactgccgcacgagctgaatttttcaagatttttcaaccccaggaaatttgttttaaatagaattgaacccctacccctcggggggggggggggggtgttggaggccggagaccattggggggctgatgtcgggggtcggactgggtgagttaaatagtcgggggtcggggaatccgatcgtggaatacccaaaattttattttaatgaaaaaacaatttttctttttaaatgcacataaatcttctttttgttaacttaataaatgtaccaatttttgcgtgttatttttaaaaatattaaagcaatatcaactattaaataaataatttttcaaatattttgcttattgcctaaaaataatacctttcctgcaatcgtgttccactcgggcaaatcgccccccgtgtgaccgatggagcggccgaacagcattctttcggccaccatccccccgaaactgatgaccatgttggcctgcaattgtttgcgcgtgtagtgcttccggccccaataaaatgtcgcgccatcggtgtcgttcgtcgcccggttggtcatctgtatttttgctcacattatcgcctcgcaaattttttgtaaaattctaattcgaaatgaggccatttttgctatgccgataagcccttggaatgcagattttaaaaatttatccttaagctttgaatttttcttgaggaagattatttgatctttaaaatttttctttagaaaatctttcacgttca

SEQ ID NO: 18903 - DNA, 3594 bp, Heterodera glycines
  misc_feature (91)..(91): n is a, c, g, or t
  misc_feature (98)..(98): n is a, c, g, or t
  misc_feature (120)..(120): n is a, c, g, or t
  misc_feature (126)..(126): n is a, c, g, or t
  misc_feature (132)..(132): n is a, c, g, or t
  misc_feature (135)..(135): n is a, c, g, or t
  misc_feature (137)..(140): n is a, c, g, or t
  misc_feature (147)..(149): n is a, c, g, or t
  misc_feature (159)..(159): n is a, c, g, or t
  misc_feature (177)..(177): n is a, c, g, or t
  misc_feature (190)..(190): n is a, c, g, or t
  misc_feature (192)..(192): n is a, c, g, or t
  misc_feature (197)..(197): n is a, c, g, or t
  misc_feature (207)..(208): n is a, c, g, or t
  misc_feature (212)..(212): n is a, c, g, or t
  misc_feature (215)..(216): n is a, c, g, or t
  misc_feature (220)..(220): n is a, c, g, or t
  misc_feature (224)..(225): n is a, c, g, or t
  misc_feature (259)..(259): n is a, c, g, or t
  misc_feature (266)..(266): n is a, c, g, or t
  misc_feature (276)..(276): n is a, c, g, or t
  misc_feature (279)..(279): n is a, c, g, or t
  misc_feature (281)..(281): n is a, c, g, or t
tgtcataaccgttttcagcgacctcgaaaactcatactctccacaggccttgtaatttatgaatttcgaattttggttccctttagggttngggattnggaattatgaaaaataaatgtnatattngtgatnagngnnnnaaattannntagaaatgantttttatttgaaaatttnaggggggggggtnanaaaanagaaaagaannttgnaanntaanaatnnaaaagaaaattttaaaattttcgaatttaggttnagggttngaaatcgagnagngnctcagattacacctagaaattgtttcgtaaaacaaagttttcgggaccaccaaagtttctgcccaaacattgtccccacctctctcttcgcgtccgtcccccgcttagccatccgccgccttccccgacggtcggacacagcgaatgacgcagtttcgtcgtggtcgctgcgcttgcgaacattgcgtcgtcgtccccttcgctctgccgattgtccacacggccccatttgtcttaaccatttttaatgatgccaaattttggctattaaattgatgaatcgtgccgttgtcgtcgtcttcatgctgcttcactgcgtacagctcacttcgtcctctcccttttggcattctatccgccgatgacatcggatcctccggcaccgtgccaccgctgttcaaagcgatgtcgaagaatctgtcgtcgtcctccccccctcgccggttgtcaatcggacggaaaccgaacccttcaacaattaattgtctttttgccgcttcaactcccattgttcctttttcaccttcgtctttctcctttttgcctcgctttttgtctccgccccgcacgaactcttcgaaagagaccaattcttctcggctttccctgccgaatccgttctcatcgaccagttcggctattgggcgaccgatgttcgtcccgaagcattcgtccactgggaataatccttccgctttttgttggccactcatttcacacaaaaaaactaaaataaatattaaatgcgcaaaattccgacaaaaagcgacggggggagggacacgaaaagtgactgcgtgctcaaatgagtgactctgagtttgacagccggcactttaagattaattgtatgtatcacgaagtgtgagaaaacttctcgcgcccattccatttccgttgctatggctacaacttaacacaaatccattttctgcctaattcactgaattctttaattgtacaaaaaaaggctcgattaaatgcacgtgacgttggcttttttccttaatttattcatgcaaattcacttttgtatgtgagtcgctcaacggagagtattatgaaaagcacaacttttctgttttagctatatgtaataccgatttcgcttttgaacaaatgactttttccagcaccaaaaaaaacaaaatgctatttttttaacaaaatggattggaaaataaaaatttagtgtcacactctttgctgaatgcttgaaaattcggtcgggtcaaatcgcagctcgacaaggtccaagagagggagggactgttgtccgtttagtgcgtccgttgtcccttcgtcgtcctccgtttgcccctcctcctcgtccatcgtccgtgcgtcgtcttcgcccgtctcctccccgcccgtgatcagttcctcgccttcctcgtccgtcgagtgcctttgcttgtctcgtgcccctccaatgcaacattcgctttccttttcctcccccctttccatggcacttccgttgcataccgcacaaaagccgtgctgctgctgtggttgtccgacttctcccctcacgtatgcttcgagttcatcggaaatataagtgggaaactgttgcgagtgcgttttgttttgttcgctgcccacctgcgattgtgcagtgtctcttccgtgagcgcctctcatccaaattcagcgattttacggtgcgacgggtcgactggcgcgtggtcagcagagcggagaaccattggttttcaattcgttcggactgacgacgaaggccaaaggcaccgatgttttttgccgtttcgcattctttgctcatcacaaaagggacctgaaagttggagaattatatagtaaactcaaattaattggcgagatgaccttcctcttcggtggacagcacatgagtttgaagtgctcgcgaacttcgccgttggaaatgaaatgggcagggaaacggagggcattcccaacgacagtaagcagagaagaacagtcagaacttatccttgagggagagagaagtcataaacaaattttagattttgaagggcgaaaaattgcaaaaggggcaaattgaaattaattaattttatatttgtttgttgtgatttcttgaacggacctgtactggtgcggataattcttttgcagaaaacctgaaaaagaaagggacaaaacaatgggaagagacaaaaaagaaaagacggaccgggattgagaaaagcaaagacggaaaggaaaaggctgagcaaattggagattaggtaaatggaaatgatcagcagcaaagtgttagtcgccgcgcgaatgttccgacggcgaactttcatataatcgtagcccatggtcaattcggtgatcagcaaacgcaactgttgcacattttgtcgccgtaaccttaacaaatggaatggaatgtgaagatggcacggcaaaaatgtacagaattaatcactcacatgagcacaattccgccgttaaaaaacaccaatgtgccgaatggaatgataacagtgagcaaattgaagaagttgggaagccattcccggtgggtcatttgtgcgggaatgtaacgacggaaaggcacaacggactgttcgttgaagagaatgacgacatcctcaaaaatatttatgaaaaataggagtcgggaaaagtgactagtcgtcaaaacccaaaaatttgaagggaaatttatggaataaatagtcagtaaaaaaatatggaattgttttttttgatggacttaccaccgaagtcgtaaagcgaatgccaatggaaatgaaaaggacaacagtgagcaaaagccatcgagtacgttcctcaaaaccgctgaatgtccaatgggaagtgatcaaataactgaaaagcaaacaaaatttcaaaattaattaattgtacggtatttatggactaaaatggctgcactgatcagagcccaccaaaaccaccgcttcgaataaaggcacaaaaaaacagtcataatccaaaattattcatttttcacgaatcccctcgttatccggatttaaatagccgatgaactgaccgttcaaagctcgcgattataaggcaaaggaccgatgaaagtttgaatatctgacccaacaaataaagccatttaaagtgataaagccatgagagataaaggtggacgagttggagttgctctaagaggacgggagggatctgaaaacaaatgcgttaaaatttagatgagccattaaaagactagtttttgttaaactatataaatacagtaaatcgttgtgattgtgagcacggaccaaacgctaataaagcgacttttataaattttaaaacaaataattcgaataaa

SEQ ID NO: 18904 - DNA, 3538 bp, Heterodera glycines
ttactgggtttttgagttccttctggccataacttttttgaaacttaaccaaaatttttgagattttgcaaattaataataaacacatagactatcgaacaacaccaacaattcttaatttgattgacagtgaacaaagttatggttcaaaaagtcttccgacgacgtttcggccgacgacgttttggggtgcaccgctaaaaatcccatccctacacatgacccaaaatttggtggtggttttgggtgttggtgacagaatggggtcaccaggacagacaacccatcggtgctatataagacattagtaaaaaacaatcagatgaaaaaatttttggtataaatttactcaaaagcaaccaaattttaaaagcttaatatcattcgatagtcctaaatgttttctattaacttacaaaatttcaaaaaattttgttaaggttcaagaaagttataaaaactaggcttgattttttagttttctcaggtcaaaacttttttgaaattttgcagaatgataaaaaatgtttagagctatcaactaaaatttaattcatttttaacgaagttgtgagtaatttctgtcaaaaattttccataacgaatgcggaatcactgaacatttgaatcctggggatgtccatcgccatccatggacagttgtgggttccgatcaatcgaacaaaaagcgccgcagtgtcaaaattccattcactgaacgcaaataccgtgatattttcataaaaaattttcgcaaaacacttaaaaaacaccaaaattttccgcaaaatatcacggtccggcggggtctgacccgctcggaactgcgagccttgtaccagcttaggactcaagcatatgaaatgaataagtccgaaggactgttcaaatatactgtcgttgacctttccattatcacattgaaaaacccacaccctctcaaaacatgagaaaataatgcataggggtcatcgaacaaaccactacaaaatacgaaaatggcaaaaaaccaaaatctctcctgtatactcattaatgcaaggtcaataagcaataaggtacaggaaataatttatttaatggaaaccaagaaccgggactaatctttataaccgaaacatggctgaaagaaaaaatacaattatttctgaattctcaaatatggggaaatataacccaatttttgcaaaccgtccaacaaaagggggtggatgtgccataatagtctcaaataaaataaagggggattaatagagactggactataattagagcatatacatatattgataattctaaagcttttgatagtgttccaattgaattacttctacaaaagcttaaaaatatcggtattaatggtaagattcataaatttatcgaaaatttcttaaatgaccgttcattcagagttaaaatctctgagcgtattcaaattcaaaaaacatttatagtggggtgccacaaggtagtgtcttaggccctttgctttttcttatttttattaatgatccccccgaacaatttgcctaaaaatgttggtattaaaatgtttgccgatgatattaaaatttatattgagcataaaaatgataaaaatagagagaatttatcttccgcgcttgaggcaataaataaatggtcaaaaaataatggaataaaaatatcaatagaaaaaacaatggtcctttactttggtgaaaataacacaaaatttatttattttcttgatggcgaaccattgcccgaaacaaaatgtgtaagggatttgggcattttaatcgatcaaaaactatccttttctaaccatattaataaaattttaaaaaattcatatttttcttgttttcagcttctccgggcgttaaaaactcggaagcttgaaacattaattttggcatataaaagctatatcagaccagtgttagaatacgccacagaaatttggaatccattgaaaaaagaaaatgtccacaaaattgaagcagtccaaaaattctttacaagaaaagccttcaataaatgtgggcttgtccctatgccgtatgaaaaaagattaatgttttgcggaattaagacattggaaattaggcgcaaaattaatgatattacaactacttttaaaataataaaaaaacatacacatcttaaaccatctaacttttttgctgttgctaaacgggctattcgcaaaccctttttactacaaaataggatatatattacaaaaacaaaaaataatttctttaatagggttattaattcatggaatttattaccgaaaaatattatggaaataaatgaccccaaaaaattcagagaaattgcagaaggaataattaagcaataatgcatattttccctattgagaggtgtgatttgtttcatttatgtctattgtttgtttaatttgacacctattttgtgatttgacacttatttttgtgatttttgactaccatttatgttttatttttattctcacttttttctttttacaccactgttagagtgcatagcaccttgtggtttgttcgataaataaataaataaataaaaaatgtcaaaatagtgaaaaaaatagtgacaaaactccaaaatagtgattttaactattttagtgacgaagtcgccaaaatagcgatttctagtgaccgataatgacatcagaatcgaaaatttttaatacagaaatgcgttttttagctcctttcttcaaaacaatcgaacaaaaaaatagttaaatcattagttgcttccctagttatgtgaattaaattttacctcgtactcatcttttgaaaaaacttatgttaataacaaatctgccgttggttccgcacagcacttttctaaaacggcttacacttgttggtgatttgatcaattaatggagaaaatctgttcgaaaattgagcccagttttttaaaatttccccagcggcgtctgtcgacagcgtcgcctcactcccattcattggttttttctaaaccatttaaatctctgtagcattaaaaaaactaattaaatatttgaaaataattggcaaatgtgataacatacatacaagggatgcgtcatcggccggcgcaccccccccccccccccctccctcgaaagccctaattgtaatctattaacctgcatgcaaaattttgaaaaatttcgttaaggtttaaaaaagatatggccagtaaaaaaccagacagattttccaacctttttggctcttttgaacttgaaattttgcagtgaacagagcaagtgaagggctctctaatgaaaacaacaatgttggatttggggtaatactgccgctggtatcacatcttttttgaaaaaaatattttgtgatttgaaaattactgaaaacatgtttttaggggttttcggggcagatgatcacgaatcttgcgttcatttcgaccagtccctcaacctggacccaaattcgaacaaaaagtccaaaattcaatttaatcattttgctcaaaaaacgcttaaacacatggaaacaaattaaagccaccaatcctg

SEQ ID NO: 18905 - DNA, 2120 bp, Heterodera glycines
  misc_feature (1988)..(1988): n is a, c, g, or t
  misc_feature (2032)..(2032): n is a, c, g, or t
  misc_feature (2050)..(2051): n is a, c, g, or t
cccacctaataattgttgctgaaaaaggtccataaaatgtggcttaagcccatattgcgcataattcgcatgcatttcgccaagctgttcacatgcttcatacattttgtcctcgtccatttcgtattcgttgatcattttgtcgaaaaagttgaaaattgcttggctaataattatttaaattaagcagtttaaattaacgaattaaacccattaattttctttctgaccatattctgtttagttttggccatttcgtcaggtctctgtagcaataatagccgcaggcgataacctcgttcattttcgggcttgactgaatgcatttcagcattgtcttgtggaacaaatctcttcggcttgtcgctatgtcattacgccaacataaaaaaatcctaaaaatatttcagcatatacttagggtggaacataatttttgatacccaaattttttttattaaaatttttttttaaatttcaacaaaacacaatcatgattcaaaatacccgccattattatcaataatatgttgccattattctggcaagagatcaataccaatggaaaagtatttagggagttagagttaagtaagtaaaaatggtcattttagaggtaggtatttttgatggctgatttaaagaaaaataaaagagatacagagccagagaaatagtgattaaatagagcaaagttaggactataagaacacaaaaatataaaattttaattacaaaaattgaattattggagagccgagactgaaagtggtctccaaaaacggcatttttcaagaccaccaagtaacataatgttttaaaagtggttttggaaattctgaatttaattaaacaaggtaaatcgggtatgttgagttcgaatatggtcttagatttggtctctgggatcgcaacaaatctgtacagctcgaacttcatgcatggagttggagcagtacaagctcaggttgaaaagataggtcccatttaaggccatattcggattctactggtctaaattgtatagaaaaactaagattttgttatatcagctttggtttttgaccataaaaaattcgagaaaaattagtgggccaattttcaattttggcatggtcgggaaaaaaggcagaaaaatctatcaatcaaataaaaagtgaaacgatagtaagatataaaagaggacaccatgaagaacaaaataaaaaaagaatcatttaaataggcgcagaaataacggagttatgaatttttaaaaattggaaaaaatttgggtatcaaaaattatgttccaccctaagtaccaaaaagaaaatgtttttcctatatccgactacgtagaatccaggaaagaaaaatatgcatttgcatattttggacagccctgataataaatataaagctatttttcttaggtatgacaattcaaatttttttgaaaataagaaactgaagtttgagtcaaatgttgcattccaattacgaaaaatgcgcattgagaataacgaaaaggcaattcttgaatttaaaagtgcggttgaacagctaattggacccattttgctgagtcaaattgaaaatcggcatccatttttaatggcattcggtaatgggaaatccatttgatgaaaagagagcggacagtaggcactaaaaatgccaaaaatgcacaaaacaacaaaattttatgcttttcgaaaattgtttgcataaaataaataattaattttaacttacaatagaaacaaaataaaaactaaaaaagaataaaaacccagagaatttaaaacaaaacttaaaaagcttttggtccatggcaatcaaagcgctctcaaaattataaaacaatttttcgaataatcgcacaatatttaaaaattgataatagtattattattttgttttattaatattttacttttctcagatttgtgactaaatgcgaatgggcggacgaatatttgctcattttatcaaaagagacattngtttgcgggcattggcgaaattcgaatttcctcgcgcatttatntttctcgaatttttgaanntatccaaaaatttatttactgcaacgaaaatatttgcataagacggatgcaaaaatcagcaacattttt

SEQ ID NO: 18906 - DNA, 1577 bp, Heterodera glycines
  misc_feature (1493)..(1493): n is a, c, g, or t
aactagagttgtacggaccgggaattttgagataaaccgggaccgggacttttctggttgaaaaaccgggactttttggctgggaaaaccgggaaaaaaccgcgggacttttcccggtcccagtcaaaactggtcgaaaccgggacttaggtactcagtagttgtaagtttttatcagtttatcagtaccaggtcccggtcccgtaactctactgtaaactataagtaccgattcttaattgctaaagaaatgcaattaacggataaactccttaaataaaaatagaaaaaattcgttttttaaatcttgcaagaaatcgtctcgaaaaatagcaaaattccatttacggaccaaaattacggaagaatcgaaaaaatctgtaactcgtaacccgtaattacgggatccaaaaacgccgtaatccgtacagccctgcttagcagccttttattttgttttggcacgccaacctcatctcgaagaaaggacccaatgccgagctgtacatcagcggcggctccgctgtccctttgtcggcatcgcccctttttgtgccatttccgcgccgccgtctccgccccgttagtctcagcgtcgaatggttgtaaaagcgacgtaagaaattttttgctacttctaaacgggactcagaagcgcccgtgctcagctggtcgctctcgcaaatggccgactttcggctgcccggcacactctccgcttggtgctcaaccggtggcaccccttcgcaaattcggtctttccgtctccgaatggctgtcccaagcgaaagtctgaattggcacatttcccgtggtttcccttccccggggcttttgtcctctcacttcagtccgttgtccaaacttttcgttctcttccgcgacgtttcccttcccaacggatcaatgacaaaggaaaactgctgctgctggtggggcgaatggcaaagtgagtggggactcaaattgttgtgttttgggtggagaatatgtcggagcgggcgttgggcgggaggagggcacgaaattcgacttggacacggcgaaagcggcacggggcaacgcagcggcggcacaaaaagctcttccagcgaacagccggcgttgtggagccggtgcgcaaaggcagcggaggaaacggacgacggacaaaacggcgaaacggcatgggacgcggccactgaagagtttaattggccagataggtaattgtcaagaaaaagtaataattgactcactaatagtgatgctggggagtctcgatcttgagtttcattccaagattactcggaatcaaagatcggtcttgaatttcgagtcacgaaaaattttctgtctcgcatcactactcactagcagggaaagtgccctccaatcatttttaaaatataaatttttgtttttttaactgattttttcggaaaattttaatttggcgaggagaaaccaaaataaaatgggatcaccctaaggttagttcaattccatataanacatttttttaatatatatatatatttttataaatttgctaattatctaatcatgaatcccccatcgccttaattatgtcatca

SEQ ID NO: 18907 - DNA, 240 bp, Heterodera glycines
ttgtggaaatgagatgaattggcatcctcccttcctccccccccccccgtgggtttcgccattattcccccccccccccccgtcttttgcagccattcattgcgttaattacgtcgccactttggtgtaaaattgtctgattaatggaaacggatgggtgggcaaacagagagaaggtgaagccggatggatcaaagctgatccgtccgatctgttctgatcggatcgttggccatcgat

SEQ ID NO: 18908 - DNA, 1245 bp, Heterodera glycines
tattagggcaggggcatcggaaaatttgggagggacgggaaaaaaaagcaaaaattatttggcgtaaaaaacaaaaaatgcaacattcaaaccaattcagagtaccttagacccttttttcggcaacctgggttttttctggaacttaattttcttggattttgtttaaaaaattcagggttcaggtcaaatatgaaaaaaacccaggtccatgtgtttatcaggcacgcataacaggaaagtaccgatttttcataatgtattagatcaaatttttcaattttgtcaggccaatggtgtgacaccgttcgaatgtttggccgccacttttgactcgatgttggcacaatgtgcgctccatggcattggcagttccgcggacggaagcattcacctggtggggcaaaggaggcgaacgaaccacctcctgatcacttttttttaaaacttttcattgatcatttttgagccaggcaattgacaattctctgatcacatttcatttagggggatgggagtgatcagaactagcgatgccactgatcacttcttataaaagcaatttttgatttttttttaattagaaaatatatgtattcgtttgatttatttgaaaaaaaaatcctcgtaggaattttgaattttgaaaatttaaaattttttagcaccaaaaactgaaatctcaaaatcttgctgggtttaataggcattatatgcctcgggttttttgtgattctcgcgactgattaattcatggccactttaattagccccccccccaatttaaaaaaaaatcgtccttaagtttttcttggttttgagtggcgtctaggcctggcactttgccaagagtacattttcttcaccgtttaggtgcccgactcggcattttcacactacgagaaaggctgcatattgagtgagttctgtcatgagtttttttaaggaaatttctggcatttttttcagctgaaattgttgagctgtgccgaggctatccaatcatacggtatccgcaaaaggtaggcgccgctacagtaccgggccatcattaatagggactccatttttaagcaaatgcctaaaatttctgcgcacttaacacgcacagataagcacgaaaaacgtattttccgcttggttttgggtgtctacgatcacttttataatgcctatttttgcctatttcggggtttttgtgcctaaagtgcctattttaaggtttttgaaaaaatccttaacaaa

SEQ ID NO: 18909 - DNA, 894 bp, Heterodera glycines
cgtggtgaggcgaagcgaaaaaagtatgcgtgtggcgaagcgaaaaaagtatgagtgtggggtgatcggagggggcgggtcatttcagtacggaagagttgttctaatgattagggatggtaattatatggaaatccatatttttttcctggaatgtgggaggcctgaaacgcacgaaaaacatgtttttagcttggtttgaagcttctaggaaggatttctatatccatattttccatatttttccatatttcgcgatttatgtccatatttccatatttttccatattttggcattttggtccatattttatgtccatattttggcatttttcaaaaaaacctctattagaacggcccccagcagctaaattagcctttttgagcccaaaacccgaaaaatttttcaattgaataaatttaaattttcttaaaaattaataaattatgtcaaaaataagcaaaaaagcgaaaatttcgcttttgttgttgattttgcgctaaaaaaattaataaattttggcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatctggaaatgtatctcatatgcaatttcaaccaataaatttgaagaaattttacattcaattttgaaaaatttatgtccatattttgacatttttgccattttatgtccatattttgcgatttttggtccatattttatggccatatttcgcgattttatatccatatttttaccagccctactaatgatcaattaataatagaaatttttaatctattaattagatttgtgaccataa

SEQ ID NO: 18910 - DNA, 2138 bp, Heterodera glycines
ttattatttatcgaacaaaccacaaggtgctatgcactctaacagtggtgtaaaaaagaagaaaaaaaatgagaatagaaataaaacataaatggcagtcaaaaatcacaaaataagtgtcaaatcacagaataggtgtcaaatttaaaaacaatagacataaatgaaacaaatcacacctctcaatggggaaaatatgcattattgcttaattatttcttttgcaatttctcggaattttttggggtcatttatttccataatatttttcggtaataaattccatgaattaataaccctattaattattttttgtttttgtaatatatatcctattttgtaataaaaagggtttgcgaatagcccgtttagcaacagcaaaaaagttagatggtttaagatgtgtatgtttttttattattttaaaagtagttgtaatatcattaattttgcgcctaatttccaatgtcttaattccgcagaactttaatcttttttcatacggcatggcgacaagcccacattttttgaaggcttttcttgtaaaaaatttttggactgcttcaattttgtggacattttcttttttcaatggattccaaatttctgtggcgtattctaactgtggtctgatatagcttttatatgccaaaattaatgtttcaagcctccgagtttttaacgctcggagaagctgataacaagaaaaatatgaattttttaaaattttattaatatggttagaaaaggatagtttttgatcaattaaaatgcccaaatcccttacacattttgtttctggcaatggttcgccatcaagaaaataaataaattttgtgttattttcacccaagtaaaggaccattgttttttctattgatatttttagtccattattttttgaccatttatttattgcctcaagcgcggaagataaattctctctatttttatcatttttatgctcaatataaattttaatatcatcggcaaacattttaataccaacatttttaggcaaattattcggaagatcattaataaaaataagaaaaagcaaagggcctaagacactaccttgtggcaccccactataaatgttttttgagttggaatactgttcagagattttaactctgaatgaacggttatttaagaaatttttgataaatttatgaatcttaccattaataccgatatttttaagcttttgtagaagtaattcaattggaacactatcaaaagctttagaaatatcaatatatattacatcaacacaacttttattttcaatcgatatataaaaatcatttaaagttgatagaagttgtgttgtggtggatctttgtcttcggaatccaaactgaaatggactaaaaaattgatttttattcaaaaatttaagtatttctagctttattattttttccattactctgcatatggacgttttccatatttcagggattttagatgaatctaaaattattctaaagagttcagttagtatgggtgccaaaggtaatgcgcattcttttaataatatgtaagggatgccatcaggcgatgtcgaatttcttctagggagttttttcaataaattccaaatattatagacattaaattcaatgtctgtgatctgattagggttttcatggctgagtaagtcattgttattttccttgtacaaaaatgacttttgaaagacatcagccaataaaatacatttttgtttattccgaaaaataatttgccctcgttcatcaataagtgttggtattccggtgttagttttaagccgatttctaacaaatttatagagagaatttcttccatttgaaataaatttagcttcattttcacagtataatttgtggatatgttttttgtactccctgcataatattttatatttaattttaagctcacggcactcagcttttccttttagcatgctatgggttcgggctttttcccttactaaagtttttattttttcatcatgttttttcttaatagttgttttaagcaatttcatgggtacatttttatcaaaacgcttttttaattcagtggtaaatatgcagtatttctcatttatgtctgaaactgtaattggaaagggaatttggcccatt

SEQ ID NO: 18911 - DNA, 3071 bp, Heterodera glycines
ataaatagggctccaatttttaggcaaaagcctatttttttcctgagctccccgtggcctgaaacgcacgaaaaacatgttttttttgggctgttgttaagctattttttgtgttattaatgcctattttctaggcttttatttttagagcccaaaaagattaaaaaattttgaaagagcctatttttgcctattttggcgttttgccgaaaatttgttaacaaaaatgcaataaaaacaaaaaatacacccctaagaatcgatttttttggaattttaaaaatacacccctaacaaataagcagagattcaaaaatttctgaaaataaatcacctaagaaatgaagattttctcaaaaatcgtctttaaaattttttttggacaattttttgaatttaaaaaataatgtaactcaatactgatctgacttatttttttaccatttgaataaaattttttcattttacacccctaaatttgagactttttagagcctattttccattttttggagcctattttgggggttttttagagcctaaagcctacctattttagcggtttttagtgcctataaattggagccctacttcatatacatattttgaccatcattttcaaaggttatctcctttcgcgggcttttcaaattttcaatgaaaacgaatgaaatttcagtggatttataaatatcctaacaaaaacaacctcaaaattagaagaaaatatcttttttgatactaatccattgattttacatagaaataacctacaataacgataaactgttaatccccaattgtttaaaatgactccgccctctttttatggatgtgccaataataagaaccctcgaaaagaaggcaaatttgagtccgaaaatcgttgtttctgccccgaggcggagctgtacgccgtcgaatgcaaaaaggtgggaaaagcggtcaggttttgtgctgtttgtgtgaacttaacaagtgcggaccgaccaattccataatgattttgctaagtcaattaaaccaagaaaagggtttggaaacattcggattttgaattatttaatctcaaaattcagtcgatccgcttttgcccatgtcccatatttattaatgggctctctctctttcgtctttttccacttaatgcatttttttcccttttaaggtcgtgtgcaataaaatgaatcggcgcaaccttttaattgagaaatgctggatggcgattggcttcattgtgcgtaaggttttacccacaaatttgctgctgctggtggcaccgctttatccgttctttgcccgtttagtttgtggtcatggtaaactttggccttattggattacaaatttggctttggtataaaaaaagtgagaaagatgatcccaccggtgccaaaacatcaaatattgccaatgctttctctgatctcggcatactcattccgaccatcttcgcgtgtatttctactgcatttgttctcgtcatgttttgtttcactggtgtggttttttcttcctttttttgttgttcgaaacaaattataaaatactcgaatacttaattagcacttctttcaaataattatgacagaatttttcattaatagcttttcttttccgaacttttttggtcaattttttgcaactgacttaggtgttgctttaaattttttttattaatttttaaatctttacagattttacacacagcgcactgcaggtgaagtacaaatgtcgccagtgtggccacgaagtgcacaaaacatacgaaatgatgggtaatggtggaagatgcaaaaaatgatcatttaatgttttgtttcccgtttaagaagagttcagcaggggctttagcgacactttcagcgaatggggacgctacacaaatttgtgcgagccggaagtgatgctcaagaagaccgattacaacgacattgaggaagaattccgcgccatgtgccagtgctacgtacatgtgttccatgacagccgagtgtggaccaacaaattgatgaagcgcatcagttgaagagacatatgggaaatagcgaacgaacgaacgatggacaaatggaacaacaatatttgttaaatgaccaaaaaaagaacccctgtttattatgtccaattgttcatcatcgtgtaaaataatgtctgtaataaatgcgtaggaacttacactagttttattgtgcacagaaattctaaaaattcgaatgaaacctaattggtcctggtttaactgtttgaaaaggttagaagtgtctcatttttttacattaaaaaagtgcatttcgccacgaaaagggtgcggcacttaaaactgtcatttttagggctgctaattttatgtaaatacatattttttttcctggattctccatgctctaattagtaggaaaaacactttcttttttgtgtttgcgaacaaaagttgggacttttatttacatattttggactttttcgtacatatttttcatttttttacatattttgaggatttttgagaatttatagaaattttttgtaaaaaattaaaaaatttttttgaaaatgtatccctaaaaaatcgaatttttttttcaaaaaatgatatatcaaaaattaatttgtaaaatattcaaatgtgattctaagcctattttggtcatttttatggcattttgtgcctatttcactttttacgaagaatttttttccaaaaaataactagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtccatattttggccattttttggaaattttcacaagaaaaatgaaaaaaaaacgaaaaatacacccctaaagatcaactttttggaaatttttaaaaattacaccccacaaaacacgaacaatttgagttttcgtcgtcattttggcattttcaataaatattttcgtcatttttt

SEQ ID NO: 18912 - DNA, 2611 bp, Heterodera glycines
aaaatttagcatttcaatgtttcggaagccgaaaagcaagaaagttggcgccgatatacgcaacattcggcgtcgcgcggatgactctgaaggagaggagaacaacagtgggccaaggcgatctccctccacctgggctgatgagatggacgattaccaacaacaacaacaacaaccaaacattggcgctgaaagccaacagcacggcgagggtcaaatgacaacgaccgcagcacgtcccgtgggactgagttttgacgagagagagggtgaggagcaaagcgataattattatgctaatggaaatgttaaatgccaataaaagggatatccgtgtaatttttgaaaatacttagttacgtggtttttcaaatttcatatgtgccgcgctcgatggagcgctgcattcattgcttaaggggacgacgtcactcatttcaaactgaagcggcacactgcgagcggtcactcctctgccgccgccgcgcgtaggcgcagcgttgagaaagcggcgagacacaaacagaaaacggtggcggacgaagagcaaacggcgggtacaaacgaagcacagaaacaggttttaaataagccaaatttggatcacttaaataaatatttacaccatttttaacaggtcaaacaagaagtgctgccctctagcgaatgggaaaagccgaagcaagggaaaatggaggattctcagcaacaacaagacggcaaacagcaacccaaattcagagaaccaacgggagaaaaagtgagttagcccccccccccctctccgcaaaaacttgtcgtttggctttgaaaaaattagtacatgcagaccgatgacaatggggcgactgttcgtgccgcatttccggcgacaatgaccgatattcctgacgcaaaagcagtgtatgaagcgcgcaaaaaaagagaaatgatgagacaggttcgaaattggaaggagaaaaagtcattacaaaggtgttatttagggcggattgcccgcctcccaagactacattcctttggatgacaccattagtctgaaaagtggcagacaatctggggaacgggcacgacttgtgcgcgaagacgaaaatgacatgtcggacgaggaggagatgggcaggttgaaaagaaatggaatttggagaatttttctgcttcaccatttctgcattttttgaactttgttcttctcacttagtttttactctgccaaacaattgttgcaaagtgaggaggacatacggcgtgaagagcaggcccattttttggcaatggaacagggtagcagcgaggaggacgaggctatggaagaaggggcgaaaagcaagagtcgaatgggagaaactgtcagagggaggtacaacggaaaggcagcggcagggcggcagcacaagttggtgcagtacaacaacggaaatggagaggacgaagaggaagatgatgacgcattgcaacggtgggaacgcgaacagattcgcaagggggtcagctcgcacaaggttggcacctacgggaaaaacaagaagatttttcattaaaaaaaaaaccgataggtcatgcaaatgcaagagcagttgaacgccacttccctaaattaccggggacgtcccctcaatatgctcgactctggtgaggcggacatggacatcgaagtggacatactggcgatggaccaacagcaaaatgcacgaggcgcaaatgcactaccgccaggtgttaagcagaagcggaaacagaaacaaacaaatcaaatgactctttaagaattgaggaacggccattctgctaaagtcgtatcggtggacgacattctcggcacaattcgccaaagattggccgacaaaaaggagcaacggagtgccaacgacgaaactttgatcaaaattcgcaaccaaatgacggaaaatactgaactcattcataaagtaaataaaaaagcgaaagtgaaaaatatggggtacaactgcattttcgagtttacccctttggtctcccatggtgacagtcatttggttaaaatggatttgtgaatattttagaattctttgtttattggcttcagttgcaaaaaacttcttccttttattttcagtttgaacaagggatgccccaattggagctcaaatttcgaatgttccaagagacgcggttgtatatacgagatttgctagattgtctgaatgaaaaggtagcgcaataaacatttcatttgctaacaataagtatcttagaatttgacaaaataaatcatggttcttattaattttggaaattgttattaggtttataaaaaaatttcttaaaaatataacttttgaacgttaattaagaattttctataaatcatttttaaaggaccacaaaaaaaaaaattaccataggtccttaaaatagtcaaaatatgttgtggttttcaaatatcggaaacatgaattataaattctctcttattgattagctgaaaattaatgacttttgattatcgttctcaatatccatttcagatttgcctaattgatgcattggatgaacgtgtttcagaaatgtggcggcaaagaacaggtgccaaattttggaaaaaatgcaaaaatcctctacagtcagaacg

SEQ ID NO: 18913 - DNA, 3209 bp, Heterodera glycines
tttggcgaaaaaatgatttttttgtaaattttccggtttttggcctcaaaaaggcaaattttaacattacctcgttcttttggtacgggcctgggaggattattgttcaacctcctcagaaaggggggggggttaatggagacggggcgataattagagataatacggtaattgactttcctcttccagcacgccattccctttcatcatttaacctcttcattcgcgacttcgtctcttggcaaccaaaaccaaagatttgccccatcaatttgaatgctgtaaatacgaagagccctcctttggatgtatacacttgtcatctcctcctctatttaatgttcggaaatcattgaccacttcatttctctccggtgagtgagcagaggcggtcgacttacttcatttttctttcaatatagagctccgaacttatgatgtgtggcgctgcgaagacggaaacgaatgtgcaagtggctgttgtgaatgtgaactcgggcgtcattggggccaatgggaacggcgtgttattggcggaaagggaaaccgactcgcgaaatggcgccgaatttacaccaaactttgacaacactcaccaggtggaagattagttcgctggtaaatgggcgggcgagcacaatttttcctaccgatgttacacaccaaagaatgcattcattgttggtgtaaacctaaaaaagggtttgatctctgatcggcgcgtcaaagatcactgagctgtacaaaattaggaaccgaagtgatcggctgctcactcgatcgttttacaacgctgcactcagagatcagattgtcaatttccaaggtcaaacgcaaaaaacacttttccctttccgttggtgtttaattgccgattattaacttccctcccactaatcatttttgtcgtcagtttaattgtttgttcactgttcagggcaatttgttgccctcctcgttttctgcctgcggtgcttccacctcgagcactttgttgtcgatgccattcgagtgcagccatgacttggacacgaattcactgcaggcactgcaccacgacgagtttgtgtcttgaatgattatcaaataaatacattaaaatctgattgttttgattgctttttattttttccatcataaaaactcttcggccattgtccgttttgcataatgttaattgactcggttcacttttcttttcagtgatgaagaccaagtccaccgtgcgcactctttcttccaaaaacaaaaaggacgtgaggaaggggccaaaagcaccaatgtaaagccaggtgggattcatcaaagcattgctttttcaaattaccaatgggctaatccaaaccttaggatggaaaagttgggcggagttatttatttcttaagatttctatgcttttatatttaatttaaattacaatgaccatttcttcccttttagacgaactttgttctgtttgcggtgacttagcctccggaattcatttctccgttctttcgtgcaacggctgtaaaacattttttcgacgcgttgtaattgaagtgagcagaacatatagaaatttgatgatcaattttaatgttttttcattttaagaatcggacatattcctgcaaaaggaatggcaattgtcgcattgacaaaaactgccgttgctcatgtgacttttttcaaaaatttatctctcaaatttgcacatttttttttctctttaggtcgggcctgtcgcttcaaaaaatgcattagcgttggaatggatgccactggtcacatttttaatttttaaataaattttaaattatttaatgttccgttcagaattgaacattgaacggcgtcggaaacgccgcgttgtcgaaagtgtggaaaagccgtcgatgtccatcgaccgaatcgacgaccctttggtttttaccgtttgttattcccctaaaatttgttctgcttttcgatccgtgaatcggtcgtgaaagagcgccaatttctcaaattgctcacttcgaccaccgccccaattcatccgtccgtcactgacgcactgtcaaaaccgagctgtttccgacagtttgtgcagcacgaacataaccaaatgaaattcggtgggttcaaaaaaatgcaaataatttttattcgttcgaattgtcaggggaccaaatgaacttttcatattggcgagcaaagattctgtccacttcaattgaatgggccaaatcgtttgaagaaatcgaggtggcggctttttcaatcctaataaataaaaaaaattgcgtaatttcagaggatggacgactcggacaaagaggcgatggttgtgaactcggccttttcaattctcgtcttttctgaagcgtttcacacccccgagcggttcaccgatcgcattatgttcccggacggactgtctgggttccgcaatttcagtgccaacattatcaaggagcgcagtggtctgatccccacggttgttgccgttatcaacaacattttggtgtgtgttttgacgggggttgaaaatggtgtctccgtttggtcctcccaaaataggtcccaatccgtcgaatgcaaatgactgaaattgaatatgtgctccttttggccattgtgcttttcgactcaggtccgtccacatgcctccaattgctttttgcgtttccaattttgccccttttgtcaatttttccttcgtttgtctcatttttcagaatgtctttccctcagcaagtcggccgttgccattatcaatgaaaaacgcgccgctcttttggcgagtctaagacgtcacctgaacaggaaattgcgcgacagaatggaggcggcggtgcgaatggcggaacttttgttgaggatttcgaatgtccacgtgagtggccaaatgtgttcttttaaagtgttttcccttcatttcgcattctttcattttccaaatccgtttatttagattttttctcttttagaaagtcgctgcattcaaacgggaaactctctgcaccattgaaactttcaatttgatgtctccccatccgtgggtttatttttgacatggaattttgattatcccattttttgctcccttttcagtctcacgatggagatctctaagaagtacgccgacgtgtcttttttctgagtcttgcccttcgagttcgatgttccgacaaatcccaagaagggtcttgccatgtaaaaattgtccgacttgccaaccact

SEQ ID NO: 18914 - DNA, 2445 bp, Heterodera glycines
atttttcatttttattgcatttttcttatgaaaatttgccaaaaatgagcgaaatatgctctaaaaacccaaaaatggcaaaatatgcatttattctcgaaaacctcaaaatatgcttttatatgcactaaaaatctctaatacagaaatgctatttttgagcccctttcttcaagccctcaaaaatgcataaaagttaaaaagaaggaataaaaaatgaaaaaatgtaaaaacatcgtccaattcatgacaatggaatgacaacaatttcattagctccaatgccacatcctaaacaaattgaaaattttaaataaaaaattttcattcgagaaaggacaggatcaggcacttaactgtcgcgattttcccgggatactgacccagaattgttttcaggttcccggtaaaactgggatttccggaaaacaacacgtccttgaaaatttcccaaatcctgatcctgatttggtgttcaaaatcccggcaccggtaatctttccctggcccggttccaaaatagtgatactgatcacgacttcggttcaagatcccggcactgttaatcctatcccgggcccgattcccaagttctgaaagcatactaaattttcaagaccccggcacagttcgtcttatctccgccccagatcccaattcctgatactgagccagacttggttttgacgattccggcactgttaattaattataacaaatggctaaattttagagtaatatttttaataattatcaatcaattaattaatttaattaattaactaattaattacttcccaacggcggcacccgatgcctttgagatgatcaaattgaaggcaattaaattatgaaaaaattcatttacaaaagaatatttaaaatttcaattttttattttaatttatcaataataattcacaaataaatgttttgattaaaaatgatcaaatggatgaaaaggacttcaatggaaaaatgatgacaaattgaataaattaaatggaaaaaataaatgtgcggaaaaagctttcagcacattttgcagcagagattgttgtattaatgaatgtgtcaacataaaccattaaatgcaaaatataaaatatctttctttatgcttgatccactgaaaaaaacaacaaagtgtaaaccataattaatggtacaaaaattaattacaaaaactatgccgaaaataatctatccaattaacagagtgggggcattgattagtgaggacttagcaaaaaatcaaaaagccataaaaaatatgcatttattagttctgcaattttatgtaaaaaaaataattcgtttggtttttaaattttatacaaggattttcaatagtgttttaaaaaacatgttttaaatatgatagttcccaaaatagagccccaattttcgtccaaaaaaaatgcgatttcctgaagacaaataatccgtgtcccatcgatcactcgtcatcgtcaaaagtgacttcgatcactaaagttacgctttgcagttgcttcgaacgcgcaattttgggggaaaaattggcacatttcgcgcggaagcgaatgatatttatagacattgatcaattaaattaatccaaagattttaaaaaggaaaaaggaattaaaattttcaattttggcaaacaaaaacagacaatttataaaattattggcgaattctttttattcttaaattcgatttttaatgaaattctatgaaatatatttcaaaaatatgcttcaaaaatgaaaattgactatttttggtacaatatctgttataattagggctgggatttttatgtgctaaaaatcctgaaatatgtaataaaatatgtgctaaaaaaacccaaaatatgtgctaaaaaccaaaaaaaaggcctaaatatgtgttaaaaatgcaaaaatatgtgctaaaaattggaaaaaccaagtgtatttacgcaaaaaaaaatcatatttaatatcagtctttatcaattttcgcccgacctccaatgaaaattttggcgatatcaatcaatttgtaaagtcccggattaatttttccatcagttgaataagttccttccgggaactttgaaatccagtgacgatttaacacagcgtttgatttggctgctttaggcatttaaatatataaagaaattttctaaatgcttaagaaacgtaaagtagtcaatttttagggtgcattttcagattttcttgtattttttttacgatttttctcaaaaatgccaaaatatgtgccaaaaccccgaaatatgtgccatatgtttttatgtgccaaaacgccaaaatatgtgtttttatgtttttataactcgctctaaatcaaaaattgttcggagaaaatgctatttttgggcttcgctcgccataactaagccgcaaaaaaaaaatgttaaaacataaaaatcccagccctagttataat

SEQ ID NO: 18915 - DNA, 2023 bp, Heterodera glycines
  misc_feature (49)..(49): n is a, c, g, or t
  misc_feature (98)..(100): n is a, c, g, or t
  misc_feature (108)..(110): n is a, c, g, or t
  misc_feature (116)..(116): n is a, c, g, or t
  misc_feature (124)..(124): n is a, c, g, or t
  misc_feature (141)..(141): n is a, c, g, or t
  misc_feature (143)..(143): n is a, c, g, or t
  misc_feature (2013)..(2013): n is a, c, g, or t
tctgagccactccgtctcgccaactccgtctggcccctttagggtgagngcctaaggggccaactccggctcagatactttaaaaagagaagaaaggnnncaacgaannngaaaanacatcccnaagaaagaaaaaagagncncaaaaactcatccgttaaatctacttatttattttcatgataagaattattcattaaaatagtgtctgacctaacattttaaagtaccataaatattttagcactacgaaaatggaaaatgctgaaattaaatctcaacgaaaaaataaaaaactcgaacatgaaggctgcctttatgtcttccatttgtttaatgccgatggtgacgtaaaattttggcgctgtgaacatcagcacggcgaattcaaatgccgagggcgagtccacacaacgctaaatgacgtcgtactgaagacagttggtatacacacgtgcaaccgcagcgcggcaaatgtcatcgcacaaaaaaatcaccaccggcattaaacgacgtgccgctgaaacgatggaaacgccagcagcaatcagggcacacacgcttcagcaaattccaacgccactaatggcaaacattccaacaaagaacgcgacaaaaaaaaagtgaaaaatctatttagttttttactttttcacatttttggttttaagcttgtgaagcgagtccgccatgaaattgaattgccgccgccagtgccgttaacgcttcaagaattggaacttcccgagcagtaccgaatctacaaacgcaccgaagaagctcaggagcttttccttctggcggattcaggaacatacaccgaaaatgggcgagacggacaacagcgttgtgtttaagggcaattttcagccattttttaattttataattctcatttttggccgactttctttcggaaattgggcttccgaaatgaagtacatttacgctgacggaacctttgcaagtgcaccaacgctcttttcacaactttacgtcattttggcggggtacttttttgtcaattttgttttacattcgtttttcaccaaatttcagtcgtggaaaatgggtgtttccggttcttcattgtctgcttacgtgcaagtcgcagtccacgtacgaaaagatgtttgacatgatcagaaaccgctggccgacatttgcaccgaaaaacgcatccatggacttcgaacagcgatggtcaacgccctccgcgcaaaacatccacagtctcaatcaacttttgtctcttccacttggtgcgcaacatgaaatctcgcctaacagacgaacaaactcgcgtaagaaaaataaaaatttattgattttgaaatctcaaatttagcgtttcacaactgacgctgcctttgcacaagctgtcaaaatgatcacttcgctggcgtttgtgccgcttgaggacattacaccggcgctggcagcgctcgaagatcatcttccggatgagcttgagggcgttctcgattggttgtttgagtttaattttttttttcaatttcattagtcattttaaaggtttgtaatcaactatgttgggcgacttcgcaacaacggcacacgcactcgtccattgtttcgtcccgaagaatggagtgtgtatgagcgcaaaatgaacggcagcgaccgcacaaataacttcgccgaagcgtaccatcgcacgttgcaacttgcgatcggacatggacatcccccaatttggaaatttatcaacattttgcgcgagcaccagaaaataatcgacgtggacttcgaacatttcctcgccggaaatgctccgccgcataaagcaaagcgttgccgtgaagcagacagacgaattttgaggatcctggagcgctacaatcaagaaaaagagcggccgcaaatcgaaaatgatcaccaatattgccaaaaccaaattaatccgaatttgattaatgaaatgcttaggggaattccagcaaattaccaaatgaatcaatgattttctttttaattgcattattatttatntgtattttcg

SEQ ID NO: 18916 - DNA, 926 bp, Heterodera glycines
caattcccattcgagtgactcgatttaaacgtttatttctttggatggacatttattagtactaatttgcccgatgatgaaaaacaaatgaattgagtccaacaaaaagcgctttttaggcgtatttggtggacggagattgtcaaagattatgagatttgagggcatttagtttttgtaactttttaaaaatatgccaaaaaggttttttgtgtgttaattcaagaaatgcactgatcgacaaaaaatttttttaaaaatcataaaaagaaaagttacgtaaaatgttttaataaaataaataatcgatcatttttttgttccaaaaaagccaaatcaaaaaccttttgtttaaattaaaaagtgtaaattcttcactttttgttttccaattgaaaacgctcgaatttttccgtttttattgccaataaaattttaggccgagctgaacattgcgtcgttgaagcgttttgaggacatggaattggagcggcggaagcgccatcagaaaccgacaaagcgactcgcgttggacgggccgcgtgtgcgcgagctgtggacacgggacggaaagcatttcatcacatttgtgcccgaaccaccgccagccgagcaatgctttccaaagtgtgtgtgggttttaagtcaaaaaaaaagagctaaaatggttacttaaaggagtggtgctacgtttctccgcccctgcaaattttttcatttcaaacggaagtttttcaaaacaaaatttgaaattttttatagaacaatttgcatggaaaagtttttttaattttttttgtaatttataaacaaaaggaaatttttaaaaaaattgattttggaagcctgcatttttattttttagtatgggagggtggattttcttcatcaaaagtgttcaaagcattaattgtatttttgattat

SEQ ID NO: 18917 - DNA, 1959 bp, Heterodera glycines
tcaaagcattaatggaatttttagattatttttaattgtttgataaattaaaattagatttttcatactgtaatattaatttgtctttctcatattgtttctccgtttttgcggattgacaatagaggatgaaaattaataattgaatgaattatttatagttttttaattacaatatttaaattatttttttgcattttatttttatgaagctttgacctaaaaattgataaattttcgaaaaattgctttttcatcttctccggattttcgtttcttggattgacgatgtggcggacagacgactcattccttattgacttgaatatgatggtgccctaagatgatgccaaggcagttccgcgagtgcgcaatcaaagcacatatcgcgcagtttcattgacccgctgactccgttgccgtacgcagacatgtacgcgttccgtgcgttgcgcgaggagtaccgtcaattcttggagacataccttgaccatattcagcatagaccgcatgaacatcagcggaagaagtcggcggcaaatgattaaattggtcattatttgatttttttaatttaaagaaatgtaccatctttttttattcgtttgtcttcgtcgtccattcatttcatttgtttgaattattgcataaaacattcaatttgacaagggcgtagccagcaacagacccttggctttggagggcttttgccccttctgcctcccccccccccccttttgctggctaagcccttgcaatatctgatcagcaagcgggtcaacgggggggggggattaatcagccgccacaattcgtcactacccataaaaaaggcacattgaattttgctgcccaattattaattagccaaacaagttttatatacatattatgtattaatggcaatccaaaagttctcacgaagacatggttttttgccacattgaattgcattgttttttttttttgaaaaacgaagaaattaaattgaaatatgatggaaatagcaagctgctgccttattgttttattggatttgattaattgataagaaatgaaatagtcacgtttttgcaacatctccgaatcaattattaattaatcccccatcatttcggggtggtgacgacacatttcttccatcaatgaattatggcttaattagatgtgtgtatccgccgtcatcagcgtatcaaattgtgctcgttgttgttgctgctgtttttgtagcggtggtggtggtggttgtgttgcgaatagtgctggtcctcctccacctcgtcatccctcttttgttggtggtgtgccatcgctgccgccgcggcaccggaagccgtactcgtagcagcagccgccgatgatgacgaggacgccgccgttgcggccgtgcgcgtcttggcgaactcaatgcgaatggcgagcggcgtcgcccatagcacgctccatccgccgtcatcagttgtgattgtgtttttgtggcggttggttgtgttgcgaatagtgctagtcctcctcctcctgatcactcttcttttgttgttggggtgatcgttgccgccgcggcacccgtattcgtcgcagatgtgcgagagtgcaatttttcttaacaaaagtctaaacttcccgcttgtactgtgctttgtttccttctttttcgaaaaaaaatttgtcgtgtaaaatgatgtctttcctgagcttttcaatgtctctttgtcacgaatatgacacatttttgagactatcaaccgctcgaaatctaacagaaagccgaaccaaaattttctaatttactgcattatgttcgaagcgtgtcgcgacatttgcatcattatccaaattcggttacaaattaagttttttaatccctaatcgccttgaccgaattgtatgatttgttatcatttgatagcgccacgttactgttgcctatttgtttgccaagtttgggctctgcgttca

SEQ ID NO: 18918 - DNA, 2285 bp, Heterodera glycines
catcacatcactgtccaagtcggatccacctgatgtcttatggatggaaaaggaactgacggacggcacagtgctctgagacatcggttggctgccacgggtttcggtgggatggcgtcggcctgcactgccaagttaaagaacgaatactgaaaagcgaaccttggtctaaaaacaaagaagttgtcatcgaatatgccatcagtttctgcgtaaatttaggctttgaataaggcaccatcgcatggggaaagtgtccgccgggtttaattggcgtcgccagaatttgctcactccattgcgcttccaagttaggcttcctaatggcaaaaaaagaaagaaaacaataaaagtaattgacaaaaatgcgaaattttctgagaatttcagtgatttcactcacttgtgtgggttgacgcgaagaaataattctttttgtttgaagggaagggcaaattgttcactcccgagcatttcaagccacgaaataagtgacaaatccgctgacgacaatttctctttatgagaaagcaaatcattaaagtgtcgctcacaatgtgttgcagctaaagaccaaaaattgttaatttgcaccaaaaaaaaccagaataagcacgaaatatgcacagcacaaaaaaaaaaaaaattaagttcgaaaaatcaaatataagcataaaaatacttaaatagggtaattataatgaaatcaaaaagaagccggttacttaataataacagaccaaataactttcaatctttttttttaaagtaaccgtgctttattatttcgctggacattaaaaaatttgcctcccaatgttttctgaccgtttctcccttccattgcttgctcttgacaaaaagtcaatgcatattcatagagaagtcccctaacaacgagctgaactaatcggtcgtccgttgaatgttttttgatgccttctaacggagcattgcttttctgtgaaatcccatccataaaaccggcgatgtgcggaagaacggcttgaaagcaatccattctgaaaattggattaatgagaatgacaccggcatgaataaaagcataacttgcactgtaagggtcccacaaacgaaaatgttcatcctcagaaagttttggcaatgttaaaagtgcacataatttacgaaattcgtccgcattctcacaaaaactttcgagctcatttaaacaattaacaatttcctaaaatggaaaacaaaaaaagtatttagaagggctaacctcaaccgcaaattcgcaattttgtaaggggccgggctcttgtttaatgcaaagcaattcgaagaatttacacttggcaatctaaaaataaaagaaatgaattgacaagcacaaatgccaattaccaaaaaatggattctttttgaaggaaatcccaccaattctttgagtggcgcaacgaattgcaaagccgaatcccattgaccatcctttgttagaaaacaaattatttattgtgcggagaagaaaaaccaaaatgagttgacgtagaaagagaaggtcatcggagaaagcaccgttgacaagacccgtctctctttcaagtgaagcctaaaataagaagaaacggaggactatgacaattaaacgaaaattggggaaggataattcggcagcggcggataattttaaattattttagtaaaaaatttaatttcccggtattgccgaatagtccatcctgactacgggctttaacctgagttatgtgaatacgccgattttccaaaaattcaagcaccaatttgaccacatcgcattcatcaattgttaaatttactttttgacctaaactaaccatcccacaaacgaacttaagcaaaaattttatgttgaaaaaaaaattggaaaaatatgtaatcggaaagacagttgatttttaagagtttttattcatgagaaatactcgaaatcagtttattacatatatattagaaaaaataataataacagttaatgagagatcgaagatcatcccaaagacaaagccccgttgagaaactcagtcatcgtgtccgtgtcccatttttcaatgctgagagttttgtgcgtttgcccatcgccactcttcagcaaaattgtaggcaaaactccacggacctgcttgaccttcagcttccctccccattggtccttcatttcactacgtacaaaggcttaatgtacttgtaataattttatgtattattgacaaatgctataaaaatacctgcaacttgcggaaatcggtgcaaattgcactcacaaacatgcatttcag

SEQ ID NO: 18919 - DNA, 1224 bp, Heterodera glycines
acgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttttccatttatttcaatcggctagtgctttaaggttttgtctttgactttgcttttttgtccatttatttcaatcggctagtgctttaaggttttgtgttttgactttgctttttcttccatttatttcaatcggctagtgctttaaggttttgtctttgactttgcttttttgcggctagtgctttaaggttttgtctttgactttgcttttttttccatttatttcaatcggctagtgctttaaggttttgtctttgactttgcttcggctagtgctttaaggttttgtctttgactttgctttttttccatttatttcaatcggctagtgctttaaggttttgtctttgactttgcttttttgtccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaataaatattacttttttaaatttgtataaagttcctattttgtctttgactttgcttttttttccatttatgtcaatcggctagtgctttgggccgttgtctttgactttgcttttttgaaaaaagaagctatttcaatcggctagcgcggctttaagggtttaagtgttgacttgcttttttgtcggcattgaacggtgatggctgctgctggggtgccacctttgtcgtggcttcattttttccagtgattggcagtcggcgaaatgaataaaacatgcagctcgactttgtgttaaagaacttttggcgagttctttgactttgcttttttttgcctaaggcacaaatgctgtggggaactccgcacctggggatgctgaa

SEQ ID NO: 18920 - DNA, 1170 bp, Heterodera glycines
  misc_feature (31)..(31): n is a, c, g, or t
tggggaccagtgtgcttgcattcgaaaaacnacgagacataagcgcccgaaggcctttggcctgaggaagtgtcctaaccggggaaatccggagtgctcgtgtgagtgcctgtgcactgccctcggagctgtgtccagcggcgagatggttcttcccaagtccgggaagctcggatgcctggccagcgctgtgtcattaccacttgctcggtcgccttcgccgccccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgatgcggttaaaaagctagtagttggatcagtactagccgtccggtgcacactatgtgtgttactggtttggttggcttttctgccggtctttccccggcgttggcctttaccggtcggcgtcggtgggctggcgagtttactatgaacaaataagagtgcttcaaacaggcgtttcgcttgaatgttcccaggaagaataatagaagaggatttcggtcacgattttattgg

SEQ ID NO: 18921 - DNA, 1621 bp, Heterodera glycines
ccccccccacaacccctgccccatgggcacctgcccgccagcgacttttgaaatgagcattcagacccccagccccaccaaccccctgccccacgggcacctgcccgccagcgaaacgtcgaaatgagcactcaaacccccagccccatcaaccccaacacaactgacggtcgcgaagcgacgcaagcacgcctctcctatgcatctacccgtctgctaatgaactattttctgatcaaaaattgcttaacttccatagaagggctgaatgaagacaaagaaaagtgattcaaaacaaatttacaaatatgaaaaaaacaatcattgtattcaaatttgaatgataaataaaaatagccaaataaaaatgaaaaatgtctgaccaaattaaaaaattaaaattgaaaaagtgaccaacaatttaaaacattttcacaactttcggtttcaaaactaattaatcaatatttagttggagaaaaaaaacattaattactgattacataattcttaggcaaatatgaaacgaaacattcagtgccagcataaaaaaaggcacgtgatcagcgatttcgcaattgtctagggggacgggtaaatcaaaggggtgccactccggtgccagcataaaaaatgcaagtggccagcgatttcgcaattgtctcgagggtgaatgaaaaggggtgccactccggtgccagcataaaaaaaggcacgtggccagcgatttcgcaattgtctcgagggtgaatgaaaaggggtgccactccggtgccggcctaaaaaaggcacgtgaccagctatttcgtaattgtctcgagggtgaatgaaaaaggtggtgccactccggtgccagcataaaaaatgcaagtggccagcgatttcgcaattgtctcgagggtgaatgaaaaggggtgccactccggtgccaacataaaaaaaggcacgtgaccaacgatttcgcaattgtctagggggatgggtaaatcaaaggggtgccactccggtgctggtataaaaaataagcacatgaccgcttttttttttggttaacagaaacggtcattcattcggtgccagcctaaaaaataagcacgtgaccgcgatttcgtaatgaccacccaaaatttaagtgggcgtttctttcggtgccagcctaaaaaataagcacatgaccgcgatttcgtaatctttggtcacatgaccacccaaaatagggaggtgtgtcatagggtaccattataaaaactcgagatttcgtaataactggtcacatgaccagtgcagtgtaaatagccaagccccaatgttttttcaaaattttcccttatctaattgcaatcctaatgaatttggaggccgtcgttattaacgacaaaaaattcaaaaatttgaatgcgataggcaacaaaattgtggtccctcttcaaggctattttttgtgcccgttttttacacgcaacggccaatgtacttctgctgcccacagccccgccttttacgttcctcctcacgaggtgagtaaaactgtcatttgagagatttgaattcagcccactcatttgcaaaatattcctagtaagcatttatttatattttggttttgtatttttcactttta

SEQ ID NO: 18922 - DNA, 2503 bp, Heterodera glycines
attggtgtcttctttaataatgcctttttaacatttgtaagtatctattccatccgttgttgacattcttggttatcagcactaaaaatcttgcaatgataaagtgattacaaatcatttatctttttttgtttactttactaatatccaaaataaaataaaaacacagaacaaaagaaataattattttattttatttgctaaatcatgtaaaaaataataattttttttaaattggatgtggaaaaacctgcagcttaaaacccaaagaaagaataatgggatacgaccagcagaagcggggggcaggggcttaacaaaacaaagcgccccttctgactttgactgatcagcggggcagtgattagtcattaaaaaacaacaaaaagtgtgccccgggcatattaatttcgatgcgcagcagcaggataattaccattgtgttattgtcgtttgggggcgactcgccgccctcgggcgataaaaatggaaatggggaggcgcactgatcagcaaaagaaaataatgggcaaaaaaaatgccgaaattgccgtcgccgccaaacccaccaaaaacttgactttgctgccgattagcagcagaagcgaaattcgtataaaagagtcggagaaaacatgggaacacattataacgtgctctgttctcacaaagctataagtttctgataaatttcgctgatcaaacgactaaatcagtgatcacaacagttgttttttggggggaggaggacgctaaaaaaagcgaacccatcacactaattaattaatttactaacacatagacgtgttttgagtcttcatttgtgtaagataaacaaatttatctaattaatttttttaattttccgagtcagtcggttttgccatatttcaggctcaaatgtatttttcagtgactaatgcctaaaaattgtgataaaaattacgccctttaagaataatttccccctgaccttttaagcatttgctttgcttttaaaatggcactcgaaaaggccgccggcgtggccatagcgatggccgtgtgcactgtgctgctgtgtgtggcgggcattggctttgtgcagcgcgaagtgcagtccatctgggccgagttggacacggagatggaccggttcaagctggacacggacgacctgtggcacgacatgttggccatgggcgccggcacggcggccaaccgccaacgacgaaatgcgtacggcggcgcgtcataccaagcggccggacagcaggcggctgtcggcggttacggtgtcctggtcaagacagtatgcagtaagtgattttgcatactgtagtgtagtgatgggaatgataacattattgaaaatttagttgaaaaataattatgtaaaatttgcttgaacagaatgccaaaaaagaaactcttgcccaccgggtccaccagggcgtcctggcgatgtgggttttgctggcagaccgggcattcccggaagggacggagtgccgggcgtggcagcggacaattggcacaacgcaccgttcaaaggatgcattgtaaaattataaaaacattttaactttttaaattttttgctagaactgtccaatggggatgactggtgccccgggggcagcgggaaagccgggacagcgcggaatgtaagctaaaatttatgaaataaatcttaaataaagaacattcagtatttaatttccaataaaaatttcggcttttttaaaatcaaattaaattaaaaaaataatattaaatgtacatttaaaatttggttaaattttaactttttttaaattttatttgcaattaaatataaaagttcagtcaacgaccagaatttttttcgtaataacacatccatataaaatgtaattcattggaaaaattcaggcgtggtcagcgtggcagcccaggaatgccaggacgtgatggcatcccgggcctacccggcgaacaagggcatccaggcgagaacggcaaggagggcggcacgggagtgaccggcgagaagggcatcgatgcggagaagcgtatcggccgcaagggcttccgcggagtgccgggcgaacatggccccgagggaccattgggagagccgggaaagccgggcccagtggggccaaagggtaaaatgataaattttatttgaattttaaaaagcctcacaagagtagaaaggaagtatcaggagagggatgagggaacaaagcttccgctccgcccccgattcctaaatggttaataaattttgttactaacaaatttataaaaatgccaaatttttccgaccggaactctctcactattcgcgggattgattaccttttttcaattttttgaaactttttgtcaacaaaatcccattttcatgagtatcatttgaaaatttttggagaatagaaactttttctgtcaattgtatttcctttggacctaccataaaaaataagttttcgtatttatattttttaattttgttaaagcaaccaaaaaaccaatt

SEQ ID NO: 18923 - DNA, 1674 bp, Heterodera glycines
caaaaattcttcacgggccgggatcccgcgggattaatccagcaaatcccgcattttccaaaaaatgcgggattgcggactaggatcccgcaaaatcccgcgcgggatcccgtccccgcggcggggcctagtaattatgccatgaatagaaacaagtcataaattgaagaagacaaaacatatgtttgtattaataaaataaattaaaaaagaatattttgaacagaatttagccataacaataaatatctaaatattcgtattcgacctggaaccaggcctgggtttttccttgatccaagtccagacccaggcaatttttcggcaacctgagtttttcctggacctggattttcacggatttttggccaggaaatctaggtccaggtcaaatgtgaaaaaaattcaggtctaggctcaggttcggcatgaaaacctggatttccgggataatattttaaaacttattatttcgagtgacaatttttttatttcaagttaccaaaaaatgatatagatttaaaaatatcatattataattgtcatatattttagatgttcctaagaattcattgattttttaaacatttgcttgcttttaaaaacaaattaaaaaaaaggttcaggcctggatccagccaggcctcaaggagccggaagttttcctaagccaaagattttcctggatttttttccgggaaattcaggtccaggtccaacatggataaaaatgaattctaaataaatgtaatttaattgccattccgccccccaccccccgccccaacaattttgtgccgtgcctaattaccacgccagtttccaacgccatccgaacatcattaacatcgctcaacggcacccaacactcggccacaaaaaatttgccaatcccatcaaaagtgaatgtgttcagtgtgtggtaaatggatttgtgaattcgcacctaattaattaaaaaagtattcattttttaaacgagcatttttgttcatttcatctttaattaattaatttaaattagatgttattaattaaattaattttttgtttatttctctttaatgaaataattaattctaaattaggtgtttattcatttttgaatttatttttgaaaaaactctctcacttgttttaaccattttctgtgatttgctgccacttcgtttaacactctcatgcgatgctccctcgtttgagacatcacctaattaaataatcatttattaataaataatcaaaaataaaaaagcaattaatataaaaaataatcgatttgtaaaaagaccattcgcatgtcgtgaatgtttgtgtgcacttgttgaagtgcagtttgccgatctgcgctcgtcttcgggcactgattgaactgcttagctttgaagccctcacagacctaattaaaggataattaaagcaattattaaattaattaaagggtaattaacccatttatttttaagacaaggaaaaaatgaaattaaaaggattaatagcaaaatatttcttaccttatcaatgatatgccgtaaccgttcaccattatagaagacgatgaagacagattccttgatatcttcaccctgtttatttattattaattgattaacaaaattctttgactgttactgattcaaggtgctcaagcagttcatcaatttcggcatgtcg

SEQ ID NO: 18924 - DNA, 1305 bp, Heterodera glycines
gcttcgcaacggaattccaatgtcacttctacgacagtttgtccctcatttcttgaacagccgcatccgtaatgccctcaaaatcaaaaaaaaaataaagaaaatttccataaaattttatttttaccccctgaaaaaattcatccgttttgctgagcacatattgccattccttgagctccaaaaaatttttcttcaactgctgatcactgtcattcatgctaatgatatcgcgttccttgtcaatcaatttttgctgtaaaaatttttaaatttttttgaatattttttaatttaaattcctttatattacctcaacctcgttgatctcaccatgtgacattacatcaaccgcttctccccatgtgttgtccacaattggttgattttctttgcgaatttgtacctccaaaaatccttaatgtttcagaaaattttaattttaaacaatttagaaagttctggatttcaaatttaataaaattaaaaaaattggaaataaaattcgaaaaaaaattactcaatttgcgttccatttcatcaaaacgccgaatgtctttcgtgaacattcgttggaagacgttaacttcggcattcagctacatttaaaaatgtaattatttttatgaaatttatttaaaaatatattggttaaatttaaatttaatttgttttttattattacgtctttgaattggacgaatggatgcttgccaagctcagcaacacatgaaaaggctgcgtcccgttcaacaatcagctggcaaaatcgcatttcctccgagcggtaaagcgaacccattttggcgaaacaatttttgtgggtttttcaatttaaatacaaaaataaatgttagccgctataaaattattatctaaaataaattttccacaaataaattaaaatatagcatatttgttttagcccaataaatttaaaaattaaaattccaatttattagttccatttgaatataaattcgcataaaaattgaagggatttatttattttttttttgtttttaataagaatcagaaagtacatgaacatattggagttggatgaacgagcgacgacgacctaatgggaaattgtctatgaaaaaatgagggatttttttcaatttcagattttatctcatctcttttttgtcctgtctcctctcccttgggaacaaaacatttcctattggtttttttggatttgagtatttatcgtcgtcggattacgaacggaaaataataatgatgctaaatgattaaaataataggaaacaatttttaataacgcattattttaatgaa

SEQ ID NO: 18925 - DNA, 2570 bp, Heterodera glycines
  misc_feature (1019)..(1019): n is a, c, g, or t
  misc_feature (1036)..(1036): n is a, c, g, or t
cctcaaaaatcccagtcctactcatttgcaactgcaaatagtgaataaaaattatttttgctcaatttttggctgaaaatttgtcactattcgtcagtcactatttcggactttttggcactattttctcactattttggcatttttactcactattttagttaactattttgggatttttcgtcactaaaagtcgcatccctagtaattaggtgtccaatgaatattaaatttaattaatatcgatgccattttggcgacaaaaattccattggcataatcgaaaaatttactatattcttaaattttatgtagatggtataggcaggtataacttttttaaatatggaaaatttttttgaaattttacaggcttagggtgataaaaaaaagtaaaccgaattaatttgggcgaatttatgacaaattttatgctgaaaagactgggttttaagaaacgccaaaggtggcgggtttttgagaaaaaaaaaactgtaaaaaaataaaaaagaaattctggtattaaaaaagctccatgccccttcaacttacatcccaaacactcgaataattctggatattattcagggtatctagaagccgccaaggttggaaacccagaaacgttgtcgattttttgagatatctcctggccttgaaatttccaatcaccaagcaaaaagccctgtccctaaataacccaaaaatctgtttttcgggaaaaactactacctccaggccccggaatttctaattatggggcaacaacactgccccaaactaaaccccaatcgggaaaaactacttcctgagcctggccctgctgtcttaattggttttattttcaaataaaagcacagaaagacaattgattttttaaaaaatagatagaaatcgtaaaatgatcgtcatgcaaatttaaattaattaatttgtataaaattgtgtgtgtttaaagtcatcgcaaaattttgttagactttttcacaattttctttcccattcttggcacgtttcgntttggcattattcattngactaattggcattttccctcgtcgtcgatcaatttccgcctgaatgtcctccaggcttttgtttttcgtttctggcatgaattttgccgcaaatgcaatgaacagaacggacagtgcggtgaacacgaagaacacatactcatccagaacggactagaaaaaacatttttttagattttttataaatttttcgaaaaatatatcccataaaaaacacagtcaaaaaataattctaaacataagagaaattccatgaattgataactagggagcggatttttagacgcgaaaaattctaatttagaggggctcaataaaggcgaaaaatggtaaaataggagcgaaaattttgcaaaaatctgggttctttttataggatttttgttaagaaatttttcaaaaatgccaaaaagggacgcctcttttaggggtgaaaagtccaaaatagggattcctaaaaaaataaattaaaaacttaagaatccgctcccaattgataacctaggatttttgaaaatattattttcccatgataggaaaaccgtatttaaatatgcggaattacagtaatagaattagtctaatgtacgtaaacatacatttagcattggaaagaagaagccaacaatggcatttgagccccaattagaaaggaccgcaattgaattggcattgccacgagcattcaatggaaagatttcattaacaaaaaaccatggaatcgagcctaaatagctttttttaattatgattgaatataaatattactgtttttggtttatttattttttaattttttaaattttaaatttaacggtattaccgaaataaaaacaatttagttcaaaattaatagattctaataagatccggtctcttgttaattaataatttatttgctatttgatattgttttttgctggaaaaaccggtatcacatttaattaattaacaaataattaattaagtttaattgatcagctaatgaatttattaagtttaattgattaactaatgattaattaattaaatgacctggcccaattgccgccgaaatgacaaaaagcagaacaaataaaatggaaaaatatgaaaaccattgaactgactggaaagcaaatgtttaaatatattttattttttaaacaaaaagccacctttgatataagcattgaaattgcgataaaagcgcttgacaaaagcaggccaacgaggccagtaatgtgcaaagttcggcgcccaaggcgttccacctgaaattcaaagggtaggcttcttaattaaggctagagggctggaaaaaggcaagtactttttcaaggacacataaaatggattatgttttttcaaggacatcattagcagcggtctaattaaggtgttaatgggtgattgggcacacgcaaaaatagagccctttttcaaggacgcgaaagtgatttatttcaaggaattaaattaggtccacagtccttgaatatacacaaatttttaagggcgcctatagaccatatgccttgaaataatttgttg

SEQ ID NO: 18926 - DNA, 4092 bp, Heterodera glycines
  misc_feature (4008)..(4008): n is a, c, g, or t
tgttgttagcaaatttccggcatcttcatttattgagaattttcaatcgaattgtccgattgtctcctcactgtgtctgtcagacgacggaattattctccgaacggtttctttcaacgtctttccttttatgttcgtttttttatatatgaaaaataactggtaaatggtaccacagatttaatgctcattaaaaggtttcctctcttcccactttaaaaattaagtacaaaaacgttctacgcctaagcctactggacctgtccgtcgagttcccgctgttagcatcggaagtgatgtgcgacaaaagcattcggaaagaaccgcaggaaaaggttgccaattgtattagttaggaattttctgacaatttaggtgatggaacaaatggattctggcaaccatggaatgcttcggatgattacagtgaaattaaaaaacgtcttttgcgtcctccgaatgatttctccgagctcaggggtttagttgaagaataagataatcataattaaacacttgcagaaattatacgcaaagacattgaaagaatggcacagataaaggaggaaaacgtaaaaaagaggaagggaacgaccaaagggaagaagcaaatgacggatgagcagaaggaagcacgggaagaagaggggcaggaggaggacgaagtgaactcacaaacatttgaaaatagaaaaactaaacaacaaacactgaaaggaactccattggcattcttaaatacaccccaatttcctttttcccaatttagactcgcaggaacagaatgatcaagcgaatgttcttcgttttttgcctgacctttcctttctttgtgatgttagttggaaattgtttgctctcaattagaaattcatttttcctttagccactattggcttaaccatcgtttcgattcattcctgttgcccatcgatcctaattcttatttatctgtccttatccaagtcccttggagcgattttattgaacgcattgtgcctactggaactgtaaaaattcattgactgtgattttttaatttacgtttgtttatttttcaggtgtcaaatgttcatttgaaagtttctcgtgggcctgaaagaagaatttccaaaaaagcactggtcacagttatgccgggtgcgcggtggccggatggaaaaatggtgagagtttttaaaagcaggtttaaaaaattgttgatatagttaggctgtggctagtgccctccccccatttttttagaaataaagaattctaaaagtattaatggctttccgattttatacccagcggcgcctatcggccacccgccggacccacattttaccttatattttgaaatgttgaccctttttttggcacaaaaacggctataaatccctgctttttgcacttcggcgctgaaaattttctggagaaaaaattttttcagttgccaaggatgttttttgtaaatgtgcccgacattggtcgagtggaacaagaaatcaggaaagcggtacttaaatgcgtaatttagcataaaaataattctaattgtcagtttaggaagtggatgctgggcttgcccctgaacattggagcaacatccaatggatgcaaccggggccaatgtccgttcatatgttttccattttcattccacttttaggtcattgattataccttctctggtcattcttgctttatttgtccttccatttggttttccttggtcgaatgatgactggctcaaaaaatgggcaacttctccgaatcgatcgtaacacatttctcaaagcagtttcaactgctaattttgttcagtcttccatgatggggcatcgtcttcgaatttatgacccggcattaaaggatggtaaattgaagatcaaatttcgtgacgtggcaggccttcacgaagcgaaggtggaaattagcgaatttgtggattatcttcgtcgacccaacaaatacacgcgattgggcgcgagactgccaaaaggtttttctttttgaataaaatagcgtcccaagtctctgttaggtgcccttctgactgggccgccaggctgcggaaagactcttttggccaaagcactcgccgcggaatcgactgtcccattcatcaagtgaataaccaaccacgaaacaatttattttcctaaaattactttttcagcattaacggcactgagtttgtggaaatgattggtggcctcggtgcttcgcgaatccgtcaattgtttaaggcggccaagtcgagggctccatgtataatgtgaatagaccgattagcaaatgtcgcttaatgttagtttatttgattaagttacattgatgaaattgacgccatcggtcgaaaacgtaattctgggtaattaataatataaaaaaattgattatattgaatccgcaaaaattataggcatggaaatgacgagcaggagcacacactaaatcagttgttggtcgagatggacggaatgttagtttgaacatgagaaaaatcacaatatttaacaaattcagggacacggcgaagggaattgttgtcattgggagcacaaatcgccctgatatgctggacaaagttctacatttaagccgtatcactttttattgatctcccattgaaaggctcttcttcgtcctggccgttttgatcgaaatgtcagtgttgacttacctactctgattgaacgtcgtgagttgttcgacttgtacttgcgcaagattaagaaggacaaccgactgacaggaattagccatcggctggctcaattgacccccggatttagcggtactcgctaattcgaaccaaaaccctaaaaaaatccttttcctttcgagctatttcatcttttctgcattaaacactacaaatttacttcgtccaagtttccaggtgctgatatcgcaaatgttatcaatgaagcagctattcatgccgcgacaattcaaaagaaaatggtggacatcgatggttggttttaaggaaaaattataattgttaacccaatgccgtagccagaagtaattttggtcaagtccaacaaaaactttccaattaatagatgtggattacgcactgcagaaaattttggctggaccagaaaaacgtagcaaagtattggtaaaggaggagcgtgaaatagtcgcttatcacgagtctggccatgcattggtcggatggttgctggaacacacagaagctctgctaaaagtacagagacccaacaaatttataaccaaatttatctattattaaggtgacaatcattccaaggacaagtgccgcccttggatttgcccaatactcaccgaaagaccgaaaactgttcactcgtgaggaattaatcgacagaatttgcatgatgttgggcggacgagcggcagaaaatgtgacatttgggcgaattacaacaggtgctcaaaacgacttggaaaaagtaattagaattatgctattgcactaataaataaacataaaatgaatttataggtaactaagcaagcacaagcgatggtcaaaatgtatggaatgagcgatgttttgggacctatcagtttcactcccgaacccggcgttgacccacaaagtgttcaatttcaaccgaagccttacagcaaaaagctaggaaacatcattgatcaggttcgtgcgaggcgtttaatacccaaaaaattgggaaggaaattaaaaaaacaatttgttttttgccttaaaaacattttgtttttctgaaataacgtattctttttctgtctgaattttacggattgaaaaagcgatataaacttattttggacaattgtttaacgaagaaaagaaaaattataatttattttaattttatatagtattcttgaggtaaattttcaacattctattttcaggaagttagccgacttgtatcggatgcttattttgttactgaaaagctccttcgcgaaaatagaaatatgctagaaatggtaaagagtcattacaagtttacaaccatgtctttcttcattataagntggcgcgtgccctacttgaacgagaaaccctttcgtacgacgacgtaaaaaaactcattggaccccccaaatttggaaacaaaa

SEQ ID NO: 18927 - DNA, 647 bp, Heterodera glycines
tttagtaggagaaatgtcattagtggatagtgtcagtaggctgagatgtccagtaggcgaaacgtacgcacaccctttttgaaattttgcatgctaatagaaaacaactagagctattgaatgatataaagaattaaaaatttggttgattctaagtaaagatattgaaaaaaattggtacaattgatggttttttgaccaacatcatagcaccgaccgaagaaacggtgagcagaaaaagggaatggcacactgaattggaatggaaggcaacagaggagaggaggaccaccaaagagaatattttgcaaaattatggccatttgccgggcgttccccgactcccgccacccttttatcatctaatcacatcatcagcaggggcgacagagagagcgaaatgacccacacaccatggcagagggacccctattcccaatataccccgaccattggcattggcaccccttttgccattctcccccccccattggcattggcaccccttttgccattctcccccccccattggcattggcaccccttttgccattctcccccccccattggcattggcaccccttttgccattctccccccccccattggcattggcaccccttttgccattctcccccccccatggc

SEQ ID NO: 18928 - DNA, 773 bp, Heterodera glycines
  misc_feature (756)..(756): n is a, c, g, or t
  misc_feature (767)..(768): n is a, c, g, or t
aaaattttgtttaatatttgctctaaattctttacattgctttcgtgaatgttttccattttgcataaattcatttttattttaaaatatttttctacagtttctgttttttgctcatatttttgattttttattggttttccattttttaattgtttcttccaataattaatgcttatttctgccctaatgttttgctattattttttgacatttttcctttttccatacaatttttgatttaattcattctttattttacatataattgatcaaattgctttaatattttaaattttttgaactgaaaaattttctcaaaaattgatcgcaagattttaggtttaaaatttcgttattcgaaaaacattataaaatatttaataatcatttattaccaaaattaagtttttttttggttaagttttaggtgtttttctctctaaaactcattaataaaaaatttttaaattacttttttatgcttttttcacaatttttgtgccttttttgcgagctctacttattagatattataaaaggttaagtcaagcaatttgaaggcaaattttataatacagtcatggtcataagtgttgtcccatcatgctttgaaaaaaataattgcgtataaaattgtcattttccaatttcaacagataagtagcatgccattggatagcattttttatgggctttccaatgataccatatttgcatttgtgacataaacatttatttgatttattttaccantattcacaatnnttgat

SEQ ID NO: 18929 - DNA, 1626 bp, Heterodera glycines
tagaaaaaataaatttattatctaaacaataaacgttcatttaaaaagcgtttttatcttactaattaatggtttctcgtagtaatttgtgttttggtctttcttgaccatggaatgctattgtcatttgaagccccgagggggcaaatgacgtcgaggtcattcgtattgtggttttaattaatattaattagtttataattaacattaactcattgctccactatacgaaaatgctgccgaaaaattaactaataataatcacctaaattaacaagttaaaactttcgactcggaaatgttacagcaatagtttttttttatttaactaaggacttaccacacaatttatatttttacaattatcaagcctaaacttgatacatagatcaggttatagtcaagataacaagccaataataaatagagtaaattgattgtttattaagaaaattaaaatatttgtgtacaattttttatattaattttattaagataatccgttttctaaaaaacattatcaagatgacggttttcactttatctgttgcttttttgtttttatatgcgcatcaattagtttcttcacatggaatgatcgctgaaaaagcgcatatgaaaatggtggaatagaattttcaaataattaaaaaccttaaaaattttagaaagaaaattttgtatgggcattttcaagaaaagtgaaatattttacaacttttttgtgcactatcgtctcctctttgtaattctttattaatgctttagcttttttgatcattttatatgtcattttattaaggtgagtctcgcaaatttatccatcgcactttctcaagttggaaatgatcaaagaaacgatttgcaagtggacaatggcacagtgtgcaatttgcccttcttaaatcatccgtcgatgccaaagtcgcctgaccgatttgtgtcgctggttttaatggtggtgtctgtttttgtttcacataaattgtttgtcgtagcttttttgggattctcgagtgtcggagtaaaatctatgggtggactaaatcattaaatcattgattttgaaaatgaacttttataattcagaagggactgcaggcaaaagtggataacttgcatatttaggggggggggggactttacagaaaaaattatttgttaaaaatttttcaaaaagttactataatttttttttaatctaacaatcaaaaattgaaaatttatttttaaattaaccaaaagcaaattgcatgccaaatttacgctcattacctaaaattaagaccggacgggattctaatgtttttaataaaatatctgtcttttttgcgggttttttctgttttttctatactatatttcaagacaaaagcaattgaagcagttacgccagcaggtacggcatataaaaggtgaaaatcggacagctcgagaattaaatatttcgggatttttcaaaattgctttcatcaacaaaaatcgagcaatttatttggataatataaaaaaaagcattataagtagaaaccggatttttaggtgctaaaaatcctgaaataggtactaaaataagtgccaaaaaagtgcaaaatagatgttaaaaacgcccaaaatgccaaaata

SEQ ID NO: 18930 - DNA, 3275 bp, Heterodera glycines
aattaatgcaaaaatcggtgccattgtgaggcggcgacgtctagaagacttaaaattcttggcacagattttagtctaaaaagtcaaccttcatttttgccccttgctaatgccattgttaatatcattatctttgttgagattgcagcacaaaaatatgatttatttgtatatatacatacttccattaattttgctttttattcagagatatttgtttaagataatgtctgtatattaatatgataaacaatataaaacttattttatttgcttgtgttttacatattcaaaaaattcagattcaattatgggtatacaaaatccccccaaaaaacgagaggaacccaataaatagagagcgcagagaaaaatgcacctctcatttcggcatactaaatactagtaaattttaaaatttccccggtaccttttaagcgaatccgatttcagtttcgtgatcagaccctcgaaaagtccagaaaactgattttagcacaaaaaaaaaaaaattaaattagggacagcaaaattctttacattattttattttaattaattttttcgtcaaaaaaaaactaaaaattgttccttgtattaaaaatttcacattgcccaaataaattaatgaataaactagagaccgagatttccaaaaatgccggatcggaccgggctgatattttcagaagcaaccggtttccgggcctggcctctcaaaaaccggtcaaaccggatttttccaaaaatcaccgggccggtttgccgggcccggtaaaaaccggtaccgggcccggctcggtctctagaataaaccttgaaaaagatcattttcctatgtaccaacgcgaaactttacaccgaatgtaaatttgaactgaactttttttgtcaacaatttatacataaagaatttacaaaaaaaacaggaaatatgaaataaactattgaaaaacggatagcatcactcatctaatacccaaatagaaaatagaaaaagcatatggaaaaaactaaaagaaaatctctctttgatcagtgcggcacattgtatgatgtcacacccgcgatcagcagcagcagacacaccgcaatcattcttaaagaaataaaatttacatttttttaaattttattttagcgaaatttcggcattttttaaaccctcagggcacaaaccaccccagatatatttgagtcaccctaaaattcgtatataggccttactcgtactaaaatgcctgtttttttatcttcccctaaatctcatctatttggactgcgtgctgaatggaatagaaaatttgaaacagataaatgattttttccccctatttttatgaaaaaaatgattaatttttgaacaaaccaagttccttgaatgcattcaaaattgtttgcttcagggactcgtttgaaggaaatgaaacgtcataactaaaaaatgttttaaaataaataaattataattaatctaatacaacaaattattgggactgctcgagagtgaggagtcgtaatttttcaagacttgggattgaccccgagagtcgcgactctcgaccctaaaaagccgagaaattcctcgactttagagccgaaaactcgagcaactcccctataaagtatcattataaggattttgcgcgcacattaccgctttgtcaatgcttcgccgatacttttggaaatcccctccggggtgaaactgccactgcgcggatcaagcacaaccgcagcgcccatgcgtcgcagcttttccgacacataaaactgttcggcaaacatcggcagacaaagcaatgcttttccactgcttaacgcatccattacgatacgaatatcgcattcgctgatcaccaattccgtctttttattgcctgaaaatggtggcacacttttacaatatgataccgtagacagaggccagccatactgtattttacggggggggggctaaaaattgaaaaaacgtaaagaatcggttgacccaagcccatcggaaaattttttgaaatttttcattaaatttgccaataaaaatagtaaatttaaattccaaatttttgaattttgcgccggccgtggtggattagcctagattagcctaaccatgccatggcatttttttgatggacataaaatttacagaccaataactgtggcttgatcgtaatgctccacaagatgcacattaggagcatgcttttgcaagagtgacatccgaccatgatcctcctgtttcgcatatttccaaatcacttccttttcacacattccaagtccttgaataaccgtcttaaatttgtccaatggcattttggatggttctagtaaagaactcatgctgaacacgatcaccggttttggttgcccaaaaacttgcggtaaagccttaatttttagggaaattatttaaatattacaattataatatcgtttttctgagttttcggcatcgcgtgatttgccgaaaattttcgaaatttcaaatcatttttattatgagactgttttcaatttcttaaaaattatttgcttttaatttaagagaaataaggaatagactcggatttaaatttttcaaatgtttcatatgggattttcttaatctgtgtatactgttttactactgaatggtattacatccttgtgatcgggctgcatcagatcaatgccaccaatgaatttgacgcgttttggcaaactgccaatgtcataatccaataaaggcgttgtgttgacgaacaaagcttttgcatctccgaacaatttttccagagtaggaaatgcattgttcttgaaaaggtccttgaatttttgatccttaaaagaaaaattttatcaattaaattatattaatttttattaaaataaacttacagcaatttcataaacttttgagaaaatatccgaactttcgttatgcttttccttgtatgcaccagcttttccaacatttttgtcgttaatgactgctgagaacagttctgtaaaaatatagtttattagtaaaatgtaaaatagttttatttgtttatttataatttttaattatatttcattaattaatttataatttacttaccgtatttccgatgatacagtcccctccctccccgaatagtgccccaccccagaaaaaagccctcttttgaaggttgaaaaataaagcccttgggggctttatttcaggaaattcggtatgtttattttaaaataagtaataattaattttttcacctggccactcccttgccccaatatttgttttt

SEQ ID NO: 18931 - DNA, 2184 bp, Heterodera glycines
aaaataattttataataattaatttatctaattgtgagtgaaaaactaattattgataaaatggattattgaaatattagaaaaagaattaaaaaaaaatctatttgtttagaaataaaaatgaagtgatgagttttataattcgtacataatggaatttttaatgtacaaatgattttttgaaatttaaagatgacagttcatctttgttatacttatctttttactccgtttaaatcaatataatcatattaaaaaaaaaattaaattcataacatctcttttttttactttcgctaaaaattagattgaaaatgaatacaaaaagatttttcattaacggaaggaaaccaaaagacaattgaaaaattagtaaatacgaaaatattcaaattcactacaaccaaaatttctttctaaatttataatttatttaaaacaaattaaattaacttgggaagacatcacagtccacatttggcaggcgtttgaactcgaaaataaacaaataataatagtaattataataaattccaaatttgatcattaaacatcacaaattgttacatagataaaccctagaagtgccacgggaaccgggacctggaagcggacaactgagtaccaaggtcccggttttgaccgggaccgggactagtcccggttttttcccggttttcccagcctaaaattcccggtttttcaaaccgaaaaggtcccggtccagggtctgcccaaaattcccggtccccgtggcactctagaataaacacaagtagttatcccacggtacccgtccgcgtccggtgtgaagtttcacacctttggtgtgaaaccggcaccgtccgtagggtttaggacgtggttttcgcgcacttagcggacggtaattaatctcccaattaaaaccaaaaggtttgggaccaatttttcgcgcacttcttgggggagggggctaccgtaataaaaaatttaaaaaaaaccaaaaggtgtggagccgaattttaagggggttaccgtaatcaattcgaattaaaataaaaagattcggaccaaattgcaaaaatgtaaaaatattaataaaaaataactaataaattataataatttaaatttattgccctcagcaatttttcggcaaatgattatcccccgtttcccattcacagcgtctctttttttgaatgtgttggaggatcaatgatgaagagaatggggataaggggcaacgaagggggggacgaaggggggagggggggggcaaatgagggagagggcagaaggggcacaggattacaaaatcaattaataaacgaagtaaaagtaacatttattttctttacaattatgagtgttttaatgaattattttaattttcatttcaattttcaattattaattttttcccttttgattaaaagacaattcatttccaaacaaattgttcgcttccaaattgttcgcttccaattgttcgcttccaagttttcaacaggatcatgccgccaaaaaaggtaagtttgaaaacaatttttaaaaaataaagataaaacaattttttaaaaatgataattttataatttttttcagaaattgtccgaagtcctgccaaagccggtgatggtcacacggagtgcgaccaagcgtgagacggaggtgccaaaaaggcagatggccattcgcggcgctggtccaccaaagcaccgtgggttaaaaatgcgcagaatttaaattaatttaaaatttaaattaataaaagtaaaatttatatttaagcattatttccaccaccagcagcagcagcatcaactttttcaacttttacaccgccgacaccaccaccattttctactccatttcacaagcacgtctcatttttgacaccttcaccaccaccaccagcagatgatttggagtatggacctgcaccaccaccaccaccagcaacagttgatttggatcaaattccgcttccgccaacaccaccaccagcaacattttcagtggaattttggctacaacctgcaccaccaccaccagcagcagcaacagttcatttggatatgaatcccacatcatcttcaaaagcggcagcagcagacgaaattgaacgtgaaaaaaagaggaaaaagcggcgaggcaatcggtggagcaaaacaaaggtcagattggattttatttttt

SEQ ID NO: 18932 - DNA, 2945 bp, Heterodera glycines
gttttcgcgcacttgcggacggtattctcccattaaaactaaaaggtttggaccaaattttcgcgcactggaggaggggctaccgtaataaaaaaatttaaaaaaaaaacaaaaaggtgtggagccgaaatttcagagggttaccgtaatcaattctaattaaaacgaatatgttagggaccaaattttcgcgcattttttttgcggtgggggtacagtaatataatttttttcaaatgaaaacccaaagtttcggaatactttttcacgctctttttaggtataattatgctacagaaatgtaaaaattattaataaaaaataactaataaattataataatttaaatttattgccctcagcaatttttcggcaaatgaaatatgcccccgtttcacattcacagcgtctctattttgaatgtgttggaggatcaatgatgagcagaatgggataagggtcaacgaaggggggggggggtgagggagagtgcagaaggggaaaaggattacaaaatcaattaataaaatgaagtaaaagtaaatatttattctcttcataattatgaaagtattttgatgaattatttttaattttcatttaaatttatttaaaattattttcctttttgattaaaagacaattcacttctaaacaaattgtcgcttccaaattgtcgctgccaaattgtcgcttccaaattgttcgcttccaaattgccagcaggatcatgccaccaaaaaaggtaaagtttcaaataatttttaaaaaattagttaaaaaaagtttttttaaaatgataattttagattttttttttcagaaattgtccgaagtcctgccaaagccggtgatggtcacacggagtgcggccaagcgtgcgacggagatgccaaaaaagcagatggccattcgctccggtggtccgccaaagcaccgtagggttaaaaacgcacagaatttaaattaatttcatttttaaattattttcataaagttaaaaataaaatttatatttaagccttatttccaccaccagtagcagcagctgtgcaattggatgttggattggagacaccacctccaccaccaccaccagcagcagcagcagcagcatcaacttttacaccgccgacaccaccaccatttcctactccatttcacaggcacttctcatttttaacaccgtcaccaccaccacctgcaacagttgatttggatcagattccacttccaccaacaccaccagcaacattttcattggatttttggctaccacccgcaccaccaccaccaccaccagcagcaacagttcatttggatatgaatcccacatcatcatcaaaggcggcagcagcagacgaaattgaacgtgaaaaaagaggaaaaagcggcgaggcaatcggtggagcagcacaggtcagatttggaatttatttttaaatttcaattcgattaaatttactttttttatttttaactttgtattacgaattataaatttgtttttttaaaattgtaatgaaattatagaagcgccagactgtgcgcgtaaagaagggtagtgtgccggcaaaggtagtgccgcgccaccctgagccaggctattttggcctcctgcgaggtcaaaagccgagaggtcactagtaaatgctactacatagactgggccggtgagtcttccccccccccactgccctccaactgttttgattaaaaaattttaaagaccagcgtggtcaggagagctggattctgtccacatgcaacgacgcattagaaattaccggcgaacatctcgaggattcggctgtggatgccgcatacgacgcggtgtacggcgagccggtcgctgaccatctagcgagaaaaatcgtaatgagacccaaataccacgatcgtgagttttttttttgtcgacaaatttttaaaataatttaaattgtgaaattcagtccggcgtcgaatggtcggagtcaatgctgcaccgatttgccgtcagcactttgctttccacacttgtgtcacaaaggaccaatttgataaggtgggttgggggtctgctgctgtttgcctttgtctctctcgctctttcttatatttttctggcattggttagcaggcatcgcttggtatttgcccccttaccaatgctcttttctgtaaagtggagagcataaggcaggcatctcctggtatttgcccccttttgtttttcatcttttatttatttttttttgtaacgaaagtctgttgttttcaaagaaaatcattctaaaacttttataaaattaaggcggagcgcctttacaaagaattacttgtcagggaggggctcatcgaggatcccccctcccacggggctcaataaattggaggaaaggcgccttggaagcaacgtgcccacagtggccataattgttaatccaatgcgtcgcaggcgagacgggacgttcagcaagattgcccaaaaaatgaaaacctgaaattaaaccagtattaaacatttgaaatttgaaatttcatttgaaaattttttatgattttattttaaaatatttaaaaatcacctgagtcatgaagatgaagagaaaaaagacaaaattcatcgagttgacgcagcccgtccctttgatggtcattccagccaccaactcggtgacattgaagttgctggtattgtcgcacggtttgctgaggagatggtcggtaaacgaccccaaatgggccacattaatgcactctaccggtttcgtataatcaaccggccggttgcatacgcaaccctcaatgaccatccaggtcaaattggtgggacgaacagaaatgggaatgatgctcattagggtaagggaatatgatcagttgtgctaaaaaaaaggaaaagggccaaatttgtacaaatgatggtgaagatgtggcctgtgggtattcgggaatgacta

SEQ ID NO: 18933 - DNA, 2501 bp, Heterodera glycines
tcacataatacggtcctttggtcgtccgccctaacaattacttttattattaccaaaggaattctcccgggctttgttcgtccctcaaaaatggcattcctaattaccacagtttcatttgtaattctcttgtcgtcggtgttgagtgcaaaaggtgatttcttctgctgatgaccacagttctgctgatgttgacgatatcgatggtccgcccttttacggtcgcattttccgcacttttcccttaggcgcgttttcggagaaaagtgcggttgttgtggggggggggtttaccatcgaatgggtcactggcgaagggttaagtgaaaaggaattactgaaaaggtgtcgccgacctcagctgactaatggctgtttgttttgtcccttgcctaggtacgccaactctaagctgatggtcattagcggcgttaggaacgaatggctcagaaaacggtgccgcagggagacaatgttcgccgagtgatgcaactgctgagttctgtgaacacttctaagtgcttgcttagacccgtcgaattcatttacttccacgacaaatggtggaacgccacacttaacaaattgacctcctttttattagcatttttttgtttaactttattgtaatttatttatgttcaaagcattcgatcatttggatgggctgatgagtgttttcattttatcccagcagccccattctccaaagttgcaacttcgtctccatggcattgtttcggaatggcctgcccgtccctcttttcccgaagcccttaacaaaattgaattccaaagcattctttctccagctaccatcatcggaatggtcgccgggtcgaactcggtgtccctcttgccaaagccgatcatcggaatgccggttcccttgatgaattggtctgaatagacccccccccctgttactgtgttctgcaattgccaattaccgtattcgacttcgcttcgtttccccatcttttcaaagttgtccttctcaatcgacgctgtttagagaattttttaaaaattaacttaccaaaaatcgttcggtcgataagctcaaaggtatcaccgccaaacattcactaaatagcagaaaaagtgggagagtgccgagtttgaacttcatcaaagcttcgcgacggaaactgaatgttttcattcgacaatttgtcctcaattttttaaagggtgaagtcacacataaatttacacgtcctttccctcggcacgggttcaatcgaccgtaaaaaaagcggacaaaaagggcggaaactgatgaatggacgagaggatgagcagaaaacagtgggcaatgaaaaaggcaattgccacgaaaggcattcattccgggatgattgattaacaattagcgtacataagacagaaaggcgagtcggtctttcatatccgagacaaattgattcagcgtcttattggggacggaaaattgaacactgagagattggacaacagaatttatttttggaaatattattatatactgtacattaagtaaccaaaaataattgattgaagagattactacagggttcgaattcgtttttgaatggcaaggacggcctagaaatttgaccctctcacttgaaaagttgaaagtatccttgaattcaagatgtacttgaaaatgagcattcgaaagaaaagaaattcaaaagtttacatttaattttaaataaattttattataacaaaatgctcgtcgccaattgtctaaaaatcgcaaaaacctgccttttttgatgtatatcattaacaaattacactctaatttcaaatttttcgtcgacggcgcctatcggcactgctggacccccctgtatcggcacatatgaccaagtttataaatgtccttgaatttaatggaattttccccttatgtccttggaaaccggtatacccgtccttggaaagggagtccgatccgaaccctggattactatcaattaacgtttgatgtaaggattaatttttactcacgaatcaacaataacttaacaaaatcctcggattttccataataagaggaacatggagggaagaggaacaaaaacagcagaaggggaagaggaacatgaaggaaagagtaacaagaggagaagaggaagggaagggaaagaggaaagggaagaagaaacgggaattttttcttgccctacaaaaaaaaaattatttatcatcaatgttttgaacccataatttcttaacagcaaattagggggaattttcggaaaaaaatttgtaaaaaagtctttcttctaaattttgattttttttttttgcgtggatcgtaatacatatttatgaggagggtattggtaaaaatttcagctcggttgggcatgaaaagttggcgaagtggctgaaaaattcttgaacccataattacttaacagactgtatatcagatttaaaaaatgttcctacatatatcatttgttggttgcacgataagcacaacagcggcactaattgta

SEQ ID NO: 18934 - DNA, 2582 bp, Heterodera glycines
aatttttatatttataaatttaatttatgtgaaaaatggcaaattcaattgattttgccagcacatttttcaaaataaattaataataaaattgattttttatttttattaaaaaaagtgacaaaaaaagtaatgtgattttgacatacatgtgaaaaagtaaaattgttaagtagtaagaatattttaaaaatatatttttaaatattaaaaaaacttgaaaaaagaaaaaaaaaattaaaatcagtaagcgttggaataattaaaggacagttagtcctctgtctatggagacatatccttgtaaattttgattctattctgatcacttttttttaaattatgggcactaaaaccaaaaaaataattaaaaaatttaaaaaaattaattcaaaaaattactttctctctttaatatccattcgtaagccataaaagattgtttaagataaaataaatattttaaaaataaacgaattttttaattatatttatcaattttagaaactatttttatttgcgtaaatatgtaatcattaaatataatttggaaaataaacagaatttttaaattaaattttaaagaaaaaataaataaaaagcttatttaatcaaaatataaattttttttatttattaaaaaattaaaataaatattaaatgttttaattcaaattttataataaaccaccacacatttgttccattgttctttcaattttgccatttttggttgaaaaaaaatgttgacgtgaattataaacaaattccgccgctaattaactaattaccgtttaattaggcggcaggcgcgcgccacaattagtgtgcccaatcgacacaaattttcgcgcacagtcaattagcgcccacaattaaaaatttcattaattaagcgggacaaaatttcaatttttcatcgaccaaaaatcgtccgtcctctgtatgtgttctataaatcttactcatcaccaccgcaaaacaatgggcgtgggtgggggatgagccaacaaattagcagaaaatccatccttaaaagatgggacgggacgaacggacggttggatcattagcatcatcattaacgattcaattcaacgcctcattaatgtcggccggtcattagtcactaattgacgacgggcggctgattcagcagacaaagaaaaacaaaaaatgactgcagcaacaaatagaactgtgtgtgcctatacaaatagggtgtagatcaaaaaggagagagtttagaggtgttttttatgtcacaacagcagcagaaaggctgagcgaaaagggagtgtttttttaatcgaaaaattaattaattagccgtaattttattataaaatttattgtcttttactttggtagcatgcatttttacacgacacggcaattaatggaggggggaagtggctatgaaaaaatgtacaaaaattccaaaatattctctccaattcgttaaacaagaaattttttgttgccgggataaagaaaataaaaaacaattttaaaaaacaaaaaataggtgaactaaaaaactttttattgaaaataattaatttaaattttatgttatgttaatttaaaattatttcattacttttgttatttatttttcaaaaaaattttacggcaattttatgcgatgaacacaacaaatctatgacctccattttacattaattctttttaaagtgtataatagactgatccagattaaaaattaaaaaagattggcacttaatccgtgacttggatttcagagtgccacggtctatggactgtttaatagttgaacttgctaaattataacccattatggcatgtctgattttatatcaatttaattttgtaaaagggcatacaaattttgaaattgttacaaaaataaaatttacatttcaaattttaacattttgcttttcgcgagtgtcccatttttgtaatcacagtaattggatggaccattgttccaaattacagtcattatagtacgcaaaagcattggcgacacgatatccaaaatccattaacatttttttaaacaataatacgcccaatcttggcaacacaataccccaaattcttttacaaatcctttcaatcaattaattcatttaaattttttattgtatgttttttgttaatttctcataaaaagtgattgacctcagcatgcgtactgtagcaacaaataccgtatagccgcgccgcgccgtcagacactttgatttttctaccataccgtatctttaaacagccaaacttctctcgtctaccgtacctgcctgcgtctaccgtaataaatcgaattttaaaattaattttttgtttttcgacgccagttaacccaccaattctctgctaacactcgctgaacccaggccaaacatggccattgtcgtggccacgcttgacgctctgcgctccgccgcttcggctggcggccgctcgttaggcttgtcattgcccatggcattgctgcttctcacgctccttttttggcattggcaccgcgggcgccgggctcatcggcacacattccctccggggccaacgccactgccgttgatcgggaa

SEQ ID NO: 18935 - DNA, 1432 bp, Heterodera glycines
tcctcgagacctggatccaggcctggacctggattttttgaaatttgttttaaaagcaaacaaatggcttgaaaaaatcaattatttgctagaagcatctaaaaatatctaattaataataataatgtgtttttaaatttatttaatctgtttttgaaaacttgaaaaaacatcggtcacttgaaaaaataaattctaaaatttcgtctaggaaaatccaggttttttcctgttttgcctggacctggacctggatttttttcacatttgacctggacctggacaaaaatccaggtccaggaaaaatccagattgccgaaaaatggcctggacctggatccaggaaaaatccaggcctggatccaggtccaggtcgagctctactgatcacaaaaaacagtaaacaactaaaggacaaaatcatttcataatatattgctcacaatcagtagattttgtcgtatgaaattttgaattgtgctaattttaattttacacaattttcagcaaacatatatggcaaataataaaatttatcatagcaaaaagcatacattgttcgtatcatacgataaccacgaggcttttctatagcaaatgcagctcacttgaaactttccaaaaaatcaaaaccgaaggaagtcgaaaagattcgtcccattttcagcatggccgcacttctcttttctcctcctccaattgttcttccgttgcggctgcccttctcccctccacctcgtcttcttcttcttcctctgctgctgctggtcccaatgctttgctccgcgacgcgcattttgtggacagcggacgcaccggcgaatgcgcacagtgcgcacccatcacattttacgcgtcccatcacattttacgcgtcccataacactttacgcgtcccatcacattttacgcgtcccatcacattttacgcgtcccataacactttacgcgtcccatcacattttacgcgtcccatgacattttgtgtccatggtagggatggcattccgaggccccaaaaattttcggaaatcggaattccgtgccatccctggtctcatggtattatagttgtcctaataactaagagaaaaactttttttgtcaggtattcagtagtttttaattaaaaatttcgttgttaaacctaaggttatcatgacaacttatacacaggcaactcgaacaatggcttattgttagaacgccacactcagcattcaaatgatcacttatttatttgcctatgcaaaatattgtgtgccttccctaattactaattaattaactaattagtgtctcctttcatcaaacattattttgttgtgcaattattacattccgaaaatgagctgttttatcgccaaaatctcaaaaaaaaaaactgttataaataaacaaaatttcgggtaggtgcacgcgatgacaatga

SEQ ID NO: 18936 - DNA, 3385 bp, Heterodera glycines
atttatcgggcgtattacgtttccctcgcaaggccaaaaaaatgtttttttaaacagaaattttcggaaaaaactttgaaaattttatataaattaatcttcagcgctttttgaaaaaaattaataataataagaaattttaaaatattttttttttctcgaaattttcttataaaaatttttaattttttttttgaatttctgtttgaatttttttagtttttcggggggggggggagggacggatggggaggagctgctcacttatttataatcccatagattcccttaatttttgtgttgctatggaataaccgccagcggtacttatggaaaagtgacctctgcctttggagtactgtttcgtctcgacgatttacctcaagattttttctgtttcctttttgttccctacctgttgctgttgttgctgctgtactgctccatcttgatggtgttgctcggccgccagtagtgatggcaatccacggaacatcagccgaccgtctggctccatgctgaacaacctgtgcccgtccgcgcccggaccggcatcatcctgctcgttgttctcctgctgatcatgccgctggtgctgctgatcaccatcaacccgatctgttgctgctgcagcaactgaactgatttgaaagcgaacagttccgtgcgctccatcgtccatgtcgacggcgctgaaccgggccaacagtgtgccgggcggactgagtcggccgagcgcaatcactcgtggcaacggctccacaaattgggggaaattgtcgttgacgtccagaatgtgcaccgtcacatgggtctcggcacttcgattcttggccgggtcgaaagcctacagtaaaattgtacttacagtatactatgttgcaaggggcgaaaattcaactattttttgggcgtactgttcatccatctgctgttgtacttttctttctatctgatcagtattgatctgtcctatcgtacccacgaagattagttagatggaatgtttactctactcctttttcccatttactccgattctgtgtggggtcgaacgcctacagtaaaacgataggtagtcattgtaaccccggtgatcagttacagtaatcatgggaagggatactgtaccccctttttccatttaaaccagtcacttacaaattagtaccaaaatgtatacgatacacacttaccataacccggaattggtattgtgcctgctcctcccgatcaatttccgcaaatgcgatcagttcaccggtgtcacggcgcacaaagaacggcaactgctgctgctgctgaggctgctcactgcttgctgggatgatgctgaactcgacgcccccgggcattccgtgggccaacggctgtggccggagggacagcagagcaccgctgttaccgtaacgaccctataacgttgagaaaagggtcgatactgtagctccactcttatgtgttaaagaattatgttagcctaagcttgatcagaaaattgagtttgatggtacaatgattgtttttgtgtgattttagtcaaaaaatttaaatttaattgcctctggcaacatggcccggtactgatcggacgcaaagtgcacttcgttttgttgctgttgttgatcaacaccaacaaccggtgctcggcttctgctgctggacgacgaagactgatcagactgatcaacagaagatgactgatcactgatgttcgtcgatttggcgttggaggaatgatcagcagaagcagcagttctgctggtggtgctactgcttgttgtagacggaggcgttgaagagaatacgttagccactgttgttgttgctcttgtcgacatcgtactgctgaatcggttcggctgttgtgacgatgtagatactgtagttggtgatactgtagttgcagttttacgacgtgtcgcaaatgttgaacgtgagcttgtgactggtgttgatcgtggagatgaagctgctgctgctggcttaagcgaaccaatttttgtctctgttggggcaactgttcgactcgcctaaaaagaaaaagttaaagataccgtacccgaaatagacattatcggaaaatatatatggtatccaaaatgtacaaaaaataaaaatttatgggtgaggaaataacgtatacgaaatatacaaaaaggcgttacggagtgagcaaataccgtatcaaaaatgtaccaaaatagtagatacgataaaaataccgtatctgaattacaaaaaataattacggttccctaaattacaataaatacacgttttttataatttttgcaaccataaatctttaaacttcaccaaacttagtgaggataattatagctaatgcttgctaacggcacccattgtctatgtttaaaaaatgatttttgattttcaatttttaaaccaattccttggcattccgtccacttttgggcctcacctgatcagaactttcggcaatttcaatacccgatggggttgcgagctgttgttgatggtgttttttgtggccaatggtagccgcctttggaacactttcatcaccaccaccgacaccggcaccggtgccaacgctgccggattttggcggtaaattcaaatcgactaccacaaccgcgtcggcccagtggccgtccagggcggtcaaatgggcacggaattcggctcgttgccggccgaacaattggtcgggtacttcgcgcaagtacagctcgccactctgcaatgaattggcgtcgagattaaatatcactgatcagtccactggggtagaacatgattaagaaataaagcgaaatccaacaaatcccgaatattcccgataaaattcaggtcactctgatcaatgctaaccaaaacagaaaatcccaaccaatcccgtgagcagtggcgacaattcgaaatcatccttgatcaggggatccaacaaaaaattaaaattcagcaaaatttccttaaaaatttcgcgtgtggtgaggtcttgcccccccccccccctgggaccgtccctgtcagccacttctttttcttcttttttttcggccagcaaatttgattaactttttaattagtgatttaaaatggcatttcccaccttttggtcaagctgaaaccatgtgcggaactgtggcggttcaatgaccacactgtccaacagttggccgtccccgcgcgtttcgagctttccgatcagtgactgtttggttggttccgacactatcctggacagacaataatgattgatccattttgaagagatcagaattaaaataaatttgtggcaattacttttaaaagaaaattttctagaaagaatttttcaacaaattttccagcgattatttagaaattttatgatgaaatactaaattttttcaaa

SEQ ID NO: 18937 - DNA, 1044 bp, Heterodera glycines
tgctacatttcttttataaaattctctttagaaaatattgatattttttaaatcaaaaattttcttatgaaaaaaaaatttgggggaagaatttttgagaaaatttccaattcttagtggtgtgtttttaaaaattttcggtcgattcttaggggtgtattttccgttttattgcatttttgttaacaaattttccaaaaaatggcgaaatatgcataaatatgtacaaaaagccaaaatatgcaaatatgtaccaaaatctcgatatgcaaaaatatgcaaataaaagtcccgatttttatacgcaaacacaaaaaagaaagtgtttttcccactatttagagcatggagaagccaggaaaaaaatatgcattcgcataaaattcccatccctattaatcaattaagtgaaagttgtaaatttttttattaatgattaaacgaatcaataaagataataatcgaattcttttattcgtattcattttaaattacttaaatgatttaatatcatttattaaaaagtggtgaaatgataaataatctatttaaattacctatccaagagcaaaattcaaaaaccaaaaaattaacatatttagaaccattttttgtggaattgttttttcaacaaaaaatttttttataaagtaaatagttgtttaattttaaaccttttttaaatttaatattcctttgaggacccgacttttaggctttattaatcgtataatttacaaaattgagcgcaacaattgaagaacaatcagcaatgtatcatgataagtagagctcataattttgaaatggccagaaccgggacttggaaaatgaaccgggacgggacccgtgacctggactcccgttttaaacgcgactcccggtcccagtttttgggccgggatccccccgggaccaggactttttcaaaatttttgaaattttgattataaattttaaattgcttcaacttctataatgtttaaacatagtttaatttaaatcaatttgcacttttacaatggttttttttattgaaaatca

SEQ ID NO: 18938 - DNA, 1483 bp, Heterodera glycines
taaaacatttcgccaaaataattattaaattttttcaaatttgggcttgtttcactggtgaaatttagtcctgtttttacggtccaaatggaccgggacgggacccgggaccgggactcccgttttaaacgggactcccgtcccggtggcttgtccaaaaaaacgggaccgggaccgtgagtcccgttttaaacgggactcccgtcccggtggcttgtccaaaaaaacgggaccgggaccgggactcccgttttaaacgggactcccgtcccggtggcttgtccaaaaaaacgggaccgggaccgggagtcccggcaaaatcccggtgggatcccggtcccgtccgggctctaatgataagtaattgaaagcaaaatattagtgaattttgtgaaaaataatgcttataaaaataaaaatttataaataatggagttaaacaagaaatattttcatacaaatcgtcaaaaagttgtttaaaaactttcagaaataagatttattctccttcatacattgaatcaacaaaaataaatattttatatttaaaaaagaatacaattaaaaaaaacgtgaaaataataaattaatctaaatgctgatattttttattgtagaatcttcattgatgtaaattattaaattaaaagcaatattacaaaacaaataagcaatgaaattaaaaaacctttaatacaaataaacggctaagaaatagatgatttttatattaattttggtatatatattaaaattaagatttttcgaataaacattggcttcaaaaaaacagaaaaaaatatattcaacaaaaaatattaaaaataaaaaaagcatgttcaaaataagaaaaagttaattaagtataaaaagtaaaatgaattttaatgaatagttaaatttgtagactcgtttatgagcctttgtgagtaacaaaatcaaaataataacataattactgaaaccttgtaaaaaaacttataaaacaaaaatgtatgactgaaaatatatataaatttcttaatatatctattctcaatttaaaagaaaattttattatcaaatgagacaaaatgcatcattaaacttataaaccaagataataatttttgactaaaatgaaactaatttcgataaaatgaaaaactcaagttccccaaaagagaccaataattattcaatagaaattagaactatgttttaagaactttgctattaatttataaattaaattcatcgcatattaattcataatttctacattgtaaacaaaaataaacaaaatattattttaataattgattaaatttcatatgataacaaaaattaatttaaaaatttttcatttttaaatgaatgataaaggaaaaagccattttggctgttgattaaaaagacataattatattttggttagctttcaatgtatttataattttaaaagacatttttttgaattttatcgtgtttaactttactttta

SEQ ID NO: 18939 - DNA, 2354 bp, Heterodera glycines
  misc_feature (2199)..(2199): n is a, c, g, or t
  misc_feature (2299)..(2299): n is a, c, g, or t
  misc_feature (2332)..(2332): n is a, c, g, or t
ccttgaacccgtgcttccaatccttgtccccgttgtccaccaccaccaaacgttcgcccgggcgcagtgtgcaatcagcgccgatgtattcatgtgtcacgatgtgcaaaattgatggaataactacaaaacaaactatgtacatagttaatcatatttaattatttttaccaaacgaattttgcaacgattgttgtacagtaagggtggcacggtacttctgctgctgctgatccggtacggtaggcaaacgtcgcggcaaacgacgtgcaaaaaatgtggcggcggagggcgacgagctccgctgcacgcactggtcaaagctgtccgcatgtgttcgtgcggaacgcaattgcttcatccctaatgaaaatttaaaaaataataatttaaaaaattaaattttaatgaatttcaaatgatttggtatgctttaagtctaacaaaattttcgatagataatcaaagaaaaaagaacaaatgttcgagtttcagggcatatctgtggtatatcccctcataaatcacccctctcctctgactacaggccttgcccggctacagtagcaaggcgatgaacttactgtaattggggtacacaccggcaatgccatgctgctgccggtggtgatcagctgaggacggtggttcagaacagtccaatgagaatgatttcattttttcagtcaattttatgcgaacgcttctgctgctgctggcggtgtttggtgcacttgaaaacagacctaaaaaacgaaaaaagaatattatttttctaatatgtgtaatatagaagttagtgaaaaacagtttaaaaacctttcatttaaaaaaaatatattaaaattattataaaatttcttttcccaaaatttttagaattaggaaaatattttagaacatatgcaattaaaatgaatattttgggcatgaacagcaattatttttattattatcttttttggaatctcattaaattattttaggaaactatgctaataaaatgattatttttggtcaagaacattaaatatttttagtttttatagatttttttttcatttgagtattccaacagccaatttttgccgtttgaagcgtaaaatctattgattgcaaataaaagtatttgccaattttaatttgggcaaacattctcaaagatttttatgcccatttgccgatgccaccattatttgtatgctaagaaacggattagagtgtgctcatcagtggaagaagcggacttgaaaaaacgcgaggcatacatttccggttattattataattatttttgaaattaaaaaaaaaattaaaattgcattgcaaaacaaaagctgtacattttgttttctcttttaaaaaatttaataaaatatttctttattgaaaagttattttaaaaaatttaatttaatccaaatttttgagtaaaaaccaaatttttataaatttaaagcattagaaaatgattaatttccccccttaaatattcaaagaaaaattaattaaaaagttaatctaaaataagagaaacttaaactattttcaggggaacatattgagaagaaaaatgacgtaaaaattttgcaggtgattttatttataaatgaaatgtcaaattcccaaaaaaagaaacaacgataaatgccaaatcttaatttaaatatttaataaaagtgaccctttttcagctgcttctcagttgaatattttatcaaaaaaaaacgttatacaaaaattacatttgtgataaaaatagaaaccttttaaaaaattaaaaaaagatcaaaaaattatccgataaaaatgtttacattaatttcctcaaaacagaaattaaattgtcgaattttttaatgaaaaatataatcaataaaaatattttaataaaaaataatttgagtaaagattcttattaaataattgcttctaattgaaaaagggattaaaatgaattttccttaataattttcaatattaagttattaataaaaaatttacaaaaaataaattttttttattaaaattaattttgctagcaaattaaaccaaacaatttaaacttttcgggacatttacatttatagtatttccctcttcccacgggcaaatttaaaattctgacaaatttaaacaaatttcgcaccatttgtcccattaaatttgctagcgctgaattcgaacaaatgcaattanacccctaattgtcgcgtgagtgaaattaaactcaaggtaattagtttccacaaaatttcattttttaaattggaaaattaagaaaaattaaaagaaattntataaacgaatttatgactaattgtgtaattgngtgatgaatttttatgaaaaaa

SEQ ID NO: 18940 - DNA, 1763 bp, Heterodera glycines
  misc_feature (31)..(31): n is a, c, g, or t
ctaaaaatcgaaaaagaaaagcaataaattntggtttttccttccagcattcacagacccgtctccgatttcgtccacattaaatagaatttgattccactgatcaaaacattcccagccaatcgcttcctcttcccattttgcccatttgctcgcatcacgcacaattggacaacggaccaacacaaaacagtcgtcacttttgtcagtttctttaaatgccaattgttcacgggtcaattccgttggtcaacacaaatggcacaacagggtcagcaaaagacgaaggaataaaacaaatgacgacaatgaaattgacgggagatgaagccgaggcaaaagcctaaaaatgtggaaaaattggttaagaaatatgaaaatgaatgacacttttcggttgggagggggacatgaaaaaccaaaaggtttacaacttttatggttgaagtgaccaattctgttagagccaaaaaaaacaacgaaaaaaagccaaaaaaaaaaaatcattgaaaatcaccgctttgaaggcttcaatcttcgacgccaaattctcgtcagccatgtccaacgtgcagatcaacacctttggcacagcgttttgaagtggagtgaaaagccacttaaccaccgcttgtccatccgatgtgatggcactgtcatcaaatggaaattcggcgaaaatgtcgtcaaaaatgaaagagacaatgcgaagtgatggacattcgttgagaaatgatgggacgaatttatgcaaagggctgaaaacattctcaaacaaaaacatcccacaaatgtttttcgcgatcattggccaaatgttgcgcagaatgaaggccaaaattcggtgtttggtcgtgcagatggccaaattaattggacagaatgaggcgaaaagtggacaaaaacggtggagaaaagcgatggaattgttatcgatgtatctgaaaaagaaatgatactaatttatgtatatttgacaataaataatttatccattttactctattgaaatggctttaaatccgacgactttctttggcaccggtttttgcgcaattggcaatggatttcgatagcaattgacaatttccatttcgttggtgccattctccctgattttgcttccaattcgaattattccgaatgtccatttgcgcgtcttcaagtgttcatccacgtagaagttaaaacggtggctgatcagcgcaattccaaggccaagttgagaaggctcaagcaaatcgaacaccgaaagccaaccgtcgccggagatgaaactgaaaaaatggaaaaacaaaattgaaaattgaaaattagcatttttaattttacattgattttgccattttttcctctgcttcttttcggttgtcagacattttgttggtggcaaattattaagacagttttcggcagatttaaatttgcttattagaaaaacagaaaaagaactttgtaaaaccaatttttcctttaaaacaagaaaaaccgagaaaagtaaggaaatattttgcgtaaacaaaacggaaagaaaaaaatgagcgaatgaaaggaaatgggagaggagagaaggcttttatagcaatgcgttttgaaatacgactgattataaaaatcgtgaaaaattgtaacaacaaaaattagtataaaagtggttgctcctctgccacttttcgtcattattcattctccattttcgcctcttcaaatttttcctcctgacaatcccttcaaaaaatgactttgtacgttttgtgcgtttc

SEQ ID NO: 18941 - DNA, 863 bp, Heterodera glycines
tcaaaaaaatccgaaaaagaaaatgtaaaaacagcataattttcaaaaaattttgcaaagctgataactatataataaaaatagaattgaaaagagatgaaggaattaaatgatgaaattaaagagagagaaaaggaagaaaaagacgacagaaagttggcttacaaattagcaaaggtaaaggaaaaaaataacggacaaaaaaatgtgcaaaaaaagagaaacgaaattttaaacggacgaccaacggacagaaaagtgaataaaaacgacaaaaatcatcaaatcaaaatgcaattgaaattgccaacctttgggaagaatttgaggaaaaaatggaaaaattgtatgaaaaaacgaaagaaaatgccaaggaagaaaaggctcaaaaaacgcatttctgcataaaaaattttcgattcagatgtcactatcggtcactaaaaatcactattttggcgcttcgtcactaaaatagttaaaattcactattttggcattttgtcactattttttcactatttcgacttttttggaaaatttctcaataaaaaaatgcaataaaaacgaaaaatacaccccctaagaatcgacctaaatttttttaaaaatgcaccccctaagaattggaaaattttctagaaaattcttctcacaaaatttttttttcttgacaaaatttttgatttaaaaaatgtcaatatatgctaagaaaatattagaaaggaaatgtatctcatttgcaactgcaatcagtgaataaagattttttgctcattttttggctgaaaattatgtcactattcgtcacaatttcgcactattggctactatttggatatactatagtcaaccccccggaa

SEQ ID NO: 18942 - DNA, 1191 bp, Heterodera glycines
  misc_feature (1136)..(1136): n is a, c, g, or t
  misc_feature (1141)..(1141): n is a, c, g, or t
ttccaattttccatttttattggggctttttcccacccacacctagcataaattatggcatggattgccaactgcgatactataatccacaaaacttttgcatagtaaaattaaaaatagcattaataaatgaattcctgagacaaataaattttaattaattcaattatattttattaaatacatattagctagcagcaaggggattttgctttagagaagagagtattttatactcattaaccaaatttttggaaaaatttataaattttacaaaataaatatttgtatctgtttaaggataattaaagaattccgtcgtatttagtttataacatttctaatttgtaagctaaaaatgtaaaaattaaatattaaatgaaaaaccgctagttttgcaacattgtataaaatgtttaaagacaccttttaaatatattataatggaattttattttattattttttgatgcaaaaagcaagcatataaaatggcactagttccggattggcacgcgcattgatttattctatgagtgggtgttcacaaaatcaaatactcatattgtttatcgttgttggaaaatattcgttgttttttccggaaatttaattaattttttaattgttttagcattaaacaagtcaataggctccggtttcaaaatgatatcgtcaaaccctataaatataaagaagcagccgaaaaaattggaaagtgtaaaaaaaaagtttatttattttgtattttcttttcatgtttttcatggatcggattttaatattttatcttttttgttagatttatgagagaaggtcaaaaaacaagtttgcttcatccaattttcaaatatcagcgagtcataaatacctaaaataccattttggaaaatatgaaaatttatttatttttgttatttcattggataatcattaatcatgttaatttgagtttttgagaatttgcttttttggatcgaaaaggtcgtctccttctccttgttgtccttcgtcttcttcctcagcatccgatagaaaaatttttttttggagtttggattagtggccaaattactaattgcttttttctaaatgaaactttcctaattttatagggttttcaggaatagaaccanctgancatcgggctcctagaaagggccaatttaaccgtcgatgagctcaacactg

SEQ ID NO: 18943 - DNA, 2113 bp, Heterodera glycines
  misc_feature (1876)..(1876): n is a, c, g, or t
  misc_feature (1908)..(1909): n is a, c, g, or t
  misc_feature (1940)..(1940): n is a, c, g, or t
  misc_feature (1998)..(1998): n is a, c, g, or t
gtgtggtattagtgactttttgaccctttatttgattgtttgaatttgtttggcataatgtttgatttgaattgacccaaattgtttcgtttttcttcagttgtggttggtggattagttggtcgttggggataatttttaggcgttttgttgattggtcgtcgattgatttttgttttaatttattttgttgttgacttattttaatttaatttggattgtcttttaattatttgttgcataaatttattttgtttggtattggatttttaaagcaggttttgccatttcatagactatttgtgcaagatttagaagtgtggcaaagaaacccccgacaaatttcttcttcttttccaacatggcgctcctggtaacaaaggttagctcagtggcggacggctttatttttcttcagtgaatttctcattttaaaaaaagcgactacctaatttggaaaaaccctcgtgttgggtttatcgactgttttaataccctcgtgttgggttcgtcaactgctcgtcaaattttaaaaccctcgtgttgggtttatcgactttttcaataccctcgtgttgggttcgtcaactgatcgtcaaattttaataccctcgtgttgggttcgtcaactgctcgtcaaattttaataccctcgtgttgggtttttcttcatccgccttatttcgtccacgtttacaaattcgtctaaagcactcgtgttgtgctcgccaaaaaatcttttataaaaagctcgtgttgctttatacatttggattttttgttttatctcgtgttgataagacaaaattatgcggacttcatcgacaaatttgcatccgttgaggtacgaatcttatgaggtgctcaaaaaacatgctaacgacattgacaaccgattgcattattcacttcaacggctcgacaattttactcggctcaactttttggtggaagtcgaacggaaaggaaaaacgaaaatgcaggaaggaaatgaggaggacgcatacatactttacagcagagccatgaccatttatcttatgatgagtgagtcaattgacgacaaattcaaacgaagctgcggaggtcaacttttttatgaaacttcacagcgtttgtgtgttgcttttgacaaggttgcagtgagtttacaacagcggtttatggagggacaaggcgatgagcctgaattttgtgatccagtggaactgcgttgggtcgaaatagttgaaaaaccgattcccgaaaatttgcactgtagtaaggactccaattcgtcggatgaccaggacaaaattcggtccctttcgccggcaaacgcaacagaacttgtggcaaccgaaaaattttcaaccaaaattaaggcggacaaagaaaaccacattttgcacataaaggacaagacggacaggggcattgggatgattagacatgccgtgaccaataacctggccacagttggacagtcaggcaccagcgagttcatctccaaattgttcgactcgtccatctcatcaaagcagaatcaggatttagttactcaatctctgcacctcaatgaggaagcacgcaactttttggagctggataggctgaaaaagtccgaaaaaatggagaaaccggtaaaagtgagcaaagaaaataagaaaggagaggaaaagtcaaaggaagtgaacaatgaggaaaatgagtacaacgaattctgcaagtcaacgactaaaaacattgacgagccattagtccatgtgcaattttttgctgaatttgagagctccttcaagtccattttttacgtgccggaaacgttgaccacagacgaattccaaaatcaaaatttggcattttcatcagggacgatgaaaaattcgagggaggngaagaaattggcagcagtgagacggacaatannaatggcctaatgagaatttggcgattagaanagttcagcgtgaaaaatggacgaatcttattttcagtggacagtgcaaagtggctcanaacgtggatcttcatcaaaatttccgataaatttctttggacaacacattaaatttttcgagacacaaatgccacatttttaaagcgtcacgtcactagctgaaaccttggaccc

SEQ ID NO: 18944 - DNA, 3452 bp, Heterodera glycines
  misc_feature (1618)..(1619): n is a, c, g, or t
  misc_feature (3436)..(3436): n is a, c, g, or t
aaatgtagcgcagcgacttcagcaacgccaagtaggtgttggaactgatgtttgagggctgaaaaacagtaaaaaaaatttgttagtttttaaggggcaattaggcattccatgattaattggttaaaatttcgaaaaaacaattaatgtagtaatttccgttcactttgatgcacttttcccattgcttacctagaattgccaatagcttttggacattgttgaggaattcaaagttggcgcccacaacttggcggagtttgtccgggtgttggcgcatgttttcgatgacccggttgaagagtatgcagatcgattccaggcaccgcttgtcgtcgacatacacgagccgttgggtgaggtcgggaaggcctgccaaaagggcattttaaacacaataaaaaaaattaaaattttattaggaacgtacaatctttgactagttgaaattcagtttgggtgacgtgaatggcgcaattcgcggcaatggcaaaagccaaacgttgagaaggcaatgaaaaaaagtcgacgtgcgaaatggtagacgcaatgccgccggacaacagaatgtttttggcattgcgacgcgacatcacttccaaggcgatcagcgactgttcctttattaaatgggggacagatttggcggttaaattcaaaatatgtattaaaaaagtaccgcaacgtcaatgtattcaatgcgcttcagcttttgaagcagcagcggaatggcctccgtaatgacgggcaaagcgcgcgggagctgaacaaattaggcaatgaaatacaataaatggtaattaaagagagatttagatcaattaatcagacataatataacaaaaatagtgctctgctcgtaagtgtcttggttcttcaacgggcattataaaataacaaaaaaatactgaattttctacagatgtctgattttggaggtctgcaaaactttgatcagaaaataccagattttgggtgaacatttgagaaatttcgaatttaaatttatgtcgtaatttattaccgcctcctgcatgttggtgatgcaacgagcggctgtcagcatctgttgaaaaaatgcatcaaataaaaaatatgaaacaaaaaaaacaattaccaattcaaaattttggtccttttgcaacagtgcgcacagcgactgcactatttccacaattggcaaattgggaagactgtcctacaacaaaaaaagtttgggtcttttactgatttgctgggtgggagtggggtacactgtttgcccgcgaatcaaaaacattttcgacgaaaacgttatgaaaaggacggcaatcatcaagaattggtgtcccgacgaaaacaatgttaaaaatttgagacttagaaaatgcgctgatcacgaatctgagctcagattatgcttgaaccttaattttacctctgattattcatcaattgtcataaaaaataaatcgcagccaggcggactcgaaccccagacccctgtctcatataagccctagggtttcaaaaagtcgtaaaaaattgaaaacttgacttttccatacattaaatagctcattcgaaactctttttatgctctacacatctgtgtatgaattttatgccagactatttnntcttaaatttgaaaaaatcaagtagttgatgaaaaatcctagataaaaatcaatgatttcaaaaataagagttcagattcatgataagcgcatttttaaagccagaaaaaatacctgtcaaattttaaacattttttttcgtcgagacaccattgatgattgccaaaaatatctgcctccgttttattagtgtgtctgtctgtcccacctcattgccaagcagcaaaatgtcagccaactctgaagccgcttcggattggcgaatttcattgctcgacttcagcccttcgacgatggaaagcattgcaggagctgaaaagggaaaatggaaagtgaggagaatcagcaattcaaaagaaacaactctacatttacaacaaaaagtgcaagtagtaaaaatgacgcaagtaacggataaataaatgggaaagttgctttcgaatgacaaatttccattgacaatgaaaaaggattcagaaaaattgaccataggcaaattagcggggatggggaacagaaaaacgggtcatgggaatggcaaatggaagaaattatttggtcacgggtcgtcttttaatggaaaaaagttaaacaatgtgatacggacacagacttaggaaaaaggataatttacaaaatatagaaaaagaataaaatttttcaaaatttaaaggggggcgggctttcgatttgaaaaatcattttgtatgatgacatcaactcgattgttcggggattttgggttgctgaccatgaatttgacatcagttatcgaaattcgggaatttcatcttgttagggttcgggttaagaattagtgtcgaaattggtgtcaaagatcccgaaaaccaatacatacatgtacaaggggtgtctcagcccaagggccatacgacggacggttgggacagggggatgtctcgggaccgatttttcatacgaaggtccaaatttttctccggcgacgactttttttttctattcagaccatttttttctgccgactttttttttgcttttcaaaaacctttttttcggcgcgctttttccaaaaaaaatttcggtatcaggtgggccggcgatgccgataggcgccgccggggaaatttttgaaaattcgagtgccaatttgtcaagattttcaccaaaaactttcaaagtttgcgattttttggcaagtcgacgactttttttgttaaaaaaacgtttttttgcggcgtaatttttgaaaactttttgggggcggggggggggggggggggtggtcgagaacccccttgtacatcatgtatgaaccaatacgaacaaatttccatgatttgttacgacaaaataaaaccctgggactcacttgacacgtgctggtggtgtccatgcgtgtgcgagaaatggaaggtgggcattgctgtggcgtcgatgagtccggcagctccgcccgcaatgttcaggtcgagcgcagcggtagtcgttgtgccaccgcttccgccactgcccccgccggtggtcgagccgagcatttgctgcatccgcggcacaattgtggacagaaaggcgttggcacgctgagccctaaaccaaaggaaagcgttttgtaagtccattcagcgcaaaaagtgaaacgttcccataaatgaaaaggattttgtttaaatagtataataggcgtaaaaaaacctggcgtcctgttgcacactcgacgaactctgaggctgctgatttgtgtggtggtgcggtcttcctgacgaactgaaaacagattgtaaaagcaaactccaatccaatttatacgcccccaagtttatcggcatttttccctnattttccatttgttca

SEQ ID NO: 18945 - DNA, 3500 bp, Heterodera glycines
  misc_feature (31)..(31): n is a, c, g, or t
tcgctgctgctgctgacgcccaatgggcatntttgccaccttctaaatttaaagcgatttgttgaaattaatagataattcattagggaggaagcgggaaacacctgctgctggggaaatctggtgtaatgctaaatatttggggacttttaataaatgtaaatcccatccctaatcatttcttatgtaattttcccaaaaattgaaaatccgagacttttgtcgagtcgagatgagattcttgaacatagctattttcctcccattccgtcactgtggctataaaaggttagttaacttccccacttggacagactcaagaagtggatgactctcggactcgatgactcatggattctcggatctcagaccccttccgcactcatccttttcctacttttaattcccgacttaattttaaataaatattgaataatttgaagtgattttgggattgggtcggaggctgattgggagctcaaaccggagtgattaaaaccccggaaaacttccaaacaatttgagaacggaacagtgcagcagaaagagtgaattaaaaacaaacaaagaaaacccttttaagaagccgcttttcctaggccttttaaaaagcttcggtcgataaaaaagtaaagaaaatattttaaaaagacaaaagttaaatggaaataaaacaaaagaaaataaagtgaccgatccgacccaccgatgagaacaaaaaggggcactgattctgacaaaacattcgttcatttgtacaaaacaaaacaaaaaaaatgcaaatgaatttttttgtctgacggcggccaatcacagacacaaatttccaattgcaatggatgagaatgattaacacacaaacagcaagccataaagctcaccagtagcagcagaaaagtatcccccccatatccattcatattcataatgtacatttatttatcgccggcgggggggggggattattgatgaagccaaaggggggggggggggagggaacgggggacgacgaaggacgagtaaactccgtaaaaaaggctcttttcattgaacgcccacaggtgcgaaaaaaaaattcagtttcattgtgtgaaattgaaagcattatggggaagtacacattcccattgtgccagagaatgtgtggaaaatttgccattcaccgttttactgtaaaatgcacctgtccaatcgatcgagaaatattgcaacaccaaccgaagcacaaaaaatgagagaaatgagaaagacacaaaacacaacgccagaagagaggccccaataaaaaagaacgaatttctatcggattaaagcataaaattcaccccccccctatttaaatgccgatcagtgccggtttatgacaatcatcaagttcaacatccgcccgactgatcacttccgtgatcagttaaagaaaacatggatcaaactcaccattttgtgccttggcattccgccgtttctgttgttgtttccgtgtgctgttgtcggtgttgccgctgtcgctgaacggcatggcatggtcgtgccgttggcgatggtacacgcggccgtcgctccgacgccacaagacgcggtaggggcacgtgttgccaaagcgggcacagcgcaagtaggagctgctctggcgacgcatggtcagcttcagcgagtgctcacggcacagtgccaaaatggcacgctttccgtacacgccgctggcgagcacacgccattcttcgcggcacgagttgcggacatttacagtggtaggtggttgagataaagcggaggccgaagcggcagagcaaggggaggagagcgtcaagcggaccagctggaaacgggggacctcaaattgtgccaaaaatggagagatttgatcaggatgtatccaggggaaagtgagggcacagaaatgaaaaaaattacaaaaataaacaaaaaattttgccaaatttcttgtttttctcacgcggcacattttttgataaattcactggagtttttttagcctaagcacaaaaaagaaagtctcaaagaaggacactgtattcgtccgtttgtgcctcccctggaatttgtttctgggtatgacgagcctagacttggtcgactagcaggacagggttcgaatttctacccgagctttttcccgggcatttttttttttttgctgaataccaaggtttgtgatcgtgtgaaactggtaaaatccttgtcttgatctcctgcccgagacctaacactcatcagggatgggtttggggtcggcggatcagcaaccaaatcagagcccctcggaaaaggcccaaccaatcactactgattagattatctaccctctgcttcccaggccccgcataattatgatgaatggacggcttcttattcgtccattaattagtgggtaattaattaataattaattaattaattaagaaaagtgcaaaatgctgacagcgcgaggagaaaaagtggcagctgctggcgaggaaggggaaggcggtgaagaaggattattgtccagatcagttggcaacggatggttgtgagcagagcgacagtacaacatgtgtttatttgcgtcgatcattgttctgttgaatttggggccattttttgacaaataaaattccaaaaatattttttaataaaattaaaaagccttataaaatggaaaaatgaaataattttagacgaaaatccttcgacgtttcatcaatgttttattgagttatttattgtgtcccaaactttctaagctgagacacaatgggtctttttcttaaaacagaggtcgcataattccaaaattgaagttaattttaaattcaatatcccactttttgaaatggggtcggagggtcgacggtgccaacggacgccgccggaagaaatttttgaaattttcggagaaaattaaaaccaaataaaaacaaaaaatataaacaccgaaaatgacaaaataattgtgagttttggtgctttgtttgttttttttttgttccgtttcgtcccccttttcggcactttttgagtttttcgtgtttcgtttttgcccttcaaaaaatttcctttcgtttcggattataattcgtttcgtttttgtttccgaattttttcgtttttcgtgcagttcccctggggctccccgtggtcaaattctttccttatcagccttgtcacaaaataaagtgattgatcactgatcgaaataggtcccttgtgattggaaatttatggtctcaattcaacaatttccccccccccccctcccgcgctctgatcaccgattgttttggcaacaaaaattgatcagataactctctctctctctctcaatttgaggtcttcccaaaacccacttgtaattgcacttcacatttgagcatctgaagtagaatttgccgttttttgcaatgccactcttgtgcacgtaatgcaattggcacacctcgcggcacacctcgtccatggcgcccctgatttttcccaacggaagccaataccgaaaa

SEQ ID NO: 18946 - DNA, 1708 bp, Heterodera glycines
  misc_feature (63)..(63): n is a, c, g, or t
acaaaaagggaaatccaagcgaatcactgacaaaatcacccataaagaaaaatggtcggaaancgaggaccaaattcgaccttctctcggcgtcgcgattcccgtgagaagcagaaatatgccatgtccaacgtatttttggatctaatggatttgtccgcccgtttgttacgtcccggcggtcgtttggccttttggttccccgtttgcagatccgagtaattctcgagtccatttcccacaaatcccatgtgtttttcagatattccgaacgtattttgccccgcatggattgcatgcgattggtgtgcaactgcgaacaaacactcgcgaaggattcgtcccggtgactaaacgccatcgcttaattgctccatttgactgctatgcttttaaggcgccttttggtctatgaaaagcttcgccgtcctctgactgatggccaaaccaaaccaagtgaaagggcattcttcgaattggactgttatgccgagaaaacattccaccagaaagtgttcggaagcatcgaaaagaacgaggccaaggagtgtgctgattaattgcttcgtttaaactcccattctcttattttgtgtttgacgcttttcatatcgcttaaaaagaaaaaattaattttatttcaaataagagaaaacgaaaacaattgtctgccgtgtatcttaatttatttcaaattccaatggcttcttccgcactctcttcgtctctcctttcgtccattttcctctggtatttctccatttcgtgctgttccatcggattctcatagtcataatacattgccgcccacactccctccccactgttttccttcattagcctttggtgctcaaacaatggtttcttaagccaattcgcctggtagttgatgtccgggtattccggctccagtttttcgtctggcttcagtttcaccaacttttccagccgtttccgctgcacttcccgcctgaccgtttccgggttccggaacatgttcaaatatctgaaagaaagcaatatgtttggggtagttcgaatagtccgtttgtagcctctcactggtgaaatggcatcggcttcattgggaattccttttgttccggacccatttgctcattccattcataccaataacgtggtgtcttcagacctggaattaatttgtacaataaataaattcattggtttggcaattcaccgcacccaatcgatgcaatgtttggtcgcaacttttatcccattttatttggcaaaaccgaagcgcagaaggactcattttgtcctcgaattgtttgtaaaaagcatttgtgctgaatgaacgtgcgaccagcgaatcgcttcttaaaaaggaccaattgatttgataaaagtgctttggtagtggggcacccttcgaggccgaattcggcaaaatcgatgcgctgtcggtgtcgaaaaagcaaaaaaccgaagcgatggtacccagtaccttaattggcaatttattaaaaattgagcaatggaaaatttatatgaatacgtgccgtaaaaagggacgggcggtaaatacggcatcaattcgtcccccgtctgaactccatcgcattcatcaggaatattcgaaatcatccaatggagcaactgatgtctccccagcttgaccagcagttgatcctgtgacgacggtgctgaagaaaggcttccttgcgacatatgtacatcagtc

SEQ ID NO: 18947 - DNA, 1758 bp, Heterodera glycines
  misc_feature (29)..(29): n is a, c, g, or t
  misc_feature (1697)..(1697): n is a, c, g, or t
  misc_feature (1705)..(1705): n is a, c, g, or t
  misc_feature (1707)..(1707): n is a, c, g, or t
ttctgtctgaatgtctctcgggcaattcnccgctgtaattgcccatttcgattttggagtatctaaatgggacataaatatcgcctcaattagagaattagaattctacctgaagtttttggctgattccgttgattcgctttcgactctcatccaattttcgcacgtacgcgtccaaatcatagggcaaaagctgttcatccaccaaattctttaactctaaatatgttcagcattttttgcttcaacaattacaccataacgttttaaaaatgttcatttacacgactctcttttgacttgatatgattaattgctcacccactttctgatgtttggtcgatgtgattggccaagaacagctgactcttcctggtgttcttcacctgttcgtccatgcgttcaatggcgggacggaccatttgcataatcgctgaaagtaaaaacaattaaaatttacgaaacgactaacgaaccctcgctcatattggaaccatcggcggaagtcattggaaattctaaaacctatcagaaatgcagataaattgatttgagaaaaaaaaaatatatatatatatagcgaagcaaatattacgtttaaaagtgcgtaaagacaaaatgaccaaacagaaaatatagaaattacgtcaaaggattcaacagaaagcgcaaagtacaaaagcaaaatgtaaaataatcagattataaagggacaagggcacagctcacctcctacagattcccaggccaaaagcctgggaattctttctggccatgcctcgctataaataaaatttgttcgaaagtcccattttcaattattttattcgaaggaatgttgcacagggtttgtacatggccgagttgagctgtgaaaagtccaaaaaagaggtgcctctgattaatctggtttgattcggatgccaagtttgagcaaatctggtgcctgttttgagtttggcgaaagggccttcgctgccttgccaatggtgtccaaaatgatcatccattgatcgtcgttggtcacacatcgggccgtgttttggtgatcaaatggctcctcaatgaacagacggaaccgttcagtgtttggtggcaattcagtcctttcgtgaaaagcattcaaataaattggggacacttgttttacaataccttgggaaaacacagccccttcgtacggaaatggcaaatcgattgaaatcgaagcgattgaaatagtcgaagaaagcgatcagcaattcacccacagtcctgtcattttgctgtatttctgaaacatacaataggtttattgtcttcgaaaatcactttgttgcttcacccggcaaaggagtgggcaaatcctcgaaatagaccaagtcagtgaatgggcgtcttaagctgaacaagtccgggtaaagttgctgcaaattcggaagaaccggcgggtcgacgccgcactgaagaaaatggagaaccatcaaaatcagcgagtaactgagcaaaagggcaaccaattaactgtcaattaagcgttagtcattcagtcacctgttgaggtaaccaccgctggcatcgctaatccctttgactttcgcccaatgtttcacaagcaaacaaatggcagggaatctgtcgtcgattctgaaaggaaaaagccttcccaactgaagttacggaaagatagtacctggagtaataagggaggagaaaanaatgtaancncctgtggaaaatgggaggaaattagggacggagaggaaaagtaaatgccaa

SEQ ID NO: 18948 - DNA, 3202 bp, Heterodera glycines
  misc_feature (3097)..(3097): n is a, c, g, or t
  misc_feature (3115)..(3115): n is a, c, g, or t
  misc_feature (3170)..(3170): n is a, c, g, or t
tctccaatttcaatcagattttaccgtaagaaatttacaaaaaattcagttctattaattttttttttgtaggccaatacaattattcgtttcctctttggatttccgtgaggctcaattaacaccgaatggtccaatgcgtgtttgtaatgctatcctaatcaacggggagggaaagaccgttgaggtctcagcttggcgcttacaagcggatgtgttagcatcagccatgagaggctatttgtacattttcgtaaactgccgtgccaaaccaccgcgagaacggaccaattgttggttcagactgaacattgatgccatgagttcatacatggtacaggtccaggttcgagcgttgagagtagcaaaaaaatacgagattattttagccacatattgcagtgccacaaaatacaattgctcccgctcaaagccaaccgtccggttcaattatgcctaatgaaccgccggttaaacctttcttcagatttttaaattaaaatctattttcacccccagagatcacaaattgtcaattccggggcaaatttagtggctattcaaagccaacaaaatgaaaattccgtgcctatcacgcaatctgccccggtaaaaagtgttgtatttcagacaatttgatttttgaatttaatttatttcagtctaatcccttagctcatgatcaaaatttggtgcccagtggggcaaactcgcatcacactgatgagatagtggaggtgttttttatacaaataataataataataataatggcttttaagaccattttggattgaaaactttttttaaaaatgtttaaataacaaaatattcttgacttttcatttttttattgaaaatatattcaaaaaaagttattccttatgaagttgttttgaaatatagaaaataaatgtatttaaatgtatattagtgaaaaaatcgttaatgttttttcaaggtcgaacgcaacaaatcagcgggacagggaaatcgccaacagcaactgaggcgttcgaatgttgatcacggacgtttgcgacatggcggggacgacccgactgaatcagtgcaaaatgtacgctacgcgtctaagaaatgcttttttacttatgtttttcatttaatttggcattttttaatttatgaactttttttgttactatatttaaaattcaaaaagttctttacgttaaaaaaatttggggaatcctaagtggctatttttagcatccctaccgaagaccttccagggcacaggagcctgttcttgacgagagacccagcacgtcagggggtactgggttaactcgtcctgagcggcagtcccgctaatcggtgcgtcctttagttgaacttactttgtcatctataatggaacccccgcctcctcccggcccttacccgcttagtaaaattaagcgtttacccacttgccaaattaaccaataattgcccatttgatttcttttattatgatgctatgtcatgttttggtgaattaattattgatgataaatactgctgattatttaacaattaaaaaattaacctataattaatatttgagtaaaaaaaagattaattggtaattatttaaatgtttaagtggacttagctaaaagtcttttggtaacatattttgcaataaaagttgaaaattcggttatccttgtagtcctatgttaatcttttattaaaaattttaaattattcttttataaatattttgttttataaaacttttggaaatttagtaatttctaaattttttgattaattattaagatgctgtaccttcttattttgaacatttttataaatcatcggtttttaatttattaatgtttttgttttttttaaatgctaattctttttaacttattttttaaatcaatgataataaatttgttctttaaaaatggaacttgttgattattgttaagtattaaaaaagtaaatttaaacaaatatgaattttttaatattttgaatgctttttttgaattaaatctcaaaaatgaataatatttctttcttaacatgtacacttttgctaataaaatgtgttatttattattattagcaaagttcccaaaataaatcagctttttaaaagttttttgctgtttatttttgaaattatgattgttttaaaattgggcattgtgtaaaaacattactatttaaaaatctgatataaacaaacttttggctttcttattaggttgtacacttatttttcttggaagtttaatttttttcattaaagatggtgcgtcaaatgtaaacgaatgctttgtccttgaaagaacgacaacaatgagaaatgttatgcgcaatacgagggagaaatttgtgaactacggtttatgccgcttgaggaagcggaccgtcccgatctcgttcttgaagcgctcatacagcatttgcttgatagagttctaactggccatcctcgtccactaatggtcggattacaacttcatccgccgggattcgacagaccatatattattcgactccgtccaccggaacaaaataatgcagcggcgctcgcagctgctattgaacgactcaatgagcagtctgcggccgggattgatctactttctggcacaatggtcacaaaagtgctcgctgtgtggccactagatcccattcgtgccgatccgcagagaggcggtttttaaacaaattgcattttaaattaataaattataattaggagggtgtgatctaaatgatgaacacaacgtgtcgcataacgtgcaatccatcgtgcgcgtagagaatcctgacgaccgtctatgtttagcacgtgccgtgctaatagggcttagagacagtgagtccaggatgcctaatggaggtggccttgacgcactccgtgcgtacgttggacatcaaaatcaacatggacctgaagcggtttccttgctgaggcgcactgtaaatccacacaacaaggacatgtacacgctacgggacgttgagcaactgcaaagatggttgaacaatgctcatggcattgggcagactcggctcgttgtatttgagaaagagcataataccggatcgtcttcaagggagaggngtgagccttggtttttanaattagaaattttttgcataaagtgcggcacagtttaatttgtgtctcctattgnagcgaggccacttcaattatataggccgaatt

SEQ ID NO: 18949 - DNA, 740 bp, Heterodera glycines
cccgagaaaatttttaaaaaaaaaatttgctaccttaggacttttttgagtgcggcgtgggaaccgagactggggcaggcactgatattttgggggaaacggcggggtgggaaacggcgaggggggaaacgagctagctcccatttatgacacactagtttcgtataggagttttgttttttaaaaatttggtaaaagtttgggttttttagaaaatttttttttcatttgacaaaaatgttgccttctttgcttttgaatgtaaaatttcgacagggttcttctctattgctagctttgcacaggtgtcgtcctcattttcttctgccccaagacgttcggcggctgccgacggcgacgagtcgggcagcggggcggaggaggacggtgatggcgcgtggagcagtggcagccgcacggaacgccaaaacgaggaaattgcacgacggcagcaagaaggtgaggcgtgcttggtggatgtacggaaagaaaatttcgctgattgtgagcctcaaaaatgagtcatggttccaaatccgccggaactccgccaagaaaaatttttttttatatttcaaaccgaaatttttcaaagaaaattcgaagaaaaagaaataatatttcaaaaaaaatttcagcgtttttcaaaattgaattcttcaaaaaaatttctaaaaaccactggaaaggcccagtgactacgagtgggagggggcggcccgtctcccggacaatccgtc

SEQ ID NO: 18950 - DNA, 1350 bp, Heterodera glycines
gcttttccgtcttgacttgtcaggtcgggaagaggctaaacaattactttatattcgtttagtaagtgaaagaacgaaaagaagtaactaacaaaaaagtaatggccggtgtcaatatctgtgcaacttcaggtgtcgtaatggcgcatttatgtcatgttcattcaaacgctctttttcgcgatcaataaatgttgtcaatctctacagcatcccgtcaaaagattgtctcaacatttgctggtactctgtcctttcactgaccattgtcacttcattgacagtaagtggttggattaactcatagatcaaagtcataatgatgcatttttgtattagtttaaattgcgaaataaagtcacttcagatcggttgccaattgacaaatgccgtctttttcatagcgatgtcttaggcctgaatcggtaacagtttcggcataagacaacaatccagcatagacctaaaatatgggtaaatgtaatcttaaaagtattaataactccaataatatgtcagatggactgactgaagcattcaaaaacagatgcataatcttcaagttcagtcttctccccacaccccccaacccccccgaagctgggattgccaaaaatggtaacgggtcaaacaaattgttggcacaacggacggagtctgtcgtacttgcttttgagaatccacacgccttcccatacacattatttttgggttttcaaacccaatttcgcaatgttcagcccggcgtcagccacaccgtgcggcacgaggacgtggtcagcattggcaccgccgagcaaatttggctgtcctttcacatccacagcggactgaacacgtgccagggctgtgagccgggactgttccccagcggcgacggcacttgtgaaaagtgagagagtgcagaaacaacggggcccaagggtccacccaggaatcacaaagattcaaaaaatgacgcacgcgttcaagaattctcaatgaaaccccgatttcaaggcctacgcatgcagccgtgagccccctcttcccccaatagctggaaccattcagacgcaaaaaatttttgtgaggcgaaacgcacaaattcaggggagcgagtcgtcgtttctcctccccccgcgtcgtttcgcccccgaaaaattttttttaaaaatttcaaaccgaaattttccaaaaaaattcttaagaaatttcttaataagaaaattaaaaaaacaatttattgaaaaactttccagcgatttgattgaattaaaataatttttcgggttaaaaggagaaactgagaacgaaacttttttgatgtttttttgtttgtttgtttgaacagtgatgaaaggccaaaaa

SEQ ID NO: 18951 - DNA, 2612 bp, Heterodera glycines
cgaatttagcggctgatcgtggctcacgttcctaacatatcaattaagaaaactagccaatgtcattcactggtagttcagtggtctgtctctctgtaattacttttgtctggcgctggttcaattccctcttccgttgggttttcccgtttacaaggcgctattatcttctcaactttgttgtagctaaatgtgctggaccatgtcccgggaaaattgtgaaaattcggactgagtgagactttaagtgatgcggagtcaatgttggatcacctattctaagtggtctgacgtgttcattcagcccacagctcttttttgcaggattatttcaaatagtacacaattttggttgtgagcaaacttttcaagaccattattactggaacgggacaaaattttaccgccgaaatttttcgtcgtcaattttttttctaaaaaatttccaacttagaaattttctttaaaaaattgtataaaatttttttataagaaatttcaaaaaaatttttgaaaaatttttctaccgattttttgaaggaattttcatgcaatggttaaaacttttttcagaattcatttggttttattcctcctcagaattcaatgccttagtcttcggttttgcatttcccaattttcaggcccttcacaacatcaacgtgaagcgcagtgtcacttggctgctcagcgcactttccgtcactcaaaggcaccactgatcaattaacattttgtgatttttcaaaaatgccacacaaatacctgtaaaaattctatacattcattatcccactgctgattgtgaactgtgatgaaacaattttatgatagatttttgattggcatttgtctttttaaaaatttgcttctttgacttggaactttctgtcattatccaccattagttcctaattatgtccaagaagcaataaattttttatgaatcaagctaattttgcataattaaaaagtcttggggcgcatgcgtctgtttgcctatgttttttcgatgggatttggttttataataccctttttttcctcggttttcatttaccataatttgcccatttttattaaaaggatgatcaattacatgctgctgttctcgcgccagggcaaactccgtctgcagaagtggtacgtcgcatatccggacaaggtgggcaacacacacagcgggagcagaccattgacagtggggtcgggagcggttaattgcttagatggctgctctcacattggattgactacttattgtttgtgatggcaaaattgcgctagcccgttgtgattaattatctgattgtttagtttaatttttgtcccggtttatttagagattaaacaagtggtgagcggcacggtaaaatttaccggccttttttgtgaccggtagatttaccgaccgactatctctgaaaaaccggttgtttttaccgttatgcatttgccgttcactattagctcttacaaaattgtttaaaaaagactgcattttcaggcaaaaaagaaaatcacccgcgagttggtaaccaccattttgtcacggaagcccaaaatgtgcgcattcctcgagtataaggacacgaaagttgtgtacaaacggtgtgccatattgaaaaccaatttaaaataaataatttaatttctcagttacgcttcgctttacttttgctgcgccattgagcagacggacaatgaggtgaatgaattgaaatttatgatgaattactaagatttttcaagaaaaaaatttccaaaaaaacgctgaaacattttttttcttgtaattttcttataaaaaacttaataagattttttcttgaaaaagtttctaagtttgtaattatcacttggttccatgcttattccgaagtttgtttttgaaattcgactcgatttttacggtaattttttccgaattcgccccgaacttcgttcagttgctttgtctggaggtcatccaccgttatgtggagctgttggaccgttattttggcagtgtgtgcgagttggacatcatcttcaacttcgagaaggcctacttcattttggacgagtttttgttggccggcgaaattcaggagaccagcaaaaagcaagtgctgaaggcgatcagtgcgcaggatttgctgcaggatgtgagtggtggtggggacggcactgatcactttgttggacgcaataaaaagccaaacaaataattgttgaaattgttgatcctatctcattattccacagcaaattgtaccacctttgttattctcctgatcatattttgattcataaattatatttcttcctgacaatgagcattcattcactgttgatcacttttaatcgacattgatcagtcctctactttttttaatgtgctttgatcagatttaatcttcttctcgccccttaattgattgtttatcctttcaagcataggtcagagtataatatttgctcgtcactttaacattttatgcgtcccggtagcattaagcattaacgctgcattttcccagcgcaaacattattaaggttttatcaccgtgggatggggaaattctcaatattccgaaattgtattcatcgctggtgctcaaatgaaccgg

SEQ ID NO: 18952 - DNA, 2539 bp, Heterodera glycines
  misc_feature (1308)..(1308): n is a, c, g, or t
  misc_feature (1338)..(1338): n is a, c, g, or t
ctggtgctgtttgccttaaatatgttaaaatcatgaggtgtttccatgtccatggttatattaaaaattttctcacgcacaaaatagcattaacaaattttttatcattttcacagtcgttttttattcttcggaattttgcgtgatcaaatttttttgtgagagtcagttaaaccttaacattttgattattgtctttattattaataacattcttcatcggatttaagctatctatagagcaccaattgatgtttttactttcagaattaccagaataaacgatttttattagcacgttatattcaattaaaagtttaatgccgaaattaattttctttttttttttggttcaatatacccactcattttttcatcattaatcatgttatctattttataatgaaaatattaaatattgttatatccttacttatcttttaatcctttaaattgaaaaaagattaaccccttgaatttaataaaagtatgctcttaaattttaaatcaaagatagcttctgaattaaaaaaaatatttttaaattttcctgagatctttgcatatatatgatagaatgaaatttttatctaagttcaaaatttttaattttttactctttgtctagcaagaatttgaagtgttttatgtagatttatttaattttttaatttctttatgcatttgattggaatccttctggcacttattattagtccatttccaataatcagtttatttatttgtgcaccttatccttttaaaatttttatattgttcattttattattgtagctttaatttttatatcttaacgataatgacccgtactgggacgaacgaagtccgaatagggcaagtaattaaatttaatttaaaaaaatatttaaataataaattaatgattttaattaatcaataggaatggttatttccaaaaaaatgattcacgtaaatacgtgaacttaatttttttttcttgataaaaatttttggtttaaaaatcgtccttattcaaaaaaaactaaaattttaataatttcatttaaaaatgaaatactataaacaaaattaataagtttttatgtgttttactatctaaaaagcaataataaaaaaatatttttttatttgcctatttttgtgcctattaatgctattttgcgggtttttgtgcctaaaattcccatctctctatttataactcggctcctactgaaccgattgggacgcattcgaatcatctattagagaactcattgtagaaacaatatatctatatttttatacccaaaaatttttctttanttaagcaaaataacatactttttaaacctntttaaaccctgggggaacagaattcttccaaaaaatgccgaaataagtcaactgagattttgatgaaggtattttttgataccaagatcgttaagatttgacaaagctacggaataaaatgggggtgtcgtaaacatatgacaatgattgtacattaaaacacatttaagtataaaaaatagcttcatttaaaaataaatttctaggttaaaaagctaaaagtgtattcaaatgttttaaaattataaaattaacattttataaaataataaaaaaaatttaattaaatttaattacttgccctattcggacttcgtcctagcaccataatgaccataatatatttattatttttttgaaaggacatgccccattttagaaattcctacattcgatttgagccatccataggattttacatcaattaatcatattatctacctgataatgaaaatttcttattattttttaaagtaatgcttacactgaattcaacaccgatctgattactaaaatttggtagtttttagttgtttttttttgataaagcaaagttcattttttaaatttcttacttatatttctcagaaaatttaattaaataataaatatataaaatcaattcatatatgtttatgacagggatgaaattcgttttgttactacaaaaaattcaattttccctttcggcgacgtatttttcgagttctttgtgcttatttctaggttttatttttagcacctataaaactaaaaaaattaaaaaaaaactattttcaactattttgcgttttgcccaagatttttataataacaaaaatgcaaattatttgcggtttattttccttatgagaatacattcttttctcttattcaataaaaatgttttgtttataaattagttattttaattattaaataatttttttattgtttttaattaaataatttcagcaatattaaaactccatttttgaaactaattttatagcttccccttatgttatttttatgaattaatgttcttttcaatactcgagcaaacattttagagttaattgggttgcaaatttctttatgtttgttttcttaattttaattgagtaattaagaattcttttcccttccaataattacagctgaattgacaaactctgattacaattctaatttggagttttaattattattattaattttt

SEQ ID NO: 18953 - DNA, 4033 bp, Heterodera glycines
  misc_feature (2090)..(2090): n is a, c, g, or t
  misc_feature (2642)..(2642): n is a, c, g, or t
  misc_feature (2660)..(2660): n is a, c, g, or t
  misc_feature (2670)..(2670): n is a, c, g, or t
cctccccccccccctccgccccgctgtgatgtaccacccttctctgccacccaatgctgttgtggactttggagtgattgaagagctaaagttgctgatcagatcagcaccagtaagtggtaaaaggatgcccatcgaccgcacacagcggcagcagcagcggcggcccataacacaaaagtgcggcgactgttgctgcaattgttcacgtgaaaatcagcaagacattttgttatggctcgagaagatcggtgcgagaaagatgcgaaaacagcagcggacaaaagagtggggggggggggaggcgggaatcgcattgcaaaggtgatcaagaaagacgatgatcagcagggtgctggcggttgtccgttggctgatcggtgatgggatgggaaactgtaagaagaaagtgcagggagggggggattcataaaattaaaagtaaaatggttgggtgctctgcgcgcgcgcgggtgcgctccaaattgcgcgtctgtctcctcgatttgttttgtacgggtttcgcgccgcaggggtaccagcgccggaggcaagtcgtaattttggcgcattttgtcatgactaaatcacgtgcagcgaaactacaattttgaaaagatagaattaggacaagcaataattataattttaaatggtacaatgccataaccatcagcattggagtgtacatgaaaaggaaaaaaatcggaatttctgagaaaagcatcaggccgttgttacaaaatttatagcctaccgaaattaaagaaaactcaaaaaaactagctcattaaaaaaacgtcgcaatgaccgtaattaggcattcaatgaaaacaaatttaacggaacggaaaataatagggaaagaaaattttttattattccttgagatgaaacagattgtttttaccataggatttgataatgtattgggatttagacattgaagataaaaaagtaatgtcaatttaataaattaataattaaaatatatttttataaaatattaaaactaaaaaccgaaattaattattatacaaatttaaaaaaaaaagaaaaaacgaaaattcagcaaaaatttagtgtaaattccagcagacggaccaattttgcatttgtttatttaactaatattttcgattgataaacaattcacaaaatgagtgttctatttttgtaggaataaacaaaagcaaaaaattatcgaaaatattctaagactttttttacaaagaaatttaaatatccagtcaatttgattttcacatttttaacattaaaaaatcatattttgtttagtgaagatattattccaaaattgtttgaattctccttttcattttaatccaccaattttgtatcacttaaatacgaattactggttctctcattaaaaaaagaaagaaaaaaaataaaatttaaaagagaattaattaatgttcatatttaaaatctcgactaaaattggacagcaaaaaataataaattaaattataaaaaacagcaaaattagttttttgcggtaaccgagtttcagcctcacaaatcaaaacaaaataaaacaaactttcttttgctcctttggattattaaattcttttcctttttttttgtccacaggtttcaaaccaaaaacaaacactttattactatttttgattaattaaccaattaattactcccgatcctcccataatttgctgctgctaatgacactggccactcccctcaaattagtccaaaattacaaattacacacacaatttcctgccgcccatttcgaccacttttgaagtgcacccaaatgggttccttctcccccccccgcacattccctcgggggatcgttcgtcagcaatattttgccaccacttcacccctcccccccccaccactggcgaagtgttcaaaacgccacagttggaccaaaatttggaggaataaaacagcaaaaaaaagaaaaaaattactaccgacaaaatcaagcacacaaattgggccaacagaagaaaaaaatttgtttgttaacttggctgaacaccaaacaaaactttacgattttataattggaaaacgggcaaaaaaactanaaattttgtacaattaaatatacaatcactaaataagataaaaattggcctaatttattaacaagcttggtcaaatgatagtctaaaaaatgaacgattatttgtgtattgcacttaaaaacaaagatcgaaaccagggatttgcaatataccaattaccaagattaaactttaaaattaggtaatttttaatttaccattagcctagctattcaggaaaaaaatatgttatgctgagcacaagtgaaacaaaatgtcaaaatcagcgaggagcaaatgctaagatttcatttctgtttaggggaatgattcatttgaataaaaacggagaatgtaaaagctaattttggagacaaattgtataaagtgaatgaatggttgttcaattaacgggcattttaatttaacaaaaaaaaagaatgtcaaaatttatgtacattatttttttcaataaatttcttattaaaaataagttttaaatataaactttcttttaaagaacaaaaaaacctaccttattacattttgagaatacacaaatttatttattanagctatttgcaaaactanatgataattnttaaaatcaaaaaataaattatttaaataaacatcttttaatccgaaacttaattatattttgtaaatttttttttaaataatgagataaataaatgtgtttgggatttagattctaaattctctctcaaaagattttccatttaattgttttagtgaatgaaaaacttatttaaaatcgaatttttgtaagagtttttttctctttaattttgatataaaattttctcaactaattaacataaacttatttctaaaattaaatgataatttttaaaaattcctaaaaattctctctctttctctgctgatgacgataatagctagaattgatgaatgctaataatgcattagcagtccctcggcggacccctcatcccctcgtcgtttccttccatcatcattagttagttttactgcctttcgcttgcgttgggtgtgggcgatctcgtcaatggcggtacattccacaacaatcctatgaataattggtgagtgcgtctgtttggcctttgtaaagattgaattagcgggatttttttcgagtaaaaaatgaaaaaataaattgaagtaataaacaaatatgaagagacacgttggaaaagagatagggagagaaagagagatagacatagagagagagtgtaaaagagtgagggtgaagagtgagagtgagagaaggagagagagatatggagagaatagctgagaaagagagagacagagagagcgagtacaaaagagagtcctgctgggggtgtgaatgatagatgatgagatagatagacttcgtcaacaccaagaaggagaagagaaagaaacataaatactcatttttttgttttaaaatttgactagcgcgagcgaagcgagccctagtaataatgataattaaataaagaatgataattatcctgctgctaatgtccgatccaactaagccgccgattgatctgatcgcaccgccgtatcggcggcgagtcgacccaaatcatttgttatgatactttgagtggtgatggattaatagagattaatcatacgtcatcatagcgggatatcatttggaaaatgattattttatttttcaaatgatatgatcagctgttaagggcatttagcagcgaatcgctcaatgtgaaaattcttcgaaaaatttttaattttttgttgggtgatttaaaataaatggacctaattgatctctgcgtttttgtttttaggaaaaataaataaaatatggacttggagcggatttaattgggaatagaaaaattttaataatggattattaaagggatttataaattgtaaaatgacgacacatgaaatattattattattataatgaggcaagcacaaaa

SEQ ID NO: 18954 - DNA, 2764 bp, Heterodera glycines
tggagatgcataaaaatcagacaaacacaaaaatacaggactgatttatttgggtacaaaattgaagaaactcctgatcaaattcttttaccaaccactttgaaagactgtcatcaaatggcaatttacaaaaaatgtgaatttggtgttttgtcaggagaaattggccaaatacacacaaacaaaaaactaatcattgaacaatcgtggtggaaaattgggttccaaaaaaccgagtccgaaaattgttttttgtcaaaaatcagtttgtttggaaccccagggtcagagataatacattcaccagtagatgacacaaagaattgtaagtactcagatggacaatgccagttagaaaatggtgtttatcttttatgggaaattaagaaaaacattaaaaatctttttgatgaaaaaacttgtgtttataaaaaggaaacaaaaatcaatggcacttatgtcccaggtatttggatgtcaaatgataacaatcgggctttggtttttgatcaaaattcaaaaagggtagagtcatgtggtgaaaaattgcgtgttagtgcgcaaggatttgcaataattgaggaacaatttaaggaattgatgaaaaatgagcaaaattcgttagacaaaaacacgagaaacgggataaaaagattcaaacgttggaatactgctttctcaagtgaaatagagaatgctcccttggacggagaagttcgagcaagccaattggcaatgcaattacaagccggtgctttttatcaaaacaaggaaattaagaattcttttcataaattaattgaaatggtttgtaaaacattggatgataatattttcaatgggtattctcatttaaacccttccttgtttataagacaaaaaactggtcaagcttttttagaagggcgttggatttccgatgaaattttagaattttggggttgttctgcaattaatttctcctttgtcccgtcgttagatggaaaatgttatgaatttattccattaaatttttctttagaccataccgaaaaacttttgataggatttttggatccaatgacaatgattgttaaagaaaatagtgaaatccaaacatgcaatgagggacaattcaaaacccttttactgaacaataagctcataaaaataaaccaattaactggcaaatatacttttattggagaaccaactatttataaaatcgatcaaaaaatatggggtgaggaaaatttacctatttttcctttacaaattttcaaacaattaattttaacaaatttaacgaacaaacaaattgacatgctggaaatgcttcatgcattccgtactagccgaattattgacaatagaccaaatgaagaccgaaaaatttttgaattcaaaccaatttcaagcatttacctttcaaaatttaattactgaaattgattggtggaaatatgtaattcgatcagtcgttttagtcattataattaattgggtctacaaaatttataaatggaaacaaaaaatcatgatcagaaaagaaattgaaaagaggaatagtcaaaactttcagcaacaaactggtgccattcaaattccactggccgctctgaaacaacgtttcgttgggggagtgtcggcgcccacgaccgacgcagccgagatgccagagaatgccgagaatgccgaaagaattaaatgccaaaaacagaagagacggaggaaataattttgaacaaatttgcatttaattatttattaatttaaatttcattctccattttattattatcatccatatctttcagcctttgcctttgcgatcactttattcatttatggtaaagtcgttggagacaagaagaaaaagagcgatagggaatttcacagagtttaacaaaaggcggaaaatgtccgtgagcgaaaaaagggggaaagatgaaaaaaaaatccgttattcattcgcttaactttttaaaaaatctgttcaacgttcttgctctccgatttaaaaaatattatttgtcaatttcgtatttacgccgtaataaatacttgtcaccgggacattttttttgaaggttacggtaggggaaaatttggtgctaaaatttgtttcaccgggaaacgggagattggtccaccagggactttttgaaaacaacatctgtaaaatcaaggggcccaccaggaattaagaagtgattggcaaactctaatttgttccaccaaacaaaggctgattgattgattgattgattttattttgccttttttcaattaaatctttcaatttaaatatttaaaaatatatttatacttcagctttttttgcaattttttatttttactaaagaattcatttctgattaacctagtttgcttattatcagctaataaatgagatgttgttttgttggtcctctcgacgcatgcaataattgttgtaaataaatttccattcccaagaaaaatgccaataaatcctactaatgttattcgtttactgcaagagcattatcttaataaagctccaccaccgaccccattgacagccgaggaaaagctattggccgaagattttttgaaaactttggaatttggtgcaaaacaaggggttgaactcgagatttcggatgagcttgtctttgatgagttttcaacagttcatcaaagggaagatttgcacattcagacgaagaatttgacattgaccttgaatgtaaagctgaaagtgatgacagtggcgaacttttctcatcgccagcaagtacag

SEQ ID NO: 18955 - DNA, 3005 bp, Heterodera glycines
  misc_feature (61)..(61): n is a, c, g, or t
  misc_feature (91)..(91): n is a, c, g, or t
agtcaaaatgaatttatttattcgatagtactaacatttaactatttatggttaaaatttnaaaaaatttaattgagtattaaaaaagttntggtaaaataatttgattcttaaattattgaaaattttggagtataatttttttataatttaatataaaaattttataaattaatattgtaatagaaaagatttaaagttattgtataatagtatgaaatataaatttggtttaaattgggttaagatatgaatttatatgttttatatttttttgtttttatagtagttggaggatttaggaaaagtatatggtggaggtttttaggaaagtgataagtatgttaaattttaaatattattgatgaatctgtttttttcagaatttatctacggaccagtgccagttttggaggtggatggaaaacaattggcacaaccagcagccattatgcaatatttggccgaaaaattcggtgggtttaataccatttagcgggataaatgtaaaaaaaaaaattatcaactacacattcattcatccatagaaaatatttgtaaaatgttttctcaaaatcccattgatcaagctttatttatatctttagctgattctcactatttatgtaatcatgtctgggagttagaagtcataatatcatttttccactttaaaatcacattttgatttttatttttgcatttattttattattgttgaagaattggccggtcaaaacgcgtgggaaacggctaaagcattggagatcacgtgttatgtgaatgacatcatcactgagttggtaccctatcttggcgcaacgatcggcttccttcccggggacgaggtaaaaaaaatggaaaatctaatctgatcatgatcatagtacaatgatcttttgattgagattagtgattatcagcaaatagaattgcttattgtttttttggttatatggctaatcaatccaacgaatgaatgagagaatgaggccatgttccttttttgcaaagcagatttagtccgatttttttccatcaattaactaaaaagaattgacaaaaaaataaaataataaataaattgcagtcattaccgaattaaattaatataagaattcttttatcactaattgtatttttgaatgtgtttaatctgctctaatagcactgaacattgaatttatcagtccggtgattaaacagtgattgttcatttttcttttctacatgctgaatatttcacaataaagtacaaaaagatttgaatttgggtattagttgtcctaattactctcctaatagcttgtattgctctaatttgttcattttaaccaacattttccactttaggccgcccttcgttcggatgttttcctccggtgcgtgaaaaaagcatttcctcttctgatcgctcagcttgatcaatcaaagtccggcttcatgcttccgtccggcttgtcctatgccgattttgtggtcagttgcgccttcgaaatgctgtgccaactcgacgcggctgccgactttttgccgaatgagtacccgtcgttggccaaactgacggaacgggtcaaagcacttccccaactccaaaaatacttcagcactggcaagaatcagaagcacaaaatgtgaccatagagaaggattgattgatagtcttgtcaattggacgaaaaatcattgtgaaatttgtcactaaatttgttaattaaatacgctttttgtgcggttattttgtacagatttttcatgccgcttcctcacccctcccaataaattcattcattcacagtccatcaaagttatggcgaatgaatggacaaaaaatgtcttcgtgtcgcaagaaaactctgatcactctgttcttttgcttccatttttcttacataaattgatggatgtccttctcatcgccaaccatcgctactcaccgatttttgcggggcgtttctctcccataaatttttgctctttgggaaatgaccatccttttattgtacaatttgtttaagtttactaaattttatggaaattagtcccttttaattggcactaaaaaacggcacgaaaaaggcaaaaaacttttttaaaaagacaaaaaaaaatttcattcgtagttttaagacatacgattatcgggtaaaaatatttttgtaaacagaaaatagtcgatggacatcgcaagaaatgaggggggcatttttgtaatcaaaaataagcacattttttaacgcgccataaagttaaattttttaaaactctcaactttttaatttaaaacttactttgtttttagctgcatcacttctctttttctttttctctttttgctgttctgttgtctcaatgttcaaatttggcacgcgctttttcgcttggcaatccgcttatccaaaacgggaggtttttgttgtgtttggagcagatgcttaatttttacgtcatctcacagcacaacaccttcacaaatctgctggaatgttctggcaaaaagaaatgtttaaacaatcacaagaacaccaatacgatttatcgaaaagcgacttttcaattatttaatcagtcgtaaatttaaattcacaattttaatatggaagtaaaaattgttttaaaattaattcttctcggtctaaggcacgggaatttaaaatctcggacatcactagcaagcaacccaaatggcgatttgctgacttttttgcaaatatttgcacaattttcataatttgttctatttccatttctcccaatttttcctattttgaatattcataagttaaattgtcaacaatttccttaaaaaacaaaagttttaaaaattatacaatttttggctaaagctactataaaaaattttcacaaaattttctaacattgcccgcgtgccaaacatatgcccctcttttttctgctttgtgcattgacagtgatttcgatcctgaattttctaaaatatatatcaatgattttctctgatttaattgcttaaaaattcccaa

SEQ ID NO: 18956 - DNA, 1070 bp, Heterodera glycines
ccctagcaatcaaattcagcaaaaaacgccaacccccccggtttttgtcgacaatttctcgcaaacttttcgcagcatgacccctctttttcatgtgttgatgccattgtatttattgcacctgttgccattgattgtgagcaaatggacgtgccgcagacggtgagccgtgacggcgatgaattctgcggctggtggttatgtagttgaacatgatggtcatcaacggcagcggaggaagacgacgacggcgcaggtgccgaggagttcagcagcgcgttgccaatgccatccgcgcgggcctccagacgcatgatcaaattggcggtgtacaaatagtaggagaaggtctgttagggagtggatttttttcaattttttaagaaattttggcagaattttgtccaaaatatacattttagggcgtctaataattatttttgcacatttctttaaaaaaattggcataacttttgacttctcacacttttcttgacacaatttagggcgccaaattattaaaaaccgagtagtgccaaaatcagaaaaaaacctgtaaaatacaacagacctgcatgtacgcgtcgtaggccttggccaactcggtctccgcactgtcacagcactggcgccggtcatcgtccgccgcaatgccaaactcggacacatgcacaatggtacacgtggtcagcaaatctgaaaattaattcaaaatttcaaaaacgatgaaattttgcggtgaatttcgcagaaaaatttctgggttttcgccattcttgaaaacgggggatttgaaatttttgtttttcaggttcggctttggttcgttaaattcgaacgaatatcattggtgcctgagaatttgtagcgtctcgaattcgttttagagtttcaaattccgtaaatgccccactcgctcaccccgaatttgtcgctcggtgccctccatggtctgccagctcatctccgactcggcccgcagcgtggccaaccgtttccgaattttggtggtgccgttgcctgaactcgtccgccaacgaaccctcggccaccgaaatttgtgcgacatg

SEQ ID NO: 18957 - DNA, 1844 bp, Heterodera glycines
  misc_feature (41)..(41): n is a, c, g, or t
  misc_feature (48)..(48): n is a, c, g, or t
  misc_feature (1737)..(1737): n is a, c, g, or t
  misc_feature (1782)..(1782): n is a, c, g, or t
  misc_feature (1801)..(1801): n is a, c, g, or t
  misc_feature (1834)..(1834): n is a, c, g, or t
taagaaaaggggtctgcttttctcggtaaaaatgaaatgcnaaatccnaatcattgagcagccccccccccccctcgggactttgggactcatttcaaaaaacacatacaaaaatttatgtcatcaaaaatagactaaagattctaatgaagatctcttaattgtaagacaagtgcagcaacaaatattgatttcccagttaaattgccgaaaaaacggtcaagaattccaaaaaaaatttttctcgcatattggaatttgtctatccccattaattgatggaatcaccatcgtaccgttcatctccacttggcacgccgacttgcgtgccgtgatcatgttctgcaacagcaaactcagccaccagtccatgccaaggtcagtgcactgaaaatgagaaaaaatttttaaaaattcccaaaaaaaaattgtacgtcgattaagtcggaaatgtcgtccgcaaaaaatttgtgcaacgaagcatttgccgcatcgatgcacagcaaatattcgttgcgcgcccgcgtgcatttgagccgtgccgacgcgtatttctcgcttttctatttaaaaaaaattatataaaaatggaatttttaaacaccgaaactccctattttctcatgctttttatttaaatcagcattgttctacctaaattctaaatctttctggttttatttgctagaatacaaaacaaaacggcataaaaattgcggggtttcatttgccgcttctaaaattcagcgccaaattttttttttgtaaaaaaaccacccgaaaaatcaggaccacaaagaaaacaactctaaaacttataaaaataatggataatcacggaaaataaaacgaaaattcgtggtttcccatttcctccccgccccctcactttgtcgtatgttttttgtgccgatcgttgcttgcgcgtcgagctgttcggccccactttgttccgttgcgcctccgcctgctgcagctgtccgccgagtgcgttgaattggcaaaaacaatgctacaaaaaaacggcaaataattttttagaggatggttttctaaattctttcccatttttgatgaaaattttaagggattttacaatatttatctttttgtggaggaattgaaaaaaaatacatgaaaaagcgggaccaaatattatgccatttagtctcgagtaaatgccaacatatatttttggcgacttttgggcaaactaatcaaaattgcggtccgctttgaaattaatttgtgcaattttgaaaattgctcgtccacctggtaggttttcatcgcggtgtgcagctcatgcagcacacggaccacctcactttgggccaacacgccaatctcacgacactgaaatatttgccaacactgttttctaattttcatcgattaaagtattcaaaattttcatccctcgccctccccgcctccggtggccacctttttggcaattttttgcagtgccattgtccgctgcgcaattgccgggcacacataattggcacacacgtcggcaccgatgctccgctggcgcgcctcctccttggcatcgtcgaccaactgttgccacagttggcacgtggaatggagggcccaattggcacgtcttaaaaataacaaaatttattcgcaaatttttaaaaaaacgataaattgtaagacaaatggacaaattccgggtttattgtacgttttatatggttttattttattttaaaaatttccaattanagaggcatgaaaaaaatggacgccgtcaaaatttttggcgaattntttcgcgaggacaaatttntctgtcaaagtatatggatatgtgccatagtangtaatagatg

SEQ ID NO: 18958 - DNA, 1331 bp, Heterodera glycines
tttataacattggtttgcttggtatttgtacaaatatttattttgaatttttgctattaattatcccatgtgcgccatatttttatgattactggaaaataaaaattggttttgatttttttataaatgtatatatttttctttccatagtctgggtaccgaaggatttcccgcattcttttttctaacaaaattgatttttattattttatttaaattaccaaacatattaaattttttattcaaaagtactttgttataaaaataaaattaaaaaaagtttatatggaaaataaaaaaatctttatgatattgtagaagtaattataacaaaaacgatatgaaatgtaaaataaacaaaattttaaaatcttttggccgtttaatagaatttattcctgttaagaataaatgttattgaatttatcaatttttaaagttatttattatttagcataagctaatggttgaaaataaaattgaactaggtttactccttgaaaatcggaataattgtcgattcggggcatttggtgctaagaaaatttttaagcctgaatcatacatatgcaacctagatgaaaataataaataatggaaaaatgactatttatcaatctggcatcaatcgtattcagatcaaaaaaatgaattggttggaattgttcgttgtatttgctttccttgtgcaacaaagttcgggcactatttaaattatgcatatttaacctccatatgaattttttttgtctcattaattttaaatgaatatttattttatttggcaatatataagcttcagtatttattttctttaatcattgatcattatttcttaggaatttttcaaatttttggaaaaatgtaaatcagtagtgtgaattttgttttttgtttatacaaaaccaaaaacagcaaaatttaattaataaaaaattgttgtaatgcaaaaaaggttgtttatatatcaacttttaattaattactaatttattgcaaaaaaatggggtgagatgtggaacattgggctcagtgtggactgctcgaaaaagctgaaaaagtttgccgccgtgggccaaattcaattcatttcagagggctattgataaagtaattgtgcaagagtaataatgaagtggagatggaatttatgacttttaaaaattcattaaagaattgtaaaaatttaatttttttttgtttaactttgtttgtcttttttttgtaaattttatttttagaaattaaaaatgggtataaattttaattaaaatttataaattatgaatttacttagaaaaaatatggacggaaccaaaaaaattaaaaat

SEQ ID NO: 18959 - DNA, 2339 bp, Heterodera glycines
taattaaaatttataaattatgaatttacttagaaaaatctttgacgtacaaaaaagattaaaaatgtttgggttttaatcgaaccaaattttgcccattaatagtatcataatttaattgggtaggtaaaaagtaaaatgattttttacagtaaataaattcaatttttttttgttaaagtaaaacgttttaaaaaatttcttttgcactgtttttttgacttaaaaatttatcatttaattaaaaatgcattaaattttattgaacccggaatcaatattatatggcaaattggaagggggttctcatcgccgctttttccattcgcattttgctgctgcaaaattttatttgtgatgcagcaacagagaaatgggtggtgaatcacaatgaaaaagggtcggtgcgaggcagaggagagggaggactgaaaataacaatttttgttttttgcatttaaaaaagttcgttttatttagatgttcaaaaatggaaaaaattttttgcgcaatttgcacactttaaaagaacggaatctaacagacaacattttaataaataatacaaatttaagtcaaatggacaaattttgtgttaactgtagcaattaagccagaaatatggaccttttaaattgataaattaatgaaatgccaagaattgtccataaaaattgctaaaattatttttaagcaaatatttgagtccttttgagtagataaaaaatgggatgggataagtgtccaacgaaacgggaaaaatttgttgctgttaaatattgaaaattcgcatttttaaccaattcaataatgaatggctaatttattgttatttcgtcgtggtcatcgccttttttttgtcgaaaaaaataactggggagcagtaaaaggcgatggaaatgaatttttgtggtggttgcgaaggaagaagagacgaaagagggaggggagtgggggacggataactgcattatttttgcttttattaaaatatgttgaacataatttaatgaaaaattaaataaatttttaattattataatggaatttttatgaataactgtttttgtgtgattgtttttgttattaaatatagtgcaaatattattttcttacacgtaaaattaatgaagtctaacatgtaccaaatatagcaaaatgttaaaaagcttttaaatcagttataacgaatgcgttttattagtcttttaaaaggcaatttttaaatgcttacgcaaaattaaaattaaaatttgaaaggtctggtgaattaatctgtgttttgcaaaagattttttttggtactctttgcagtcggagttgaaaggaattggccttgtgttttactgatttcaattcattgagaaaaattttgcatgcaagttttgaagagtttgaataaacaatatgaaaaagttatatggcagaggattattagcataaaaataggtgttaataattaaaaaattgctattttcatcgttaatacaaaaaaaagctgctgggcaaaaatagaaaagaggagtggctcttaagatgtaaaataaatgacattgtatcagagatttgtaaaatttattaaaaatatgagaatattgtatagaccaaaagtgccgattaattcgtatattaatcaaaaaaacttgctttcagaaaatattttaaaagttttaaacaaaaatatttaataaaaagaatatatttttaaatgcaaaaaagtaataataattaatttttatacacaaatataaagttttttttaaatttcttttcaaaatttgttgccaaagaaatttattcaaattcttatatggagtggaataataaaatgtcagctttcactcacggcaacatttgtcattttgctcatcgtatttgccattcgacattgccgcacgcagtcttcctttttgcaaaaattttgaatgtatttgtgatcaaaccaattttttgcaaaataattgaaaattttaattatagattataaaattaaaaatggttttgagtgatttgtcgaatgccgtcaacaatgggggaacactgagtttgcaagaactgcggcggcgccgtaggacggccattgtggttctggcgcccgacttggcggcccgacagcgacagttatggcgagaacgccaccgcagctcgaatgcaatcgaacagcaagatgttattgaattggattagaagatgacggcggaaaaagggcaatttggatgcttttttgttaattttttgttcgaatttctggtaattaatttgcttgaatctttataataaaaagtttaaatttttattttttttgtaaaattaaaattcatttaattatttgcaatttt

SEQ ID NO: 18960 - DNA, 2811 bp, Heterodera glycines
ctgcttgatgtgttctaatatactctaaccgatcccattctatttttgccgcttagtctactacccactgttgaaaaagcttttttgcatgaaagtgaggcataaattttccattttctttaataaataataaaaattttgtataatcgcaaagtgaaattttttttccatttaagtcctttacttcataattaaatccttcatttgaaactgggtaaagtaatggataacacattggttcaacgcatttatccaaaggatatatttcctttaattttttttcaccctttgggtaaacaactattttagctggtgggatatcgtcattcgcatcacaaaccattattgcacatacttcattaatatgcggtaaattgtatctcctttgatcacaattttccttaagactaaaaagcaattttatctgaggtattttatttccttcattttgacatttttctttttcctgctcataaacagttttcattaatttatatgattgcgcaaatttgttattttttctaataaatgcatcaatatacttcatgatatttacattgcatccctcattcatgccacaccgaatgtcggttgcttcatcagaatcaataaaatacagctgcccgtttgttgggatttcgtgttcactgagagggattgcatttgaattaaatctatgataaatttggccttgtattttataacatggaggcccaggcgtaggaaatttaaatttaaaacaacttattgaagcacatgcaaaagcactattgtagcgacgaatgtttgttataaaatttttataataaggatgttcagtatcgaaaagaattttcaattcttcaggatattgctcaattttttcatctaaatttaaaagtttgccgcccttacaacaattagcaaagctattttcatcattttgattttgtcttaatgattcttccggaaaatgtaaagaactacactttgaacaaaatattttaaatggtcctaactcataaaaaattgcttttttgggctttgcagcaataccgtataattgatcataatccattttactccgctttcttgatatttcaacgttttgactatgtgattctcttgcatattctaactcttcattaatcatatgtattttttttaatgtataactaattctatttgcttttctttcgctctcaacttcttcttcagtaagttgagctcttttttgactaattctttttctatttgcttctcgttcttcttcaattctgttttctgtaatactcatcattttcctttgttttaattttctttccgccatataagatttactcagaatattggtgttataagaaatatcaataaaatcatctatctcatcaagatttattaacatatcactgtcattttttttagttctcttgaaaaatgtttcattccgcttttgattaccggagctttgaaccggttctatcaccacttttccgcttttttcgggagcttttaacccgtcattacattggagagcagaagaagagcaaggaatgtcagaaagaaatttttgtttattacgtaccattttatctaaaaaaatattttttaaaaaaccgagcttagaaaataggtaaaaagttaaaaaaagtgaataaaaatgtaataagaaaaataaagaatggggggagggtaaacaaaacaataaaaaataatcgcaattaaaaaatgactgatcgattttttcacgacttgctgttatggatttttaactcaaaaaaaattgtcgactcacaaagatatggtaaacaaaaccctacacatttggttctactgcaatttacatgcccaccatatttttcgtattaattttcgtttataaaaactataaccaaatttacaattggtcgtccaattaacataaaatttttagttcttaatgaataaaaaattattaaaaaggtgttaaccgtaataatcacacacaaaaacgtttttaattaatcgcgcaaattgtggttgaacgtcgtaaaaattgattggagactaaaactgtagcagaactgcaaatgaatcctaataaatgagaaaggatttttaaatgggagtaaaaattttaaaaaatagaattaattacttttataattgttttcgatcaattggaaatcattacaatacttgaaaaaatcaaaccggtaataaaaaaaaacactccattccaaaaaaaattcggcagcaagtccagtgaactaaccatgaaataaattacttcagagattttatcatttaagtgatttttgttaaaatgatactaaatcgacaaaagcttttgattgatcgcgaaaattatgattggtcacctaaaagttgattgaaaaaactgcaggagaaacgcaaccccaccctaatgtaaaatcaattaatgagaaaaggctttttacaaagaggggattagagtttaaaaatctttttagggtacacaaataattttttttaattattgtacacattcgaaaaaccattaaaaataactattaaaatcattttgttaaaggaaacggaatcaaaaaacctaaaaatttgagttgatttctttatttttatcattcagaataatggaataataattcaataataataagaaagagaaatcgaatttacgacactttgatttcgtaaatgttatcgactttagttatttggtcacaactcataacaacaataattctcttttccccctttcatctctctttgtttttgcaaaggcattcgcttcgaaaaattgtccattcaaagtgtgacatacatagtcacacatcaaattagtatagt

SEQ ID NO: 18961 - DNA, 1541 bp, Heterodera glycines
cattcactagggatggaattcgagtcccccaaattttttttggaaaatcgtaatttctatgccaaaaatttcagaaatcggaatcttttacatccttcggtaccaatattaaatgttaatgaattgtgggcattcattacccctggtgggaggggggggggatttaaaagtcaaacagaaaatttttgaaaatgtttcccaccttttgaaatttcaaaatttttatatttttgatatctttttgaaatttaattaaaattttattttcccttaatttttggtggataaatccgtggagatattcagctgctgcttctcttccggataaaattgtttatttttgcttctttttattaccacaaaatggagtgccaattccgcgcacagtatccaccgtggttggttacggtaatggaggaggagacgccacacagtgaaagggacgacgaaatagcgaaattcgagcaaatgggcggggacgaggcaggcagaagtggacacggcgaaggcaacctttgaaggtgctgagtcgttatataaaaaccatcaaatggaaattttcaaccaaaatctgtccataacttttgtcaaagtcaaccaaattaaaccttcttgatatcattcgatagccctaacatttctctattagctcacctaaatttcaaaaaatttggtcaagtttaagcaaagttatggccaaaagagtctaaggcaccgggttttcaaacttttttggccataacctttttgaaactgagcgaaattttttgaaattttgcaggttaatagaggacaaatagggctatcgaatgatagtaagatcactttattttgttcgttctaagaatgttttgatcagaatttttgataatcaaaataattttatttttaattaaaaaatttatgttagaaattatttttgtttttaattttcttgctattagtcgatagctctatgtgtcctctattagcctgcaaaatttcaaaaaacagttttttgttgaaatttttcatttgatggttttttatataacgcccattttgatgggttttattagagattgacattttgaaaaaaacctggacctggattccatgttggacctggaccttgatttcctggacaaaaatccaggaaaattcaggtccaggaaaaatccaggttgccgaaaagagggcgcagaaaattgatccaaaaaatcgaaaaaagaaaaaattagaaatttaatttattttgtagcgcctgccgaaaattctaaaataaattagaaattaatctgttcctcataatatcacactctgtttctgggctcgactctcaactcgagaaattctctggccttttcataaattattgagccaattagcgaataaaatttaaaattaaaattaaaaataatttgctccactttagtcacagtgtctgtttccattgtgtgccaaatgaacagggcacaaatggcataggccggcacgagggcataccctttgggaaaaaaatgatgggcaaaaatgccgaaaaaaataattcccaatcactt

SEQ ID NO: 18962 - DNA, 1622 bp, Heterodera glycines
  misc_feature (56)..(56): n is a, c, g, or t
  misc_feature (93)..(93): n is a, c, g, or t
gggggggggaaaatataattttgttttagaaaaacactgaaaatcaattaataatntaaaggaaaaataaagtttgtttatctgtagaaattntaaaagaatttcttgaatttttaacttaaattaaattttagaaatgattttaaatgtaaaataaaattatattattattatttaataattgttgtgcaaatttaattagtgcatttcattatttatgtaatttccaattcttgtaatatttttttgctagacaaaagtcaaaaatgataaacaaaatttgtttatcccaattaaacttatcaaatgacactataaaaacaattttgtcaaggcaagtaaatgtgcagggatggccgagtggtctaaggcgctagactcaagcgatgattggcttgcccgctatgctgggtcttctagtgggcgtatgcccgcgtgggttcgaatcccacttcctgcagtaactttttttccaattttaaataaaaatttttttttaggaatttaagagaattattaattattggatacattaattaattgcaatttttccttgcctaattcctcgctttttgccccgaaaatattctcggaacaaacaaaaaatgtaattggcaaaatgtggaaatgccgaagcagcagtaaatgcacaaaagtacaacacttgtggcacatggagcacaggctgaggggaacagttcaacaacaattaaagcattttgccaaataaaaaattaattggaaaaattaataaaattaatttggcatttaaaatgcgcttttttcaatttgcaaattcacccgatgcgcagaacggtcgccgagcaccacggaaccaccgtttaagaacagaaaaatgatgaaacaagcacacaaaagggcatggggccaaaggcgacgaatcttcgggaaaaataatttaaatacattttattgggatcgggatttcgattcaggaaacttttttttagaccgggattccgatgtttttttgtgggttccgggctctctatccgtggatatgtatgtttaccaagaaaatggcagtttgataaagcgacatttgcccttggaggaaagagcgtaaagaatgccaaacaatgggaaaagcggagaaaaacagccaaacaatgtttgtctgaagaataggtaataatcaaaactgaatttaaattaaatattcattcatccacctgccgcacaaaaagtgccaatgcaaacactgaaaacattgggaacggacggtcggagagggacagtgccaatgccaacaaagtcagagacaacaaatcggtgtaactttaatgggcgacaaattgggaacaaggagcgaaaatgcccaaattaagacaatgggttcgaaattgccagaaagtcgggattttgcacggaccaaagtgtcgagatttttggaacccaacagaaaattcatcaaattaaacgcattttgaacacacacaataataaagaagtgtccaggagaacgggcaaactgagcacagccaacgcggacacataagcatcagcatcaaaatgttgctgatcaccaaattgagacgttttctgatcataattttccatttttcaaaaaatttttgatttgcaattattatttatcgtat

SEQ ID NO: 18963 - DNA, 3132 bp, Heterodera glycines
cgctgctgctgctgctgctgatcacactacttaagattctgttgatgaacaacccgccatgcaaggcaattgtactgcttgacccggaaatgatcatgtgctgtcgcatgtgagtcgcgaacggttgacgaagcgatttaaacaaaaaaaaatttttacttaatttacaatagatttatttgaattcgaggttttgagcaggcgtgaaaaattgggagccaataattttagcataatggcagacaaattttcaaaaaatgccatccattgaatgtcttggaaaaagttggatgtgatacccgatcccaatttgtcatccattgacactgattttttttagtaaacttgatcagctacgtgccgtttttgttgctgcaagtcgcaattctgttcgtattttgttacatcagatgatcactgacaaattaatgtgcgttaaattaaattttatttacaattaatttatgactgccaaatttttccatttttatttcaattttcgataatttttggcgaagaatgtcagtaaatttgctgattccttaattattttacaaattgtttgtgttatgttgtcaactttattcttcagtgaagtgggcgtcaaggccaagccgtacatgacactgttggacgaatttgttgccgccggggcggtggagcgcatggagccgcaccagtgtgacaagagtgggctggtgttgcgcgaattgttggcctgctcaattgaaatggcggcacgcgagcggcggaaccatggcaacccgaaactgcgcgttctgttcttgtcaggtccttttttcttcctttatgatgcaattttgctggaaaagtcacgcctctcaccccgaaaatatcaacaaaaaacatagttttaatgggtgggataagttcgtgtttggattagacgtattgaagaccttttttggtaccagtttctttatttatcctattaaacaaatttatcggtctggtgctgcctattgacgctggtgccgaaaattttggacagagcgtttggatggggtgggtaccaatatgaaaaacccctaaatttaccattttttacattaacaattttggtgagaggggcacagacgctcataatggggggggggggggtgaaaaggtgaacccccgattttgttttaattaaaaaaaattccagcaatgattggccccaagtcggacgatgctaccaaattgggcaacagtcaaattgaattggtaaatgctggccaatttgtggagcaattcaaatgaagtgcccgggaaagaattttgaataggaaatagctcggcattacaccaaaaatattttccaataaacatattcgttttatttatttatttttgttcccccatttaatttgcgctcctttttgagacttgtggattttggggaaaatttcaccgaccactcaaatttatttttgccttcatttgtaggacttaaattgctaattaaaataattttaattccactttactataataaagcatagaccattttgactttagtaatgatgaaaagctttcaaaaattacataatttttccgctcggtttttattttttgcaaaaactccaaagtccatttgtctcactgatttaatagttaaaattgcgacatccttaatttatttgtttcacttttctgtttttgtttctttctttcttttaatattgttgtttccttcaacaaccatacatatttgattgaaaattcactttttccttttacacccgcttcatcatcatttgcttgctatactggttcaccacaacattcaattacaaatccaccttaatcctttttctttgtgtttgttttgatgaaaataaatgtttgctaaatagccaattttgctttttgacgaaaaaaaactactgcaaattcttccggcatacggttttataatgctttaagtaaaatagagaagggggggggcagacatagaaatagaagttgagagccagagaaagcgcagaaaaaatgtgccggatgagaattaatgtgtgcgcgaaaatggcattgggagaaaatattacatattcattattaattaaatacgctaatgaagggggaaaggggggggggggtagaaacagcacaattttaaaaagtgtaaatgaaaatgaaattgtttggctaatgtaaaaaataaaataaattgggcgaaatttggtccaattcagacagaattccgagattttcagctataaactttatgtatatggatgatcagaaaaaaatttgatcgggcaccaaatttcgcccgcagggcataatatttatgagcattttttagaagaaagtggggaaaggggaatcaattaatgatcagaggagaataattaaaacctgtctatcactgtgattactagagccctgacgggcttttaccgggcgacccggtcccggtcccgtttttttttttgaaaaaaaccgggcccggtaaaacgggctttttttgaacgggctgcccggtcccagtcaaatggctaagcccggtcccgggcccggtactttcaaaattccgggctctagtgattacgatttgctctgatcagcaaaaaaaaaacggtacaaaatgacaaaaataaacgaaaaattaaaaaaaaaatggggcaaaatagaattttgaagtgaacagcagaaaaattgtaattgagcacatggaagaaaacatttttcttctctcagcaggcacataaaagtagagaaatttgaaagatttttcggtttcatatttgttttttttaaatgttcgtttttggcgcccatgaaatttaaaaaaccgaaaatttttgcggattaattaccgtaggagacgggagaaagtatggtaattcgatcgtatcataagacattttggcattctctctctctctctgtctttgattcacaaggccaaaatcgcacaatttcgccttactttttttattccaccaaattctgttctcatggtctctgactttcgcgcctaaaaatttaattattccttttttgttttgtaattatttcgttttttcaatctatttttttttttttttgaaaaatattttgagtaagagatttaattttaataaaaaaaaaaataaatcttttcttaaaattctgataattaaa

SEQ ID NO: 18964 - DNA, 2766 bp, Heterodera glycines
ttttcaaaaaagttataaactaaaattcacagattcactaaaaataatgttttttgtgaattttactttataatttttttgagaaatgattaaccgcttagctattgctaactcatatgttgtaaacatgaagagctttgtaatgttaactaatttataaaaaatggttggctatgaaaaaagttatggctcttggcaacaaaaaggccgtttcccccacctctgctgatggttcttgccagggttagtgcacggttgcttgaaaacaccccccccccatctttttttggtttcgtattttaaggtgataatcgtttaactgaaaactgaaagcggtttttggccaaatgccaattaccgacattttcctaaatgaagcttcccactgaaataaatgaaataaatcccccctttgaggagggttaaaaaaatagatcccccgattttttgtcaagttaattccattcaataaaaatgaaattaagtcgataattgccagaaaataacccctagaattttgcaatccactccgaacatggttttggggtgaacgatacttatacatttaacgatatatattatatataacaagatactttcgtggttacgaagcctggtcttacgacataatatttagataacatctttacaaggacagaaaatcaagataaaaaattttgcaaaagatcattgcaagaaatcagtttgtttcattcaaataattgcgtgataatcctcttactgcgcgttcactttccgtccaattgcttttgtcccaccaaatgggcccctcttcaacagccaataacaacgtccagccgtttttggtgtaactgacaggcgaatgggcgttcaaaaatgcctacaaaagcgagaaacaaacagttaggtagtagagttaccgtatttcctctaattgaaggcccgggtcctttatttttaaaacctcttctatggggtcttcaaatggaggggcccattggagggagacacatatgtatagaaaatgcagaaacaaataataaagaatgaaaatgaagagaaagtgcagactaacgacgacatacctgtatgggccaaggatttgaccggatgccgaaaatgaaagtccggaatccggacattttttcaatcaaaaaatcaataacccttgaaatttctcaaaatttgttcagccgaaaaagcttaaatctcccctttttggcgcgtttttgagcagtttctgaaaaaagatttatgaattaattttgcaaaaattgaaaaagtgcgtaaaataggaatctcgaaaaatttcaaatgcaacaaaatggaaaggaaatttaaagctaatatctgcttcttctgagttgttaccctgcaaaatctgggatttttctgatcacttctcgtaaaactatgagtgattgaaatttcactaaaaagtttagcctaaacttttgcgcatatttaaaaaacaattaaaaaattttttaaatttttattcatctccctttttgatagaagaagcatcagagagccttatttatcttgtaaataaaatttggcgcgttttagagcagtttctgaaaaaatatttatgaaaatggatagcaaaaagtttaatctacatatctaatcccaaaaaagtgcggacaaacaattgacccgacggaaaagaaacaacaacaacaacaagcaaatggggtcaattagcattcatcattctttcgtccgccttcaattttcatggcttcaccattttgatcttggggccccacttgttacatagctttgcacccaaatacaccactcattatcaacctttcttggaccgttttctgaaaacatatattaggtattattattgtcatatgcatttgttctcatatgatgttttgtgtggagcctaagccaaagaaaaaggccctaaaaaacaaccaatcgcacaaataaagaaatcaatccaatgcttattaagcccattatttccgtaaatattaagtgttaccgctcgggtgatagttctggttatttccgcgtccgttcataaaagcaatcagtgccgcttgacaatcttccttggttttaccgcaaatatcttcgccattatacatagcagtagcgaataaaatttgtgagatgttgacgaaagcgatgattgtgaagaggattttcggcatggaattagtcatcaaaaattaaacaattgacgacaatttctattgctttttggttgaaaatctgttgaaattagaattgtataaaagaggcatacaaaaattgactaaaaattataactcttttcgttaaatgaatgaacataaaacactcttatatagaaatatctatttcttctaataaagtcccctgaaattctcctaaaaaaattccagaatccgttcccctccctgatggacaagtgctgttgcttggaggaattgggggggggggggggggtaaatatgtatattatttattttttatgatgcaaatggaatggaaagttatttgatttcgccgggtaaatgatgaatggtaaaaatggtagtgccacaatcagtttttatgcggccccctcatcaggcagaagaatgacgaaaatgaaattgagaaaggcacggacgcgcgcgaaaatgtatgtggacataaaatgcagggggaccgccagtgctcttgaacctccttatgccctgatcaattgctgatgcagtgaatccgcccatgccgatttgcgccataataacctacacgctgaattgcatctctaatatgtgatgtaccaaaccg

SEQ ID NO: 18965 - DNA, 1518 bp, Heterodera glycines
cgttgatgcaagcgacagatgaggtaaaggtgggatcgttaaaaattaggttgtctgaaagtgggcggaggacggcctttaaggaaaattggcggtgttggaaggtccatacgaagcaatggctgtggggggatttttggtggttgcgacgtgataagaatttgtggtgggatcattctcatcgcagcgacctaagacaaaaacaataatcattagagattaggcttacaatttcaaatatgtattaagcgagtggtctcctcaccctgttatcactcgttgtcctcctcttgattatgtccggtatgggcggtggcggcgtatttctgatgaattctaaatcgaccataattgggacttctcgcgatggtttcggttgctggctgtcgttgtcattcactttcttcacacagttcgtttgttgttgccttggcacggatgtgcccactgtgttgtttggcatttcgtcggtctttcttaaagctgtctctggagttggttcggtcaaattaagagaaagtagggggacgggtcttgtggtgtccattgttgacgttgttgcaaccattttctgatgaggaccaatacgttctccgacatttcccttccttgacgatgccttcgtaggcttcggaaatcgcaatggaaattgttttcctcggtttatttttgaacgtcttgagtgtcttttgaattgtcgaacaactgcaggaaagtgttcttgatcagtgatgaatgcataagtgttgaggttttcagaagaacgaattggatttggatggggagaagattggatattcggtggcgaaactttggccataatttgcgacggaggagacgacttgaagtgattttgattgagagatgaggactggagaagaaatgatgcattctcttctggaatttactaacttgttttgcttttttcataattaattcaccgtgcaacggaggaggagggggaggcggtggaacaatgaaagaagaagcctcacaatcagtgccatccaaaattggaggtggtgccggcggtggaggcagcagaccatttgagaaggaaagttcccccgaagaaacggccgactgactcgaaatttccatggcatccatttctaaattgtccgccgcccgttgctccgactgaacctttggcaatccttcagacccaaaggatttgttttcatcctttggtaggacaacgcttggaacgggactgaattgagtaatatgagtgccaatgagacaacaaacagcaaaacgacctccgtatcacattggtagttgaacattccttgtccgattctctctccttttttgttgcgacttttttaagcgatgcaagaaaagtggtcagtaaatcgtccatcttcaatttgtccaatttatggagttcatcgccaaaaaatgctcgtatcatttccaccgaaaagccagtaaccgagcagaaatttgtcaacatttcttttgatgcattttcttcggcagaggagacgatttcttttttgaagccttattatt

SEQ ID NO: 18966 - DNA, 1476 bp, Heterodera glycines
  misc_feature (36)..(36): n is a, c, g, or t
ggggactgggcttattcctgaccaatgatttctacncctccatttccattcttttaagtgtttataaaaattaccacaatatttcgattgggcagaatgcttcctgtcggtttcgcttccgcttcaggcgccgatgataggtttgttcctggtgagccgggcggagtcattggacctcgctttagggctgattgttcgggcgtttccgaactatttacttcaggtttcgtgccaacagcaacatcatcaatcgtcgcagcagaaggcattgccggaaaatccatgtcaaattcagttgggcttagcttaaaatcaaatggaaaaataaaatcactccaaatttctgtacttcataatcgggaatcgtacagttgtccaggtcaattttgatcctaattgtagaatacgactccactcgtcctttgagcattttatatgccaatattcgctgcatcaaatcgttcctttccaagaaggtgtggaccatgccgtgatcttggtcctgtcgcgctagctccattctgttcaaagagcggtaggaaccgggcatcggagttggcggcagttgtcggctcgaacacggcgcattgtcggcctcatcttcttcactctcaacttaataggaaagaaataaaacagtagagaaagcctaaaaccatggcattataatttacctttctttttcttgtttgccgtatcaaaagcttcgatttcgtccaaaatcgtatctaagggattgacgccgttaatcgtttgttgttcgattgtcgctggcttattgttaaattttctaaaataaaaaaattacttaaataaaaaatcggtagaaattgttacttttcttctgtctttgactggttttggaccattttttcaatttgtcctttgggcattagtttttgcttccgttcattcgtttgttccagttcatcggttgtattcgttttacgttttagaagagaagttggtttctgaggaaattgatttattgttattatttgaggttataaaaagacaaaaaccttttgacgtttcccgtcattttgcccctccgtgtccgtcttttttctcgctgtttcatttccgttctgttgttgcgtttctgccgtctccttttttgttttttgggttgtcacttgaatttgcttttgtgtgaagcttttccgacttatcattattggtaacaaaacataattaattataatttattaaatcagaatgagtgcttaaattaaaataccattaaaacaaaattcgtggtgagcaaatcgcggtaatagtgtgtacatcattggttccaaaatgtgcgaaaaaatttcgaacgccaaaaactttttattgcgcctcacacccacttgtaagagatggatagtggtgccgggaataaggtaatccttctgaattggtgtcccgacggaaaaaaataaaaaaaatttcttagtaaatcactttttctatgataaaaaaatgcgctaa

SEQ ID NO: 18967 - DNA, 1214 bp, Heterodera glycines
ttaatttcggcttttataaatgttgaaaccttgaaattgggtgaatttgtgctagggcgaacctaaaaaaatatcacaatattcatatttaaatttaattattatgacaatttatttcacaataataaaacataattttgctcaaactaatcaataaaataattttggtatttttgcgatagttgctcgtgccctctattatcttgaaaaaaatataagttaaaatttaaaaacttgttaatcaaaaactccgaaatacatatcaattatttgccctaacttttttgaaagtaaataaaaattaacagaataatagagaattcttcgagatatctattataagactttagagctattttataaaaaaaaataatttttaattcaattccttttaaaatacgcttttgtccatgtgttcagtgtgttcatttgtcagggtttccctgctgtcccggcagtcagcagctcgtttccctcatgtccggttacgtcgtctctttcgcttattccgtcgagaattacggccctcgagaattgtgcgaaattttgattgaagacgttgaggggatgaagcacgatttgcgagcaatggtcaattgcagcaaaggtggcggggaacgaattgtggacggaatcgatgccaaattggacagaaaaacagcaatagccgaaggtgaaaagatggcatttatcaccggcatcgatttggccatttgataaccaatattatggcttactttttttctcaattaatcacgatttaatatttttcgaatataaaataattttttaataacagattaagaattaatttaaaaaatattaaatataaatgatttttaaaatttttaaagaaaaaatcaaacaactaagaaattgataataaataaatattataatttacataatctggtccaagggtttcggtcccggatttcgaagcttagcgttccctaaagctaaagattatattcggcaaccttaaaattttacatgggccaaaatcttggacccgtcaatattcttagttattcttttttgtaatatttttgttttttatgacattatattttgtcgaaaatatttcaaaaatgacaatttctcaataaatttacttctggtcgggccattggaatccacggaaaatttttcaaattttccgaaaaatattaaaaacattaaatctgtttaattaaaaaaaaatattttatata

SEQ ID NO: 18968 - DNA, 1457 bp, Heterodera glycines
ctgcaaaagcgactggacatatcggaagcacaaaatgggacggagtcaccgacacttttgaagagcaaattcgcatcatcgataacctttgtcaagagctcaaaatcaccatcaataagaaggccatattcagagacccattcagaggtcaattgaattaaaagtgggccattttacgtggaaaaccaggcatttcccttttttaatccaattccgtattttgccggaattggatttttcgaagattttctatttttcactcaacgtgatatttttaaaaaaggaagaaatattcgtacaaattgttttaactttccatttactatactttcaatagctttttaaaagttgccgggtttttgactttggaaaggcagccctaattaattaattatattccaaatacttttacattttattcactcgaaaagaggactgaacagaagagactcaaagcctggtttaaggaatttgtgcccatgacgaggtaccaccgcctgaccaagtgatcaccaacccgggcaaaatcagtgcctaccgccaaaaggaggaggttggaccagcagaagaagcgaagggatgaacggattaacaggagatgatcattagagacaccatagtgccgcttatacagaacgataattctactaattgatacctatttttctaattgagcccccctcttctcccctgccccggtggttcattttgtgtggggctttacgtacataaagtgggtccccttaaaaatggggacactctccaactcacattatttaaattcataggtttttcctctttgttctttcaaattcttgaacctcaagtatgaaagaacaatatttgctttacagcaaacaaacactttaaaacattctttgaaacttatttaaaatatttgaagatttaagcattccatcagttaaattcggcaaaatttaaatttaaacaatttattgtaattttaaaatgaacaatgtccgcaccaaaagtttagtggaacacgctgaagcaaaaggaatcgacacaaacacaatcattctggccataaagtaagttcaaaagcataattaatgctaattgatgacaataattaatagtgcttttcgtatattttgatctaaatcagggtttccatcgaaaatttttcaaaatcagaacatcaagtccaaaaaataagattttagggtcaaaaataagaacatttcgcaaaattgcttcaaatcagttatttttataatttattaaatcaaactgtattaaatattatattttcacctcttattattgattttaacaattttggggaggaaataagcaaagcgtatatttcagtgcattcgggatcaaaaaaatcagattttaacaatttttttgcggcgaattttccaaaaaacttttggtgaatgggcaagaggagagggggtccggcggtgccgattggcgccgccggaaaa

SEQ ID NO: 18969 - DNA, 2227 bp, Heterodera glycines
  misc_feature (15)..(16): n is a, c, g, or t
  misc_feature (42)..(42): n is a, c, g, or t
  misc_feature (70)..(70): n is a, c, g, or t
  misc_feature (2190)..(2190): n is a, c, g, or t
tacgagtttaatccnngaaattttggaaatgtatctcatttncgtaaatattctggaatttttagtgttntcgtaaatattttcgacgagttttttcgtaaatatttatttaaatatttttgaatttttcataaaaataaatccaccccctaattatgattgaaccgcaaatgcaaggcatctgcgcaactttggcttcgagggctccgaaaagaacaaatgcatgaggatttttatttttgcagctttgattttaatgtttcgttttgcgtcgatatgcataaatataaaaaaatattttagactcataaataaaatatttaccaaatttttttgcatttttatcaatattttggtaaatattttggcattttagggtttttttgtgaaatttcttatttaacaaaaatgcagtaaaaactaaaaacacacccctaaaaattgcgtaaaggtgttttcgacagtgattggtttcgacagtactttttaattaatgttctacataatttattgtacattgaattaatattattaatatacaatttacatatacaaaatttataattgaagtacgtaataaaaaataagtcttatatgaatatttttgtcaaaagatttaatgctttcacattttctatacatatgtcttatgatagattatagtcaaaattactacaattttcttaggtaaggttctcgaattgtgtgggaaaatctactaactaatgccgggtttgagtgccaagatgcaaatctgcaggctcttcaacagaatttgaaaatcgcaaacgctctttaatgtataagaaagagcctgtgcttatcattgtaattttgaaaacctaacgcgacttatatcatatagaacaattttttaaaaacaaattttattgtcgagatcaatcactgtcgaaaattaacagcccaagaattgaacttttggaaattttaaaaaatagataaaatttaaaaaatatttttaaaaaataaaaattagaaaaacaaaaaaaaagtcgcgtccaatcttaaaaataatttgtcgtaatcgtatgaactttatctcggcaacgcaagaaatgtaattaatttgcaatgcaaatgcaatattgaaatttttttgttcactttttggtttttatatttcaattagaagagattttcaatatttgttgctcaaactttctcatttttgtcaatattttttaatattttggcattttttttaaatatttatttaatatttcgggatttttttgtaaatataaattctcaccctaatgaatgagacatccgggaaaaatgctctgaaaattgcttctcttatatttgcggcggtcttttatttttacaattaattatttgagtaacgaaacaagcaaatgtcggctaatcaattcaaaaatatttaattttgggtacaataatggcctgcaccgattttgccaggatttgcctttccgtctgtccttcgaattcgtcgcatcttcgctgcccccccccccgtttttttgatgctttgtcatttgaattttgtttttcccccttccccctctcatcaaattcaaaatcccccctttcgctccaacttttgacatttgtcaacaaataataaatgtgtaaagaaatgggagggtccgtccgtccgtccgtttgctggcatttgctaaatgcacaaaatgggagaacgaacccatttcttaggcaatgcaaacattgttttgctgaatatgactgctgaaaagtcacttttttattcggtgatttttctttccataacttttcacttttattgacccctgaaaatttaatttaaactttttagctaggggttaggatatttttggagaaccaccatttaggggttggatcatccaaagattttttacaacaacaaaaaaaagatgtggaattgtcacactgaccaaaaaacagttgaggcgatttctttttcatttgatattcaaaaattatctgagaatgagtggataaaatgtctgccctcttttctgcctcccttatcttttttgtttggattatccgaatcatttaatcccttctctaataaaactctcttcaaaaatgccgccgcctcattaattatgcggagaattaattcccccatttttgcataaatcattaatcataataaatattgtcaactttttagttaggcatcaaattatgcctaanatttcagcacaaaattaatttaggaatttggcggggg

SEQ ID NO: 18970 - DNA, 2212 bp, Heterodera glycines
attactgaaatgccagccaaacccatctcttctgtggatcgcatgaaattgttgctgagttcgggggatggggcggacgtgcactttttggtgggccaaagggacccaaaagaggcgagtgccgtggaaattcaaagcattacaaaattgttttggcttttagcttttgtcggctcacaaactcattctgatggccgcttccgacgtgttcgaggcaatgttccgttttgactccgcaaatgccacgacttccacttcaaaacgtaataaaactgttggcctaaaaacattccctcaagattttggggaaaagtaaaaatctgagattttttggtattttacagttaattaaatgaaagtttcaattttcagcccctttggatttggccagcagcagcaaccctgtggtggtcagcgacgtcgacgccgatgtgttcagggcgatgttgggctttatttatgcggacgatttgagtgggatgaacggcgacaatttgttcgacgtgctttacgctggtaaaactttaaaattcattattttcttcgtttattttaatcacttttagccaaaaagtacaacatcgccggactggtcaaagcatgcgccgaatttcccatttctgagttgggcaatgtcttccacactttggacgaggcgcgacttttcggagagaaagtaacattttcaaggaatacgaattaaatgggaccgaactgctcgagagtgaatctcggcttcaaatcccggcacaatcctctacatatggaaaaactcgtttttaaaggcattcgccgaacactgcttggaatacattgaccaaaatgcggacactttgctcaaatcggaggaatttctgcgcattgatcagcaaatgttgtgcgacattttgaagagtgatcagctggtgatcagcagagaatttacgctttggaaagctgtaaaattggatttttaaaattgtttaattaattaaaatttgttttttcggcactccgttgggccgattggcaatgtgagcaaaaaggcatcgaatgttcgggagagaatcggcgggaaatgctcggcttggcactgttcgaaattcgcttcccacacatcacaaaggaggacttttcgaagagcattggtaatgccaattttatttattaaattttgtctaatttgggtaaaattaaaaaccaattaattctggcgtcacgcggaaaataaaaaattaaagaataatttataatttatttttaaatttcaacaaaacagtgccgtgcggtgtgctaaccgaccaagaagtgatcagcgttttgctgcaccattgcctttcgtacaacggcagcgacgatacgcccgcggagttggagcagtatccgttgcgattccccgacgaagctcgcggttcgcttcagcaaatctgtgcgcattagggaaattttttggcgaattacgatggaccggaaaattgacgacaaaatgggcaaatgtgtgaagttttacctgcaatgctccaccgaaaatccttcgcggttttccagattttccagacgaggttagagagaaggcaaaaaatatgatttgtctgctcagagtttcgatcgaaagaacattcagttccgaaaatcagtcctcttttttctgtaacaaccaaaatttgtaaaaatataagcctttctagtgctgccaaaaaccaaaccgttgccaactctcgactttggcaataaatttatttttaccagcgacgatattttttgccggctaattttaaaataaagactagtgctgaatggcatccaccacctgcccccggacacaaaatggcatttaatcaaaaaattatcttttcatttccctcactgcgacccctgtcctccccgtccactttgttttctcgctcgaactctgtttttgaattatcccccccccccccctccctctggcaattacccatacgccccattaatcgcattaattaggtgccgttttgcactgttcctgttgggccactcgtcgaattgtctcgcaaaaggagggcaaaaaagaccacgtgcgcgagaattcacagctcactttcaacgccaacacaaacattttggagcttggagacccaatgccaattgaggtgaagccctcattagattattaattacaaactttttaatcaaattaattctcagaaattgatgtctgctgacaacggatggtacgacgaagcggacgaca

SEQ ID NO: 18971 - DNA, 1761 bp, Heterodera glycines
ctcccccgccttttcttctaaactctattaattaatttctattatagttccattatgttcattatttcccatggtttacagccctcctgtaaaaagaaagaaaattggaaaaagttaatttggctaatttgccgcggcggaggcaattcgattgaaagcattgaaaaatgagcgcactttgggtgcaaacaaaagacaaaaaacagccaacttcagcccagtcagcggggacagtcatttttgagctttcatcgcttagcaattgccctttttcaccatttgccttttgctgcgcaaattttccaaaaagagcgaaactggcacttggccacttccccgcctcccccaacgttcatcctcttcctccccctcccctccaacgttcatcctcttcctccccctcccctcttccccctgcattcccttccactcccttcccttccccccccccgcgccccctcccgcgccctgccaaatttgtctttttcccttccattaattattcgccttccgttagtgcccttgccgcctcctccctccatccgaccgacgtgatgacggcacacaaacacctcatccattttgtggctcattttcgctctttccgttttaattgtctgttggcagctccgccgcttcatctggcaattttggccaattcatgataattggccaaaataggtcgttggccgttcccttcccccggggccaccgcttctttttcttcttttttttgcgtgaaatttgtcccattgttttttccctttcgattaattggaagacccaaaagaggaggtgtcgggagggcgttccttatatcgtcccatgccccggttcaatccctgaaatatcccacaaaggcatttgttccctcccctcctttccatttcgttcggcatccgcccaccttctcctcatgtggtacttcttcatgccgtgccatccatctcaatcaatcttccccctccccttttccctcctttcctttggccccgcccttcgctttcccaaattcaatctttcagggccttttgttctttcgccatttatctcaaccgtttttccaattctttgttcattttgttggacttttatgcaaaagtgccactcgtagggcgaaaattaaaagatgggaataagaaaaagaaaaataaataaataaaacgcgaaagcaaacgttcatttgctttttggtctgtaagtccgtaggttggccctcccccccccctccatttagcctgccattcgctcgttctaaggatgaacaaatgcgatgataatgaagatgaagcacttttggcatttgctctctttgccccgtctcataaaacggagtcaccgccactctctcttccccaaaattggagtttcaacggaaacacgaaaaagtggccaaatgaggaaattcgagctgaacatccccccccccgccctatgccgtgcccctcttcaaacatttggtcgttattcatttattgcttttattttagcatattgagatgatgtgaatgtgccggggtgggaagcaaattcattgcgtttagtcaacgcgtaattgtcggtgtatccttagcatgcaaatagtgaacgaacgcattgagtaaagggtgccaattgcgtgggccaaatttgggagggaaaacgtgacgaaaaggtgtccaaatgaatcgaacattacgatgaaatgcgcccttctgttgtcattccctataaatactgctccctctctcagtgccctccactatttcaggtcatttccat

SEQ ID NO: 18972 - DNA, 1078 bp, Heterodera glycines
  misc_feature (1065)..(1065): n is a, c, g, or t
tggtaagacggacacttcagcttcgtttaagtacagttgccaaatgcacttcctcttcagtgtttatgagttttgtcctctgttctgagtttatcccggcaacgaatgcgaacgaaaacggcagaagcgcgccgtgggggacggagaggtgagaggaaacagaggcagtggataaagcgaaacgaagcggaagaattcgggggggggggggggtcaaatggagagacaacgaaacgaacatccggggagacaaaccgaaccaacgaacacacagctgcttaaggagccttcaaagtcatcgcctttcgtccaaggcgtgccttggacattttggaatcggatggttttggcggatttcggaaaagagcattggatgtgatggacggcgatgggttcggttcatttcaaaagagagcgttggattcactcgaaggcgacgatttcatggggctgaagaaaaagaaggctttgactacagcggacggggacggcttcactgatttgggcaaaagagcattggatgttcttgacggagatgattttgttggcttcaaaaaacgcagcgaaatgcaaaagtaattttggatttgaaatttggggggggggcattggcaaattgcgatcgatggcacttccctcaaaacaatccctttgtttctgcgcaggaaactcgcactgttagaccaaattcagcaccgacaaatgagggcgagaagagcattggacgccctagaaggaaacgctttcggttttcggcgataagcaaaaagcctaagaaaaaagggctttacgtcagtctttggcttgaacagaccgatcacaacgtcaatttatgtgattttcgatcatttgatcaaacggttgataaatgttttgatacgcttacatacctcttcaataaatgaaccacttattaatcggttacaattaaaaaggaaaggccgagagaatgaggcgagaaggaaattgtgactgactctttcaacagaaggtaatcattgataatttcaaaaaagaaaaaaacaattaaaccgctgaaaaattaaactgcataattttcaactnaatgcttaacaca

SEQ ID NO: 18973 - DNA, 2081 bp, Heterodera glycines
ataaatgtaaaaaattgtttcatatttcgtaaatttctttgattttaaagctaaatttagttaggtagacttaaaaaattcacataatttaaacgctgtctatgccattcaaaaacgatgaaacatttttgaattttaaaatgattttttacaaaaataaaatgggcaagtccccactccccggtgccctcttcttttgcagcaacaatgttttatttattttggtgtgagcacgccacgttcgatcaggtcgggaatctcgacagccatccatgggccaaggccaagtgagaaggcatgggcaatgccaaacttcggcacatttctggaagcatatggaacagggctggccgtgatcacggaaatcacggggtttttggggtgccgtgatctcggatcacgggtcacggattttttcaaattttccgtgattttgatccgtgattggcattttatatagggaatttttattgagacgaaaatagtaaagtggtgtgaagaaatttttgagaaaaatagataaattctttcctgcttacaaattagaaagtaaacatatatatgtagtctgttggttaagccttctgtctttcgttgtctgtcccttgcgttcaattccccattgggataggacaatttatatattttgttttgataattttaattgaaatttaattaacaagaaatttcataacattgaaaattatttttctttattttttaaaacgtccatagaccaataaattaaccaatgattggacatattttggacaaaatctgttaacaaattcactcaaaatttttcccggcggcgcctgtcggcaccaccggcagacggacccccattttaccgtatttttgaaattttgaccccaaaatggcagaaaaattaccatttttggcatataaactgctaaaaaccctattttttctctccgtcgcttaaatttaaaacgacaggcctaatcaaaattttcagaaaattttccaaccctctaagaattttttctaaaattttcccgacgttcagtatcttttggggtgttcagatcgtcatgaagaactgagcatgttggtccaaaagattttttcagcatcaaaagttagcttacaaattagaggaaatttttctctacataaatagatttttggttaaatttaagaaaaatttgaaaaatcttaataaattagttaaaaataaaaaattttccttggagatttctacaaaaagctctaattttcctcaaaaaattgccaaaaatcgtaaacttagtcattttttggaaaaggtctccgcaaaaaaagcggtttatatgttttggtttctttaaaacattttttgggaatttttcccgcgattaaattccgttttttaaataaatttaaataaaaaatcattagaaaattttttttttataatcacggatcacggctcacggatcacggaaatcacggggattttggggtgccgtgatcacggttcacgggtcacggatttttttaaaagccccgtgatcacggctcacggatttccgtgattggaaattcaatcacggccagccctgaaactgatgaattttttttgtttttaacacaactttgcggctttcttaggagcttgcaaaagacatatgttttttgctgtcacttggaaccggaagaatgccaccaagaaatgtcgaaaacattgacatagttttgagccaactttttcatcgcttgtgcggtctatcgatgccatgaaaaacctcaaaacgattatggttaatcaggtgcatcttttgagctccagttcgcattttgaacattttgcaattttttcaggtcaccaactctgatggagctcagttgagcttgcccgaacgaaatggtttttttgtcattttatttttttgtatttttgtgattttacaaaacattattaccgagcccggatttatatgcaaatgcatattttttgctatgctctgaaataaattttccataaaaatgtaagaaaaagatttacaaaaaaattcatgggttggcgagtgtccttgtgcttttccggcacccgagtagcagggaacggatttatatgt

SEQ ID NO: 18974 - DNA, 634 bp, Heterodera glycines
gaagcattttaaaaaggtgggtgggcgctcgcgctatataaataagtgcgcgtgtccccatcggcccatttcaattttttcctgtcaaacatttcgccagcagttttttgtcagcagcatatcggataaaaaagcattgtttaagcgtgttatcgcagaggttgacctcactataagcacgggcggcataactttgagcggcccccgtctgtctgttccccgtttcattccttttgaggaaaacgggcgttgccgcgcatgtaaaggaactgaggctgaggtggacacaatggtcaccaaggagggaatcaccttatggtgcacacgaatagaaaaggctcagtttgtcccttttgatgttgtctacgagcttcccggtcattgtttctttcgcgtgaagaataaggcacgtgtgttcagcgttccatatagcgaactgtcgtcctcagacaagtgcgtccagccgctaccaccaccaccaccaccaccaaaacctcaacggacaccggacgacgaggaggagaagaatttgagacgtaaggcaaaggtggcgcttgacttagtggaagccggacttatggcagacgcaatgatgcaggatgggacgcgttggaagaaagccaaaaccgcgatc

SEQ ID NO: 18975 - DNA, 2780 bp, Heterodera glycines
ataaacaatttgcagtgaataattctggatctgaggttgaatgtcttatttatctcgttatatttctttttgacgcaaatatcagctcttctctcatttttataaattcttgagcactattgggcccataaaagttgaagctcaattgacctttttgacgcctatagactggaaatttagccatttttgaatagctcagaaattttttggaccgcacaaatttttgagcacacattttcaaaaatcgtatagcggttgaaggcaaataaatttgggtaattttggaagctcggggaaagggttaaatgtgtgaagaaaattttcgattttcacatttttggtctaaacatggctcaaatgatcttttattgaagcaatgttgaatttcagttcgtttccgtgtatttaaacaaagttgaaccaaaaatgtgaaaatcgaaaatttaaattttcgactttttgttcgaattcgggtctgaggttcgaaattagtcaaatgggcgccggattcgtgatcagtgaccccgaaaaccccataaaaagtgtttttatgacttttgaaaacataaaaaaatttgaaaagcggggggcagagctgtgcgaaaatcacaaaaaaactttttcgtatacgaaaacgaaacgaaaacgtgcattcgatacgaaaacgaaacacgaaacgaaaaaaaatattttgaaacccgaaaacgaaacacgaaacgaaaaaattttgacggacgaaaacgaaacacgaaaacgaaaaaataaccattttcgtacgaaacgaaacgaaaaaaccgaaaattttttgaacttatttcaatcataattaagaaacataaaactttaaaattgtatcctctaactgaaggaatgaagatcctagtaggtggaaaagctaatgtggctctaggacaagggtgtgaccaaacaatttttaaaataaagaacatcaatgacaaaataaggtttagggtcaaaaaagacaatcttgcaaaattggttcgaatcagttaatatataattttttcgataaaaaatgtattaaaatgttatgtttttcacatcctattatggattttaacaatttttggggaagaaattagcaactgctgaaaaaaaagattttcaaacgttttttttgcagtgtatttttttttacaagttgatgaatgggaagtgggtccggcggcgccgataggcgacgccgggaaaattttttgaaaatttgagtgctattttatagcagattttcaattaaaatcggtaaaaacatgattaaaaaatcggtaaaataaagtgcggtcatgcgggatcgaacattaatgcacagcacaaagcaaacctgctgttttcaccactaaactaaaatacttaaataataaaacttattatttctttccaaaaaagtcattcttaagggtgtaaatattttcgtctttttcgtaaaatattgctctgacgaaaacgaaaacgaaacgaaaatcctaaattttaaaaaccgaaaacgaaacacgaaacgaaaaataaaattttgaaaaccaaaaccgaaaacgaaacgaaaaaactttagcggacgaaaacgaaacacgaaaacgaaactcaaaaagtgccgaaaatgtaggacgaaacgaaaacgacacgaaatttcgtccagccctggggggggttccggcggtgccgataggcgccgccggaaaattttttgtaaatttcgttgatttattaacagattttcaccaaaaaaggtcaatttttgcaattaaaagccaagcgacgacttttttttttttacttttaaaaaggctgtatgacatttcgcggtcagggtcgttttcgcgtggccgtttcgcgtggtttaatttgctaaaggaatgaacaaacaaaaaaacgcaggaggatgggtgaagaatgatggtaaattcattgcctattttcctttttcttgaaaatcggtccactttccaaagctttttcaatttttaatggaaaaaacgtctaatttctagagcccggaaatttcaaatttgcggatcccgctgcgggattggtactgaaaattctttgcgggacgggatcccgcgggattaatcccgcaaatcccgcatttaaaatttgcgggatcccgcgcgggattgcgggattttggaaaattcgaaaaaatttcaattaaattcaaaaaatttccaaaaatcaaaaaatgctgaaaaataaatttttaagggctggcgggatgcattaaaaggggttgatgggtcgactaagatttttcgattggatccgacggtaaaaagttgatcggaaatcaaattattaacggttcataaattgactatttttttcttttcaaacccacttttttgcggtgcaatttttcaaaaaactaggaacagagggtcccggcggtccttatcagggatggcattccgaggccccaaaaattttcgaagtcggaaatcggaattccgaccccaaaaacgtcggaaatcggaaatttttcaaaaaatatacaatataataaaatttctaaattttttaattcttaaccaagtaaaaggtatttcacaaatgtttttagtatattcgcttaaaaaaattattcaattattttatcaaaatatttttttgtcatttttcattattttagaacatttttgggaaaaggagtgactatttttacacgttttatacagcgcgattttttcaaaaactttttggaaacttgggggagggtacggcggtgcggataggttcccgccgcgaaaattttggtaaccgatttt

SEQ ID NO: 18976 - DNA, 1190 bp, Heterodera glycines
aaaaagggatagccattttttgaccgtccatacttcacatatactcaaacggcccgaaaatcatttttagagcataacaactgatgacagccactgtcattgtttccaaagagattttttattaccagattgccaaaaaaagagatagccattttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggccccgaaaatcatttttagagcataacaactgatgacagc

SEQ ID NO: 18977 - DNA, 2240 bp, Heterodera glycines
tacgctccgggactcatcgagccgttgatcatcggcgacgttgtggcgcctgtgctgcgcgttgtcaacatccgtgggatgccggatgagattgttgaagaatgctacaccgctgtccaataccagaagctgatggtgaaggagatttcggatattctgatcgagatacggaccccgtccggtgcattgatgccattccagtatggaacctgtacactgactttacatttcaaaaagactccctacttctgaatttgtattccgtttatagacacttacgcgcataaaagttccatttcccaacattgtgagaaagagagagacaaatgaatagcctacaaataaataagatattgaggcgctgtgccttgacccgcgagcacttcctcggctgttttccggccgaccaaatcccagacccccgctcatcgtatccctattgcatggtgttgaacacggacacggcgctggagccaggcacgcattgggtggccgtctacattatgtcgtccaccactgttgactactttgactcgttcgcggactggccaccgacaagtgaaggcattcgcaccttcttacaccgttttgcacatgtcaaccgctgccccatgaatgttcagtcggaccggtcgagcgcgtgcggaaaacatgttatctacttcttgtaccgtcgctgccagggctggacccttgcccaaattgttcggcatttgacaaactgcaaaacgccaccggaccgtctggtggcagcgttcacacgccaattcatttttcacgatgctgacgctgccaagactatataaaacagcaacacaccagtacacgctttgacggaaaaaaacacatcgtctgataagcggtggcgaacatgcacgtagactttgatccgctcggagtcgactggacccccatgttcacatgcgcccaaaacgacgcaatcgtgcactcgggccccgccgacgcgggccacggactcaacagcatcacgacacctatgggaaccgccgaggccgccgcagcagcacacaactatcttatgattggtggtggccatactacctaccccgtgttctccggcctaccgtaccagcgcggcgccgggcttggctccatgttcagaagcttcctccgcttcctgttgccaattggtcgacaggctggcgccgcaattgggcgccaagggctcgagtccggcgcccgcgttctctccaacgtgctcgacggacagaacttgaaggagtcgctggtcagcgagggacgcaccggcctcaaaaatctgctagacaaagcggcggacaccgtggcaaagagtcggcagaacggtggcggcaacttcgacttcaaacgatacagacagaatgccgccgaactcaaagagggcataaaaagtggaaagaaaggcctcttttccacaatgggtccgccaacggcacctgctaagcaacacaaaaaggagcttcaaactctggaacgcatactccgccgacaacaaccgggctcaacaccccgcaagcgctcccgcaccgtgaaaacgcccgccaacagcgacgacaagaagcgaccgcgacgtgcgccccgctttgacacactcggcgcctactgagagccacaaaaaacatacgcgcatacaatgacttgtgcgaagcgcatcagtcagcagagtgcgctagcgttcaacagtgcgctcaacatttttgcggtaccacccaccaacgtgtcggtggcgcgctccttttttcgcgaactccttccattgtcaacgatcagccaggagggaccgtacctattccgcatgtacaatgatagcctgtgggccgacctgtcccgtgtgtacctgtacctcgaaatgtccgttgagaaggcaaatgcgcagggcatcatggagccaattgacagtgtggtggacaaggaagtcggcgtatgccagagcatcgggcaaacatttgtacaacaactaaaggtgggtaacagcagaagccctcgcagacgcacacatcagtattcaggttgaagtgcaaaacacggagctgtacgacagcgggacactgtacccgttcaaagcgtacatctccaacgagctgtcatttcccgcaaatgcaaagagccatttcatggcttccaacggctactacgtaagccggacacacgatgacgccaatgatgatgggttcaagaaacggtgtgcacgattttcgggaggggtaaggcggagtttatctcgcgcctcgactttgact

SEQ ID NO: 18978 - DNA, 1863 bp, Heterodera glycines
  misc_feature (47)..(47): n is a, c, g, or t
  misc_feature (1095)..(1095): n is a, c, g, or t
tgacaggaaacggtcccttttccatccatcgctcattaattccctcncctcttttcccttttcagcattcaaacggtaaaaacggcttcaattaattatgctttgaattgagaggtgcctttatggtctgcctaatgagtccgatctttttcaggtccgtcttacgctcacacccctcccttgcaactttttcctttggtaattagcgaccgtttgccttttgagcgaatgttcccttaggcttcccttctgcgccattaatgtcatccaagctttttggggtcttaatttgctgagtgagtgttgtgcttaattcgtcgtcgtccaattgactttctctaaggccaagaagtgatcctttgcgtcgtcatccttggcaatttgaatgcttgcgtatttttatcttttcgattttaccgccatttttctgttaaggtaaacccatggatttatattctttggaacccgcgccaaacgcgacgggcattgttctcactgattcgaaagggtgaggggaggggagggggggaaggaaaggccgaacgataaacagcagaagaaagggtggcccaccgggggggggggggggggtcgattgattcccctctgggcatttttatttgatgactgattgaccaaaatgtaatttaaacacaaaagataatgagctgatcaccacctcaacgagtgccacccgacagacgagcatcggactgcgcatgtcgggaaatacgaacagtgcggggggtgggccgattcgttagccgtctcccgaggcgttctcccccccccccgtcactggtgattaatttttgttaaggttccgagtgataattgtcaatttaaatctcgtgccaaaatactctgtaaaaaaatttcacatcttttcgcattatttaaacgatttgaaatatgtggaatttttttcttatgaaaacaaatttgttcttgagcatatccaatttataagaaataaaagggcttcaattcggctttttgactcaaaacaaccgggtttctgtataagtggatttggaagcttactcaaacgctgagaaaagaacacagataaaaatggatacatcaccaataganaattattcgctttttcgcaatcattcttcatcatcaattattttgtttaatatttattttcttttatttccatgttttcaacaattgtattaataataaaacgtactttaatttaatttatttttttgtaagggattgtcacagaatgaaagagcaacgtattaagaaacagacaaaaggaacaataaaattaaaaaattatttggctctgaatgtatcacaatacgcatttaaagggggggggggagaaaaaaaatataaaaatgaattgcaaattatacagtatgagaaggcatacagtcaaacgcaacaatacaaaaatactgtagtactgcccgacaaaatgggaggataccaaaagggataaaaatgtgagattccgtttgtgtcgagaaactgttggtaaaaattctcactatcagtccatccgttcgagcagtactttcagtcagtgagaaaaatggatctctgtgtggggattaggattattcatgtcagatgattatgagatggttggggggggggggggtcagtgtgaaattctgttgctaagagtggtcgctgacagtacttatgcccgagtcggatgtttcgttgtggcagtgattggccgcctccgtgccgggcgactgttccatggcccttgccgtccatcttccgcccgtccctctgtcgtcgtttggtgccgacgcccgcttgacccccgtctcttcctccgcctcttcctagaggttcgtttccgtctcggtcccttcgtcctcttccttt

SEQ ID NO: 18979 - DNA, 3530 bp, Heterodera glycines
catcagaaaacgaatccgcgaggaattaattaattttgaataaaaatttttttataaattattcatatcccaaaaataaaaatggtaaaaaattacttttttctaaaaattacaaatacacaattttttgagcgagttttccggcggttggcgaatgcgtgtggcgttggcccgtgcactgttcataaaaccggatttgctgttgctggacgagccgacaaacatggtcagcgtcctgcatttgcggaaaatagcaattttaattcttgatttgtttaagttggacatgcgcgctgtctattggctagagaatcatttacaggtccatttaacatccaattgcattttaaatttaaaaaaatcgtaatgaaaatcgcatttttggatacattacgtgaaaaactttttttggcggttttcggctttggcgcgattgacgccgttatcgttggagagaatttcaatagttaaaaattttgaagttcaattcggccatcgttggcctcaaatagggatagggaccatcttaaaaattttgatttttttagaatattttttatgtgttatttaaaaacatttcaaatccgcttcatttataaatcctgtaaagaatttgtaatttggcatggcctttttgtatatgttaactctccccccgttttaaaggaatggcacggcaccattctgacagtttcccacgaccgcaaatttttgaacaccgtctgcaccgacattgtacatttgcactcacgtcggttggacgcgtacaaggggaactatgacaattttgagaaggtttcgtttttgaattttaaattttgttttttcaaatattcaaattgccaggcaatgcgcgagaaactgaccctccaacagcgagaatatgaggcacaacaacagctccgacagcacatccaggagttcatcgacaaattccgctacaacgccaagcgagcctccatggtgcagtcgcgcatcaaaatgctggaaaaattgtaaacattaatacattaaaaagatttgataaattctaaaactttagataaacaaaaaagtttctaaatttcctttaatttgcttctctatttaaaattatttgcttcgtatcttctatctgtcttttatcatggaaattgattacaaataatagtatgataaaggggacgtgtcaaaatttcaccgccgaaacaagaaaaaaaattattgcaaattttttaataagaaactatccagaaaaataaaatccttcagtttttttgaaattttctgatgaattactaagttttttcaaacgtttttccaataaatcgctaaaaatttttcaaaaaattttttcttagagttttcttataaattttcaaagtttgaaaaaattataattaattttcggtggtgagatttttgggtgcaccctatgataaaatgttatttttcgacatttttttaaaagttttcgcgttattttgcattttttgttgtggtgctcactttgcgttccaatgtttcagaccggtgctgcaacccgtcgagttcgactcggacgtggtgttccacttcaaagactgcgacaagttgggcaacccggtgctgcagctggacgaagtggccttccgctactccaaggaaacgccgtacattttccaggttgcgtaccataatttttttatgggccggggaggttgcaaatcgctgggatagggaagggatgaccgaattttgggatgggtccaagcgcaaatttacatctgtttttgttgggaacagcttatcccccctattttataaaaaaagaaaagtttttgatttttctttgaaataagaaaaggataaagaattttttgaaaaagaaattccaggggggagaaacgcttgcgcccgttttgtgctcttccctgataatttactgcggatgaatacacttttgtaatattttttaaaaaaatttgttaaaaacacaaatgctaattttccattttttggtttgaaagttgaaagttgaaactttttaaaaaatatatatttttattgaaaatttcttgtgaaattgtgaattgattaacaaataaaatgggaaaacaggtgatcattttaaatctttgtttgtttttggcgtttttctttatgattcgcttaatattcccccaaaaaatatattttttctgcttttccgattcctaatttttgtattttgcagaaggtttgcatcggttctcgctccgactcgcgcatttgcattgtgggcgaaaacggggccggcaaaacgacgctgctcaaactgttgctgggcgaccacagccccaccaatggcacacggagtgccaaccgtcggctgaacattggctacttcacgcagcaccacgtggaccaattggacttggacgactcaccgctggaactgctcgcccaacgctttcccggccttggccaggtgggcgccgcaattttttctggcattcagcattttatttcaccgtatttcctaaaatagagcctccgggggctttgtttttcaaccccttaggggggggggcgggtattttaaggggttctaattccaaaattaacaaataattttttacataattacattaattgcactaaaatttccggccacaaaaattcataaatttctcttacagaatttttttttcattattttttgaaaattaaaaattttcgggctcttcatttttctaaattctaattattatttttgagtgtgtattattttattgatgttggttgcgttcataaaaccttgccaatttatttcttttcccaggaggagtaccgtgccgcaatgggccgttttggtctgtccggtgacattgccttccaatccatcgccactctctccggtacttttccgttccaaaaataatgaaaaaattaaatctaaaaaatttaaaaaaaacatatttttctatttgaaaattattttcaggaggacaaaagtctcggcttgccttcacttgtctttctcttcaacagtgagtttttcggagtgttaaaatttataattaaatttaaaacaatccttaaaataattttaccttatttcttggcaggcccaattatttggtaatggacgagcccaccaaccatttggacatcgaaacggtggacgcacttggcaaagcattgaacgattttaaagtgcgttatttcactagtttgaaatttttcaaccaaaatcttacaatttagaaattttttaaattagaaataaattccactaattttttcagaaattcttgcacaaaaccgctagaaaatttttcaaaaaattttttattttacctattttaataaaagctagttttttcttgaaaattttctaaattttaatcagaagttaacaagcaaagcgtaaccaactttaaaataaaatggatatattttcaagagcatgatatttttaaatttttttgaataattagctgtttgaatttaaaataatgttttttttgcttcaaagggtggcgttgtgttggtttcccatgtcgagcggctcatcgagttggtgtgca

SEQ ID NO: 18980 - DNA, 2266 bp, Heterodera glycines
catgggctaaactttgacttcgagtttcgaaaactttgggtttttgaaatgcctaaaaatctctcattaaaaactttttttaagaaattattcagggtcggaggtgaccaaaagaaattttttttttcttaaaatcttgataacaaacagcataaatattcatttaaatcaaagaatgtgaacaaatttaaagtcagttaaatcattttttttacaagaaaattcgaaacaaaaaatctgtaattttttcttctttttttcgtactattttttgttaatttaaatgtatttgtttgtttacacttttatgacctttttgcgccaatttttattggacaccattctcaattcaattattttgtgtgaacaattaattgccttatttgtgcacaattttttttcctctaatttcaatggaaaatttatttttatttttcaatttcatctatttttaaattcaaaataaaactttaaatttaatttaattaagttttccaatgttcttgaaatttaattccattatttgtgcgtttgcttttattattcgtaattatggctttttcgttcatggcggcagcatgggcttcaactcaatgtgtgaaagcacaatttatagcaaacaatttgaaaatttgaaggctcaaagctatgtatgtaaataattttttaaaaatttcaaaaacaatttagatattaattagaaaattacaataattagatttaatgaggaaatgaataaggaattttcaatggcaaaaattaaaacaagcatcaaaaattttttaatgattaaaaaaagaagtcaatttagttttttgtagaaattgataaattttgtaataaatttaactttttaaaaaaagttaaaaaataaaataaaaatttatttaggaatagataaaaaaaaattatttgatagaaaatatatttttaaaggaaaatgtatgaatattatataaaaaaatttcctattctttttaagaccaccaaaaaaatacaaaaacaaattatttaaatatatttgtaatatttaatatatttttttcacagacattcttcattggtaattatttcaacggcgctttagtgacagccccgaacacaattaatggactctattcgggtgttaacaaaaatggaatttattgcattggaaatgcgtcaagtaaaacggaaaatttattttaaaatttacaataattataaataaataaatttaaaataattatgcaattaaattcaatgattttaagaaaatttttaaattttaaaataatttaaataaatttaaaaaatatgaaaagaaataaaattgaaattcaattatttccatagaaataatgttaaaattttatttaaaatttaattttaaaaaaatttaaatttatttttaaaatgcgtttaaatttattttaattttaaaaatcaatttcaaaattaaattcactaaataaatttaacggcatcaccccgctccgtgatgcctatcatataccaaaattcactgcttaattgtgtctaattaagtattgtattgtatcatttagccgataataattttaatattacaaggcacgtttgccggttgaccttttaaacgccgcaaaagcgtcaattggacggacttggctagtcatactgaatgggctgggctcaaactggagcaacaatttgaccgagaacgagcaattcattcgggaatttgtcagctattttccggtaaaatattacataatattaaatttaaaatttaataaagggaaatctaatcaatttaataccaggattataccaattttactgcattcaacaattggttattagcagttattaaagaattaataattggttaagctaggcatttttgggagaaaatggaataaaggatatgggagaatcattaaaaatgagcacccatagttcagtcggttaaagcattcaaccgtatggaaaggccgtgggttcgattcccaacgggcgagcaaccttttttgctctatataaatgatataaaagcacttaagttttatttacaatgtccatttaaatatttagaaatttaataatacttgtagacaggatcgtccattgagtcccgaaatttttctcgccccgaatccatgatgactcgtcaaattttgacagtcccgaccgaatggcgactttaagacacttttgaaaatttattaaatatttaattggttttattgaattaggtatcagccggttatgcaccgttacaactgcagcataagcatcattgatg

SEQ ID NO: 18981 - DNA, 1172 bp, Heterodera glycines
  misc_feature (25)..(25): n is a, c, g, or t
  misc_feature (89)..(89): n is a, c, g, or t
  misc_feature (1107)..(1107): n is a, c, g, or t
  misc_feature (1111)..(1111): n is a, c, g, or t
  misc_feature (1114)..(1116): n is a, c, g, or t
  misc_feature (1120)..(1122): n is a, c, g, or t
  misc_feature (1125)..(1126): n is a, c, g, or t
atttcgcgtttttaaatgcagccanaatttccagaaatttcttgtatttgttttctgcagtaaaccgtgcctaaataaatttttaaaanaatgaaaatttgcgaataaattgaaaatatttaccttgactcgttgcacaaaatttaaagctatcgaccaattgctattttttttgctcattcaaatccgaaggttcagcttaaaaaatttaacgtaaaattattgaaattgtttaaaaaaataatacctttttcgggaggaaaggcagaagaaatatctaaataaaaattaaattaaattttaaaaaaattatttaaaaattaccggaatcgaaaattaatgaaatgtaaaggacgaccgccacaaagaaataatgcatttgaaatatcttttaaatgaaaaaataatgacaatttattcagttattgtatttatattaaatttacaattctttctttattttttaaattttcataaaaataaagccttaaaaatcgtgactgtgtattattttaatataggttgtataatatagagtttcgtgatacactttcggtgtgtatatattttcgaatatatatatatatatatatatataacatcagtgatataaagatatatacatccggaattgcatatgaataaatgccacaaggcaaccaacatgtttttagcatatgcatatgcattcgtgtatgcatcctgaatttatattaataaacaacgaataaatacacacatgtttaccatatgcatatgcaccagtttttcaaacatttttgattaaaactttcatgaaatttaatgaagctttttttgaaattttacaagctactatataaaacgcttagtgctttggaatgatataaggattaaaaaatatgttgcttttaagcaaatttatatcaaaaaaatttttcagcacagcaaatatcttaaaactgggagccggaaaatccgacacttaacctgaattccctggaaaattttcattaaatgcccaaaattttcaaaatcaattaatagtttcggtttctgccgaaaacagaagattttatctcttaaactttattcaattttttaaagagaatttaaagggttttcttngttnttnnntttnnnatnnctgcatcataaagtaaatttaggaaacttcaactgaaaaattcaaa

SEQ ID NO: 18982 - DNA, 985 bp, Heterodera glycines
tacaacaactcttcgggaatttgtagtagcccagtgggttcggatagcactcccgctcaatgcacgcctcgtgcacaacacggtcaatctcatcggtggtcacctgatgtttaatacaaataatggcacttatttaaatcgaatcatacgaaaaattggcgtttttatttgattcgaattttttgaaaaatgaaaaaaaattgaacaactttctttaaaaccaaatgtctaacaacaaccaaagaccataaccaatttgaaaaaaatcagcttggaaacatgaaatggataggatttaggggaaaaaaactattttccggaatcccctgatccggtttgtatttttatgggattttaataaaaaaaaaattcattacgccaggctcaatggcacgtgccgcctcgtcgagcacctcgcggcccaatttggcggccaaacgcattcccaactgttcctcctcgttcaacaccttaaaaattcagatgaaaattcaaaaaataatttttttttttttttgatcagaccctcccatttatttcgcttcaatacaaaactaaaaaaaaatttttttttgaaaatttaccccctaaaatcctacacgaatttgtccactgtttcgtgcgtttcgttcctccaacgaaacgccttccggatgcaacgcataatcaggcctcggaatatgttccgggacagcgcggcgcgcactttgtggggcgggcctggaaaataggcaatttttttaattggttaaaaagtcaggaaaatttaaggcttcaaaaaaagaagtttttatcaaggtgaacctaaaaaattgaatatgttgttaaaaaacggaaagatagccaaaatattgctttttaaactattaaaaattttgggaatttcctaaaaaaattgcctaagcgttccactgaattgatacaaaggccacgggttgtactcgttgatattggacgaatcgtctttatggcacaacttatgttc

SEQ ID NO: 18983 - DNA, 875 bp, Heterodera glycines
acaccacatggagctggtcgatggagctgccccctgaaacgccgccgccagcctcgccactccacttggacatggagccgctcgcgcacagcacgccactgcgcagccaatctgcacatgtatgtgtttgcaaacacatcatcgattcctcacttaatcccttgcagtccatcgtgcacgctgcgagccctgtgcgtgcggctgcggggatgatgcccgtggtgccttcattccacgggcggacccgctggacccctggcgagttggtgctgctgcggcgcctcgtgacagagacggaagggatgggttcgctgtttggtctgcgaagagcagcagcgatccgcaacgcggctccggaggacagcaggctccggtaagtgtcctttgctcatgctttttctcttaatgatgcttttgccattaaggaccatgcgcaacacccaggtccacaaccaggtgcagtacctgtaccgtgggccacacccaccgcttcccaacttctgatcgggcgcggcgacggcaacttccccccccccccaatcttcatatcccaaacggccctctttagggccacaaacacacaaatgagcgaggtggcttgcctctttttctctcttttctctctactctctctcctcttcatcatttttgttcctttgcatttctctctctcaatgttcattaccgttcctccctatttctctctctctctcctctctctctcttcatcagcattccttttcatttctatttctcttttttcatcattgcttctcactatttattactcgctctctctctcaattaatcggctcccggacttttcgacagtggaattgcgacagaggacttttcgacagaaggactttcgacag

SEQ ID NO: 18984 - DNA, 1255 bp, Heterodera glycines
attttatctgtagaaatagtctcatatgaccaagacataaaagtgctttgcgcaacaatctcccctctggtgtccttcatttagaaaggcactgaaccgtatacaaaaactctcacattctaaaataactcagttaaaacagcttttaaatttaattgttctgaaaccaataatttttatctgtagaaaatagtcccatatgaaccaagacataaaaagtgcctttgcgcaacaatctcccctctggtgtccttcattttaggaaggcactgaaccgtatacaaaaactctcacattctaaaataactcagttaaaacagcttttaattttaattgttctgaaaccaataattttatctgtagaaaatagtcccatatgaaccaagacataaaaagtgcttttgcgcaacaatctcccctctggtgtccttcattttaggaaggcactgaaccgtatacaaaaactctcacattctaaaataactcagttaaaacagcttttaattttaattgttctgaaaccaataattttatctgtagaaaatagtcccatatgaaccaagacataaaaagtgcctttgcgcaacaatctcccctctggtgtccttcattttaggaaggcactgaaccgtatacaaaaactctcacattctaaaataactcagttaaaacagcttttaattttaattgttctgaaaccaataattttatctgtagaaaatagtcccatatgaaccaagacataaaaagtgcttttgcgcaacaatctcccctctggtgtccttcattttagaaaggcactgaaccgtatacaaaaactctcacattctaaaataactcagttaaaacagcttttaattttaattgttctgaaaccaataattttatctgtagaaaatagtcccatatgaaccaagacataaaaagtgcctttgcgcaacaatctcccctctggtgtccttcattttagaaaggcactgaaccgtatacaaaaactctcacattctaaaataactcagttaaaacagcttttaattttaattgttctgaaaccaataattttatctgtagaaaatagtcccatatgaaccaagacataaaaagtgcttttgcgcaacaatctcccctctggtgtccttcatttttagaaagcactgaaccgtatacaaaaactctcacattctaaaataactcagttaaaacaagcttttaattttaattgttctgaaaaccaataattttatctgtaaaaaat

SEQ ID NO: 18985 - DNA, 2281 bp, Heterodera glycines
cctttagatcaattttttcgtttcgaaggtggcgcggagattacacaggcgaaaccgttcaatttgtgttcgtttctcttttaattattattttcatttctgtcccctgctaatttcagtgccaccgttgtgcaaaatctcaagagattttgggtgaggtccatcgtttccgtaagtttggtgtgcttttgctctgcttccattgccatttcccaggtgccaattccgtcctgttcaatgcgttcgtcgttcggcgtttggaacaaagagatgccgacggtgccgccgccaacggacactttcaaaaaggagactttcgaggcaattattcccgaaaaatcggttaatgatcggccgcttcagttgtttaaccccggctcggctgctcagctgatcagtgaaatcagtgccttgccatccgaagggcgcccccgggtaaattttaattgctttttccctattaaagtgccgttctcccaagaatttcttccctcagcagcccactccacagccccaaccaaatccgaccttctttcgagctaccgtaagaatgaaattgctgtttttcgaaatcctaaggctttttctcaggaaccgacgccttttgttgttgccacgacgccttccttcttccgacccaatcagcaattccagcgatttggccaaaattctggtggtttgcaaaggatcattgcatttcaccgatcaaaacatgttcagcttgccgtgacgcgacttcgactcgccattgcttacaatgggtccaattttgtccgacaaatccgtggatgagccaattctgcaaagcaacttgtcggatgtgctgaccggcgatgtgtctgaacggtgcccggtcgttgctgatggtcgacacgacgaccgatttgaaaatgaacggaccattcttttgccatagaacgactcggaatttgcttacgaatttctatctcattttaaattatgaaaatattggcaaaatattaattaagggaatgaatgtttgtgaaaacgagcagcgaattggcgtaaatcttccggaggaactgaaccattttgaacaattagtccagtccttttaaatgaaccgcccattatgggtctctgactctctctctctctctcctccccctacccttcagtctctctttccgttctctctctctctctctttcctgccaacgacatcgtcgtctttctgcctctgtttccccttctctttccttttccttctcctccccacaacattgccaacctttgttttttgtacaatctctactgcagttcaattgatctgctgttccgtcatgtcattagttatctccctgaattttaggcataacaaattaaaaaataaataaaaaatcattaaaatatttggacttttttactttgatttcttttttgatgctggttaattaatatttgattaacctccatctcttttcttccattttattttagcttcgtttgttttctcctctttttttctgtgtgttcaatgtgtcatccgtaaatcgagaacgacgtctcccttttctcaccaatcccttaatttactttttcttttgtaaaccaatcaaatttctcccccgactctcatctattgtcagcttttcttccttgattaagtcatcgcatcttcttcctaaattatttgtgggtcaaatttagaggcggagggggcggggcacaaagcgaagtaacagaaatttgaaaattcataaagaacaaagtatgtgttcctcacaaaagtgctaaaaatgataatataatttatgttagaaatttcgttaagtcaggatttgtacaaattgtgttcgagcatttctgtttttgattgtgtcaacacaaaattgttcgtttccattccactctttcagatccctaataatgcatccttctcagtacaatcaattgcatgcctatggcactggtgcatcttcaaactcagcaaattcggtcggctatggtctctcttttccgctgattggtgttttttgatacagtcacccatgaaacgtgcccctccagcggcggtgtctccgttggcctctccgatggagtcgcgccgactgttcatgcctcccgcttctgccaaaccttcggtttcttcctccaccgatcattccatgctcaacgccattcaattcggctacactttggctgggccccaacctgccaaattgctgatcgacccccaaaccggacaacagtattttgttcccacaactccccaaccgatgtcatattacgctgcccccgccccacttttttatccgaa

SEQ ID NO: 18986 - DNA, 3356 bp, Heterodera glycines
tattctaatattgtggtgagcagaaagtctttgtatagtggtcaacaatattacttaaaacattcaaacaattcaaataataagggtttataaccaaatttgcaggctaatagagcagcatttagaatcaaaaaaatcagatttttaacaattttttttcggcgcatttttccgaaaaattttttgggcatgggtgagggaagagagttcggcgttgctgatttgccgataggcgacgccggggaaattttttgaaaatttaatgcaatttgttaacaacttctgtcaaaaattaccaaaatttgcgatcttgggctaatttttaagaaaaaataggagtttttgggcgccggcggtgccgataggcgccgctggtggaaaattttaagaatttttaatgaattttgttaggaattagcgaaatttttcagaaatttcctcttttaaatgaaaataaggcactaccccaaatcagaacatttcttagaaataataacattttcattttcttaatttttttgacttgcagactgactatttttaatttgctttttcatttagaataatattttaactttaaatatccagtttttaaaagagaatattcagaaagaaaataaagaaataacaccgacacatattaaaataataaaaagaattcgtaaaaacgggacagttaaccaattaaatttttatatttttatttatttaaaaatttttaaacatttaaaaaaataacaaaaaaaagataaaaatacaatgcttttacaaaattaataagaaaaactaattataaacttgtataagctcaatataaactaatttaatttaccttttgagaaagatcagaaagaatgattctgcgcaagaatttaaaacatattaaatcaaagaaaaatgactaatttgcagatttttcttttcaaatagaataaaaggacattttaaattcaaaacattcttctaaacgtcataatttgtttaaatgcaacaatacatcgggatcccaaaaaatcttcgggatgaattggatttgtactggaccccgactcgggatacatctcggtctttttccaaatcttcgggaatgggatttggtcggggtccctccaaccttagttttccggtctctagtttctaatagaaaattactgattcatttatgaatttagcgtaaaataaataattaaagtcaaaataaactcaatcaaagaaatttagcaaaatttggataatgaaataaaaaatagataataaaatatataacaagaaatattacacatttcgaataataatggaactccagaagaaaaaaaaataaagtttaaatttaaaaataaatataaaaaggattattatagaaaattcaaattaaaaataaatataaattaaataaaaataacgcgagacgaatttttaataataaataccattgctaccaagattccaaacaattattcatagtcagtcctaaagtcaagaaaattattgtgagataaaataattttataaaattgcaataatagattttcggaaaaaaaattaaaaaatataatgctttcatttaaaataaacaaaatcttaaaaattccgattaaataaaacttcagaacacatttaagtttaataatttgattctttctgaattttttttacatattttgcacaaatttgtttttccaagctaacatccgagtatcgggttcatttgatgtgcttcatccaaccaatagtctatcgtaaattatttaaatgattaaattaatttttatgtttatttaatctaaagccatattcagtttcagcgtagagttttatccagactaattaaatctgaaatttttcatgcatgaagtttcagctgtacaggctcatttgagaacccagagttcaaatataaataataaaaatatattaaacaaaaataatacgtccagatggaatataaattaattaaacaatttaaaataaaaaatatttatttagtcaaatattttttttaaatcttaagttaaaataaaatttaaatactttttttttattaagtataatttgattttaaaaacacataaaaaagccaaatgagtgcgtgggaacatcgacagaatttgtttgcgaaaatctacacaattgaaaatattagaaaattaatttctaacttttttaaaaatattcatgttaaaaataataaaatactttaaactaatattccatctctttgtatgaatctttggaaattaactatagtttttgcgtaaatttgatttgatatgaagtaaattaaccatgttataatcaaataaacacaagacgagaatattaataaaaaataattgagtaaatttttataaactaaaattaaatataatttaaaatataaaaatgcgagtaaaattgattaaaataattaattatcatataaatatgttaagaagaaaatagcaataaataaagaattaacttaggtatgaaaggtaaagaaagaaagaaattattaaacaagaaaaaaataaaataaaaggaattatttaaattaattagtatcgaaattaaagtataaaaatttattccattcgtaatataaaataattatttattttcaaaaaattttaaaaaatcatttttttaatttttaaatgacaaataaatttaaataaatcctttgttattaaataaaatgagcatacaactgggcgcatatgtttacacgagataggccacaagattaaaattataaaagaaattatcgcaaaagtgatttctttcaaggatacatttatatatgaaaataattttttaatttaattttgtaatttaattttaagataaataataatttagaaattgaataaaatgagattaaaatattatgggtttaaattaaaaaatgggacaaagcaatgaaatcggtcagtgctcattaaattaataaaattattcgctaatgaagtataaattaaattaataattaaaagataacacataggaaaaaacaaaaaaaaatagaaaaaatataatcaaattttaaaaatagaataaattataattttaaatgaatattttaaaaactaaaataaaatttaaaactgacaaataaaatgtataacaaagttgacagtgctaactgttttaatcatgatcaatcaatgactcatgatcaattaaattcaaaattttatcttaatcaaaccttttttaactcattacaaaatgataaatttaatcaattaaaaaatttattataaatcaattgaattcaaattgattttataaaatatttatacatataaacaaaaaaacgaccatggtctctacaaaaacaggacaaataaaaacttgattgaaaatattcagaa

SEQ ID NO: 18987 - DNA, 3097 bp, Heterodera glycines
  misc_feature (2067)..(2067): n is a, c, g, or t
  misc_feature (2103)..(2103): n is a, c, g, or t
ctcccggctattctttttgttattttttccccgatcggttcagcacaacgggatttgctgctggatcaccactgcttgggctggacagaaaattttgtctgctgctggccgattggtgagaggagtgctgtgaaaacaacaatgtggccaaagcagatcaatggtggtgatcggtggtgatgtggccaagccatccatcggtcggtgaaacattcgtcccccgtccgcccccccccatttagtttcgacccattagtcacagttgtttttgttgcttttttaaagttgcccactatttgttgagaatcagggatgtgccggaataccaccgctttccgaatgccgaaaatttttcagccgtctgatgaatgccaatttctgattgccggaattttttttagtgcatcggcacacacatccctgctatgtaggtacggaacagaatttatgaaattcagtgccaaggcgcttggcgattgaaaaaatatcgggttaggttccgaatcagaaatttcagggttttcggggtgacacaaccctgtttgttacatacctctctgttcattgaaaaaattcctaaatttttgtattttttttctttatattttcagtttttaaaaccaatgtaaagccattttctcaccaccccataaatccgtgtctatttaagttcgccagcattccctgacatttcaaaaagtcgtctttgtcctcctctaccccatacttctgctgctgttcagcccctgttcatttcattttatgtatgaatggccaagccgccccacccttggcccagcagtccgtccaaccaaaatgtgttacaactgcctccctctgtgatgacactgactgatcagacggggggtgagcacggcctatggaaaccggggggcgggggggagtggctgctgctggtgtgaaaagcattgaaaacgggtggggtgttaaaaaaaatggcgaggggtccgttgcccccgccaacccatcaatcaatcaatggggggaggggggaggggggggaaaaaggacgataaaaacaaaaaaaaaccccccgggtttggccccccctttttccggtttccgggtccccccttttctgggttggggcaattttttttaaaaaaaaaacggggttttttgccccaaccgttttaacccccgaaaaaaaaaaaatttttttttttcttcccccccccaatttttaaaaaaaaaaaataaaaaggggcccccggcggcccccataaaaaaaaaaaaaaaaaaaaaaattgcccggggaaaaaaaaaaaaaaataaaaaaaaaaaaaaaaaaaaatttttttttttttttttcccccgcggggggggtggtgggttttttttttttaatattttttttttataaaaaaaaaaaaaagaaaagtttttttttttttttttggggggggggaaaaaaaaaaaaaaaaaattttttttttttttttttttggggggggggggggggggggggttttttttttttctttttttctccccccccccccccaaaaaaaaaaaaaaaaaaaaaaaaaaaaaaaaaaaaaaaaaaatttttctttttctttttttttttttaaaaaaaaaaaaaaaggggaaaaaaaaataaaaaataaaaaataattttgggcgccctagaagcctctttttaaaaaaaaattataaaaaaaaaaaaaaaatatttgttttttttggttgttttgtggggggtctccccttttttgggggggaaaaaatcccccggaatataaaattcggggttttggggagttttttcgggggagtttttttccccaaaaattgggggcccgggttgggggggaaatcccgaaaaaaaaaaaaattttttttttaaaggtcctttgggggttttaaaaaattttgggggcaaaatttccccccgaaattaaattccgggtttaggggaaagtttttccggaagggtttggttttcccaaaaaatttggggcctttgttttggggggggtttccccggaaacaaaaaaattggatttttttccaggttcggtttggggtactccaaccatttanaaaaaattttaggtttttattcattttcctttttgnatagggaaagcatttgagtgcctaaaataccttgtaaataaaatttggtgcgtttcagagcagtttgtgaaaaaatatttatgaattaattttcgctaaaaaaataaaatagtgaagctttaaaaattaataaaaaattttaaattcagaattactggagttagcatcatagcagtgcttttccttgtctttttgatgccctcgcaaaatctggtccgcttctgatcagtttataaaaaaaaagttaagcctaaaatctttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagatatatcgattttagtgcgctaggttcgatgaaactttttaaaatataagcctaaacttttttggctgtttaaaaaggaattaaaatttttaaatatttatcatctcccctttgataaaaaagcatc

SEQ ID NO: 18988 - DNA, 1654 bp, Heterodera glycines
  misc_feature (44)..(44): n is a, c, g, or t
  misc_feature (77)..(77): n is a, c, g, or t
gaagaaaaaaaattgagatttgtgaaccaagcaaaatcctccanttatatttttgggtatttgactgtcctcaccanagccttttggtcccttttatcacctttccctttcttattatcactatttcatttcctttatcacattctcgtgtcatttgtattccttctcttaccttctcaaatcattagaaccttttctttgtctgcacagggataagcatacggaatttcggtttccgaaaaattggacgtcggaattctgatttccgaaaatttttggtaaaaagtcggaaattttttttaaatgctccgcgaaaaattcctttcccaaaacgttctaaaacagtttttgatgaaaaccactgaataattttttttaatgaaaaaacagtttttgatttcacctttcactttttggggaacggggaaaaaatcggcgataagagtaaataggtcaacagaaggcaaaattggggatcaacaaaaaatggacgcagaaaaagagaaggagaagaaggaaaaaggaggggggcgccttgattaaatagcccccgagcagaatatgcaaaaacacgtgaataaggagaaaagtgggcatttttgagagacaaagggaaagaggcatcgctgaatatgttggggggaatcagagtacagaaaatggatgaaaagaggggatggcgggcaaaaagataatggtaaacatttagagaaatggatccccaatcgggccgaacaaaaggaatttgaaaatgtgaatgaatgtgaaaatgcaaatggggcgaagaacgatggagaaaatgcagatgtgaaatggtggacaaattggataatgagaaatgaaattgaaaatgatgatttaaataaaaaggagaaaactgggaagaaaaggaaaaaggggccagattggcaggggtttcgtcatctctccgatcttctgctccgaccgacctaccaacgggaatgttcccgatcatcaatggtaccacggcttcttcttcttcgggcaagtgcgcctttggggagccgtaaaccaggcatcctgggtggcccatcggttctcctcctcctcgtcaattttacgggcattgtagtgcccgcccgagccccgggtaaaggacaattggccggacccttcaccccaactctcgtcgcggtttcgcgacacagcgatttggaacaagattttatttcgatactacaaactagagtagagcggtaccggtacaggtactgaaaaaagcggtacaactgagtaccaaggtcgcagttttgaactttcttatttccattattttataaccggccaaacagcaattgcccgagaattttttaatttccaaaaaaattaatatgggatggaactggtcacagcatcaatgttgagcggtttttcgatttaaaaaaaaacacaataattgattttcatgtttaaaattacaattttaagcataaaagttttcttcaatttttcaaagaaaaatgtttccgtttttcaatttttgaattgccgaatgcaatcaagaattagagcttagaaaaatttgaccgggtaattttgagaaaaattgaaacttgcgcagcaatccgcttttgccattgaaaatgttgtccaccagcgcatcgaaacgggccgaaagcagtgccaatttgag

SEQ ID NO: 18989 - DNA, 648 bp, Heterodera glycines
tggtggtcagcagcgcagcagcgaggaacggcgcgtgcacatgtgtgtctgtgtggtgtgtgtagggagggttagagaaatcattagagagtgaaggtaaaagtgagagagtgagacagcgagagtgaaatgaaaagtggaagagggagagagtgaaagagagagtgagagaaacaaagagagggtagagtgatagagacaaactaaacgatgaccaacaagtgaacgcatagtggacattattagcgtcatttttcggaaaacgggggggggatgactgcaaatattttaattatttttctcgtgttttttcaggtcaaaaaatttttactcaaaatgtccggcaatttggttgtggctgaaagtgacaccagttttgacgcaacaaattctgtgagtggatggggagggggattaaattatgaagaaattcaatttttatttttgtttagtcaatcattgacaccaccaaagcacggcggtggacgatggcattggcataacagctccacaggaggttataggggggggggtcgagatttaagaagttttaaagaaacaaaaacttttgtttttgttttgcaaggtccaaaacagtggcggaacggtggaaaacgacggcaccgtcgtcggtggcacaacagtcgg

SEQ ID NO: 18990 - DNA, 3091 bp, Heterodera glycines
ttgacgctggccatcaagttgtgtcttaaaacaggaacggacacgaccgacctgttgttgtagtagtaatcgatgagaagtcagctccatctcggcggtatcgccaggcggaggcccgttgagatggtgctgatgaattgttgttgccagcgctccgattaattccgttccttccgagtgcccatccgattggagagtcccaattggagcaccattctcaaaagaggccgtgtcttcacgtccaatcgaagaactggacgcattttcaggccgatctgtaacaagaaggggattcagacgattgaacagaggaagaggaatcaaagtgctaattgtaagggattccccgacaaaccctccccgtgactgtcactgctgtccacaaatccgctgggcccaggcgctcttttgtggctgtacttcttcagatgcatcttcagactatggcaatatttggtctgataagtgcagtcctggcagcggaactggtagacaggagtgtgcgacttcatgtgggaattcagcattgacttgttgacacaagctgaacgacagaagcggtgtttaattgtagtccgtccttttcttactgtaatcacaaatggagcacttaaaaggtttctgtccgttgtggttacggtagtggtactccaagtggtgcttgtattctgtcacaaagtcacaaagttcgcaagtcaactgcttttgcttgggtatatgcaggcgtgcgtgtgcccattgctcctctttactgcggctgatgttctgacatgtcttgcatttgtactgcttcggcttccccgatcttcgtggcgtgtcctgcttctcatcgctgccgttctgtgctgcgttttgttggtgaatggcatcacttccgataagcgactgaaatggcgcttttgcgtgtctctttttcggtttgctttgcgctgcttaccgcttctggcccaatctgtaactctgcgatgttcagtgtgcctgctgtcgatgtattcagcagggcggtgtgcctttccgtcagggccctcagctgttcaagcggaatgtggccgaagtcccccacctgcggcgacgaattgagcatttttttgttgggaccattgttcgcaataacatcagtgcatatcttaaggagggcgtcggtggagttggagaaggcaacagaattggtattggtgagcatagactgaatggactctaaggcgagtgtcccgttggaattgtctcccgccgacaacatgctaaatcagaaaacttcgttttttgccattctcattatcatccaattgccacctgtttaatatgcttatgccatccgggggcattccttgactggcaagtattttctgactcaaacatttatcgccacttaaatcgccgttagaaggtggcgaattctgcttgagtgtcgttggtgtcgggggcggcgattggatgttaatgcctgcagcaagcctttgctctcgcttgtgcgactgcaacatgtgcttctttagacgcccttccgtgcgagtctcaaacttgcaaattgggcattggtgcgtgctgaaaatcatttgttcagttttgtcattgctcgcccaacggggccacctgtgcgtgttgcggtgtgagttgtaatggaatttcgaagaacaactgaagccacaatcaggacagaccaacgcatttgtggggaagtcgccactgttctcatccggcgcttccaagcccggcgcgcggaagaatgttctgccggtattccgttggtggagctgcggcaaaggctcaattcttccgttgttgacgatggtttctccagttgcaatgtgctcggtggtgttttgctgcagaatattgtcgtcattgctcgatgtagcagcacacactgtgacatttacgctggcacttggagagagaacgacggatgactttgttccgttatttgtacagctcgttatgttttgtgttgttggagaagagcttattgtttctattttgatagaagaattcgggacagaagtttctgtgaactggtgatgttgttgggaattcggtgtgacattatcactgactgagagagacgcgggtgcaggggccgacatgttggagatcatgcttggacaggaaaaagttcgagttttttgttaataccaatggaacatacttgagcaccgtctccatgtctttgaaggttcttcaaccccttttttcgactttcaatgtttgccattcccgtgacaacttcctttttttgccttcaacattttcttccacaaaaatagctaaacaatgagtaaaagtaagtgataaataattaaaaatatagcaattaatcatgtattaggtttcttcacctcccccttcaggccattcatacacagttggccagagttcattatgcatttagcaagaaagacaactgtaatggaagacgagacgagaaagacagcaagtcataagactgacaaaaataactgataaagagcgaaaagtagagtaatataaaagagagagtcaaacgaacgaagagagcatagaaaatgcagacggaagaggaaagagtgaaaaaaggacatctttttcactcacctatttcttataggcaaaaaattccttttttaagttcttttcattgaattttactttctctcttcccgttctccctttcttttctttcttctcttatttccttttccatcgctctttcgcactctttcatttctcttactctctctctctttccattgcttttctcattctttcccttctcacttcccctctctttcttctgtcccttttgttgcctgttcgtttccaaccctttgattatctttcttcgattcttcgcaatgaaaaatacctggagaaagattagcagaagagcgacaaagagaaagagagaatgaatattgaagaaaaagaatggcagagaaagaaagtgaaagaaacataaagggagaaacgacggctgaagaaatagaggaaattagtggcaggcaactggtttttctttttgagcgaatgcaccacaagaaatggaaaaacactcattgcctctcccccgccgcatgtcctttcttttgctcatttttgttttggtagggaattt

SEQ ID NO: 18991 - DNA, 1718 bp, Heterodera glycines
  misc_feature (1564)..(1564): n is a, c, g, or t
  misc_feature (1596)..(1596): n is a, c, g, or t
cccccccccccccccccgcccttcaaaattttgaaaaaaaaaataaaataatagaagactcaggattttgaaatttttataacaactgatgacaagctaatgtgataaaacaggttaattcttttcctttcagtatccctgcaaagtttggggcgcttctgataagtttctgaaaaaaaagctaagcctaaactttttggcctgtttaaaaaggaattaaaaatttttaaaatatttattcatctccttttttgataatataagagtcagagtgccttattcaacttgtaaataaattttggatcgcgtttcagagcagtttctgaaaaaaaatttatgaattaattttgcaaaaataaataaataatgaaccctcctccttaataattttcctgcgcccatggtactcactcggccgcttcgaggcctcgaggggggccttcggccacccccccccccgcccttcatttttttgacattttaaatataattagtataatgagccggactaaaatcttaatctacgatatgctgaaaagcttctgatgaaaatgggagaagttatgaacaattctctgtcacagattatctagttgacattttttatgactatcgccaatttgatagattttgactatcgtcccagcgacaaccctactccaagagaatttatatagactactcatgcacaatattcaatagccctacaatttatgtgttcaattcggcaaatcatagataaaattaattaattagtgggcctaataaggaatataaaaatattttcccttcgattttcattaaccttttcgtgcatattttctcgctgttcgcctttgaaagacatgaagcagtgtgccgcggtcagcacatgctgcggcccaatgattgatgccgtacaacagaatttgttgccaccaccgccacaaatgccggcctcgcgggcaaacagtgccaccaaccatggccatttgttgtttgactttaccggattaccgtggctgatcttaatgggagaaaaaagcacaataagtaggcaacatacaataaggccaattataggagaaagatccttaaattgtggaaaatttagaaatttttgtatctgagtctgcttaatcattgttatggttttcgtatattataaagcggattttatctaaaaaaaaatctgaaaaaaatgcaaaatttcattttcttaaattcaaaatgctaaaaatagatttaaagatgagtattgaataggcaattcaaaaatgttcagcaattatgccgtttttttccaaaacactgtcaaatgtatgctaggattaacaaataaaaaatttactttaaattgaaattttgccaattctgctgtttcttggtaatatttgtccctttctcgaaatgtgccgcattcgtaagcatttattcggtgcacaagcaccaaagaaaatgccaacaaaaaatatttgtaaagcatttaccaaaaataaatgattattatttttatttaaaatatttatgaataagcaaaaatgaaaatggaagtgtaaatgtgataaaacattgaataaattanatgtttaatcatcacatgtttttctttttgancaagcgaccaaatttattctctccatttacgaaatgatttacaccagtgtaaattattacgatgaatatgttaaaaaatttaatataaaaaaaatttttatgaaaaaactgtttttaatccg

SEQ ID NO: 18992 - DNA, 1541 bp, Heterodera glycines
  misc_feature (164)..(164): n is a, c, g, or t
gaaaaaaaagctgaaaaatttttccaattgcatcagatgcagactcaaattctcaaacaacataatgtaaaaaatattacgcaagaaattatttttacatcctttttagaaatgctgcataaatttttattgtaaatagtcacaaacaaactttttatcactcncaatatctaccatttatcattacaaaaggcaatggttaagcactgagatataaaaaaatcgtctagaataattatctcaacaatttgtcgggaaagatgaataaatttcagttgcaataggcatattggctcaatacataaatgtagagcaggctcaaaatagaggaaataccaagattaaaaaattcgtgtttatcccccactctgctttggctggccataactcgccagagagtggagatagaccctttgttgatacatttgaaaatgtagagctcggctagcgcattcgaataacacaaaatttgttttcatttgcccccaaacaatccgcttatgacgcgccgaaagaaaattcacaaaaatttggcaccggaaaaactccatttttttatgggccagcatagtaaagtaaacccaaaatgtaagggaatttaaattggtgatgagagatgtttagttttttatttgccccatcctttttctgggaaaaaaaagctgaaaaattttccaattgcatcagatgcagactcaaattcttcaacaacataatgtaaaaaatattacgcaagaaattatttttacatcctttttagaaatgctgcataaatttttattgtaaatagtcacaaacaaactttttttcactcccaatatctaccatttatcattacaaaaggcaatggttaagcactgagatataaaaaaatcgtctagaataattatctcaacaatttgtcgggaaagatgaataaatttcagttgcaataggcatattggctcaatacataaatgtagagcaggctcaaaatagaggaaataccaagattaaaaaattcgtgtttatcccccactctgctttggctggccataactcgccagagagtggagatagaccctttgttgatacatttgaaaatgtagagctcggctagcgcattcgaataacacaaaatttgttttcatttgcccccaaacaatccgcttatgacgcgccgaaagaaaattcacaaaaatttggcaccggaaaaactccatttttttatgggccagcatagtaaagtaaacccaaaatgtaagggaatttaaattggtgatgagagatgtttagttttttatttgccccatcctttttctgggaaaaaaaagctgaaaaattttccaattgcatcagatgcagactcaaattcttcaacaacataatgtaaaaaatattacgcaagaaattatttttacatcctttttagaaatgctgcataaatttttattgtaaatagtcacaaacaaactttttatcactcccaaatatctaccatttatcattacaaaaggcaatggttaagcactgagatataaaaaaatcgtctagaataatta

SEQ ID NO: 18993 - DNA, 1265 bp, Heterodera glycines
agttttgaaccctctatcccattaaaaaaggcataaacattttgaatttttttaaatgataatggaaagccgaaccaatttgggtacctccaattcgattaacaatgaggaaaattttgtttgaaaatcggttaaaatttaaaccttgtatttcacattaaatgccccgttcgtctccataatgcttcttccgttcactttcttcaacaacgcattgggcaagtggttgaaaatgagcaagacggccgcaatttccaccgtgtcaaggctgaccaggaagtcggcgatcagaagcttctcgtccgggagcagcgcatttggcatcaaatcgacctaattaaccgggagtaattaagaccaattacacggaagttttgaaccctctatcccattaaaaaaggcataaacatttcgaattttttaaaatgataatggaaagccgatccaatttgggtacctccaattcgattaacaatgaggaaaattttgtttgaaaatcggttaaaatttaaaccttgtatttcacattaaatgccccgttcgtctccataatgcttcttccgttcactttcttcaacaacggtatgagcaggtggtcgaaaatgagcaagccggccgcaattttcaccgtgtcaaggctgaccaggaagtcggcgatcagaagcttctcgtccgggagcagcgcatttggcatcaaatcgacctaattaaccgggagtaattaagaccaattacacggaagttttgaaccctctatcccattaaaaaaggcataaacatttcgaatttttttaaatgataatggaaagccgatccaatttgggtacctccaattcgattaacaatgaggaaaattttgtttgaaaatcggttaaaatttaaaccttgtatttcacattaaatgccccgttcgtctccataatgcttcttccgttcactttcttcaacaacggtatgagcaggtggtcgaaaatgagcaagccggccgcaattttcaccgtgtcaaggctgaccaggaagtcggcgatcagaagcttctcgtccgggagcagcgcatttggcatcaaatcgacctaattaaccgggagtaattaagaccaattacacggaagttttgaaccctctatcccattaaaaaaggcataagcatttcgaatttttttaaatgataatggaaagccgatccaatttgggtacctccaattcgattaacaatgaggaaaattatgtttgaaaatcggttaaaatttaaaccttgtatttca

SEQ ID NO: 18994 - DNA, 825 bp, Heterodera glycines
tgaaaattaacccaaaattatttattattaataaaataaaaatattttaaatgaataaaaattagaataacagaaaaataaatagaaaaataatgtgttacaccgtccggattcgaactttgccccccccccaaaaatgatgcctcagaatccccaatcacacagggattctgaggtcttaacgatgtcaaaagtaaaatctgatcacgtattcgtgatcagcggcccaaataacccctaaagacatgtttttggaagatttttggtgaaaaaattttcaactcaaaaatcctatgctcacccctttggtcccgaatctcaaaatcacttttatttttataaaaattcttaaaaaagtgataaaaatgccaaataaaatttatataatagagcaaaaaactgcggatttttgtagtattttatttttccagaatatcttttcagaaccgagttatgaatttttttctgaaaattcgaatttttccagaaattctggaataacttttttccttttttagatagaaattccaaataaagtccataaaattctcctgatttttctctatttttaaggctttatacctgtaaaattgatcaacccttcgatttgttatgaattttcaaatattaggccaaaatcccgagggccaaaaaattgccaaaaaataaagaatttttaaaaaattccaaaaattatgaaacttaaaatagacatcatattcgtactcagtaccttattttaccccagaaaaatatttttcacccccattttcgtccgaaaaaaaatttccgaaaatttctagggggcctagctcgaaaattttt

SEQ ID NO: 18995 - DNA, 1370 bp, Heterodera glycines
ttttgtatattttggattcttacagggatctggcacattttttttcatattatgtcatttttttttttggcattttgggcaatttttaaaatacgaacttttcgaccatacaaaaagcaataaaaaactttttttaccagtttggtagtcaccttgtcgcactctttttctataataaaaatatttaaaaattttaaattaaaaaaaaaccaaaatattttttaagactgagtccaagtctattaagccaatgtttttttaaaatttttatagtccacaaaaattaaaaatctatgaaattttaattaatctccactgccgcccacctcaaatgggtgtccaatgtgccgggttggccaaacgattgggcacacacattgcacgtgtatggcaaatgtttgccggatgaggacgaggaggaggatggcctcttcaccgctttggaagtgaacgatgatgagcatggagaagcggatgaggcggatgagcaggaggggactgagccgggagcgttggaaggcttaaatttcaaaaaaaaaaatttttttttttgaaaaaatttacggcattaattggactgggaaatcgttaatgggaccttttgctcgagcacaaatctcgagagtcgagactgaaagccgattgaagtgatttgagatcagctagtttcccctccccctcggagaaattcataaaaatgcatttttttctcttgttgagatcgttcgtgcgattacgcaacacgtattttcatattttgttttgctatgtcgggcgcttcgcgcccgttttttaaatttgttaagttcggacgggcgtttcgcgcccgtttttaaattttgttgggccttttcggccgcttcgcggcatagtacgggcgcttcgcgcccgtttttcaaatgttgttttgctctaacgggcgcttcgcgcccgttttttaaatttgttaagctcagacgggcgcttcgcgcccgatttaaaatttagttgggccttttcggccgcttcgcggcctcagaaagaggtacaaaagtgataaaagaggtacaactgtgattagaagaggtacaacagtaattagaagaggtacaaaagtgattagaagaggtacaaaagtgattagaagaggtacaaaagtgattagaagaggtataaaagtgattaaaagaggaagaacagtgatgagaagaggtataaaagtgattaaaagaggtacaacagtgatgagaagaggtacaacagtgatgagaagaggtacaacagtgtgagaaggggtacaacagtgtgagaagaggtacaaaagtgattaaaagaggaagaacagtgatgagaagaggtataaaagtgattaaaagaggtacagcagtgat

SEQ ID NO: 18996 - DNA, 1753 bp, Heterodera glycines
  misc_feature (328)..(328): n is a, c, g, or t
ttgtttgtcacaaaaaggccttttcaatgtttatattggcccttacatgaactccctataagattatggaacttgttaatatgagaaaaaatgctgcagaaaaataacctgaaaatctaggagaacattattaaatatgtaaaatcaaaaaatgataggttctgaagtcatatttacaattttcatattggcttttttgtagaccattataggtcatttctagagatttatagttccttttacgtctgattccacgaaaaggtcagcttcatttcgttgttttcattggtggagcttcttcaggatctgctaagtccccaccacaccnaattatcgggttagaaataattcttcatagcaaatcattggctctgttgcattggctttgtttgtcacaaaaaggcctttcaatgtttatattggcccttacatgaactgcctataagattatggaacttggtaatatgagaaaaaatgctgcagaaaaataacctgaaaatttaggagaacattattaaatatgtaaaatcaaaaaatgataggttttgaagacatatttacaattttcatattggcttttttgtagaccattttaggtcatttctagagatttatagttccttttacgtctgattccacgaaaaggtcagcttcatttcgttgttttcattggtggagcttcttcaggatctgcttagtccccaccacaccaattatcgggttagaaataattcttcatagctaatcattggctcggtttcattggtttgtttgtcacaaaaaggcctttcaatgtttagattggcccttacaatgactccctataattcaaatataaataaaaagaaaaaaaatattaaaacgaaatataatcaaaagaataagcaacaaaaaaaaatttaaagtcagaaaaatgaaaataaatatataattaaatcagagaaatatgaaaaagccaaaaaatttttagtatgaagattttaacattattgtaggctaaaattattataacacagaaatgtttatatttcattgggtattttaaattcttaattttcaattaataattcaagtatcaaaaagcaccaaaatcaatagtgtgaaaacaaaattaaatcgaaaaatcaacgttaaatcaattttaaaaatagtcattgaaatagggatacgattaaaaattcttcatagttaatcattggctctgttgcattggctttgtttgtcacaaaaaggcctttcaatgtttatattggcccttacatgaactccctataagattatggaacttggtaatatgagaaaaaatgctgcagaaaaataacctgaaaatctaggagaacattattaaatatgtaaaatcaaaaaatgataggttctgaagtcatatttacaattttcatattggcttttttgtagaccattttaggtcatttctagagatttatagttccttttacgtctgattccacgaaaaggtcagcttcatttcgtcgttttcattggtggagcttcttcaggatctgcttagtccccaccacaccaattatcgggttagaaataattcttcatagcaaatcattggctctgttgcattggctttgtttgtcacaaaaaggcctttcaatgtttatattggcccttacatgaactccctataagattatggaacttggtaatatgagaaaaaatgctgcagaaaaataccctgaaaatttaggagaacattattaaatatgtaaaatcaaaaaatgat

SEQ ID NO: 18997 - DNA, 1059 bp, Heterodera glycines
atattgccccttacatgaactccctataagattatggaacttggtaatatgagaaaaaatgctgcagaaaaataacctgaaaatttaggagaacattattaaatatgtaaaatcaaaaaatgataggttttgaagacatatttacaattttcatattggcttttttgtagaccattttaggtcatttctagagatttatagttccttttacgtctgattccacgaaaaggtcagcttcatttcgttgttttcattggtggagcttcttcaggatctgcttagtccccaccacaccaattatcgggttagaaataattcttcatagctaatcattggctcggtttcattggctttgtttgtcacaaaaaggcctttcaatgtttatattggcccttacatgaactccctattaattatggaacttggtaatatgagaaaaaaatgctgcagaaaaataacctgaaaatttaggagaacattattaaatatgtaaaatcaaaaaatgataggttttgaagacatatttacaattttcatattggcttttttgtagaccattataggtcatttctagagatttatagttccttttacgtctgattccacgaaaaggtcagcttcatttcgttgttttcattggtggagcttcttcaggatctgcttagtccccaccacaccaattatcgggttagaaataattcttcatagctaatcattggctctgttgcattggcattgtttgtcacaaaaaggcctttcaatgtttatattggcccttacatgaactccctataagattatggaacttggtaatatgagaaaaaatgctgcagaaaaataacctgaaaatctaggagaacattattaaatatgtaaaatcaaaaaatgataggttctgaagtcatatttacaattttcatattggcttttttgtagaccattttaggtcatttctagagatttatagttccttttacgtctgattccacgaaaaggtcagcttcatttcgttgttttcaggggtggagcttcttcaggatctgctaagtccccaccaca

SEQ ID NO: 18998 - DNA, 2091 bp, Heterodera glycines
  misc_feature (1985)..(1985): n is a, c, g, or t
  misc_feature (2029)..(2029): n is a, c, g, or t
tttcagcagcaacgcgccactcgcgttcctccgggatgggtccctttcgtcttccgcctcctcttccgtttcgtgcttccgccattcgccgtcccttccgcctgcccaattcgctttccttctcttccgcaaccttcgtcctgtcacttccctcccttcgtccacctcaatttcgtcctcacagccgcacactgaactgttcattggtgccccatttgaatccgtcggattacgaatgggcgatcgaagagagtcggaagacaatcggacgaatgggacggatgacgggcattgaatacccactcgagaaattgacggtagtattaagacagactcggaatgtgataactgtttttgtttgttattagttggtatcgtcgcctttgcagacgggaaacgacgccattggggcactcggattggcacaaatccgcgacagttgggtaagacggggaaagggacagacagacggggggagagatcggactgatcagaccgagtcgaacagtccgagatcatttgtttggcagctgtccttttctttagatggaatatcccaagttcgtccacacccacgaacttctgattggtcagctcattcgccaatggacttcgaatgtgctgagtttgtgcgaccaatgccttcagaatgggttcggcctttacttggaatggctggtcggctctgaacaactcggcgtggagacaaacaccgaatttgaccgccgactcggcgaagcgcgcgaccgattgatggggggaaatgcgaagacagaggcaaaaaacgaacgaaaacgaaaggagcgaaaggaaatggccgactttagggcccaaaggaatgcgcagaacgaatggcagtcgtactgcacatgttggagaggacattcggtgcgcaaaacatcacaaacttcgtcagccttttgttccgtcggtacggatgggcgccccgctgcacttcgaccgccgagctgagcaaattgttcaccaccaccgtcggcatgccggaagctcgttcgtttttctccctatccctcacccgatccctccaatttgcccatttcttcccctttttctaatttgcccatttcttcaatttccccgtttattccctcccctctttttgaactgctccaactccttccccttcagaacgcgtcttcgattcgttcctccgtccctctgtgtcttcgccttcccaaatccctctcgtgcacatttccgtccgtcctgcccattctctgctccgtttcactcaattttcctccccaaatgtttcgtcccttctgtccattcccgtcgaaattgtcgacgacactctcaaaagtgtgcgtttggtgttgaacacttcccaattggacgttccttttgttgtgtcctctttcgccgttgctcaacccaaaagcacttttgcccgttttgtttacaatgtgaggagacggaaaatggcactcaaattttggccttcctttaaaaggcagaaaattacgcaaaattggccaaatgtatcagcaaaggacagaagcaatcggacgaatgcccagcaataagcgaatccatgctgaaaaatgtgtgggacgacctttgttggtaattaaaatgaataaataatgaatgggtccaagagccccggggggattttatttgggtaattaattaacattcttcttttcttttggggctttgttcaacgggcgactgagtccgacgaccgatgaaaaaccactggtcgccgacgtttcagtacaatccgacgattggccgtcccttttccgagttttgactacacgcggtggcgtaaatgacgattgcgcgtgttgcatgaaaacggaggaggaggcaatgggcgggccgtgccggtggacatggctggacagatgcgcacgggtgatcatgccgaagaaatgattggacaaagttcgagacaattttcaattccttcaatagctgacaaatgagaaggacggggagcgggagacggaactganaaccgaacaaaattggaaattttgggtcggtcttatcgggtggnggcacatcaaaatttcacaccttttattaaaacaaaaacccttttgctttttgctcaattga

SEQ ID NO: 18999 - DNA, 645 bp, Heterodera glycines
tatcaataggtaggtcataggtcctaaaaatccccaaaataagtgctaaatctgcgataataggcgccaaaaagttcctaactttaggggtgtaaaattgaaaattttcatcacaaaccaataattttttatcacgtcattaagaatatacatagaatccagaagcgggcattctactctagacacatatcgtcaatcacacccccgaggcgattttctcataaataatttctacgttagcaatttttttaaaaaaaattttctcggggggaaacgatgcgggggggaaccggcgggggggggaaacgagctgctccctatactcccacccccccccccctaaaagaaaacaaaattgacgaggatcggttgtaaaaagcagcaaagtgcagaggtcattcaaattgcaacacaaatagggaaaggaacggcacttggagtgagacgaaacattggaattttactaaccaattcagcatttaattttatccgatttgaagtgccgaaaatcctttccgtattaaaaaatgggccactcagtatggcttgggacataaatattttggggcagattcataaccagaaaaacggaggggggggggaaatcgtctttttccttactatggacccaaaaagttatcgcaa

SEQ ID NO: 19000 - DNA, 1012 bp, Heterodera glycines
ctcctcctcctccttttccttttcttccctcttcgctggttcatcatttccttccttcttcttcacaaacgtgaccatcacctcctcattgccgttctcgtcctttctcctcgtgaactccatccttacttcccctccggggtccttcttctcttccttgtctccatgatcttccgcttttctaaatgtctctgtttcttttccatccttttgtgcttccttttccgctttgttgcgcgctttttcggccttatctccttccttttcggctttatctctcatttcttccactttatctcccttttcggcgttatcttcctcttgttccactttatctccctccttgtcggcttttccgcccgttttggtagcccattcgttcagtttgtccctcctcaacttcacttccttccccacgtcgtccatttccactgtggcttccaatgcttccacgaaaagtgccaagtcgaactgttccggtgccgttgcttccatcctattttggttggtctccaaacattcccaattcattttgaccaatagtgctgcttgggcaatgcttaactgtgaagaaatttgtgccataatttcggccgggcttttccatgggttcagtgccgaaatggctgaattgacggcaccgatgtccgatcggacgcactcatctgagaggggcacggaaaattgttcaacatttgagtacgacatggaagctgggctcaataggtcttgagctaggctcatgcaacgtctttggcaccctgcttgaattttttgtctaaaaaaccctagcaggcggtctacccttccagttcggccccgcacggttaggccccagccaagttttttggctgtaacttttttctttgtcaaccaaatccaacaatcttggtgttcttcgaaagcttaatgggtttagaagctttttctaagctattgcttggcaattaaacaaatataatatgaaaactgaaaaaatcaattttttgaagatttttcttcataaattttt

SEQ ID NO: 19001 - DNA, 1578 bp, Heterodera glycines
ggatggatcatgtgatggccacaaaagtgcattgcccctcctccaaaattaggttagagtgataaaattgatggcattttatccatctctctttctggttggcattcattataaagggcaacaaaaattggccgattggcagggggcggggaagggtaatgctttgccgtggaatgtcgtggcataaggccttcaacattgtatatttggggtgaaaaagtaatttgtggccaaatccaacaattgtggggcccaagcgattgatgaatggataaaggatggccatcaaagtgcatttatttgccctcccctccaatttgctgagggtgccgtgaatgcattggcacataccatacaatgccatgaaattcatgcctgattctattacaactattgtacaattggggggggggggggaagagggtaatgccatgccatgaatgaatgaatagcgacggcatgccaaattatcccatgatttcttctccataagcacacatttccatggcattaacatttacacatgtcatatgattaaggatggcgaattttctgttgccctttgcactttctctttctctaaaatttccaaaaattaatagttgggatttttagggattttgagttgttctcaaaatagtcattctccttctgctgtttggctaagctctaggacaaggcctattatcttaagacggccaacaaatccctaaatccctgctaaatgccaagggtaagacgagatttatgtttcaagaacagtaacagaaagggcatagagtctttgaaaaatcaaaaaaggacaacaaaaaaggacagaccttggaaatggcaaatattgatcgtaatggatggtcttgatcagaaaaaatacatcattgttgttggtcaacatttcgggcgacatgtgtccagcagccctgctgattgattggaagggtcgtgggttcgagtcccatcgggcgagtaatcttttttatattttacaattgtcggagcaaaaaactttttgttttgtcgcaaattttaattatgtacatcatttgattgtttgatctgcctttggcagaataagctcacttccgcgtgatacaacaaccatttttgtattaaaataaataaatagaaaaaattcggataccataaatcttgcaattcgaaatttaaaacgcttcaaaaaaaggcaaaaatttactcaactagaaaaaagcagagaaatgggacatcaacaataaacagagaccgaataatatgatcacagaaaaatgacatttaaattttgacagtaatcaacctaaaaaaaacgggaattcgatcaatcatcgatggaatctccgatcagatccatcagcagcaaagcgttcattcatttgccaccctatttgcccaatttgctcaaaagtgtgtccaatttttggtcgagagtctcgatttgtttctgttgcttttcaatcagttgcataatggcactaattttgtcaccattgttcttcaccagagtccacatataaatgggctcatcaaaaatatctttattggttttggccacacctgaaaataattaggaaaaaagaaaat

SEQ ID NO: 19002 - DNA, 1602 bp, Heterodera glycines
tgacaacaaaatttgtttagccttttcaaaagcttgttggtgtttttcggtccaatcccacttaatccctttctttaacaactcgtccaacggtccacggagttggtgaatgtttttgatgtacttcccgtagtagtttattgcgccgagaaatgaacgcaaagtggtgatgtcatgtggtggcggcatttgttgtaaggcaagcgttctgcatggatcgggacgaattccatcagccgagacaatctgacccaaaaatttgatttccttcaccaagaacttgcacttttccatttgaacgtgaaaaccaaactgttgaattctctgaaagaatttgaaaatttgttgaaaatgttcggtgagttttggacgcaataataaaatcatccatatagcctaaaactcctgaaattcctgccgccaattgatccatgatccactggaaaatgccaggtgcgcttttgatgccaaatgccaaacgttgacattggtacaagcctcggtgcgtgttcacgcccaaaagctgcgtgattgctcatcaacacaaatttgaagataagcatccttaaaatcaatttgtgagaagaatttggcaccactgagtttggcaaaaagttcatcgggacgtggaagtgggtggtggtgcggttccaatgcgttgtttaatccggtgctgaagtcgaagcacagccggactttgccattggcttttctgaccgcgacgattggtgctgcccatttgctgtagtcgactttttgcagaactcccaactcaatcattacatttggaaactgagcctgtaactcttctttgagttgtgtcggcgtgcactccgtccctttgatctgaacactgtgcgtctttgcgttgccgtccaacagtttgagacaacgatgtcgcaattcggcattgtgttcgcctaaaccggtgatgaaaattagactcttaatttgatccttggtaagatccaatttcgctttttctgccattgcgttcacatctggtgtttgtggttgaatgctctcagtgtaacgcttgtacacatccgtccccaatttacttacaatgagtcggactttgctctgctctgacatcggcttaccctcctgttccacaaatgggccgaaccgttcataccattcctcgaaagtgcggttgtcgtggggctgtaaacgaattctgagatttgggcacttaatttgcaaaacaagtccatgtcattggactgtgactgattttgttgcggttgtgcgttgccgagttgaatattttgcaacaatttcatgaactgtgactgttgatcagccaaaatggcttttagttgctccgaagtgattgacatgattgataggaataacagtgaatagagaaagtgaacaaaatttggccgtcagtgataattttgttttgaatttttattggcagtaaaattcgatgtttgttgagtgatattaagtgtcctttggcgagtggaaattgcgaatttgaactgcacgcagcggtcgttttgacttgcgtgtcccaaatccgtctttccttaaatgggtgttcacagaggcctacttatcagcttgtgaagccaataaaggcttttccctact

SEQ ID NO: 19003 - DNA, 659 bp, Heterodera glycines
agattttggcaccgaaggaactgttcttcgtgaggacaccgtgcgcaaaatcggagctttgaaattgagccgttgtgaagaacgtgctctgtaccatgatggaacaactcgaccgtttgttggcaaaggaaatgcaacattttcgtttggaaatcgtacagcatttgggcatttctttgtttccaaagtcggatccaagaacttactcggaatggatatgatggacagactgggattgtcggacaccatcaggaatgatctgaaagataacttccagactgagactgccaaattgaacggagcgagcccgaagaaagataagaaattcttcagaaaagacggccgtggtaagaagcagaacttcttcgccgttggagcaaatgtgatcgccagcttgggagatgaaccatggcgtgccggacgtgtgatcagccagaaaagaggcctttacaacgttcagttttcggacggcacgaccggagaattcccggcaaagagtgtacagccgtacatgccggacgaagacgaaaatttgaattttcttgacggatttggactgaagagatcctcatccggtggacctgtcgggaagcaccaaatcggcagtgacggccgacgagatcaattggaagatgatctccgagcttccgactggaaca

SEQ ID NO: 19004 - DNA, 1576 bp, Heterodera glycines
  misc_feature (17)..(17): n is a, c, g, or t
acagttgccaggttacntctttttttcactatatagtattctaaaagagaacataaagagctgtattaattagataaactcttttccgaagggaaaattttgaaatttacaaaaaaaaaatcaaatttccgattaacttttgacgtccaatcaatgaccatcctgttttttggccataactttttgttactttgtcaaaataaacattcttggtatcaaactaaagcttagaagaaagcaaaagttggcacaagaaagcagtcacaatgagaaaacaccaaagtgcgcgaaaagccattttttgtatgcgacaaagtaaaatcaccttcaaaattgagatttaagttaaaaaaataggggaaaatataacaacaaaaaaacggcttaataaccatagagttcttagagtttacaacttgcgaaaaattgaagggaaacacaaatttttcatttttgtttctggattttttttaattgggcaaaatgccaaaataaaataaaactaaaatttttgaatttttagaacgcaaaaaggaaaaccgtaaagcagagaattaggaaaggtggccaaacatgaacaatcgcttctagggattgcatttcatcaatattgaacaaaattggacatattttttaaaattttaaacggcataaattagacattttttaaacacatgattttctgcctgcctacttaagttaatgtcaattaacattttaattaatgatcaaatgtatttgttgacgttgttgttgggcgctctttttaaaaaacagtaatttaccataaaactttgaaaaaatcgctaaataaattttcaaaaatttgtttcttgaaatttcttataaaaatctttttttaatttctaaatttgaaaaagatataaagtttttaggaggggagaacgagcagtgctctcagaataaaccgttgtggattcgattattaaattaggtaacaatccaaagagaatgaaatggaaacaaacaaatttttttttttttgatttatgagaatggagagaggtataataacatataaaataaaataagataaaaaggagaaaaaatattgataaatttgcaattaaaatatggaaacgcaaaaaataaaaataaaataagataaaaaggagaaaaaatattgataaatttgcaattaaaatatggaaacgcaaaaaataaaaataaaataaaaaataatatttgtgtgtgtttcataacaaattgagaaaaacgaaaagaaaaagagagactagactgatcacaaaaaatctcctagcagcacacagaagagagagagaggagacaatttggtggatcagttgtaattgtggtggtggtggtggtggaaaataaggcggggagggggtgaactgtgttaattagccttccccctccccaccccgataaaatgtttaatataaaaatgattgagtcttattagtgcagggggtaatattataaaagggtttgactaatgctaggttggtgggggggggggggaagatgtcgatcaaatgtaaaccaattttagaagaattttaatcggtatctgtcgaaaaatgaaaatttt

SEQ ID NO: 19005 - DNA, 1431 bp, Heterodera glycines
ctagagaccggcgggatcgggactcccgcgggattttacgggagtcctgctcccgactcccgcttttttcggtgaacgggatttttaacgggagcgggattttaacgggattcccgttcgggactcccgtcccgtaaaattttgaactcccgatcccgctcccggaaatttttttttaccggtctctacaccctgcttttcatttatatttgctaaaattgcaaaaatatcaaaagtgctaaaaagtagaaaagatgctaaatttgtactaaaaacccgaaaaaagtgccaaatttgcgctaaaaacccgaaaaaagtgcaaatttttgctgagaaaatgccaactttgtccaaattaattttatcaatgttatccacccagctagaccgcacttttaatgaatagtcggaggacaatcctcggccacaatgtgggcaaaaatgtgcggacggatttgtggacgatttgtgcgactttttcgtgcccttgctcgccgtcgtcgtcgtcatgttttgttgttgttgcgttttttcggtgcccaggagtgccgtcgatgactgtgccggtggcggtggtggtgccgttgagctgcccgtggggccaatctgttgcaaatggtgttgttgctgggattggttttggtgttgtgccattggttgtgggtgctgctgctgctggtgatgatagaatggtggcatcggaagcgcacccgaagcaatcggatggtcattaccaccaactgttaaaaaatggcttttttaaatggtgccacaattcgtgaccggaaaatgggtaattgtaaaacagaaagggacaactgggcgatggccaactgggtcacgggaatcttcggtcttgagtgccatacaataatttaggcaccagggatgtgtcggaatgccgatttccggcatttttgtgtcattagaattccgattgccgaatttatttggccgttggaattccgatttctgaaatttttgagagcgtttgcacaaatccttgttaggcatccccgaactaattggtcgcacttcattagcaattaatgataatcgatttaaatttagcaccacggtgaaatctgttgtgatgaggaagatgatgatgatgttgatcatcaccaacagcaatattattgggcggaggtggaggataactcgtcgcaacatgttgcggatggttgtgatgcgggagttggacgttgccatatgagtacagttgctgctgctgttgctggtggtggtggttgaacattggcatttgctgctgctgctggcttcccacatttgcacctgctgctctcattaacattgtgccatcaccgccggcatggacaccaaaagggtggtgaagttggtggtgtacacgctcgtcctgtaaaagaggaacaaaaaatcaaacacgattaaagccaatcaatcaatgat

SEQ ID NO: 19006 - DNA, 3654 bp, Heterodera glycines
ttgtaccacacatttttaccgtacttgctgtagaaatgctctgaccgtaccgcaccgccgttggccgagatcagctgaccgtctctgtcgtaatagttgtcggggttgttgaactgctcgaagtcgaagtactccggaccgaccactgttgtctcagtcgtcgcttggtccaggtagcgccgccacgtctccgtccggttgagcagcagcaaatcgccgatgatgatcattccatggctggcgcgggagatggcgacgtccacccgtgcggcatcagcccagaaaggctgagagtcggctccactgtcgaagacggagcatgttgtgacgacgacggcaagtgacgactcgtggccctgtgtcgcgtccgccgtggtcactaaaatgtccgggatttcttgttgggccaccaaccgttcgatctccagggcttgggcggcgtagaagcaaatgcagcggatgagtgtgccggggaaggcccgcgccaagcgccagagggctctcatcgctgtgtcggtttgtccaggattgggcgaagaggtggacacttcgtcgcgttgcgcaggtgtgctctggtggaccaaaattagagggactccctttttcggcaatttgaaggccgtttggtcggtcatgagtgcccgctcagagtcgtcgcgtcctggtgtcaactactcggcgtgcggtttgtaaaatccggcctccgtaccgcggacgagagcagaatgtgagcgaaaactgaccgataatgttgtgacgtccgtcccttgtgcaacatccatgttttggatgaccgtgtccatgccgaagtcctcacggacggcgatcggcagggagggcaagtggacgcgaagctcggcggcgatcaccggtgatcagcacctcggttaggcaggggagttggcttactaagttgaggatttggacgtatggcgcctcgtccggcctcgtcgatgatcaaatgcgtcgtttccccaaacagtgccggcaattgctcacagaaggacaaggtggcgaagcacaggcggcggtttttgtgctcctgcacaattttggcaactgccatttcctgggccaggcgtgagttccgctcgcaggcgtccaggtaccgctccaccttgacgcggtctttgtccttctgtaggagttcctgaaagtcctgtgcctccaccgcggtggcgagcaggtggggggaaatccgctcaacttccttggcatatctcaacttacctgtgccggagaacaaggcaagcatcggctccacgtggtttccggcggccagtgcgtcctgcatctccagcaccagcttaacgacggcgacgttcggcggggccagcgccaacacacgtgccgtgggatccgtggccaggaccgtggccacgatcgatgccgcgctgaacgtcttgccggtgccgggcccggcctgttgggagaccaggcgcggcacctcgtcgagcatgcacagcgcggtgtcaacctgtccctctttcaattttgaaagagtcccaaaagtcattaatgggttattggcctttgggctttccggttttaccggtcggcccaataaaattgacatgattcggcccacctttccttcgtccgttgccactttcgagcagtcattggaccgcaaagtgaacatccgttcctgcagtgccctgactgacgtctgcgggatgagttcaacgcatccgtcgagttcgccgcagcgcatctgatcgaattcctcctgcgcgtcctgatccttcgcttcttggtaggaaaggatcaccttaacatcaatttcgtacccccgacataacgccccccccctagatacgccattggtcaccttcccccgcttccctcatcaaataaaaaaaatttggggaggaggggaggaccaaaaaatatagcaaaatttggactaaaagaggtagctttataggcaaacttttggtccggcgaagcctacagatcgtcgggtcgcttcccgtgccccggaatttagttagaaacaaaatatttatattaataagttcaaaaatgaatttatttttttaataaaaaacctccagttccatttctctgatccgccgggtgttcaatttgacgagtacgtaaaggccatccggcaaaaacacctgctccacataatcaatgatatcgcctgaagaatatgcaatttttttcttaaaaaaattgaagtaaaataaaaaagtaatttaacacagggggagagtaatgcatcctaaaaaaaatctcaatattaaaaaaaaaatcacgatttattttaaatttttcaaggcgcaaatgctcctaaaatcatacatttttgggaaaaatttagacaataaaaaatattttaatttaaaatgggggatttcatttaaaaatgctttgctacccaatgtggtcttctcaatccgtgccttcacccgtcgtgccaacttttcgtcccgctcatcggccaatgccacggtgatgatcggcgttgaaatggagcggaccgcgttgatgattctatacaaatttgtaaatttttttaaaaatgccaaaaaaatatttttattttttgcttactcttttatcctgggcacgccttgggtgatgttcatggacgcaacgccagcaaagtgaaaggttttcagtgtcatctgagtggagggttcaccttaaagtatataattatttaatgagacaactgcaaaaattatcggataaaaaaattatgcgaggtaaatttttaatagaaaaaatgttgagcttttctgttaaaattttttatcccccagtggagcggagcagatcgttcccgatcatgaaatttttttaatttaccgaattttttagaagaaaaaaaagaattagattttttgaaaaaaaaatttttaaaccatgcttaatatcgcagattttgaaagaattttcttttttaattaatggcgaggcttaaggtggagggagatcattttttgttaaattaaaaaaatctatgaaaatttttttctttaaaagttcggatttttctgagtatttttgccataagtttgtgaaacaaaaagaattttttaagtaattaccaattgatgtggctgcaattgcaccgacgacagcagtgcctaggaaaaataaacaacaattgatatgattaaatgaatcaaaaactgtttcaatttatattaaataaaattatttaaaaacattgtttactcggctccgcagttgctcggctttttcccagtgcacaaatgtccaaaaattggtgcatttggccaagactgaaagttaaaaaaatataattatttcattaaaaatcatatcaattttttcattttctaggatgtttaaatgcggggaggggagagggggaattaaatgtacccaatgaatgaaaattttgtttttaatttttaaaaattaggaaaaaatggcattttcgacaaaatttaataaaacttattttcactaatttctaaaacatttataggcatttgaaacatacaaaaaataaggaggggtgtggtctaaaatctaaacaatttaattggtttttattgaacaaaaatttatttaaatccgggcaataattcttcattttccccctctcagcagaaagcaattttcttttgctttttttttcatatttggtttaatcattcggcattggttttt

SEQ ID NO: 19007 - DNA, 1227 bp, Heterodera glycines
caccgtgaggcgggacagttccaaaatgtgtaccacattttctgtggaaagtccaagtaccttaattggacaattaattgtcaacgaacacagtcgcctttggcctcttatggagcagaaaaggggaaatatcagatggggtgcgcgtcccttcctaaaaatttctcttttcgtctaaccatcccccctttttgtgcactatttcgttttaaaaattgggaacatttttttgtttgtttttttgaaactaaaatgtaaaaaattttaaaaaattatttctgattttaaataatgcttctgtttcgaatcttttgactctaagaaattaaactgcaatttttagaacaaataattctctgaagttttgaacttggcttttcaatgtttttaagcccaccgtgaggcgggacagttccaaaatttgtaccacattttactgtggaaagtccaagtaccttatttggacaattaattgtcaacgaacaaagtcgcctctggcctcttatggagcagaaaaggggaaatatcagatggggtgcgcgtcccttcctaaaaatttctcttttcgtctaaccatcccccctttttgtgcactatttcgttttaaaaattgggaacatttttttgtttgtttttttgaaactaaaatgtaaaaaattttaaaaaattatttctgattttaaataatgcttctgtttcgaatcttttgactctaaggaattaaactgtaaaatttagaacaattaattctctgaagttttgaacttggcttttcaatgtttttaagcccaccgtgaggcgggacagttccaaaatttgtaccacattttactgtggaaagtccaagtaccttatttggacaattaattgtcaacgaacacagtcgcctctggcctcttatggagcagaaaaggggaaatatcagatggggtgcgcgtcccttcctaaaaatttctcttttcgtctaaccatcccccctttttgtgcactatttcgttttaaaaattgggaacatttttttgtttgtttttttgaaactaaaatgtaaaaaattttaaaaaattatttctgattttaaataatgcttctgtttcgaatcttttgactctaaggaattaaactgtaaattttacaacaaataattctctgaagttttgaacttggcttttcaatgtttttaagtcccaccgcgagggggggacagttcccaaattttgtgccacattt

SEQ ID NO: 19008 - DNA, 2577 bp, Heterodera glycines
  misc_feature (1255)..(1255): n is a, c, g, or t
ataatacccctggggagaagggagtgggaaacatgatttcgaaattttaaattttttgtactctaatctactcaaaccggttcagaattcaataaaaataacattcacggtgcgaaaaatggggtatgaaaagtttatttgggaaaaaaagactttttacaaaataatacccctgggagaagggagtgggaaacatgatttcgaaattttaaattttttgtactctaagctactcaaaccggttcagaattcaataaaaataacattcacggtgcgaaaaatggggtatgaaaagtttattggggaaaaaaagactttttacaaaataatacccctgggagaagggagtgggaaacatgatttcgaaattttaaattttttgtactctaagctactcaaaccggttcagaattcaataaaaataaaaaaaatttcaaattccacaaaatgggaaggaaatttaaacctaattacctcttcttctcagctgttaccctgcaaaatttggtgcacttctgatcagaacgcgaaaaactatgagtgattgaattttcactaaaaagctaagcctaaagttttcgcatatttaaaaccaattaaaaaatttttagaatttttattcatatccctttttgttattaaaagcatcagagtgccttaattaacctgtaaataaagtttggtgcgtttcagagcactctctgaaaaaatattaatgaatttattttttcaaaaattcgaaatgtacgcaaaataagaataccgaaaaaatttcaaattccacaaaatgggaaggaaattcaaacctaattacctcttcttctcagctgttaccctgcaaaatttggtgcatttctgatcagaacgcgaaaaactatgagtgcttgaattttcactaaaaaagctaagcctaaagtttttcgctcgtttaaaaagcaagtaaaaatttttagaatttttattcatcgccctttttgatagtaaaagcatcagagggctttgttaacttgaaaataaaatttggtgcgtttcagatcactctctgaaaaaatattaatgaatttattttttcaaaaattcgaaatgtacgcaaaataagaataccgaaaaaatttcaaattccacaaaatgggaaggaaatttaaacctaattacctcttcttctcagctgttaccctgcaaaatttggtgcatttctgatcagaacgcgaaaaactatgagtgcttgaattttcactaaaaaagctaagcctanagtttttcgctcgtttaaaaagcaagtaaaaatttttagaatttttattcatcgccctttttgatagtaaaagcatcagagtgccttataaacttgaaaataaaattttggtgcgttttcagagcactctctgaaaaaatattaatgaatttattttttcaaatatttgcaaagtgcgcaaaataagaataccgaaaaaatttcaaattccacaaaatgggaagggaaacttaaaccgtaattacctattcttctcagctgatatcctgcaaaattaggtgcatttctgatcagaactcgaaaatctatgagttcttgaattatcactaaaaaagctaagcctaaactttctcgctcgcctaacaagcaattacaaccttctagaatcattattcgcgacccaaccgatggggcccactcggcggggcccaatcggcggggcccaatcggcggggcccaatcggcggggcccaatcgtaccggggcccaaccggcggggcccaatcggcggggcccaatcggcggggcccaatcgacccggtccgccgctgtacccccaccccttcaaaaatatatatatatttggaaaatcgagccgaaaataagaggccgaatcttggttctcggccaaaaatcgccaaattcccttgcagtatttgatcatggattactacgtgggcggtgacctgctgacgctgctcagcaaatttgaagaggagcatggacacgtgccggaacacatggccaagttttatgtggccgaaatgattttggccatcgattcggtgcatcgacttggctacgtccaccgggacatcaagccggacaacgtgctgttggacatcactgggcacatcaagctgggcgactttggcagctgcttgcgccgtcagccggacggcactgtgcgcggacaaccgcggtcggcacgcccgactacatttcgcccgagacgttgcgggtgggaaatgggggcacgggttgtgtgttgtgcatgcgcctgggttgcccatcggccgctcgagtcccgagaggaatttgtaaccatttctcacccaaaaaaaactatgttttttgggtcaaatttccaagaatatggtaaaagatgggggaaaattttttggaatttaatgtgatttgttaagaaagttgcttaaaatcttcaaaaatttgcccatttttcttgataattttttaatttttcatttcgggaggcctccactgctttgggcctgctacagtctcctaatttttttttacaatggtcgaccctgttttcaggccgttgaggacggacgtggacgatacggcgccgagtgtga

SEQ ID NO: 19009 - DNA, 2354 bp, Heterodera glycines
atcactagggtggggatttttaggggcgaaaaattccaatttagggacctaaataggggcaaaaaattcgcgaaataggggcgaaaataggggggaaaaagtttcaaatgtagaggtgaaatttattaaaattgccgttttctctatgtaataagttaaaattaaggcaaacaattttattcactgattgcagttagaaatgaagtacattccgaaattttcggggtttaagggtcgattcttaggggtgtatttttccaaaaatttttgggtcgattcttaggggtgtatttttccaaaattttttgggtcgatttttaggggtgtatttttcttttttattgcattcttgttaataaatttcctaaaaatcgcgaaataagggcgagaataggggcgaaacgccaaaatagggacaaaaacttattttaggggcgaacactcaaaatagggatttttaggggcgaacatccaaaatagggattcctagggtcggataggggcgttaaaacgaaagtttttcgaacaaaaaatgtgtttttcgtgcatttctcgtcgagttaaagccgcagaaaaaataagtaaaaacttagaaatcctcaccctacttatcacattcatcacacattttctctaaaataaaaagcaaataagcagggttcgcagatgcgagactttgaggcctacataagccgaaaatgaaaagcggacatttgcgctccgtttcttgcggaccatttttacccaatccatttgccatgccatttaatacactgcgtttttttgcccgggaaatcaaatggacggcacaacaccagcaaagtaaatgttcaaaattttcattgtaatcaaacaaaaatcatttctggccatcatagaaatggggacacaatgagtgattatacaaaattggcggctggcataactgaaaatgatgagagattatggaaaattaatgacaaaaaaaacgaaggaacaattcaaaaacattttgtgttgtgtgtgggctatgggattttactaattatgattcgatgtaagcacagaagaagaaaaaagaaaatcaaaaatgagaggcaaaaggaggagaagaaggagattttgtagtggctggctggcaaatgtaattagcgattcattggcgataatgagggtaatttgtggcggttttttcgttgtataggcaaaaacaattagcgctgtgtttaaacattaaggcaaaaaaagaaaagaaaagaaaagatgccacacaaaatcattttctttttttggacacttttttccgtcttttattgtttttggtggtcgtcgccgcttccgccggtcgttgcgctgctcaacttccccagcaaatcgtcaatggcactgatctgatgttggcgttgctgcttcagctgatgatcaatcgcttttggcttgcctttaaaaatatattttggtttttttttgttttgtttggtttggctcttggcaaaatgtttggtgacattttttgttccgaagcgaaaaaacgaattacgaccaaaaaatccggtccgaattcggaattccatttcaaattttgtggcaaaacaacgctattacattacgagctggaatggcatgaaattcgaccagtaatgaaaccatttaaaacccgaattcacaatcaattggttgcattttcattttattacatggcggtgatgacgcaattcgggcggacggagacggcggcaatttgtccagcgccatcgccgccccaacggtggaaggccgatgctgcgcattgttaccaaacgttggcattacactgctgttgtcgtggaaagagtttcttcgacgagccggcgaaggatctgtcgggaaaaaaaatttcgaaaaaatgccaaagaacaagggtctaacaaattgatgatgatgacgctgccgttgttgttcctgacgacagcggactgctcattctgggcactcggctggcaacaacaattgttgcagatggttgtgctgctgctactgcttgtcctcctcctcctcctgccccttcagcagatgacgtggtcgtcatgggttgttgcatcgccacgcttcctgatgatgccccggatgatgccaatgttcgcgcgccgccgccgccgctgtacagcgcgttatacggcggtggactgacgacgccgtacgacgactgctgctggtgttgttggtgacgttgtactgcttggtctcgagcattgggtaccgtttgagttgtaccgccgttgcccaaccgaacaatgacaggcggcggcgacctgtgcacatgttgttgtgctgcagcaacaacagtcgacggcatttgttgcccatgccgttgttgttgataagattcccctctg

SEQ ID NO: 19010 - DNA, 2033 bp, Heterodera glycines
actaatgttttttcaaaagcatgacacacattacgtgtctcacactaaagtcacagaacaaaccactaatgttttttcaaaagcatgacacacaatagtgtctcacactaaagtcacagaacaaaccactaatgtttttcaaaagcatgacacacaatagtgtctcacactaaagtcacagaacaaaccactaatgttttttcaaaagcatgacacacaatagtgtctcacactaaagtcacaaaacaaaccactaatgtttttcaaaagcatgacacacaatagtgtctcacactaaagtcacagaacaaaccactaatgttttttcaaaagcatgacacacaatagtgtctcacactaaagtcacagaacaaaccactaatgttttttcaaaagcatgacacacaatagtgtctcacactaaagtcacagaacaaaccactaatgtttttcaaaagcatgacacacaatagtgtctcacactaaagtcacaaaacaaaccactaatgtttttcaaaagcatgacacacaatagtgtctcacactaaagtcacagaacaaaccactaatgttttttcaaaagcatgacacacattagtgtctcacactaaagtcacagaacaaaccactaatgttttttcaaaagcatgacacacattagtgtctcacactaaagtcacagaacaaaccaaagatatgcatttctatttcattaaaagttcaaataacattaagcataaacataattatttcacgtaaagaacacaaaaacaaaataaacaaacaaacaaacaacaaccactaaatcaaactcaaacaatatactgataaattttttcgtttacaaaaaacaaatttataacaaataacttaataaactatgaacatacataaaaaagcaaataaataggtacaattttaagaatgtttattgcaaaacaaattgaaaaatcaaaaccaaacattttcatttttcaaatgcttttttaacgcaaaacaaaacaaaaacatttatatttttcaaatgcatttttaacgcaaaacaaatacaaaacgccatacaaattcaaaaactggaactgacaaacacttaactttattatataggatttgtataattcaactgtatgatttttaaaatttttccagtggcactatcggcaccaaggattgaacagaagcgccgcctgacctttaatgttctttaaaaaaaagacatgaaaaatattttgttgaattgaataattttttcaagcaaatattagagttgcacggtaatcggtaattgtaaaaaaaccggtaccggtactgaccgttaatgcaaaaactggtaccggtaccaacttttaccaccggtaccggtaccggtaaaaaccggtaattttccaacgtaaaaatttttggacaaaatttttattcagttttcgcgcgagtgcctgttttttagcattagaattgttcagaagtatatgtatattgagggtgaccacgttttttttcaaattcaggataaagaacactaaaattcagatgtagacctcaaaattcagattattgcaaaacaagggatcagcggccaattttccaattttgcgaaggggtctccggccatgtaaattaatgtaaatcaatgaccttttttgctttcaacaccgcttttttcgcggcaaatttttctcaagacttttggggaacaaggagggccggcggtgccgataggcgccgccgggaaaaattttgtattttttaatgcgatttgttaacagaatttgtaaaaaaagaccaattgattaatttttgggtttttaggatgcttaaaatgaaagaaaaaaagttggaatattttttttaattaaaatttcaattaaaataatggtaaataaaatatgaagaatattctatcccagtgaggaattgaacccaagcgaaaaataatgaaaggcagaaggtttaaccattacaccacatatgcatagatattaaatgaaataaaatttaattttttgtcaaaaatttctccttcttcaccaatt

SEQ ID NO: 19011 - DNA, 1281 bp, Heterodera glycines
aaaattttttaaaaaaaggacaaaaaaaaggtaaaattttctttttttttttatttgaaattaaaaaaattttggaaatcacatttttcttttcccttcccctttttaaaaataaaatgaaaatttaacccaaaaaaatttttttttttttaattaaaaaattttttttttagtccactgaccttaatttttttccccgaattctgctgaaaactgggaaaagtttccgacttccgcttttcgctattttgacccattttcctgttgggaataatttacttatttttaaatccgattccaacctcaattgaaatttgatgataattattttttaagtgattattactgtgcatttgctcgcttatgctgcgtaatgaagtgataatgaatttagatgaaaaccggaagaatgttttgataatccaaaacggtattaatgattaattttatcttaagataattccaaaaaataactgcttattaatttttcaatttttttttaaaattggaagggatgtttgcataaagtgaaaaaaatgcacctttattttttttttcaaataaaatttttccaatcttcaaataataatttttctatcagatcacactccattcttacatgtgcataaaaatgtcttgtttcgtgccgaaatacgaaacacgaaatgatcaacatccctgctatacaatataaaaagatgagattatgcttgtaaaagattatttgatgatcgaaatcgcaaaattattttatttatcaattctgttatttatatacaatatttatgaaaaacaaatttattatttttggacccatgacagcctggtttattttaatggctagtttgttttaattatgaaaagtgtggatgatgttgagtgtgttcatgcttaattttcgaatgaatgcatcttttggtcatttctgtcaattgcctttggatttgaattggcttttgaattggctgtgggtaaattcgtgctgtgagttttgtgggaaattggagaaggaaagcgctccgatattcgctgctgaaatcccaaattaaagagagaaaatgaggataaccaaacttaagcctaacgaataaacccaacgattaattgagggggggggggggaatatgagggattggagaagacacaaaagaatgaagaaattggaccacttccaccccatttgtatggttatataatactgaactacctgtacgtgtacaaaataatgggcgaaattgacatggaaaagtaaggggcaattgtcgaagtgttgacgacgta

SEQ ID NO: 19012 - DNA, 3331 bp, Heterodera glycines
  misc_feature (3221)..(3221): n is a, c, g, or t
aaaaagaggggggggggggggcataaataaataaaataaaaggcatgtagtgtcggaaaatgaaaagaaatgtgtgaactttattcattcatttattcaccccccgagggatgagtcatcggactcattaaaaagggggagagaatggcaaataaacaaaatgaatttgaaaatattaatgttgaaattcattaggggatgataagcaataaaattatcaaaatttcgtctttttggcccaattttctacgtttggctaagttggacaaatgaaaaaaaaatgcaaatcaaagccgggattaagaatcccacttttttcatcttaggattataaaaactaaagtgggccttcgtcgctgttgctttgctgcaacagccagaaaaagttggtccattggtgctaataaaaaaaattgcttctcctaaaaaccaatccaatttcccccgtgggcactttggcgacggattgagagagacacacaattaattaattaagcctaattaaccccagcccattctctgagcagcagcagcagtgggggaatgagaattttcagggccaatgcatccaaaccattcttgagaatgtgtatggggggattcattgtgccataagagagcatcgatcagcaacgaatgccgagcaatggcatttggttttgaataatggaattttattttacagtggcattttttttaattacctttttaatggaatgactaaatgttgagtctcagtttcttcgagaaattcttgcttattttcccgtattagccattctttttcaatttatttaattttaaatgtttttaaagcccccgggtgtgctaattgaagaaaaagcgacccaaaaatccatccgatgggaccattaattaagccactgcccaaaaccctttcgtccagcggaagaagaaaaaaagatgtggggagaggggagaagaaggatttgctcgattaatcgcaccttttgccgctgaaggccatccatcggcgggggcaaattgaggggaaaatgaaattttcaaccaaaaattgtgacgatcggagaaaggaattgatcgaaaaaacgcaaaaatttggggggaaacgccgcgagggcactgaaaagaaaagaaaaagaaagaggtcgacgaggaagaaaagtaaattgggaaattattggaaacacttctatttaaatggataattaaaatgaattaaaaagtttaaaatcggaaaaagtgtcaaattaattaggcattttggagcaaattgcgaattgtgtgccaaatatgtcaaccaaattggcacattattggacatttggtgggacgaagaaatgagaagcgaaggaagagggagggacgaacggcagcagaaaatgagtcattatcaacctcaatgttcccccaaagacaagttgagagggataagagaggggaaagagagagagtggaagagggaggaaaagacggaggagaggtggggagaaaggcaaaaaaggaaatggcgagagagtagggagaaaggggcacgagagaagcaagggaatgtaaggaagagatagagagaactttgagagaagacaattagagagagagggagggatatgctggttttattgccctaaatggccccgccctccccctgtcgcccaaggcaaaattaggggacggacgaagatgattgggaataatgagagccactttaaataatggcgacgatgatgatgagaagggagggcgcgaaatcaactgaagttggagtcccatcaaaagggggcgcagtgatcaaaggggaaattttggaggggaattttgggaggagtggaagaagtgatcagaaaatgggagagggacggaacagtgatcaaagtgaaaagcaaaagaccaaaagagagagcattggaagaggatttggaggagaaaggggaaaaagtgatcagacaatggcagaagagtgatgatgacggagagaaaagagatcaaaaaagggatgaacgatttgagaggtgttgaaggagcgatcacttaaacaaaaaccaaaatgccgaaggcaaaatggattctttttgctaatgatgatgatgatgagacgaaaacggatgaattgcgagcggaggacggacaaagtgaaaaggacggacggacgaatgaatggaagaattgcgccgtttagtccgtctgctgatgatcatcagcaaagagaagaggaacaaccaattaacagcagcagcagctgaacaatacgcaatacgatgctgcattgtgagattatgctaatttatgggcagataaagcggaggaaaaaggagaagcaaaaggatgccctgaggggaggaaaaggggggggggaagaggaattaggaggaaagagcacaacgagacaatatgaatgatcagcagcaacaacaacaggaaaacgtactcctaactgcttattctcaaaattttaggcattttttcctaaatattccttttatgaaagtgccaacctttgaaaagccgaatcatttgaaatgtaaaggaaattaagaataatgttgattgcttttagtatttaaaaaaacaactgctgatgaatgtaaaaatgtaagaaatgtaccagccgacaccgttgggggggggggacgaacgcagctcaaaccatcatttcatctgtcgtcggatggaacagaggatgaacatgaccaagaagatgatgatgatgaggaggaggagggacagaacaacaaaagggagggacggattattacgaaaagggacggaagagtcaatggaaggggggggggtgacagacagacagagggagggacggacgtcgtccccccgggcgagtggcggtgagtgactcttccaatttcgcgaccgcatttccccgcgggtgcttctgttggtgctcctctttgtgggcggtgcttttgtccgtccgtgttttccgccctttccgcgccgccaccgacgggtgacttttgctgctttgacctctccgccgatcactttcttcactttttgcttgatcaaaaatcggagcggatttttaattgaaatttaatccgtccgtttcggataaattttttgggctcaaattttgtggtggcgatggaggagaaatgaaacaaatttggagcagctttattctcaacatccatcagcagaaatatgagaagagcagcagctaattttttgagaaagaataaaatggatgacgattttatctgatctgatcagagagattnaaagtgtttggacacacttataaagctattggaaggataacgtttcattgacagtcaagagtagagaaaagtctcgaactttctgtggcttcgatcggtctcgagctgac

SEQ ID NO: 19013 - DNA, 3256 bp, Heterodera glycines
  misc_feature (169)..(169): n is a, c, g, or t
gggggggggggaaggtcgaccgttcgtcgtggatgcgatgagtgagtggtgggtggtggtggtggtggtggtggtgtttcttcccggggagagtccacgtttcatcccttcgtcggtcgtttgagtggcgccctccaaaagtcccgcggcctcaattgttttgtttgcncaaaatcgcatttgccaaaattgcatattttggttcactgttttgagtggaaaattgtttctttttttgcctcaaagctccgaaacatttaagcgggccaacaaattgcattttcctggccaaattcgcaccttttccgaatgtttctccaaaactgaggagcttttcctttctcatttttcccatccgccgccctaaataactttcgcttttccttctccaaactttgccctttgttatgcacaaagtgagcgctctgttcacaacgcaaagggacagaaattgcggcggcaaaacgaacggagtgccgtcgatggtcccccggcaccacgtggcgtcgtcgcccgcactgttcgaacacgcggccaattcgaacggcaaaagtccgttgggcgacgacggcatttcgctttgcacaattttcaaattgatagcccaaaaacgcatttgtgtggtgagaagagccgggtcggatgttgaccagcaggtgaacggagggagaagaaaaagaagaagcaattgccctgggtcaacaatggcaacacttaaaataatttacaaaataaaagcctggagttagcctaaagcttaggcctaacctatgccattgtacgagttgtaatggcacgcctttctcttggcttttccttcactttcgcccggttttccctcagatttcgtctctgatcacttccgcttttcgtgccgttggcagggccccgcccaccgatggctcttcaaccgcccatttcctttccgtcgatcatcactgtgccggcaaaatgttggaccgcgtcgggcggcggggactgccgctaattttcctcaacggcgattgtgtaggcggtttggccgaactgaaacaaatgacgaggaacggctttctggtggagtctctttgcccgcatgacttcgatttggcagtgattggcagcggcgaagggaacgcagtggcggagagagcggtggaggtgagacagagaaagaaagggaaaacgacggcattttgggagaaagagaatggcattttgagaggaacggaattttaaagcggagagagggaaatagcattttgggatgttcagctattgacaggcggcactcaaattgggcaaaagagtggcattggtggaggttaagcagacaagcggcaggaaaggacggtctaatgccttcgtagacgcacaaatagcaaaacaaatggccaatcaggcggcactgatgcgtcattcaatcggtgggaaactgtgaaaataaacacgacttttctgatggatttcagaggaggcgcagcgcaacggatggaccatcgaatattcgggggatggcaaaatcaattttggcttggattggcaatgtgtgcgcgaagcgattgagcaagagactaagcagaaaagagaatggactcagaaggcatttgagaggggaaaggtgggcagagaaaggcatttaaaggggaaaggcggcattggggcggacaggacaaaatttcgacgacaaattatgccgcgttaatttttggggtgcaccgtacctaaggcaactcgtatcaagcctaagcctaggcctaacctaagcaattgtacgagttgccatgacaccaaatcacttaccccctcccgccccctccataggttcaaacgtttcctacgactgcctgccatttctccgggtcccatcagctctctttttgccatcagctgaccgactccgattcggcacagaacaaattggcaaaacttagcgcagataaatttttgctggtcacaaagagtgaagcaaaagtgttggaaaatgtgcccggcgcgaaggaattttgcatttcgaagtcggactttgccattgccaatttgcactttgaattccgtccgtccattcagtgacgaattgttcactttggagcacaaccccggcacgactttgttcttttgtgacgatgaagcggaccctcaaattttggagtcggccgccattctgagggcccttggcaacgaagtgacggtctgtctgccgagacttctgatcagcggactgatcagacgccgctttctctgactcattttaaggtcatgacgaacacttattcgcccagcggaaagggcaaagacacgtcaaaattggagtgtttcgattcggagttcattctttcgatcaaagacaaactttgtcagttgggcattcgcttttttatgtttgttaaatttgtccagttttctctcaaaatgtaccattcagaagtctaccgacaaaatttgaacgattgagagaaccatctgaagacaaatcggctattttgcgcgtttacgcgacaaaagcatggagcaaatcggcggaaaagggcgcccctggcgattggactccgtttgtggaggagttcaacacggtcagtccatggctcctttcagttgttttgttaattgtgcttctttctacatcccttccaaaaggtcgtaatttccgtcggacggcgtcaccatttgaccgatggttttgtgctcgacaatttggcatttggcacttcaaaatttcccaattctccgtccatttccgactcaattaatggcacaatgaacggcaccaccagcagaagaatttctttgtcgtctgaacttttgcaggcgccgaatgtttatggcattggcgatttgcgaatggaacaccggtggaggggggagacgacgccgcaggggcaatcggaggagggaaattgccaaagagtgcaaaagttgctgagaaaaatgtacgaggccgaatttgaaacggtgaggagcaattgtaggcaattaattaaatggctaattgggttaattggttaattgattgtcagatggacaccgccgattcaccgattgtcagcaaaacgatgcttatcccaccaatggaatacagctgttgtgggctgaatgaggaggagatggagatgaaatggggaaggcatttgacacgcgtgtacagagacggagaagtgccaataacggcggagagggcgaaaatgatttgtgtgatgaagggggcggaccagcgcaaaaaggtgggcaaaggcaattggaggattttgggaagaattcgaaaaggacgggggggggg

SEQ ID NO: 19014 - DNA, 2014 bp, Heterodera glycines
aaacatctgtctgtgcacaatggtatttccggacatttaattatcaatttggcaattttttataatatcactttgttttgatatccagcaattgcaaataaaattcataataacaagaaataattttgtaaccaaaaaaaattctttttatttactttatgttccaatctcatgatcaggttttgctctgtgcattttataatctaaaacctcaaattagttttattggtttttttaatatttattttatgttcttttaatatttggttcattcgtttggaaacataattttttagttttacttttttacaattctcaatattttgttacatattattcttcttattttactttgatacaaatattgatagatctgtagataatttttctttctaatttcagtgcgtattttattttttgatttatttgaattattttcatatatatatatgtcattttttgtaaataatattcttcacctgccaccataatctaagcattttgtaactctcattccttataaacaattaaaaataataatatttcagaatacaaactctaaattaagattaatcaaataggtattgttaagtaaatgtaaattctaactataaaaatttcgttcgagttaaaaattttaaaggaaatatgcatttgattggtttttaaatattttttaatttttttttaatttcaagattttcacctttatctagagccaaataaattaagtttccaattaaacattttttattcatatacttcaactatttatagagaaatgttctatgcttttgcgtagtttagttcattaattttagcattttctaatgtttaaactatttaatggttcttataagtatccccactttcagaggaggttgaaaaaatccccccgttccatttatccacccagggggacaaatggaatttttaattttcgaaaaataatttctttttaatatttaataaaaaaaattccagaaaaatctcattctttgtaaaaatgttgaaaaaaacttgattttttgagcttctcagggtcataaattttgaagcttaacgaattttttggaattttgcagaataatagaaaacacttagggctatcgaaagatatcaaggttttaaatattaatatcgtcagcattcatagatactaaaaaagaagtcatatttaaacagctatgatattatgcaatttaagtaattcattcttgctaaaatatttttaagatcactttttctttctttaaaatctgtccaattaaatattaatatgcatttttcatgcacatttacagcactaaaattacaatgaaaaattcaaatgaaaatgcgcattttcttgtaaataacaattgtaaaattataaataaattgcatttttccgttaattacaatagataaaatagtcatgcggcgagaagcgctctccgagaagaagagcggagggtgctgtagcgcgaaactacttaccttccggtgggattcgaaaccatggtctttcaaaactctggaatgctttaacagactgagctgggctgcgtcatctttagagagttattccaatgacaattctcttttatgttttaccactttccacagaattaatcaaatttgatttttaagaattttttttaccataggcaggcagactgggctaagtcattcgattaagaccaacatgagcccaatggtttcaaatttttagcatccgcctgctttgttttaattgtttctcacaaatttcaaaatttttctcgactttgttgttgtttcaaatgaacccaacaagggcaagtgaaagtaatcatttcaaagaaaattggcatcaaatcaattcccatccgtcaatgaatcaaagcgatttatcgtttctcaaataattaattcacttccgctgagtttgaccggtgggcacaaaggcctaaattatttatccggagaatatagtttattctagaaaagcaaacgctattattgcttagaaaaaaaaatctagaaaaaccga

SEQ ID NO: 19015 - DNA, 848 bp, Heterodera glycines
caatgtggacactgtacaaaatgctcgtcttcatgctgttgctgctgaaccgccgccgtctttccaataattggggcatcgttccattgtccaccaagaaatctctccaaaatcgtcttctttcagtagtgtcagcttctccttagtccgttcattgaccaattcaaattgcgcatttggctgtgatacattggacacagcaaaaggaatcaatgcaaaagttatatggtaactgactgaagtggtggcacggataaatacctggataaagaaaatgccaaaattaaatgccattattggagtccggaggacgggctcgggcgggtgcatttcattccccacccccccccccccccgccaagaaattgtttccaaatttaccaaaacataaaattttttgaaaaagcaagaatttttctacttaagtaagaacatgaagttccttccttacccccccccccagaaatttagaaaaagcgatccgcaagtgttaacaaatagtttttgagattcaggcctctagtcatcacaaaaggaaaatgtaatcagcaactgaatcacaaaatacgagaaacgacctctttgaaattgttgatccactcaaagtttctgcctggtgatgcagaacaacaataatttaaggaacgcaatctcttcggtcgtccgtcggtagtcggaatgtgcaaccatttggacaacacttggccagcagttgcagttggcccatcatcggcaagttggtcggggaacatgacgtaagagaggatagaatccaatcggtggaaatcgcagaaatttgttagagaaatgagaccagaaaaattgtctaagtgatcagcatcggggga

SEQ ID NO: 19016 - DNA, 2991 bp, Heterodera glycines
  misc_feature (9)..(9): n is a, c, g, or t
  misc_feature (2982)..(2982): n is a, c, g, or t
ccaaatctntcgggccaagacccaattttatggcattttctcgttggaaatgccatttgttaatttgccacctggtagaagtctgggccgattttgaaccgttcgtccaccggaaaccgttcaccgcgcaccaacgcaccgttctccacatagcggacggtgcccggcaccaccgcattgtacggaagctcaatttgttcgccctccggaaacagcacaaaatggccgtctaaatgctttttatatcatatataggctattttctagatttttagcttacatttagtgaattgggagaaattttgacaattttgccctcaatttggaaacgattatgtgcatatttctcacttctatgtgtgtattttctatttttattaatattttatgcgtatattttgagattttatgtgcataggtatttattagacacattttaattaattaccgtcaagttggcgatgttctcgtaacatcagcgaaactttgacacgagttccactcaaaaaattaagcaattcgcaccttattgcggacatttgcttaattacagtaacttctatattgatatttgtatactttttttgaaattacccataaaggagtgtctccgaaatggtccataagcttaaattgagtaatttttctaattattagattattagctaaaacatctgaccaaattgcttgcatgatcaatgcgctcaatgatgtcctggtggtccttgaaaattgtcttcatcccgtccaaatggttcattgtcaccagtacaatttctgacggctctttgcacagcaaaaattggtatttgactgccattgtcatcagatcaaacagtttaaccatgcttaatgtgtttttgatcaaattttgaccattcatacagtagtgtgatggtttttctttaaaattctgcggtaccgtaacggaaatctcaaaatccccaagatttaaatttctgtttcttgtttggaatcagagggtggagcgcgatcgcgatccgcggcgtttttttccttgatcaaaagcgatttgtcattttcaatccgccatgattccgccgatccgatcgatacccgcgggatttttttgtccgcacctccacccttgctgatttgaactttggttctgttccgagttttttactattttatccggaatttgctgctaataaatcccattacccggcttaatctaagtgcctcattatgtgcttatctacctggcctcgttgaggcgcatcaccgaagaatgcgcaatttgctcaaagtgttggcgaagtccttgtctcgtgtacatttcacggggttcaaacagttcgtccaggaaacttttgctcagcataaccgcaacaatttcacacaaaaccttcatagttttttcgtcaccaacattttgggcctggcaaaattattaaacattccatgaaatttttaaatttttttaaaatagtggaatttattagtgcctgcaatcgttgctccaaaatataggccatctcgccgcccatgttaaggaataagaagggcattgcctgttatagaaattggtttaattgtagaaaaattattaaaaaaaaatacttgaaaactcattttgactgttttctcgacagctttagctttgattattacgaaagttttaattaatgcgtaaaataacagcgacagaaattacgaccaatttgcgcatatcatatccaattaataactcacatatccaccacaataataatgtttagcccattaatagttgttaaattgtaaagaaattttttgttggttgtcaaggtgatggaagtcgggaaatattgtcaatttcaaaagaattcaaatggtaaacttcgaaaaatgcattaaaagagaaaattaaaacaaacaaatatggcaaatgtgggattggatataaatgattaattaaatagtataaataaatttacttataaatattgggttttttatttggtaatttttatttatttaaaaaaaataaaattgaaatataaattctgattaagtaatttaaggtctttaacttttgttcttttttaaaattaatttccaactgtaataaatctccgaaataaattttatatatatatatatatataaaatacctaattagttaagggatgataaaaataaataatttggcaacaatatgtaatttacgtgattttaggtctccgctattaaggatgggctttgttctggtccaacaaacagttcgccatcatcttcatcatcagctgatgatggcatgcattattcgctggagggcagttggtccgacttattcaaattggacgaatttggcggaatgttatgcatcaaaaaaggattgcatttggagcaacacgggcaaaaaatccaattgaaagcgatagccaaacataacggtgataacaacattcggagtttcaacaccacattttttgcctatggcaaaaaaattcttttgagaaaaatttttaaaaatactagtgatttcgttggatcataaaatttcaagtttttcttgacgagttcgagatcacgaaaatttaaaataatttaagcaattaattttttccaaaatatctcatgaaaaattgctggaaattcttttcttttttttgttgttaatttataagcggaagaataattttgaaactcaattttaagtatttttagttaaaagataccctgttttgaacagcttttttaaccttttcgactaatttagcatatattttaaaaaattttgtgggtttttagcagttattttgatggtaaatcccaccacagttcacaaatgaaaaattttactattcccccatttatttacaaataatttaaataaaaatttgagatcaatggcatattggctagggcgtaaatgtctcgcaattattattttatggcaccaaaaaaataaatgaattttttctgtttcaagatggcactgttgccgaggcacaggtcattgtgaatattgaggantgtgaataa

SEQ ID NO: 19017 - DNA, 894 bp, Heterodera glycines
  misc_feature (760)..(760): n is a, c, g, or t
attaataatttactattttattcaaaaatccttcaaatatttggttctctttttttcaattattccaatttggcaataaaatttggtgctttttttaatatacatataaacccttaaaaatttgttgttacttacttatttttttaaatttttgtatattaaataataatatttagcaaataactctcttggtaaataatggcagttctcgaacaatttggttcctttataaattttgacaacacaaactaagcaatttcagaaaacaaataagaatatgaaataaataaaacagaaaagcaattaaatctgaaggaaaaataaaatattaaaattattttacttttattaaatcattcaaaaattactaataaagtttttaagaaaaatttaattttaaaatatatttaataaaatcaaagaacaggattaaaaaaattatttaaaaattacattatattatttattttgtaaactgaaaataataaatattgagtcatttgattgaaaaagacaattaaatgtgttatatcgttggaaataattattaaagaatttaaatcaattatttagttagtaaaataaaaaaaaactgttaaaaattaaaaaaaaaatttaaaccaacattgataaaattatttatttgctcaatttagattaaaaatgtaatttaatatttcaattcttttaactatctataatcaatttttaatagttaaaataaataaaacccacaataaaaaatttcatttcatttcanataaataaattaaagtttaacaaatacacaatattgattaattatatccaaaaataattttaattttctaccctaaaaaatgaaaatatattaaaagtgaattatattgagaaatatatcaaatttaatgtact

SEQ ID NO: 19018 - DNA, 1406 bp, Heterodera glycines
aattttatttgaatatgtttaatcaattttataatttctttgtaatattttttaaatttattttgagcttgcaaggctccttcatttgcattattctgtgtaaattagttacacacgtacaagtctaaacgttttccattggctaagcaatatagcaggataaggggaaggttttcttcgtctttgtggatttctttctgctttccgtttgcatcctgaaaacagattttatgaacgtgggatttggcagggcaatgacagagggaataccgtgccgtgttgtcccgttgggaggcccctccggcagctccgatgagagtggataatacggttttagcagttttaaaggtttttagggaattaaataacatttaacaaattataaaactgattaaacatattcaaataaaattagtttaaaaaattttaactttaataaataaaccaatataaataaaattatatttattttgcttaataaaatttatttgctttgcttggttgctgtggctttgtgtgtatacggtttagggccgaaacacacataataattaatttaaattatttatattataacaatggcactaatgctatttatatgttaaagcaaatagaaaaggaataaataatttataaaataaaacaaaaatataattttaagaataaaaaatcataaatattataatttacccagcagtgatgccacaaataaaataaaccaaccttatcagatttttattggtaaaaaacaacaattcataattgggcatataaatggggaaaattaagcggtaacttggacaaggatttaaattgaagaattaaaatttataatttttttatgaagaaggaaacaaatacattaataatgtttaaacaaaatgaacatcaaaaccataaaaagaaacggtccctactaacaccaatttataaattgtaaatttggtaaaattttatatggaacaattctttgttttattagaaatgcaaagaacaaaattatatttgatttttttaagtctcctgatatttaaataattacaaaaaaaaattcttgagaagcttttaaatatttttttttatttcaaaactcaaaatattaaaaagacggataacgtaatcagctcagtatttattgaaaaacaataaatattatattttaaatataaacttttaccttaacaattaatatatattaaaatattaaaaaattttaaaaataaatgaataaaaaattttatattatataattatgaataaataatattatgttttgcatagttggctattctataataaaaggtaataaattgaaataataaaaagttttagagaaaactatttcaatcgcatcctgaaaattgtatcctattaattatctatgaatggataaacattattaaaaa

SEQ ID NO: 19019 - DNA, 2023 bp, Heterodera glycines
  misc_feature (1969)..(1969): n is a, c, g, or t
  misc_feature (1982)..(1982): n is a, c, g, or t
attataacaattaacgataatatagcttaatttagaacaataatccacatatgattatggtaatcaaaaaaacattaaaattttttcaaaagacaaagacaactttgtaatataatgaattttttaatttcaataaatgtgtgttaaactcaaaattaactttccaaccttaaatggattattgaaaagctaatcgaaatttttaaatttattttagcccatttcttccggcaatgggaaagcgcgcgttcgatcgcctggacgcgtcatcgcttggcttaagcggctataacgcctattggccggaggaggagccgctgaatcggctggcatttggccaacgacaatttgcggatgccgaaacggagcaggaaaagccgactggcagcaaaaagcatcgccgatggtcgcgcccactcgcgggcacaaagcgccgagtgaatggcttcggactgtttggccaattgcgattatagcgcgccagtctctgatcgatcctcaatttcttttttttgtatcgggccgcttttgtcggatcactgtcctgaactgaactagtccaataatattattgatcaacatttctgatcagaaaatcacattggattgaaccggaattatcccttatataagctttggattttgatctgattaaattacttttctgatcaaaaaattaagaactgctagttttaaggtgttatgtatgagttgacatgatcagctttaaagaaccgtgtttgatcagtattttggcttgttttttttgatcacttgtatttggttacggttcttttgtctgatcgatcataaatgtgttatttctaaaattggttaatcaatgaaattttaaaaaaacgaagataatttttcaaacccagtaaatttatctcatcgtaataataaaaacttattaaaaaatacataattcagtggaaggtattttcaaaattaattttaatccataaaagaatttttttgtgtgaaaaatgacatcagattaataagaagtgcatgtattactaacaacaaaataaataagcatcattcatcaatacatccattatatggctttgaagcctaaaagttgactttattttcaaattaaattttttttttgtttgtcatgaaaattattttatttttatttttaattttaaattttgttttgctaaaaatgatttcatcgttttatgcaacttttatttttgtttctttttttacaaatattttttgtaatttgagcattattaacgagaaacaatgaagtaaagtctgaagacagaaggacgaacgcggacaattttacttttttttaaaatttttcaaacctttctcccttttgactcaaattatcattaaaatttaaaactttgttgactaatgagtttttttgtttggctatatttggaccaataaatataataagaattagtaaattttgaaaaaataatttgaatgattttaaaataacaaagtctgcttaatatttgttttatgctttgacagtgtttttaatttaaattttctaagattctatttaatgtagtaaaattctaaattaactcaaaatttctttattttatgcaaacaaaatatcttcctcgttcttacgtaagtaaagaattttttttaatattttttaatctttcttccgactcatttgatgctttcatcatcaaaatgcatcatcatcattgacaaaatattaacattacgacaattcagtaaacaatataaaatatattaagtaattacctttttaatgggaataaaaaaaattccattccattcatttgacgtcaaatttttacacttttattgggttaaggcggaagaaaatttgttgatcaaattagcatggataaaaaatacaaatgcaataataaattttattatgagctaaatagctaagaaaaacccaacaattttataagaggacaataattttgtgtgcgctgtgtttganaaattttggttanagtatgtttttcggatggaaatttcagattagattattttt

SEQ ID NO: 19020 - DNA, 2047 bp, Heterodera glycines
tatcaattttatttgatttacctataaaattattattgtttgcctaatttttattagacgtcataagtcatgctaacgaaaaaagaaacactaatttaatttaattgaaattaaattataagaacatattggtcgttgatgttttgtgaaaacgccaaatataatttgattttttttttgttttaatttttttacagaaaattttattatttcgtttacatcttttaatgtgaaaattaaaaaataatcacatttatcgttcgcgaaaaagttttttgtttcatttatttttttattttaatttccatttattccctaataatacacaaattttatatgcttataattacataattttttgcatttttctgaaaaatttgacccaaaaaggggacccaaactgcattagtaccgattaacccactctaaagttaattagaaataattagcgatcttttaaacccccgcaattctcttttctaacacatgaaaatgcaacatcaataattaataactttgcgattaacgggatatactataaaagttaattagcaataattagccagccatctttaaaccccccgcaattagaaaaaaaagagaaaatacaatggattttaatgagttttctcttagcggcaaagtgcgcaaaaatttaccgcatcaacgcattttttaattttacactgttttgaacattgttgcaatttggttttccgttacgtaacatccgtcaacaattatatcgtctaccataaaaagctcaactcaactcaacgttttccggtgccattgtaagtaaatgtgtagctgatgcggatttcagtcacactttaggaagatggcattttgtgccggtttacgtgtcggtaaacatcaaaaaaaagttggcaaacagagtacccattcatttggtaattttgccagcctctttaattgccaaaaaaagccaaaatatatgtgctattttccgtttacgtaaatccgtcatctggcatttactcgccaccatccactttgctaacccatattttccggtgttaatgccgaacagaattaatccaagaaagctggagatgggatggcattttgtcttccatttcacttaagtgtgtttgcgtgtttgtgtaaataaaaatgagagaaaaactggcatatttttgacattttgccaaacatttaattaagtattttgattttgctaaaatatattttttcatatttttacagatttttttatcattagtattgttatttgtgcataaagcaacgatattacacctcttttgtgcccatgcccatcatgttcacatttatcattataactcagctgctatttgtgcaacagtttttcgtggtaaaattgaaatttttaaattaattttaaataaataaattttgttttttttgcaggttgttgccaggaatgttaatgggcattatcctgaaacatattcttcacaaaatttgctgtttgacgacggcgattcaatgccaaccgaaattaaaacgtaaaagttttttagaatttataaaattataatatgatgcaataaattagatgaaaattcatttataaagtttttgcctaattatcaaaatttgggttctatgatgcaaacagacgctcccttgctgtcattttctaaatatttctaattttttctaatattttttatttttcggagcacccaaattaaaaattgtaagatattttttgattgctttaaagaaactctattaatcaacgaaaattgaaaaaatttcactaaacattaaaaaaattatggccaaaaacagtgattttttgcaattttataggcgaattgagaattctttaaaaatgttaattttgatgcttttttcaaaaagttatgaggcattaaagttgtcatgttattttatggtcgtgtaaattttttatggttgtgtaagctttaatttagccaaattttctgctttgtttttgagggaaaattaaaattttacaaaatgatttaggccatccacctcggtcagacaattggtgttcaacatcccgcataaa

SEQ ID NO: 19021 - DNA, 819 bp, Heterodera glycines
aggtgcctatttcgcgattttttgtgcctaaaaatcgcatccctagttatgagaaatgctactaaaattgttgcacagactcgaataaattttaagaaaattagaatttatattcgtttttacaatttttagcaatttttccactctccgtttttatttaaaccataaaatctgtcaatttaaccattaaatgcttttctaccgtttccaatgtccagttaatgcattttgtcacttccatccttttaaaatcagtcacaggttaaaaggaggcaaatttaggcgcgacacgccccgacaattaatggacagaaaataaattaaagaaaggatggaaagaggaggggaagagaaggaagagcaaaatgggaaaagagagaggaaatgaaggaagaaggaggaatggacgaataaggaagagagagagagagggggaagggaggggaaacggaagaagaaaggaggtggatgaaggaagacaaaatggttaggaagaaaagaagcaaagggaaaaagaaggataaaaggaaatgtaaaacaaagagaaaaaggaggaatggatgatgaaggaagagagtgagaaggaggaaaagagaggaggaggatgaagatgctgaaggaggaagagaaagagagagaggagggaagggaaaatggaaaaggagatagaaaaaggaggaagagaggtagaggatgaagacaaatagatatgaagaaaagaggagaagagggagacaagaagaggtaaaagaaaagagaggaagaaagtgagaaattgcgagaagaataattgcatcttccaacagcaaagagagtaag

SEQ ID NO: 19022 - DNA, 1279 bp, Heterodera glycines
cgccgcattggcaaaaaaaggacaccatcagcagaatgggaaaagcgagaatggcacgtcatcgacggcagcagcagcgacagaaaacaatgggggcaaattgcgacgcaatcggacgactttcaccacttttcagttgtacgaattggaacaggtgaacagcacggcatgatcagtagcagcttgattaatcataatcggatttgggcagaaaagaatttgtttctttactgtactttttctccttattttttgtgccttttttgttgccccaatccgcctatcagtagtatccgacggataattgggcatttaatttgagtatcatttttcgctttggtcaccattatagattcaaattaaactgtttttttatccttaatttgtttcccttttccaggctttcgacgagagtcattatccggatgtttacgcgcgggagaaactgtcgcgcaaaattcacttgcccgaagtgcgcgttcaggtcaaactttgtttagctaataaattgaaataatcaaatgatatttgtttgcctttttaggtgtggttccaaaacagacgcgccaaatggtaagagaattgggggagagtcatttgatcattaatttaatcaccaaaatgtcaattcaattgttttgagtattggcacggggccaaaacgtaacaaaaaatgccaggaaacttttgccgaaagaaatgattcggaatcaaatgacaatttttgagttttcaaaaaaaataaagaaaattgaagtgaaatttgaaggcgtcgccacgagaagcaggaggagctgagtctgaaggcgttgaaaatgcccatgccgcagcagaacatcgacggcattggcattggcccaacatttggccagggctgcaattatttggccgggtcggcgactgcgaactgctggccttggacaatgatgagatttgccacatcgccagtagaaaagtcagtgcaaggcactgactgactaattattggataggcttttggaaacggaacttttggcacggccttcccttccccgtgccattatccccagaataaatttcttgaaagtagagatagaaaaaccaagatctcgaaaagcctgataatttctcgactcagatttaaatgtgccattttcagcgtctttccttcggcaatgccatcgtcgccttcttctcccgtgccgctctcctctctttcggccgacaatccctcgtcaaagtccgttccgtcgatgaacaatggtgcccaattcgcctccccaccgatgccgcccgcttt

SEQ ID NO: 19023 - DNA, 2897 bp, Heterodera glycines
atctgttgccaaattcaactaaaattttcaaaatttaccccagcggcgcctatcggcaccgccggcccacccaagtttcccaagttttgtgaaaaaatgctgccgcaaaaaaattgtttaaaatctgatttatttaaccctattgctctgaaatgtattatttttaatttcttccccaaaattgtctaaaatggataatgggatgtgaaaacataatattatgtgcattttgatggatcaattataaaaataactgagttgaagcaattttgaaaaattccttatttttgactcaaaattttattttttccttggtgttattaattcgaaaaattttcaatcacacacccctgtactagagccatatccgcttatccacctactatgatctgcatacactcagtttgaggatataattttaaagatttataaataagttaaaaaaattttctgttttttcgtttcgtttcgtacgaaaatttttttttagagtttttgtgcagccctgatcggggtccggcggtaccggtaggcgccgccgtgaaaattttttgaaattttaatgattttattaagaaaaatcgataaattttttatgattttcataaatcagtaaaaaaaatagtttcgacaaaaaagggatacctctaaattgttgtggctttccggtttatttctgtattttgtttgtttttatcaagaaatggaaaaacaaaatatttagaaagatataaaaatagcatacaaaatgagttgatccaattaacgaatatctatcctttaaactattataattataatttttgggattagaagattttttgattattaattttgttaaactcgaaattctaagaattaaatattttaataaatttatttgtttagattaaatatttcaaaatctcttaaaatgatcttctggagtattttgaagtgtcatttttattatttttatcttttttgaatttattcttttactttgaatttgttttttatttgtttttcttgtctttggttttttaaaatcaattttcattcagttcaatcaaatcaaagattttaattattgttttgaattttacttcttatccatccctttaataatgatatacaaatgcaataaaaaaatgacaaaacattatcaattagatgcaataacattttgaacaaaaaaaaaatatataaaatttttaaagtgtttaaatttatttcaattttaaatatgttatttttaaagcatttttttgtgaaaaattgtttaatatttagcagatgtgaaggtcatatgggatacaataatatttaatgaattgtgtgctacttaagcataggaaaaatagatccaaatcatattgctaaattaaataaataatatacatcataattaatggcactgctcatctatatgtaagaatgcttttttattaaattatattaatgtaaataaatttattttaaattgttttttcattaataatcacttgtttctgcaacgcttattttctatttgttggagacattttaataatcacattttttataattttgactaataaaaaataatcaaaatattggagggaaaatatatatagaactaattcattaattattatttttaaattcaaaaattagacttacatgacaataactttatatggtaagtttattttgcgatgtattatatttaacaaaaaataaaaatgttttgaaaaatcaatgatatatgagaaaataaaaaaacattttttttaattttgaaagatattagataacatttttactatttaatcttaattatttatataaaatgattaatacaaaaaagaaagcttgcaggctaatttaaaatttatggaatgaaagaactcttattcgttattattttttttcaattaacagtataagctttttttaaataattaattaaaataatttagtttaatattataatagcatttaaaaattaaataaattaaatgatttttaatcaatgttaaaaaataattttttataagcctgaacaattgcgttaatattaaattattattattatttaactaatattcaggtcatattcatcaaagcatcaaacgagacacaccaaagaaatgataagtttaaatattgaattttatattaactttgtatttaatttttatgtcttaaaattatttaaattttagtttaaatataaatactcaactaactatagtgacggaacaattaattggaggaaaaaaaagtcggcaatattttaatatttgaattttttaatcatcctcaaaaaaataaatataaatatttttcatttttaataatataagcttgaaaataataacaaatgcatcagccacgaatatttaaaaataaagggcaaaatttaaaataaatttttagtaaaattaattttaaaaagctattaagtttgctccaaaggaaatttgttagaatttgagaaagtgcaaagtcgaactaacattttatttacacttctgaattgagttaaatataaaaagtcctgaaaaagaaaaaatctaattgatggagaattaaaaatagattatttacacaaatgggctcggaggctgaaaaatctgactgtttacgagtctatttattgtataatccaataaaaattttaattttaaaactatattgtaactcaataaaatagtataatgataaacacatacaaactttattataaatttataaaaagaggatttatttgccctcaacaaagcattagtaaaatgaagtaaactgctaaaagaaaattaaaaaatgcatctttaatccaaaataaacgaataaaaatgataagaaacaaatgaaataaaatgatatttagaatggattcccacaaaaaaaagatattagaaaatctacctatt

SEQ ID NO: 19024 - DNA, 725 bp, Heterodera glycines
ccccatgtttctattccgggataggaaatatgtaaatgcttgagagtctctctctctctttctcactctctcgtaaaatctcggattttcgcgcgcgcgattattgacaaatttatttttgtggtgtcaaattctcggtctcgacacatttttttctttggttttgagtactttaaaatttcgaagttcgaacaatcccattggatttcgatcaaaattttgtacaacgtttcattgattgattttttcacattttttataggcatcggcgggataaattgttttgaaattttaacgaaattttttttggaaatttaccccaaaatttatttttgacagttttagggaattttacttctatatttatttgaatgaaaatttttttggaaattttgtccaaaatttattttttcgaagagttttgcgggaattttattctgaatttattttaataaaattacttgggaaatttattccaaatgaaaatttttgtaagttttcttccaaattatttcaacgaaagttttttgtaaattttcttctagaatttatttgaataaaaatttggctctaatgcactttatgagtccaatcgattgacaatcccgggtttttatacaataactttttccatgttcgaacaaaccctatctttttggtatcattcgaaagcgcaaagtctgaataatgtaataatacgagaaaacaagagaattctaacattt

SEQ ID NO: 19025 - DNA, 1217 bp, Heterodera glycines
gattttatacattttaacttcgttagacttgtgctttcgaatgataccaaaaagatagggtttgttcaaacatgaacaaagttattgtataaaaaccaggtattgtcaattgattggactcataaagtgcactaaagccgaatcttggtgattgttttttcgtctttgtagacatattagattaaaccctttttgtttcatgtagtttaaccaaccattgatctcctcaggtggagatgattctgagtatgatgttacgccgccaccacgaattgggccgggttcatttctgttttgcgttgctggataaagcggcggtttatgccaattcattctcttgttttctcgtattattacattattcagactttgtgctttcgaatgataccaaaaagatagcgtttgttcgaacatggaaaaagttattgtataaaaacccgggattgtcaattgattggatcataaaagtcgattggactcataaagtgcattagagccgaaaattttttgagacggaaacgcatcattaaaacgccaaataccgcgtcttccgctttggggcggcaaatgttttgagttttcaatttcaactccatttgaaatgccattaaatgcggcggcgggagagatttatggcggcacgggcaaagggtcgggtcgtaaaagtaaatggaaagtcgcaaaatgttattatccatccaaccgcggtcggtctatctcctgcgcagcggatgggatgaatttcccacttccgaaacattttggcatcggaaatccgattttcggcatttttgggaataaattctccaatttccgagaaattttgttctggttttcgacatttttgggaagtaaattttaatttctgaaatttttaggcccttggaattccgaattttggggaataaattcacaatttccgaagtattttataccatcgggattccgactttttgacattttgtgttcgttttactgacttcagaaatattttaggcactagggattccgaattcaaatatatgccatcggcgactcaatttttttttggggttagttaaattccgattttcaatttttacattcacaaacttccgaatttgaggtgcgtaaatgccgacttaaacgattttttttctcgaatttcgattcggggtttttgaagagcgactccctttgatgtgcagcaccattttgacggcactgtgtccacaagc

SEQ ID NO: 19026 - DNA, 1700 bp, Heterodera glycines
cataaaaaaggagttaaaaaatagggttcccaaaattttgaaaatttaagcaaaattattaattatcatcagtcagctcaatgacccaaggtaaattcaatcccatttaaaaaataataaaattgaaaattctgaatgtatgttgttaaagtcattcgtagcaatttaaaaaataatttttcttgataattttttgctcccttcacctcttccccataaattgttttttttctgttattcatcattatttttagattttggatttagggaagttaaaaataattactcttatgtctttgccaagtaattctcgttgttcttctttctatttcaaatttaattgaatcccaaactcaatggtaggggattttcatctaaagttttcccgctgagctaaattatatacaaataatgctctggtaaaagattcccttttaactctttaacgtaatttattattgtttttgcatttaaaaatttgaaatatttcaataaatagtttaatatgaaaaggcaatccttttgagttcccgaaccttttcttttgaatatatattttaaccgttctacattttgaatgtttaaattataatattaattttcttcccttgaaaatgcttttttgtgacataagatggtatacagcttttgaatatgtctagataattgaaaacacttcctaacttagaccttttaaaatctccaagcttaaggcattgaaaaagatcgggacgatattaagatattgattactcatgtaaaaaccccaattaatattttagtaaaaacaaaaagctttaaaatcgcaaattttgtccaaaaattcattttaatgtaatgattttattagattacacctaataagattatacattttaatggattaaaaggtttgagtatctcgttttcctcattaaaccttgctcactccattcatagattggcagagctatgacagaaaattaaatgaacacctgtgcagattcgaagcgcctattttgccaacagccgccagcgaaatctttaacaaagattaaatttaaaaataatatcaggcaccgaatgtaattctgagcaggcttttgtgggattccaatctacaatgatatattttaggaatatttgaaaaaagaatgaaaattccattcatttcaaataacacttttatagctccctaaaaaattattttcgatcaaaaagttatcaaaaaatctaggaacaaatatttttaaaggtttcaaattttcaaatagaattagggatttttaatatagatgaaaaaataaaatatatctttctttcgaccgactgtttattaaggggtaattagtatttacatgactttaattatttttcataattttgcaaatttgtttaccgttctcaaaaagtttcaggaattaaactaaaattaacctttttaaggaggttttatatttaataaaatttcaccgaaaaataatttttttttaaagacatccaattttctagttatgaaccgtgaaggggatttaaattttttctccttttgaatattattgcattacgtttcactaaatttttatcaatttctgaaagtttattgtcacaataacagaccgatgaataacattttattatgttaataatgtataaataaaaattaattgcaaaactaaatatctttaaagcacaacaattttgtaaaatgaataaagaaa

SEQ ID NO: 19027 - DNA, 1059 bp, Heterodera glycines
  misc_feature (977)..(977): n is a, c, g, or t
  misc_feature (1010)..(1010): n is a, c, g, or t
aatcaacatctaaacaaaaaaaaaatcaactttgaccccttgaaatcagcaaaatgctgataaaatcaacattttatatatttaaataaacgaaaaagcataaccttcaaaaagggaggtggaaatgcaaaaactgttcaaatgtaaaatttaattaataatggcaagaaaaaggctagcatcattaaaaaaaattatgattttatgccttcaaattgaagacacaaaaagttaaaccaggtacatgccaaactggaaaatatattaatgaaatgtcaaaaacgaaaccattaaaatataaatatagaaaatacaaaatgttgtaactaattaagaaattgaaaatgaaatacaaaaggagaaacaccagcagaaaatccaaaaaaaagaaatgaactttgaaaattttaaatgaatttaaaagttgcgcaaaatctaaaattcaatttaaaagcaacttaagatttcacttaaaaattaagaaacaaaataaattaactaaaatttgccggaaaccccggaggaaaaagatggaaaagggaaaaaaagaaatgttatcataagcagaatatataatataataaataataatcctaattaacaaaaattaataaaagactataattaaactaatcaaatattcttcctaattcctcgaatccacccgtaccgtaatgcgaacggacgtgtagccgagaattgaaaaaagaatagaaaagttaataggaaaaataaatgaattgagcaaataaataataaaataagtaaaggcgttattttaaaatatcttaagttaaagcaagtgcgaaatttcgatttaaataaaattttattaacaaatttgaaaaatataatcattttttatatttaatggtcaatcaaattcagttagtaatcataatcttttaagaaaaactaaaaaacatcattttttgatttaaaaacatcattattctgattcatccattccagaatanaaatggacgtatcgacgagaaattgaaaaaggnaaagataatgagaattaagaatttatttgacaaaacaatataataatta

SEQ ID NO: 19028 - DNA, 2810 bp, Heterodera glycines
ccgttcgaccgaaataactaaaaaaccgaaacaatcgactgacttttttgacaaatcagttggccgtttttcaaaattcattaaaaattcttaaaattttcctccggcgacgcctatcggcaccgccgaccccccaaaaagctattttttcttaaaaaattagccaaaatctcaaaatttggtatttttagacaaaatctgctaacaaatagcattaaaattacaaactcttatcagcaccgccggccctaaagttatggcttgagctcacaattaaggcaccaaaaagcgcaaaatgccactgaaaaaaggcacaaaaatcccgaaaaaggcatgaaaaaaagcatttaaatttttttattaatgatttttagggagcaaaacacgtaaaaactaaccaaaaactaaattttgctgatttatggataattcaatattttataatgtttttcaataaggaaatttttaaacctaaaattttttatcaagaaataaaatgaattttggcgcacaatttttgtgaaaatttttcaattcataaaggtatattctctgaatttttttagatcatttcttagcggtttatttttctcaattttaaattattttcaaattaaaaaacagctatttaaaaaattacaccccctaaatttggaactttttcgccactatttttgccactattttggcattttttgtcactatttagttaattatttggggattttttatcactaaaaatccgggccctagtaatcaccaatataaaatgcattctccaatttgtcttttcacttcttaccattttcttaattcagcaagtaattgcaattattttccgttaatgggcaaaaacaaaactcgtcacttttcagggccattaataaatgaaaaatttacaacaatattttttattttctttttttatttttgccttcggttttctcttattgattctgcgcaacagtttcaaattcatcacaattaaacagtccaatttattattattattattattgttctgttcaaattgcagcagaagtgatacaatcctttagaaaatgaatggttttattgtctaaaaaatgcagaaatattttaaatttattaattttttgatgaataatttaaataaaaataaaaaagattaaaaaccttttgggtttaggactaaaaaatgcacggtaaaggatattttttaacaaattttaaatttatcttaaatattttttaacaaaaaaatatcttaacagtttttttttatattacgacaaaataaattattatttttattaactttaacaattttttcccatttatttttctccctttagaaatgccgtcattttttgccattttttcattttcgttgctgttcattttgtgccatcattgttcatttgccgcttttttgatcaccaattatccaaatccgttaaacaacgcttcgctgtggaaatgcggcatttcctcgccgggccctttgtgcgacccggactcgctgctcaacgaaacggcacggcacgaggcattggagcttttgaagcagttccaggaccaaacggacattgatgtgggagaaacaatgaaaaaaaacaaaaaaaaaacatttaaaataatgatatttaaatttaatagagcggatttctcggttttattgtattttaaaaatccaaacacattatttaaggaaatcagaaaaattaaattaaaattccgattattatcatttgtcacaccaaagaaatttaaatgttgaaaaaacataaattattataattttattgaaggacaatggcgatggcagctgcaaaggcaaaggagtgattgttgggttggcgctaacgaaacagccaatcattgcgagggtattaatttttaatttaatgaccaaattaccatggaagtcgatactcattcagtcttcggacttatttggcccattccgttttatcactcctttacactgccgaacaaaatcaaaaagcatattttaaaaaattgagggatcacggctaaaaatgccaaaaccgaccattactgcctaaagatccttcacgccattttaccaccacagaatgcgcggatcaatgtgacggacgatctgatgaagaacatttggcagttggacaatcggtgcaacaaggcgctgatgctgacgctgtccgtacagccaacccccgtggtgcgcttcactcggtacatgaccacgccggtgtttgacgacgagttgcaccacctgatctggactgaggtgtcgaccgaccgggaattaggcactcaccaattttcaatcaatttattttccaattagatactttaattttgtttgaaaatgatcgtagtcgtgtgagcttttctccgccattggatgttttacagcaataagttaccgtatgccaaattcgtttggattttcagctgactcttaataatcttttgattttaatgaaaaataaaaaattatatatattttcaagtcatactacttttattttctattcagatctctttttttgtatttcttaactttccatgtgtcttttcgtacaaaggcaaattaaatcattttaaaataaaatggcactattaattgactaattaaagtgattatttaccatttttggcaattacccccccccccatttgtcagatgcattggcttcgtgatcgcaattacatcatgtgggtccgcttggtgctggacggacttagggcactgatcgtggaccggcacaacactttgggcattggcccggcccagcagctggcggcagccaacaaaaagtgtgccagccatggcttcgtca

SEQ ID NO: 19029 - DNA, 2050 bp, Heterodera glycines
  misc_feature (48)..(49): n is a, c, g, or t
  misc_feature (56)..(56): n is a, c, g, or t
  misc_feature (60)..(60): n is a, c, g, or t
  misc_feature (62)..(62): n is a, c, g, or t
  misc_feature (65)..(65): n is a, c, g, or t
  misc_feature (68)..(69): n is a, c, g, or t
  misc_feature (92)..(93): n is a, c, g, or t
  misc_feature (99)..(99): n is a, c, g, or t
  misc_feature (104)..(104): n is a, c, g, or t
  misc_feature (109)..(109): n is a, c, g, or t
  misc_feature (116)..(116): n is a, c, g, or t
  misc_feature (120)..(120): n is a, c, g, or t
  misc_feature (122)..(122): n is a, c, g, or t
  misc_feature (125)..(126): n is a, c, g, or t
  misc_feature (128)..(128): n is a, c, g, or t
  misc_feature (134)..(134): n is a, c, g, or t
  misc_feature (141)..(141): n is a, c, g, or t
  misc_feature (144)..(146): n is a, c, g, or t
  misc_feature (148)..(148): n is a, c, g, or t
  misc_feature (153)..(153): n is a, c, g, or t
  misc_feature (160)..(160): n is a, c, g, or t
  misc_feature (164)..(164): n is a, c, g, or t
  misc_feature (166)..(166): n is a, c, g, or t
  misc_feature (179)..(180): n is a, c, g, or t
  misc_feature (185)..(186): n is a, c, g, or t
  misc_feature (190)..(193): n is a, c, g, or t
  misc_feature (198)..(198): n is a, c, g, or t
  misc_feature (203)..(204): n is a, c, g, or t
  misc_feature (213)..(213): n is a, c, g, or t
  misc_feature (218)..(218): n is a, c, g, or t
  misc_feature (221)..(221): n is a, c, g, or t
  misc_feature (229)..(231): n is a, c, g, or t
  misc_feature (240)..(242): n is a, c, g, or t
  misc_feature (248)..(248): n is a, c, g, or t
  misc_feature (251)..(252): n is a, c, g, or t
  misc_feature (254)..(254): n is a, c, g, or t
  misc_feature (257)..(258): n is a, c, g, or t
  misc_feature (268)..(269): n is a, c, g, or t
  misc_feature (277)..(279): n is a, c, g, or t
  misc_feature (282)..(283): n is a, c, g, or t
  misc_feature (295)..(296): n is a, c, g, or t
  misc_feature (306)..(306): n is a, c, g, or t
  misc_feature (315)..(315): n is a, c, g, or t
  misc_feature (318)..(318): n is a, c, g, or t
  misc_feature (325)..(326): n is a, c, g, or t
  misc_feature (335)..(335): n is a, c, g, or t
  misc_feature (337)..(337): n is a, c, g, or t
  misc_feature (340)..(341): n is a, c, g, or t
  misc_feature (343)..(344): n is a, c, g, or t
  misc_feature (350)..(350): n is a, c, g, or t
  misc_feature (353)..(353): n is a, c, g, or t
  misc_feature (378)..(378): n is a, c, g, or t
  misc_feature (380)..(380): n is a, c, g, or t
  misc_feature (384)..(384): n is a, c, g, or t
tttcttggccttcttggttgcaatctcatcaacatcatttttttcggnnggcacancacngncancanncccggggcactttttgaaaaggnngacaanccaancaaanccagggnacgncnganngngcgccnagggcgnggnnngncaaanacataanaaanancaacaaaaaaccnnaaggnnaacnnnngcgancagcnncacagcaancaaancgnccaagggnnncgcaaggcnnnccggcnccnncnccnnggcgagcaanncagcagcnnncanncccaaaaacccnncggcaacacncgaaaacanggngacacgnngagcaaggncngcnngnncaacanccngcagcagaagacggacaaacaccgngnggangggggcaatcgctttttggccgcaagcctcacacatgttatcatcggacaattttcggcggcaaatgagccccttggaacgaaatgggcatgcctaaactagaaaaaaattaataatttaattaattaatttaatttggactttgtaaacacggtactgcatatttgtcacttttcccaaaacataaaaaacgccggccgaattgaagttgaccacatcgctgatgtgtttcggttcaactgaatccaactcctcttgctgtcgtgtcccttgctccgggagttgaaagcgtttaagagaattcattgcaggaagatcggaaaaaacgaaggaggatggaattttttaaaaaatggaacacgaatgatttttatttagaaaaactgtggttaaatagcaaaaaaaattgaggcggaaaaaagaaactaaaaagccaaaaggcggagtcgtattcttagcaaagcaaaacaaaaaccaatgggcgtgaccaacaagaaaaggggcggagtattttttactttccatgatgacgtcatttttttacaatttaatgaattggagttttttgctaatttacttaaagcttcggatatgatatatgcaataggcttgggtttattgattatttgtgtacagtccttacaataggttttgccttttttttttttgggggggggattattttttaacctcctcatagactggggataattggagactggggggtaattagagcaaatactgtattttctctctctcgaccccatccaataggtttgggtttgtggaaggggatgtcagagaaaaaaagtagacacactcaaattatcgatcgaaaatcaatcgataatttgattgggaatattatctactaatttctttttttaaagctaaatgcaacttaattttaccatatacatttttaaaaaaattgaattttaatgatatttatttgtgttaaagattttgtaataaaaataaaacataaaataatttcattttatacaaatctgagatctaacacatgaagataaaaaattacacgtgatatcaacataaaaatgtgcttaaaaaaataattttatagaattttaaaatattgctttttgatcctcaacaagcggagcacgagttggatgaagaatttatagcatttaccttcaaaataaataacaattcaattaatctgtcataaatcggtttgggtttcattggaatgccgaaggattgttgagtttgagtctaagtaattggaacgccggagaattgagtcccggcgattgggatgcagaagtggttagatagaattacaatgattgtatgccagagaattgggtctcagtgattgtaatgataaaaatgataaaataaagaatatgtgttaattaaaaacaaatgaaataattttaaataagaaaataaaaaaagaagctaagtatttaaaaaaattctaaaattatgaagataaaaaataaaatgttatcttaaattacaaattataaaataataattaataacagcaattattttcagataaatcaaataaaatccgttatttaaacaatttattttaaatttaaaaaaaggattacagtaacatactcaaaaaaactacacattaacgcatgagaaaaaataatataattgatataaataaattataaaa

SEQ ID NO: 19030 - DNA, 928 bp, Heterodera glycines
attgggatggatgtggctcttggataataatttttttatgtttgttattaaaaaaaattataatttttttattttattgtattttatcttttattcattcaaacgatttaaatctaaattaggcgtaaacattttttcataaagtttattgatttttaaaatatcaaagttgcctggtctgagtcgttaaaaagataaaaattattttattttctttatatatcttgtcttaataaattttaaaaacaatgtaaattaaaaacctatttaatttatgatcgatgtccaaattttatttttaacattcgatatttttattataaattgctatactcttaatatgtttttttagtaattcaaatttgagctcgttcttttcacatttaccgtgattcggtcataattattaagtttagtttttttttgtattcataaatttatgttttatcatattaatgaaaattttataccttaagtaacgtagtttttatatcatatcttttttgtatttaaagacgcgcttttttttaatcttagaaacttccatatggtggagatgtttgaaaaagatatatcaataaacattcattctacatatatttattaattataatatttgttgttttaatatttgcttgcttatttttacttatttatttcttttccattatctcgcatcatagcaaatttaattcttttaataattattagtttgttttgtaagatcactcaatttttttattttattttaaattcggagtgccttaaattttttaattatagatttttttacaatctaaaaactagagcccggcgggatcgggactcccgcgggattttacgggattcccgctcccgactcccgcttttttcggtgaacgggattttttacgggatcgggatttttacgggattcccgttcgggact

SEQ ID NO: 19031 - DNA, 1193 bp, Heterodera glycines
gtaaattaaattaaaaaattttctcaggcataaattttatcgggtgttttttgccaaatgcaaatcaaaagtttctcaaagtttttcggcagtgaagcagctcactgttgatcagggcgcggaacaaaaagttttcaaaatcagaatatcgggcccaaaaaatcagattttggggtcaaaaatcatgacattctgcaaaattgctttaaatcaagtcatttttaaaatttattcgatcaaaaatgtattaagtattatatttttcgcctccattatcgaatttaacaattttttttcggcgcatttttccaaaaaattctggtgaacgggcgaggggaggggctccggaagtgccgattgccacaaatcttatattttcttgataaaatagtgaaattctgccacaaaatttaaacattgcgaatatgtttaagaaatcaggaccaaatttggtcgatacaaccaaatcaggacgaatctgataaaccatgacagatccgcgccttgctgttgatccactcgcgcatccattcaaatttggatttaattttagggcataatcaaaattttttcctaagagatattcaaattgtaaaatatttcacaagaaatggcaaaatatgcaaaaaatctgaaaatatgtacaaaaaatggcaaaatacgcatgaaatatgcagaaaaacccaaaatatgcatgaaatatgcataaaaacccgaaatatgcaaaaatatgcaaataaaagtcccggtttttgtaagcaaataccaaaaagaaggtgtttttcgtactatttggactacgtagaatccaggaaaaaatgcatttgcataaaattttgtctttatttgtgcgtcatcatcatcttagtcgaattcgttattttcttatataaataagatttgatattaatatgatacttaaatgatatacatacttgatgttagatcatcatcataaaaaagaataatatatatatatatattatttatttaagcatttgaactacaaatattttttgttcctcttattgcttttttattatttcgcatttattttcttaaacattttagcttttgaattattaaactgtgaattgggttttagctttttttattaaatttagtgtaaaacatgtaaattttaattagcagtaaattttattttgtgcaaaaatgtactttttaacaaatta

SEQ ID NO: 19032 - DNA, 2593 bp, Heterodera glycines
aatttgtggtatgcaaatgtgagtgtgtaggggggaagatacggtattttaatatgttttgcaaattataccaagatagtctaacttttcttatatttagctaatttgacccaacccggacaattccgctaaatcaaggtagaaaattccccactccttcaccctatacatatttaaaacttttagttcgcccacatttctatgggagtacgtaacatttttcaatgataaatcaaattattatccattacagttccagacggcatgaggcaattgttcaacccggctcccaccccgccagtgctttatgtgttcagaggaccggcccgaaatggagttgcgatttttaacccaacaattccaccgccacctccggtccttcgcgccccgggaacttagtgccgatcaaacaattggacgattttaggaatgatttttggataattgttaaccgatccctaaactgttgatctctcataaaagctgtcttccttttaggggcatatctttcattttaagggaaaagctaaagaaaatagtgtggtgtgacgggtgaagatgctatgaaagtggtgaaaataagtgataggcaattggaaataaaagaaatgttgcggtaaaggtggtgaaaagcaaacagtgagacattcgtgaaagtgatgaaaaccaaaaaataattaagttttagtacatactgcttagaatgcattttcgtcgcctgtaaatacaatgtgatatagagtgcgcggtataaacaattcgctgaattttggctgggtaggctgtttttggctaggttccaattacactcattctcattgatttgtgcgccaaccattttcgtcataaccaaatggaacaatttctcgtccgccattttttgcaatacgttgtctgtcagtacaatgcgatatacaacacagagagaaatagagtgcacagttaatcaatttctgagttttggctagatggactgcgtttttggctaggtgccaattcactcccgtatttatttattcgcgcgccaaccatttccgtcatcaccaaatgcaaaatttttcacgaccgccaatttatgtgccatacggcgcctgtcagtacaatgcgatatacccgcccaaagagaaagagagtgcgtggtataggcatttggttgagttttggctaggtaggcagagtttttggctaggtgccaatttactttcgttcttattgattcgtgcgccaaccattttcatcctcaccaaaggctacaattttctcgtccgccaattatcgtgccttatgatgtctgtccgtaccttacacacaccaaacaatagtgaaaggggcgtgactcagtcaaccatgcgcatactttgttcgctaatctcggtaccagccggtaccgtttatcacggacagtggccggcgtctctttttgtgtatttaagcagcggatttataccattttagtcactttattaaagcagcaaaaattaaaattgattatttttaattaaatatgtccgaaaaaaaattccttaaaactggaaaggaagtaagagcaaaaagaaatgtaattaatttttttaaaacgatccctaaaaaaaatgaggaaactaattatttcgaggaaattgagagttatataacggaaaacaaaaaattcggcattacgggacatgttacaaaattctattttaaaaatgcctataccgagtcagctgaagaaaactttaaaaaaacaattaacaaactgattgagaaagcttgtgataaagaggaaaatcaatgtaaaatttgcaaaatgtcagtgaatttatattgtaaaggaattacagaccctgtagtaatacctatcagaccgaaggagcaaatatctgcggatacgattcttaatgagtttattaaattacaacaatcgtattcggaaatcaatttactcgatcaagaaatatcagtaattttcaccacttattcaacacctgcaggaagcggtaaaaaatataattaattcatatgctcatcatttttaggcagaaaatcaaataaattaatggaaaaaaatgatcttagtcgtattcgtatttctaacgctgacaatttctgtaaggggttaatcaaaaaagagaatttaaattgtttttcaggtttattttatgccttagagctcacccgtcattaccagctcattaacaatgggataacatataaaaaatatttatgtgttataaataatcaaaaaaaacaaaaaacgattgtgcgagatttgatgaatgaggcggacattaatcaaaaagaaaaatcctacgggctcgatcatatcaaaataattcaaaatttttgggatcaaaaatattcgaaattatatagaattgtagcctttgattatgtaagaacattctcgaaaaaactttctttatttgtgttttagaaatgtggtttgaagcctatatttaaagcagaaggtgggaggcggtttgaagttgctgttttattgcaaaatggacattggtgtggactgaaaagaatcagacgttttttcaatgtacgaaatttttgtgtactaggaggatctgtttatcaccatcccgaagatcacgcaattaca

SEQ ID NO: 19033 - DNA, 851 bp, Heterodera glycines
  misc_feature (47)..(47): n is a, c, g, or t
ataacaaattttgatttggagcggataaaatgatgtttaagactttntggaagtaaattgatcaattttacgaatgcatttattggtttgagattttttaggggaggaggaagattgagggtttgaagctctcttcattataatattgttatgaattatgagatttgtataaaatattttaattatagcgaacaaatttatatttaaatagtgttattagggttattaggataaggtcagaaaaggaagcaaatgttgatgaaagaggaactgggggctggagaaaatttttgagagcagagcgctgcggaggctttttggttagaagagaggagctgggcgctgcagaatttgaaaatgaatggaagaaaggggcttttcgctgggaatggtcgggtatttatacccacacaggtgggcggagcttgagctttgctcaagcattggcacattgccaactaaaatttaatgctacggctgcctcaatagcctttgagttgcgctctgaccaacagctagtgctttctattgtcaccagcgggcgctcaaatggcccctgcgtgcgctcaaatggcaggcgcgagcgctcagatgtcctggcgtcccttcccttccccaaagggtatgacagctgacccctccctttgcctccctttcccttctctaataggatttggctttgggttttatccttcagatgttttttcaatttttacctcttctgggattggatatatttattataggtgttttttaaggtttaaatctggtactgaaatgtccctttcaactgggactgaaatggcggggttgaaatacaaccccgaaaatctgcatgggtaactactttt

SEQ ID NO: 19034 - DNA, 886 bp, Heterodera glycines
tgaattttccctaaaaaaatttgacaattatttttcgggattttgacgggggatttccgacatcaattagcaatattagcaccagcaaaattaaacagtgtcgatttgctgctgtttctctctcttttctcctcatttttgcgccgaattttccttttcctctctttctcttccgtctctcctccttccccaatgctattttcctcctcttcccttgtttctccatttttgctgttgtctatcttcatctctattcccatcaaaatttgctgctgttgttgtactgcttgaacttcttgtttttgttgctgttgtttttgatgatattcgtaattgagttcgaaaattagcatatgcacttataacggaaaattgaattcagaaaaggcggggaaaagtgtcaaagcaaaggaattgggcagttggataatgaagcgatgcaaaattggggaggccatggcagcagcagcagcagaagatagatgaaaattgggacaacaattgtaacttgtgttcttttggcttttagtagcactaattgcattgggtgagcaattaaaaaaaaggcatttaattttgtttaaataattcaaattgcggctaattaaggcaattgtctccgccaccggaagaagtggaagaagaagccggacaaagaatgaaattttatgattaaaaacctcttaaatatattttcagggcggtgaatacgattctgacttccatttcagaaattgtctccattcgaattctaggttctgaattcgaaaatagttagtttttaagttataaaaaaaccgcaaaatggggcaaatttaattgcattgcaaatatttatttagtgggcgccgccgggggggggggggaggaacagcgccactcagca

SEQ ID NO: 19035 - DNA, 2828 bp, Heterodera glycines
atgggtcaagcccaggggaccagtagcgttttgggcccccgtttttatacccccgcgtttgggcccccagtgtcagacaaaattactcataacgccaaatagcgcatttggcgtaaatttttgcgcgctaattcaaaatttacactggtaaatgccttttttatattttttattttgatcagccataactcgcttcattcccgactaaactgaacaaatttggtatctaaaaaaagattttgtaatggagaatctttttttaagcgaatgttaagcaatttgacatctcagaaaaaagttgtgatagtttcaaatttttattacgttagaactcaagtcctaaactgctgttttcaccaaaaatcctaaaatttattctttttttatttattctatatgtccaaagtgatcttgtagcctataaaccaaaattgttagaatttgagagtttcaatgttttgtgactcgttttttacgtgttactcccatcggcacttttaccggcatttctttttttattctctgtcctttaggacatcaatttgctatgagtaactttgtcaagggtctgttgccatggcttgcccttatggcgaccgccccaattttcgtccaatattttcttcgcgttaaatttgatcatagaaaaactcgtcgtggcgatctgcagtttcttggttctgattctgacgcaagtacacgcaattacattctttttaatcacaaataatgtgtatgtacagacatcgggcacttttttacttgggacccccgaaaacatattaaaaattttaaaaaaatatgaattttcttgttcaatttgggtccggaattctgaattaattgaaatagatgacggatttgtggtcagcaacttcgaaaatgtccgttttcactttcttcccgtcagatccctcactcgaaaaattgtaccaacaattggtggtggaccaagacttggacggttggcagaatgtccgtggaccgagggacgaagaggacaatgccgagtttgaggtggtcaaagcgcgccgaaaggcggaaatggacgctaaacgggaacaggtgggcaaattaattacgattgaaaagccattgatgccattcgttcagtaaatttttattccttttaattcatggaattttcggcggcaaagtggcgctctttaataataattataaacccgactggctattgacccttatttgttaagtttgtaaaaatatttttcagaatatttctagtcgtgaatgggagttcccgggtttaggaaaaatggaaatttgactaatttcttaactaatttcattcaaaaaaaaacaaaaaattcctttagtgttatcgccttatatgagtaaaatcgcggtgcaccccaaaactccgccgcccaaacttcgccgagacataagtccgccgaggcaaaaaattttcaaatttagaaatttttcaagaaaaaaattctagaaaaatcaaaaaattttcctaagatttttttcttgaaaaatttcttaattttgaaaatttttttaaatttcttcttggcggaatcgtatggcctttggcctgagaatcacttgcgctttccgttttcattttggttttgcaatggtttcaccccccccccctccctccaactaggacaaaatagtcaaaaactaggtttttttcctttttttaaatgtttgccaatttttagtttcgtggcaaacgcgaacagctcataaagaggctggagaagcagcaatgaaaagatctcaccattttatttttgttttgtttagaataaatgtttttgaataaaaaaaaactaaaaataaatttcttttgtcgcaattcacaacggttttctttcctcattttgttaaattgccttttttcttttgtatatttgactcgaaaataccaatggatttcaaaaacaattgttgtttttaatcttttccatttcaattttatgaatttcagtgactcattgtcagaaacaacagtgctaatgtcttctcgcatttctgtcagtgggactgcctattgtaaaatggtgctccatgccatcaaatacccccattgccctgtcaggtgaaaatgggcacggccaaatgcctccgctttttggcatttcatttgcatttgtcagaggcgttctcctgggcaaacgcagcagcacgcggaacacaaaggcagccgaagagtcaaacggcgcgggggacgaaaacggcgacggatcgttggccgaagcgaccgtcgaggtgaaaaaccaacccattggaaaaagcccgaaaataaattcaaagcaaattggaagttttcaacgaaattccaatcccgggagcagaacaaaacgtcgtcgtaaaatttttttttatgaattttggaaaaataacaacttttagttacctagtctaaaccgaaaaattgttattaagcaaatttaaagaaatttaaaaaatatggatttttggaaattcagcagatttatttttcctaaaccctagaaaaaaagctcattttcccaggtggtcgatgtcgtgccggccacccattcgcccgtccttgcgccgaccattgaggcgatgttcgtccatttggacgtgttctgtcggggcgagcagggcacagacattgtggggctgtatttctgcaatcagttgctgaccaacaacgggtgggtgttttttggaattatttgccaatttcgtaaaacggaaaattcttctccgaatttaaataacctttggaatttccaaaatttggcttaaaaatgtacagacttttgaagaggaaacaaataaaattgaggaataccttcgcttttgaattagtttattaa

SEQ ID NO: 19036 - DNA, 2676 bp, Heterodera glycines
  misc_feature (30)..(31): n is a, c, g, or t
  misc_feature (40)..(41): n is a, c, g, or t
  misc_feature (78)..(78): n is a, c, g, or t
tttcagctcgtacaaagcctaaaatatatnntgttcctanntagagtggaatttttttattagaatcttatatttttntagttctaaaaccttgacacaaaaaagagaaatgaatgatactttaggtgcaaaaacagcttcaattttgtccattgggatttgtttcatttcaatgcttttttattgttacttgttcaattaataaaaattctatttattagactcgtatacatagaaaataaattttttcttcgctgtttttcaaaagtaaaaaaatttggggacgaaacgacacattttctattccttcctgccattttcttcccaaatatatctcgggataatcatccggatcagtgtgaaaagcagcagcggagagtaacggtaggcaaatacccccgacaatctcggacaagggcgattgacataaggcgagtccccggcttctcattcaacataagtcggtggtgccgctacaacaaaacaatatcggcacgtcgttgtttgactccaaacccctatcttcttcttgaagtgtgagtttttatgcattcatcagctaattcttttaaaaaattaaaaagaaaagcaaatttttaaattaaaaaatattaaaaatttaaattaaaaataatataaaatattattcatagtaactttatttttgaaaaatttttattaaaaatttgagtgaaaaattgattgcattgctcaaaattacgtgaatttttattgttggaaaagatttattaaagagaaaatgaataataaaataaatattcatattaaaaagccaataaaacactaaacaaatttatttactgcagtttaaattttataatattctgaatactttacatgaatttgtggcatttaatattttttctattttgctttgttattaaaattgaatcgacaagatcagcaccaatcattgatggcatattcggcgtagaatggtttgatgatgcagtgaagaagtagtgatcccaattgagcatacatcaatgaaatgagaattttcacagtgaagttgtcagagagcgacaaatcagcgtgagatgatcgataactaatcgataggtgagatctcatatgcaatgattggcttaagcatgtcgttttgtgactcactctatctttagggtcattatccgcttcgattttattctcttagtccgtgatttacgagataacgtcacctttttcgcagtgtaccgttggcacaggcattttcgaatcggtaggctcttcctctcagacgctcattgaacatttacttcggcgtacccctccgcgttgtattgtccattgccgtgtaagaggatcggtgtcgattgggaaacgaagctgaacaagccgaggagggcgaatttaatgaaggaattcccgcgggggactcaccgagtcgcccgttcgctcgtttttgggcaagtgcaaaaagacgccgacgaaagtgttttgaagacaaacaaaacaaaatgaaattggacactttgccaaggataaccaatgtactgtaataggtatgccaatttgtggtggtaatttattagctaattaccccccccccctctcccattttcaccttgcgattaatgtccaattgtaccattgtttgctgtccatcggcggcttaatgccaaagccttcgatcaaattaataacggcggaagggccattagtgaaagtgaacatcgaaacgattctttggacaaaggcaaaatgagaagcgaaacgcctttcatctgaattgaaatggaactcacaaagtgacggtccacgtcactcgctgttcagttttggagtgaaccatttgctgggagagaccctcggaagaagtggactttgagggcctaaaacggacggaacggtggggagaaagagcaaaagaaagcccaaggggtcaaagagggaaaaattattgtcaaaaagtgggttgatcattcgccaataaatacttgatctgtttggtggtgccaatgatggccagttccctctggcgacgccggagggcgcaaagcaacaaaacgttgaggacggtcagcaaaatgatggggaaaatgacactgaaagtggggagagggggggggagtgaatgtgtggacgagggaaaactttcgttggcatttgccattcacctgatcaccgtgtttatcaacgtgctgattgactaaaggcatatttatttgccaagttctctccctcgggggacttacgataaatctgcgaaaagcgacggagtacggattggcctttttgggccattctctgcaaacggaaattgtcgcaagcatttaaaagtgccacaaactcctgagtgaccggcagacagatggaatggatttgcgtgccgttgcaaaaggcgcggatcagacatttgtgggagaagtgctggtgtgcggtgagcaacgcaggcaccgccaaaatgaagcccattagcagtgccatctttcgccgggggacgtgcccccgggcaaacaacgggttgcgaattccgattagccgatcagtacacacggcgatcacacacctcaaaatgtgcatttaataggaaattggaggaggagggaccaaccaaatggccacagcggatgcccaattggcgatggaccgcaaatggactttggcattaaaataaaagagacggaaaagggagagggaagagaacagcga

SEQ ID NO: 19037 - DNA, 1003 bp, Heterodera glycines
  misc_feature (870)..(870): n is a, c, g, or t
  misc_feature (903)..(903): n is a, c, g, or t
  misc_feature (918)..(918): n is a, c, g, or t
  misc_feature (965)..(965): n is a, c, g, or t
ttttctcaaaaaaatgattcatgggtccttttattctcacagtaaactcaaattaagaaattaaaaatcaattaattaagaatttatttaaaaaagtagtgggtcttttatccgtgggtcttctgtcggcgtgggtcttttgtctgtgggtattttgcgagtgggtcttttgtctgtgggtcttctgcgttgacaccattggaagcactgggttcaaggtggaaaaacttaaaaatttttaggattttttaataattcttgaaaggcttattttatgagtggtctcgaaaattcaaaaccaaatataaatttaaaaaaagtacataattaattgattttattgtgtttcttaatcttatactaaattagaaatacattcatttcttattgttttttcatttttattcttttcttaaattaaaaaatatttttacttttcaattttaattatttttttaaatagcattgtaaataaaaaattatttagctgaatgattacatggaacggatggtcacattcccgagcacatgcgtagcaacttatcggcttgaagaaaggccaatgcgtttggtgcgcaattgcaatttggtggaccagaaaatacgattataccgcgatcaggtcgaaaaagaaattaattttatttggtatatatttaatagtattatcttgaaattatgaaaattaataagtttccagcttttcggcaaatagtgaaaaatggtaatctctttaaatactattaaaaatatagaaaaaattcaatttctcgttttctgttattgaatggttcgtacaaaaatttttgtaacccaagaaaaccgaggatggcttcctctaaaataataggagtatttatatttcattanaataataacataataaaacaattatttaattanagattgtcttcgttncaccaaattctttggaaaagcatggacgtatgataatcagaaatgangcacacaaaatcatacactgtcccatacaatttttgac

SEQ ID NO: 19038 - DNA, 888 bp, Heterodera glycines
  misc_feature (32)..(33): n is a, c, g, or t
  misc_feature (50)..(50): n is a, c, g, or t
aaggtgagcaaacgttctgtgcgctcattacnnttaaaatttaaaaaatntgaaatctcttaaattagaaaaatatgagtgcgacagaatttatcaatttttaatttattaaatggaatgataaaaattgataaattgtttaattttttgttaaacttttattaaaataaattcattgctaggtttggcacttccgggttttgctacccacccataaaaatgttatgattccgacaaaggaaagcacttttttcttgaatagtttttggcgcttattcatgaatcttaggtcaaaactgcaaaaatctatgcttatatcaatgtttttatcatttgtttttgttaatgtttttcgaaaaaagccaaaagtctttttttttgaaaataaaacccgaaacatgcctaggatttccctggaacaagaccattcgatccctctcggctataggaatcgatgatatatgtgataattagtaattaagattcacggaatttaaaaatgctgattttcctgttcatttagtaagtaagtcagaatgacttgaaaatttgtaggaaaatagcttagtataagggctttctgcctgtaaaatttcagaatttttcgataaggtgcaaatttttttacaaaaatcagcatgtttttaaaacttgaaaattcacggaaaaatatttccgtgaaattttcaagtttattaaatacgggaatgtttagaaaaaagttttggatgtatgaaatctgtttaaagtaggcaagcagaatgacctatactaagctattttctgcaaattttcagggcattctgacaattattaaatgaacagaaaaatcagcatttttaaaatcagtgagtcttatttacctaaattttccatccctagtgataa

SEQ ID NO: 19039 - DNA, 1005 bp, Heterodera glycines
gtctctccataaatctgggcgcatcggttcggggggactgccccgaaaacaaaaaaatagatttttcaagtgtccgttgtggtgctcactcaatcatggggagcgataatccatcgcagaattaaagtacagactatagggaagctattccggaaggattcggtctctccataaatctgggcgcatcggttcggggggactgccccgaaagcaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggagactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagc

SEQ ID NO: 19040 - DNA, 2624 bp, Heterodera glycines
  misc_feature (2516)..(2516): n is a, c, g, or t
  misc_feature (2593)..(2594): n is a, c, g, or t
  misc_feature (2609)..(2609): n is a, c, g, or t
  misc_feature (2611)..(2611): n is a, c, g, or t
ctatcgttatataatattttcaaaatgttcttagagagcggaaagccaaagactcgagaaaccgagaaaaaaagtcaattctttctcgagactgaagaattgtcacaacaatttcctctgaaaaatttgaacatgttggaattcaaacaggtcaatgatctaaatgagatatgcaaaattcctaaaaataataatttttaattagacatgtaaatgtaagccaaatgctccatttcattttataaaatccctcaatttttaggtgttcaacttcaacccatttcccatttccatgctccgattatcttaaaattaaaacttacgactcaaaaacttctataattttttttttctaaaataacttcaatatttattttgaacattttcacactcaatttttctgatttcgaggcataactttaaatgaaaatattgtaattttttgattatgactaaatgttttccttatttacattgacttaattgatttttagttatccatttaattataacgcaataatattcattagtggaaagccaacaaatgcttcattttgacaaaattattatttatacaaattaaatgcttttgcttatattaattttgtttaattttttttctgaaaatcaaagtcagccccaaaacggagccaaaccgaaggattccatcgatggtggtaagcaaaacggacggaatattttgttaaaattttgtgaattaaaaatttgtaaaagattaccagaaaagggacgacagcggaataatggtggaccaatttttggaggaaatttaccaggaaatttgtcaggaaaatgagcagaaaaagtgccaagaaagtgagcagaatggtaaaccataaacaaaatgaataaaaataaacctgaaaaaataacttgggttctgttttatttttttaattgcaataatttgagttagggggcgattggttgggtcttagattcttgaattgtttgtttcggatgtcttaaaatatatttgatttgacaagatgtctaatcataataaaagtttaaccattcataattaattgtgcatttttaaagttaacggaaccgacaattggccaactcaagaggacaatccgccgacagaggacagtgtgccgcatgtgccaaagcttatccacggtagtgccataccaaaaccgatggattgaaccaataaattgagaaaaaagcgtgatcggcgaaatcactaggagaagggcataaatggcatccagggaagcttgttaagtggtttcgtgaaaatgcaccttgggtacttacaaattagcgacaaaatcgtcataggttttcaaaaaaaattgtaatcaaaaaaactcataaaagatttttaatatatgtaattttttatttactaattgttcggtccgagggatttgtttaagtccaattaaatatttatttattggagaaggaaaagaaagtcacaataatttggggaacaaatataaatgcaaaatgaatgaagggaagacaatctaaaggggaatgggagcatatttatgggcgagggaaggaacatgaaatggaacagaaatcgattggcattatgtcatgtcattcaaacttcggcggcagtgccccgaacacctccccccttaagcgcggttcccaggttacggtgagaagcgctgcggcggacggcgatttcgctgagggtaccgtcgttgctgtccctggtcaatttgacctcccaaattttcctgttcgccaagcgggtcctccaatggcatttccactgggattgccctttgctcctcaacagcaaccggtcttgggatgtcgaagacttcgagcatcaccgagagctgttcgtcggagtcagatgtgttgcgaggacgaagctggttggcgtggtatcgccctgacttaccatcggcgaatgtcacgtcgtaaatcacaccagttcgctttgaaatcttgccctgttgccaattttgggaaattctgtggcgggcaaagactttgtttccgatcgaaaactcccttaatttggttccaaatcgcttattgaagcgtctcgccatttctacgtctctttcgatcggttgtgctggtggcggccgcaacaaatccaaagttgtgcggggttttcttcccagaaacatttcagcaggtgttttgctgttcggcaacgaatcatttggcgtagtccggtaacttaccaggaaagtttcgatgatttccttgcttggggctccctcccctttcaattttcgaaacgttctcttaaacgtgtccacgaaccgttcggcttggccgttggacattggattatacggcgctgaaaacaggtggttgacaccgttgatggccataaatttagcaaattcgttgctcgtaaattgggtgccattgtcagacaccaaaatttccggaatgccgtgtcggctgaacaaatatcgaagtttttcgattgttgccgctgtcgatttggtggccatttcgaatacctccgggtatttcgaaaaagcatcgacaatgattanatattccttgccgaaaaatggtccggcattagtcgatgtggactctttgcacggtgcaggatggttttgggcatggnntgaagattacttttnanctggtgcctttgc

SEQ ID NO: 19041 - DNA, 2073 bp, Heterodera glycines
gtttcaggttttttaaatagtagtcattcgtttaatgtcagttcattagggggtgtgcgtaccatgggtgcaaaaattgttttttgccctgggctgttggaccgaacgggctgtgcatggaagagaattacagaaggacagagatgcggatggaagcattgagagatatgtgtaaaaatttcagagtggaggaagtttgggtttggcaatttccaaatttattgataactgaacaaattaaggaatgcgaggtgaaagcggaattgaagagaaaccgagagatgaagaggttctttgaaagtgtgccggataagggaccaattaatccgagggatgcttacgcaggggacgaacaatgcctttttgcttgtatgcaaaggctacggaagcagttgagagttcgatgtttgatatcatcagtttgtacccctttgtgaattatggtaaaaatccgcttgcatttttaatattgccattcacttaagacactccttatcctgttggtgtcccaaaaattgtggtgagcaggaattttaatgtgaattggacggtgcccgacgatgtgccctatgatggactgctaaaggtgaaggtcatccccccgaaggagctgctgtaccccctcctccctgtgcacattgatgaaatgctcctcttcccaaattgtggtatttgtgcgagaaaggccaagaacgagtttgttacgacgaaggatgtgaagagatgtagccatcggccagagcagagggcatttttggggcgttcacttcgattgaactgcggaaggctatggaactgggatatagggtcgttggcttctatcgggcttatcactttgaacaatttgacaatcaattattcaaaggatatgtgcggatgttcttgaaaataaaggtggaggcgtcagggtggcccggggaagtgaagagtgaggaggaaaaaagtgcattcatccagatgtacaaggcgaagtacgacatctgccttgattacaacaaaattgtctttaacccaggccttcgtatgatagcaaaattggtacgaaatacgcaaatattaatttatcagcgatgaaaattaaggggttgaacagcttgtgggggaagttttcgatgcgcaacacgctttcgacgagtgagatttttaacagcatggaacggtgggtcgcattgtcacaagacaatacgcttgatgtttcgacgccaatacaaatatgtgaaggagtagagcgtgttgtatgccagaatgcaggtatatttgctcatcttattttattctgggggcttttacgtttaaaaagtcaaaaataaattcaagaaatttttccccggactacacgatcttttatcaccataatgacaaaatggcgccagaatgcaggtatatttgctcatcttaatttattctgggggctttacgtttaaaaaagtcaaaaataaattcaagaaatttttccccggactacacgatcttttatcaccataatgacaaaatggcgccagaatgcaggtatatttgctcatcttaatttattcagggggcttttacgtttaaaaaagtcaaaaattaattcctgaaatttttccccggactacacgatcttttattaccataagacaaaatggcgccagaatgcaggtatatttgctcatcttaatttattctgggggcttttacgtttaaaaaaatcaaaaattaattcctgaaatttttccccggactacacgatcttttatcaccataatgacaaaatggcgccagaatgcaggtatatttgctcatcttcttaatttattctgggggcttttacgtttaaaaaagtcaaaaataaattcctgaaatttttccccggactacacgatcttttatcaccataatgacaaaatggcgccagaatgcaggtatatttgctcatcttaatttattctgggggcttttacgtttaaaaaagtcaaaaattaattcctgaaatttctccccggactacacgatcttttatcaccataatgacaaaatggcgccagaatgcaggtatatttgctcatcttaatttattctgggggcttttacgtt

SEQ ID NO: 19042 - DNA, 2856 bp, Heterodera glycines
gatttttttagaagacataaatttcttaagaaaaggttaaattttttttgaaaatataccccttaaatttaattttttaaaaaagaagatttttaaaatgctttaaacattatctaggcctaacagtattttacggaattttttcttattcacctttttctaaggttttttttttgtttaaaaaactcataaaattttttaaatattttgtagataattcttaaatcatcatattttgcgatttttcttacatataaaattcccagtcctaattaatcataaatagaattcattattatatgctggtttttatacaaaaattaaaatttttctattgggaattctttttttaaaatttcactggcatttatttgtcaatgttcacaatcaccttttttttgccaaaaagcgccatcattgatttatgggcgtccaaagtgcgtgtaaaaatgctaatattactcgcttagaaaattttatgctacatataaaaaattgtaatttagaaaataagcagggctgggagatttaattgtgctaaaaaatttaatttaattatttattttttttgcaactcgatttagagcgatcagaatgactttaagtttacgcaaaaatactttgtagtagggactacctttatgcaaaatttcagaaatttttgcttcttgaaaatttttaaaaaacccgcaagtttttaaaagttgtccaccaaataaaaaaaaaaataaaaattgatattatcaaaaaaataaaaaaaataaaaatccaatctaaggttagtcactaattccggggaaagaaaaaccgggaacggggaataaattccctgtcggggatatctggagaacttaaaaaatcggaaaaaaataactgcatttttttataaactcatttaaaagacactctcatgcgatttggagtgcgacaaagacacaattcgtaatccccgctttcgggtttttgcccaaaagagtgccatcattgattttgataatgtgcgtggcaaaaatgtcaaatgtaaaaaaagtgcaaaagattttgccaaaaaattggatgccctttgctgggaaggatcgggaagggggatggggggggggggggagggacggcaaaaaatcccgaacccaaatttgttaggcattcctaaaatcttgtaaaaatcagacccctggacctggtaaaataccattatccctactgtttttcggcaacctggattttcctggtccaggaaattcaggtccaagtcatacaaggaatcccaggtccaacagacaggcttttttcaaaacgtcgagctctggttgagacaagtaaaaaactttgctattttcttaatagcggaatcgcatacaaacagagtgctctatagcagggatgggccaaatcgtgaaaataaaatgcgaaacgcaaaattccaaaaaacgcgaaattgcgaaacgcgaaagcgaaattttctacaacttttttaatagtcaaaatcatgcaaaaatcatcatttgtaaaattctatttcaaatttaaaaaaataaataaaaggcttttttgcagcgcgttttttccaaagaaattttgggaagtgggggcaggcggcgccggtaggcgtcgccgggaaaattttttaatacaatttgttaatagatttttactaaaaaatgatcaaattttgcaactttttgaccatttttctatgaaaaataggagtttttgtggtcccgcggtgcaaataggcgccgctgggaacagatttgaaaatttgagtgtatttttgtttacagattttctccaaaaaattactaagttttgcgattttgggccatttttctagaaaaaataggagttttgggggcgcggcggtgccgataggcaccccggggaaaaattggaaattttgaccattttaaacaggttttcactgaaaattagccaatttataggttatacttttgaaaatttttgaggaatttcatccctcattcttaggggtgtaatattcgcatttcgcgccaaaatgcgaaacgcgaaagcgaaagtgccaaataaagcgaaatatgcgaaagcgaaacgcgaaaacgaaagcgaaagcccatcccagctctatagttatcggaatgcacttttttttgttcaaaagtgccttcattgatttcttgacgtccaatgtgcgtggcaaaatgccaaaatgtaaaaaagtgaaaaatattttgccaaaattagcccaaaatcggatgccctttgctgtgaagagcatccataagacagaggtgagtatcataagccaaccatttgctatattttttagactatttctgacaacattcgcttgccaaaatccctccccattttaatgtttttgtctataaaatttgtgattttttaaagtgcatcatatcaacgccacggcacgtcttttatgccaataaaagtgcagcagaattcattcaatcattccaattttaattaaatcgtcgcatttccaatacactcaaaattcttaaatatttattattcatttcttagattcaactcagatttccaataaaattgcattttagtgatgattagggatgggaatttaagtcacaaaaaatctcaaaaaagtcgacttaaaaagtcatgaaaaatcgccaaaaggtcacgaaaaagacataaaaacgccaaaaagtcacaaaaaaaatgcaaaaaaacaaagcactaaaatatcaaaaaaagtctagaaaaataagccaaatgtaattaaaatcaaaatcccttttaaacattcttcgaagaaagtaatttaaaaacgtctaattttaacggaaaaaattatttcaaacggttacacggccagatttttatttttatttttta

SEQ ID NO: 19043 - DNA, 3021 bp, Heterodera glycines
tttttaaataaaagcacataatcaatggaaatctttgacgaatttattgttgttgacgaaaaagcgttcaatgaaatctctgccccaaagtgtggcggctcctgcaactgttcatttactgatgtgacccaatttgctgcactgtaattcattttttgaaattaaattataagaaaatatttaaaacgcaaccaaattttaattgcataattagtcaacatgattttttcaatgtaaatcacatatgtacttatttttagtgaatttatgtcaagctggtatcccatattgaaaatcaaggacattggcaatgcttcttccaagccgaatgtgccggtgattccattggcacaaattgtccgttgggattgggacacaaatggggcacaacagatcagtgaagtattaaagaaatgatcaagcttataatttaattacctaacaaatattattttagacccttacactcaacaagggcagtgaagttaatttcaacatccgagccaatgtttctccttcatttattattcgaattcttaaaaaacggtagaaaaagtaaatattataaattacccacattttacacttttttttttaattttggcccaaaaatggcatttttttatgctctccgcgctcaaatttttaaaataacactggcgaaaatggtcttcggattccccccccccccataagtccttttaaagaaccagaaaaataagtactgatcccgattggagttgcgagagttgagagtgatcctcctccgatcatttaacatttattgtttcccgccgattaagtgcgttcccggcgccttccatcaactcaactgatcacgacgatttgacggtgaaaattggtgacaaacaggtgaaaatcagaaagaaagagagtaatggaatttatcttagcccaaatttatttgaattctaataagtttagcagaccattgataattttaaaaagagattatcatcgattccctaattcttttttgatcagatcagtgaaattttgatcaggtcttgcttaagctttataagatatatcactgacaaacgattttgatcagatctatcttgaaaatagataaaatcattgataaatttgatagatcactgatagtcttgatactgataaatcttgatcaaatcgttaattaattttgttgatcagatcgctgtgtccgcccattggctgtcgtccgtttccccggtgatcagtcgcatgctcagcgtggagatgaaggagaagcagcagcgaatgatcactttggacgaattgggcgtggacatggaccaattcatggagtttttggaggccatcaattatctgttaatgagcggaacttttctgccaaaccgtaattcattgatactgtatctattaaacttaatctccttgaaaatcacccgttttatggattgaaaatatgattttttaatttaaaaaaatggattctctatttttcagccaaaaatgtgctgatgctgctcaaattggccgactatttccaggtgggtgccattaacgatatttctctaaaattaccataaattcaattgattttcaaaaaatgatacttaaatttgaatatcctttatcaaagagagtttacccataattttcaataaaaaattactttttactcatttttaaattcattaatagctaattattagtgacactaattgctctgttttgaggtgtccgcgttgaagtcgcgctgtgaaacgcatctgatcaattgtgttgaaattccactgatcgaccgtttccttctgattgaacgcttcggactcgacaatttgaaagtgatttaattttaaaatatttaaatttaacatttaatttccactttttagaattactttttgcatttgaatatcgacaacttccgtgcctttttcaatgccaaccatgaacagtttttgcctattatcagcaaagaatttttgtacgctttgtctgtccgaggaatggctgcgatttgatcaaattgattttggcattttcataaaatgattttttgttacgaaatttcttcatttttaatgagagaattgttattttttctgatttggattaaaagtttttgttatgatgagtttatcaagtaggttttatcaaacatttgagaatatttttgttttaaatagaaaaacaaaaattacaattaaattaaaaagagtgattaggcgcattaattccgatttacgaaaattttgggcctcgaaatgccatccctggtatgggaccttcggcccactcattcgcttcccccgcccttactcctctccccctccctcttcccgggacccacgcgtttcggcgctggcgtttcggcgccagctcttttttccatttaagcttttttctttggcatccaaaccaataatcttggtatcattcgaaagctcttaacatgctctattagcctaacaaaaaaccaaaagattttttggaaaaattttatgaagaaaaaacttcaaaaatttcgacttttcgcaattttcatgtataacttttttggtaattgtctaatcgcgaagcaatagcttagaaaaagcttctaaatagattaagctttcaatgacaccaacaatgttggatttggtttacaaagaaaaaagttatagccaaaaacatgctggcgccgaaacaccagcgccgaaacgcagtggaccctcctctcccccatttaccaattttcccgtgcttaatgtactcactcggccgcttcgcgacctcgtatgaggggcattcggcccccaatcccaagccaataatgccaatccttctcattttccactattttcgtgacattctcttccattcccctctctgtctctgttgcatttgccatccatttttgtcttgccgtcattaccccccccccatcccatccaaagtccatccccaattgtgccattatataagtccatccaatttccccctcgggggctacgagatgcctgcggtggtgggtcatctgctcacaatcagtgctgttctttt

SEQ ID NO: 19044 - DNA, 3088 bp, Heterodera glycines
tgtgctgaacaatgccttttcagggcttccaaaagatttacaagcagttattccctcagggcgaccccattgatttttccaatgtcgtcttcaaaacttacgacgacgatcaggtgaattaccaattcaacacctatggacgtaatgtaacgcgttacggtaacacagtcaccgccctcccccaccccgtccattagaaaaacacgaaaatgttttggtgatttgaactcattcaaacgaaagtggaaatggcattttctgatgtttttaggacggagcaattgaatttgatcagtttgtgcacggtttgttaatcaccggacgtggcactttagagcaaaagttggcatgggtctttcggttgtacgaccaggacaaggacggagcaatcacccgacaggagacgggtggagatgataaaatgggaggggggggggcaataaaagacgaaacatttgaaagggagacggtaaatgaactgaagagagacggtagccaaaaaaagtaccgaaaattatggaaatttttaaagacaacgagcaacagctgatcagatgatcagaaataaatacttcaaaatttatgcataaccaactaatttttcaagttttttgcagtaactttttgtgtctattgaaatcctttgaccttttgtgggcaaaaaaaacatttaaaattctcaaaataagcataaatggcgaaaaatgtcatttaatgcaaaaacaaaaaaggggaaatattaaatattttctgaaaacaaagccaaaaaaaaccctcgcctacttttttcgcttattttcgtgcttttccacagaatgcctaattaggcacatttacaaattgtccggcgatgattcagagacagcggacacaaaaatggtgccgaacagagtggcgatgatttggacgaaactgaacaaggcaaggccatttcggctccgccacagaacagaggccaacggacaaagccatcctttttaggaaagcgatgccaaaataaactcggcggaatttgtggaaaatgtgaagacggacaaagcgatagtcaacgttcttagcctatacgaaggattgggcaaatgaaagaaaagcgaataaaaataaaatgaaaaaagaaaattattttataggaaaatttaatattaaatgccaatcgaacaaaggctaattgaaagataattaatttggattttatttaattactttacttaaatatcgcaaaacatattttagctgattggattcgcttatctgctggaatatcattagattttaaatacaatatttgcttgagatgagtttttaggcatagaattaacatttgcgttgctctttctgtctgggactacataaattactccgtttacttcgaaatttaaaaattgtaaaaatatactaaccataatcatgactaggacatataattatatggaaatccattttttttttctggatggtgggaataaaacgactaaaacatttttttagcttatcttgaaacttctaggatggatttctatatccaggttacaagttcgtttttggtcatttttcataataattaaaaaattttatttgacaaaacctataggaatttgaacagttatataaatgcgtccgtttttttagatgtcatgaagaaattagactactttttgtagtaaaaaagagattacagtatatatacctggagtaaatcttttttttagattctaaatataaaaattcatcagttttctctagtaaatgattttaaataggcaaaaaaattgaccatagggcccatcagagccaaaaccaatgcctttgtacaatttattttaaattaatcattgtgttgtctgtccatttgcgttggcattttctcgcaatgacttaatgatgattggcttctcctccctcaattaatgtgcaaattcggcttctgattgtaagtgaatccggcgaattccgtttctctgttgacgaatgtttgcaaaggcaccaaagaagctgagatttgtcattacaaatgatgcggtgactcaaatcaccagggttcggctcaatgtcagtgaattcgcgcgcgatgttcaaagtgtccgtttcggcacgcactttcggcacaaacggcgccttcacttctttgtttagcagtttttcccaatcgattggtgcgaaaaagggatggcttcgtatttcctgcgcattagcaaatgaccgttcggttcatccaaaatcactaatcattaattagttaatttgcctcaaaatcggattttgcgcccaatcgttccgaacggtctttgtgcagtatttcgacgagtaatttgcgcactaaagtcgaagcggacgagggaacgcacaacggttgggtgagcgtcttgtggtacatttcattctgattcttactgtagaaaggtggctgaaagtgttcgggaggtacggtagggtgggaaaggcaaaaaaggaccaatccgaagagcatttcgaacagaacgcagcccaaacaccaccaatcgaccgtccgatcgtacggctttttctgaatcacttcgggcgcttaaagcaaacggcggaagggctgagaaaggcacggggggaaaggcccacccaaatattcgggggtgccgcagaaagtgctggtggtctgccgcattttgacgtgctctttgcacaggccgaagtccgtcagaacgacgtgcccatttctgtccagcagcaaattctcaggcttcaaatccctaaacaattagccgaaaatgagcgcttttcgaagagcgaacgaacgaaaaggaaaagagtgcctgtaaatgatatccttcgcgttcaaatatgcgagagctcttgtgacttcggtggtgtaaaatcgggcgcgggcttcggcaaaggatcgctcttttagaaggtgaaaaagcagttaaaagagagagagagagagaaaggggagagaaagggagggagagagagaaagagagggacagaaacgaaaaggatgagagggaaaagaagcaaagccagaaagaaaggaaaagagaggagagacaggaaaaagtacaaacggaaaactggaacaataaaagttgattgaattcgcaatttttatttt

SEQ ID NO: 19045 - DNA, 2999 bp, Heterodera glycines
taaagtaactgttttttggtaggtctaaatccagcacaccagggatgtgtcggaatgctattttcggaacgttttcagccgtcggaatgtcgaatccgctgttttttgaggggcacccattcctttcttcagcaattcctcctctcccctcccatatgcaaatgtgcaaaaacggaatacaatggaatccgagtacaaaaaaagtcgtgtaattcgatccacagaatctgtcagcagccaatttccatccggggaccttaaataatgaaatcgaattatcctttaagtaaatcggaccatctgcaagaccggacgtaattgttttctccaataaatctgtgaatgtgtaagccgaagtcgggagtcgttccctcgttaaaacaattggaaatgacttgtgcaggcttcagattagcaaaaaacgaagaatcatttggtaattctttattttcacgtttctcgacaacagccgaatgaattaaatttttgttcgggagagagacgatttgttccttcgaagtaatttcctcagaggcggtgttctgacagggttagagtaaaattttaattgaaaattaaaaccaaattacttttttggtaattgaactttccctttgactcgttgacacatcggagggtgcgttgtctgctctaatctttattactaattgatttcattttgcaaaattaataaacctgttgcaacaaaaaacccattccctgtcgaattaacttctgttgtttattgactgattttccagatgtagttgttatccgattttcgtccatttaaaataatgagaaaaatgcaaattaggggcacgctcaacttttaacagggactcagttatccataaacaaaaatgaagcaaaaaaaaactaaatcggcgggaacgaaaacccaggtgttcccgaccgtggtgagccgaagcgaaaaaagtatggaatttataattgaataataagctaataattagggacgatacttttagtgacgaaaaaatcccgaaatagttaactaaaataccgtatttcctcgattataagccccggggcttctattgttcaacccccctccaaagggggcttatattcaagggggagcttccaatcgaggggggggcttttattgttcaacccctttccctatataaattcttaaaattttttgctttctgcataatggtacaatttaaatcttaatctgaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacttttttagaattttctatcttcaaaacgaagaagttattacataaattttggaaaaattcgttttttgagaaaaaaaaaattaatagcgctgttctaaaaaggttttttgaaaaacacgaaattcttcctctataaacttctgtttattctatatttttataagacttttgaaaaaaagtacaaaaataaactgattttggaattcgggatcatagatggaagcaaatggtttttttgtgccatgggttcagatccacttgcctgtaaaaatgttttttagggtttttgggaccactaatcaagaacttggcatccattttgcccaattccaaagccttgatccgaactcgaaaccccaaaaataattttttaaaaatgttgcaggcatgtggatttgaacccatggcccaaaaacccatttttaacaaaacaaaaaatatattggatataatatttctatatttgcttgaaaattttttagtgattttcatcaaaatcttttccagtgaatttattaacagaaattttttctagctattgcttcgctattagacaatttccaaaaaagttatacatgaaaattgcgaaaagtcgaaaattttgaagttttttcgtaataaaattttttccaggcttgaaaatcttttcgcttttggtaaggctaatagagcatgttaagagcttacgagtgataccaacaatgttgtatttggatgtcaaagaaaaaagctatcgtggaaaaagagctggcgccgaaacgcgagcgccgaaacgcgtgggtcccgtttgtacatttagtctttctaaaatattttatgaattttaaaaaaatactatttttttcagaaaatttttgtgttttaaaagtatttaaaataacaaataaatattataaaattatccataaaaagcgacgaagaaattgatgcagaagtttcctaatatttttttgttaatgttttattaaaacaaattgttcaatagtttttgcacgtttctgacttcaaaagttttgaaaaaaaattttttttgaggggggcttatattcgaagggggcttctactcgagggggggcttctatttttcaacccccctacaaggggggcttatattcgagggggggcttccattcgagggggggcgtataatcgaggaaatacggtaaatatttaaattattcgttacgcagaaaaagaaccttaattttacctttggtttgcttttttctactgaaaaattaataaaaaatcttatttacctatttcgagatttttgtgcctatttaataacaattttgagctttttttgtacctattttgtggtttttttgtacctaatttttaccgacctaataattattaataaaattgaattgttttattcctttatttatttttcagttttatcctcttcggattcgccgtcaaacaacagacacaattaaatggcacatttcaatatgaaaatggcacttttgcatatgaaggcgatggcgaactttggaccgacggaaaacaaaaaggagcaaatgcccaacattcctacggtaatggcgataccgtaggaattggcgttaattcggccactcgacagatcattttcacaaagaatggacttcgtttgggtgtggcaaataaacaaataatt

SEQ ID NO: 19046 - DNA, 2282 bp, Heterodera glycines
aataattatggcttgggtattgatgactaaatccttttaccaagaaattttgttcctttggaaaatgctcctttacatgtgctgaaataatattttccgttcttggttcgattatctctgtttttcccattattactttagttgatttaggcatttcaacttcaattactgatataatgtttgtccaaatctcatcaagacgcacttttttttctccaaaggcaattattccctttaactctgtcaaaattggtaaccctaacagcaaaggacccggacaatgtttgtctggagagacaagtaaagtcactgaccattctccaaattttccagttgaattgtcgtaaatgcgaatttttccctgtgcctttcccaaaatttgaataaaagaatcgtttgccgcagtcaaatttggatttcccccgtccaattcttggatttgtaaccctgctttttttgctgttgtttcccgacagtatgaaacactggcacaggaatccaccaatgcggaagtatgaagcccattaatatgaacacgaattgatggtaatcgcctgggatcatttgtaattattgccacccgtctaggcggtaaatattccaataaatatgcttcttggtcaattgactcccgttccggtgctgttggcaccgcagcgaccctggtacccctttttttcattccaattattctcctgacgactcgagcggccagtgtccctgctcgaaatccgcccgaaataattgtccaatattttgtcaagataaaaattattatggctattaataagattagtggaataattattaataaaattgatagcccttttaagtaattcactgcttcttgtgccttttttggaatatttttcattatgtcaatccaattccctgtttttcccaaaattgcgctcaatgtctcatttgcttcttctttaattagtctaatgacttctgagacatttgtcttatgtacgatacgtaaagttgaagaaggcaaattatttattttttttcggtattctaacatagcatcttcaattctaacattatctgattcgaaaagtgtgcctgcttttaaaatgagaggattctgcatatttctatatttaggacgcaaattttctaagttttttgtgagcttatctataatttctttttgtgttgcgttaaaaatgttttcgttttgcaaactttcacactcaatggttttacccagaatactcaattctcttgtgccgggttttatgaaaaatgtggtattttcggcaaaaatcggtgtccattcataacattcttctcctatccttttatcccaaatcactttttctggaataattggtacgcaaaaaccaacttccatttcttctccattccaacgagccaccaaatcgtccctgttaaaaattttccgtaccccctcatttgggttaatttgcaaaatcgcttttgctaattggagttgaaaatttgagtttagacatgcctgagtgaaaatgtggtcatactgccttttcctttcctcatttaatttgtataaggcatagttgacccttgtattcaaatttttattctcttgtccccctttccttgatttgcttttcccgattttcttaagccaccgtgcatcgggagtcgttacagtagttcgtttttttctatctgcctcaaaaaaatctgccgaattctcactttcttcaaaatcctctgtactctcttcattttcttcattttcattaatctcttcactttctgtaagtagttggttaattatttcggtatcattttccggattttgttcctgcattttttccaaatgtttgttctgtttgttttctgtcaaggtgtcattttctgtgtttttaggctctttttttgattgattcgactttccctttggcgtttttctgtcccttcatttcattgtttgtggccaattttggtgaaacttgatttaattccaacgtcgtactctgattgtgcgttgtcttttcgacggtacccttatttattgtaaatacaactctcgggcttgttgttgttaaaatctttttgtggagagggatttgcgtggtttgggtttttggtatcatattttgctgagttggggtaggtgtttcttgttttgtttttgttttatttacatattttttttggtttttattaatttctactggtttagttttgacttttggggtttcagattttaatttattcccttggttaccattgtcaagcacttgaagggtttctccgcgtttttaatcactttttcattctca

SEQ ID NO: 19047 - DNA, 941 bp, Heterodera glycines
  misc_feature (13)..(13): n is a, c, g, or t
taaaaaatttttntggagaattcccataattttccaatactttctattatttttaaagaatttccaaaaatttttctatattccattatttttgcagattttcttaattatttttaaatattttaataaaatttttaattctcgataatttgaagcaataaaaatcaagtttttttttttcattttccagacctgacgcaccaccaagccgagtgaaagtgaccgcagagactgcgcaatttcctcggcccatttcaccgccggcccaaattggtccgtccacaatgtcccactaccatcaacagacaacaacagaaacaatatccgcaactgaccatgctgttgcgggcgggtcgggaatgccgagcagtacagtgggattgccgtcgtcgactacggtggtcaccagtccaccgttgccctcatttgtcaagtgagcaagcaatatacggatatgggggtttttttggcataaaaattatttttcgagactcgagaaaatagcctgaatccgggactaagacacccaaatgccaatagttcgggatcagaatcctaaaacgatatgtacacagaaaaatagaacggccctaaacaaaaaatttttttttgtgtttgatcagaaaatttttttttgtagtagggcttgatcgaaaaaactgcccattcccgagacttttagtttctcccttcccaaattaaggcgagccgaacacgacaacgagaatccgttccggcctgaagagcatctttaccatgaggtggtggtccatttttttggggaggggaaagcgagactggacagtgtcggtcgggattggcatttaaattcccttccgtgaaagaaaaatccgcttttttaaaaattttttattagaattttgtcaaagtttaatcctttttaaaaatgtttgttcgaaatttataaaattttttaactc

SEQ ID NO: 19048 - DNA, 1592 bp, Heterodera glycines
tcgcatcagcaccagcagcacaatcagcagaccacgtccaccaccacgtggagtacgcccacaaaacggaacagtacaacacagcaacaacaccagttacagtaccagcagcagctacagtacgcaaacggtggcagtggaaggttagagaatggaattgcacagtgatcagtcagatgatcagagaagaagcaggcagcatcagagaagagaatggagaaggaatgatcaacagagtattttaattgtgtgtctgtctgtatattcagcagatagagagagagagaaagagagagagagagagagcgtgatcaatcagattgattagaattaatagtgtctaaccaatcgatgtatgtgtgctgcatcataaagaggacatctaattatatgcacatttaaaacggcctttttggtctctaaggacccaaaaaaattttcaaacaacttaatttttgattatttttctcaaagatatcattaatccaagatgtaatatatttttattatattcatttttcttcaaaaataataaattttgctttattttatatatttcttctaaaatggtttttcatatcaatttagctattttgaaattttagtataaatttaatgtttaacgaaattttatgtgcatataattgggtgtcccctaatcattagcaattataggaattaatttcgactttctttcttataaaattaattaatatattatcgtatataccgacttcgagagtcttgagcccactaaaaaaaatagtaaatttgtttgagaaaaagttggcattttgttaattcaacttaaattcatacaaaatgtcaatggccggccaaccattcagtttcggcggccccacaaagtgtacaagccacgaaatgtccaaaagagtaaaaacccacgaaatgtccaaaatttttcaaaatttataaaaacaaaatgagtctaatttggggtttttaggcttttcggggtcgctgaatacgaatataccctttatattaccccttgcctaaccctaggcccatccgaataataaaaaactcaaattcgagacatggacattttgtgggtcagcgtcagtttctgatgtgtaaatcggttgtcccgaaattttggattttttgtgattttcgaaaattaggccagcatgttgggggttcattgatcagttttttaatttcttggattttgtttgatttcattttcgttaacaaattttccctcatcactcgcttaagcttcttaaaatgtttacccaattcactaaataatttttccttttttttcttcacttccccccccctgaccttttaacattttttttttactttcaacccctagtttttcaaaaaagaattacacggattaattaaaaaatgcctcgttaaattaatcttaattaattggttgttttgttttttgcgatgagaaaatttttttgtcaggatgggactaaacaaaaaaaacaaataacaaatctctaacaataaaattttattcctcaaattcttacaaacaattttttctccaattttgtcattatgctttcatatattttgtttaggaggcgctggaaaatctgaaa

SEQ ID NO: 19049 - DNA, 2029 bp, Heterodera glycines
ttattattactttttttgagtcttgcagcagcgccagcgatatgtgaaaaatggtgttaattcccttaaaaacatccatgtaattaaagaattaattaaatttcttaaaaatttaataatatttttaattaaaatatttatttttaaatttattttttacttcagttagaaaaaggtccacaatgaaaaacaccatttgaagtggaaatttggcagtgaacaacgttaaaaaccattgagaagcatacctaaataaattgaaaatttaaattaaatttaatattcgtttaataaaaaattaatgtaaaattattaattataattgagaataaagtaaattagtaaatgaattaattttaaatatttaagattaagttttaaatcaattaaacaaatgaaatttaaaaaataaaaatttataattaaaaataatttaaataattttcagcacttacatatgcgtttcaatacccatttgataaaaatgtgaaaacaaatcgtgaacataatcctgaaataaaaataaataattagaaataattctataaaaataattaaaaatataaaatggattaattattgttaatttaaaattcatttcaattcattttgccgacttccacaagccgttgcaactgatggaagcgcaaatggagtgcatcgaagccggtcttgaacagctcgcgcagcccataatcaaacatgatacggaccagcacacaaaaggctctctcctctggcatctttaggggaaaaatggaaaaataaaataaataaaaattttaaaaaataataattttagggtcaagatccagcccgaccattctcaatccataataaaaaaggaaatttttttttaattgccattaattttttgactattttgaaaatccaaattatacatgagtttgtcaccaaaaataaagaagacagataaacacaatgaaaaataaattaattaattaattaaattataaaagcacatgcaacagaagtgaagcggcaagaaatgaaaggccctggcaatagcccacttcttcgtcgtacaaggaatacttaaatggaaaaaatatataatatatatatatatatatatatatatatatataattattattattattaaatttcaataattaattattagggcactgggtcgaggtgtcatgagtttttttttctggacttaagccgcccaggtctaggcacttttaatgaaaaaatgggaaaattattgtgcaaaaaataccgtttttcttgacaaattaatttcgtgaaaatgctcaaaatttactggctgccgcgaacctatcggcacgagcagtgaatttttaaaaattttaatctgttaaaaagcatcgagcaaaaattccaattcccgactacacctctcgacaaaggccgaaccctatcccttaattttttgaaaagcgctcgaaaaaattaagaggccgaagagcaaaaaagggtcgtcggaaggaagtgggcgttagttagacccccaccgcgatgccaaaaatttagctatgtctttgcgctaattactgtattacaattattatattacagtatcctaccgctttactgatccggtacaacgacttttggccaacttcgttggactccttgtagtactcatgggcggggaatgtgcggtgaatgtcacggagaatgaccgcatcttgaggacattcctgacaaaaaaaaagaaaagaaaaatgataaaatgaaataaaagatttttaatttttaataaattatttgttttgaaaaatcaaaagtaaaacagtaacaatgaaaaaatgaaaaaaaaaagtccaattatatatggtagtttattatattgtattaatttaattttttgttgtataaaatttttattgaatttcatttccaaaaaaaaataaaaacgtttatttttggaatatttaacttttcgaattcgaaatattttacaaaacatataaatggaataaaaattttaaaaaagtgaatattaaaaaattgaaaataagtgatagcttttaat

SEQ ID NO: 19050 - DNA, 2057 bp, Heterodera glycines
ccctaaaaaaagtttttttaaatttttattcatttttttttgggggggccaataatcaaggattgcccatcaaattccccattgttttttaaggaggggctgaacataaagctgaccgattacgtcaagcatttgtagccacatagtaaaagggaaacccataagcatttctagggtatggactaaaaaatttttgtttttagccatcgaactcgccaaaaactcgtataaagagggaggcacagtgaaaaggaactgccacgacgccggcatttcctcggtataaaatgggcaaatctctgctgtggatgcccatttgtttatgaaaatagactcaatgcaaagctgcctctcatcaatatcctttgcatgatatttagggatccgatcacttacaaaaccatgaaaacgccggccggacagaacatcagagtgcgttcgtgcatctccccaaaagttgaaacgtgagctgtttaacgactgtattcctcaaaattaggtcgagatgggctcgaatcgccggttttttaaaaattcaattacatgaaattttcatagtaaaccgtgtttttttaatgttctgggtgactgatcacgaataatatagctgttttgcgacaattacgccctcccattttttaatttgaatttttgtcttcgtttcaactttcaagtttagcggtacagctcgggcgtgcaaatttggtgaagtgctcttctcaatgcacggcactccggtggcaccagtggcggggagcagcaacggaacggagggggcggtgaacgaagtgggccaagtcattataaaacaccacttgagcattgtttacatccaacatttggattggcccaataaaaacgaaatttcaaattacaaatttataaacttcctaatttaggcatcctaacttttttcagttgcattgtttttttgttgtccattttcagtggttgcagcaagaagagaatttgacgccgcaaagtcgggacattgtggcccaactgaagaaactgatgcatctgaaggaggcgaagaaagaagacgggggagaagcgacgggaaagcaatgaaagaaaaatggggacacgaatgtgcatttgtttattgaattttgtgtacaatatcgaccaaaagataaaaaagagttcatcacgctgaattggcttttcgtgttggttgaggcgagcccgaggagacaagctcattaaaaaaagtttacaaagtcactgatgactcaaaattgtccgtttttgaatttgcggagacaaatgatgacataattagccatgcgttttttagtcatttctattctatttttagtgggaaggacatgccaatttttgaagaacatccaaacatttattacaaattcttcaactttctgtggtccattcattgtttcaccatcaaaaaaagcgttgtttatgccgattcggcagaagccttcttcttcgactcctcaattttcttcttttgcaccgcttcggtgagaagcggcacgagtttgccttcacgggccaggcatttcaacagctcgacgaggaagggcatgtaattgtgtcggcgccgattgttctgatgaaatggggagatggaaatgatcaaaatcaaaaattggcattaacgggggggggggagaggagaaccagaagatcgcttcttttttaattaggcgcagcgggggaaaaatttacttttttgcctgtttttattgaacattttggcccaatcgtgagagttttgggtaaaattttttgaaaaaaaagaaaattttgtgctatggtggcgccatcaatataatggcagcggaggagtctgatttttaattcataatgaaaaatgggcataaaaactgtataagttctcgaaaaacttgcccaactttccgcttttttcaccctttttgtcccccgttcttttttaatgtcaacctcaattttgtagttcctgaacttttcctcctcgccactgatcaacatgtgcagttcattcagttcctttgtcacttcgtccgagtccatcccaacctaaaaaaagaaattagtaattatcaagg

SEQ ID NO: 19051 - DNA, 1170 bp, Heterodera glycines
tttttgagatattattgcagttattttttattaaatgcaattttttgtgtttttgttccaaaaaataaacgtttttgaatatttttgtgtcatattttgaagaaaaacactttaggaaactaatggaccagaagtgccgctgccgccgggcaggcccgtatctacgcgaaatgaaaaattaaaaaatttttcatgaaaaaatgagtatatttttggaaaaatttgtccgttttcttatcatatggcattaaaatttacaaaaaaatttacggcgacgcctatccggaccccacaaaatggcaaacattgtcattttaagcacaaaatgcgctacaaattcctgccttttcgctaaaacttttgaaaaaaacactggaggaaaaaaatttcgacccaaagagcaaaaaaaaggctcttcgggtgccctccccgaaatttttttttggataggggcaaaaaggacacaacataccgcgctcagctcggcaacccgctgctcgtatttggtcttcaaattcggcaccagcgccatcaaattgaagtgaatttcgccctctgtgtaccttaaaaccaacaaaaaaaattgtttttttttttgccaattttggcattttgaattagccaacttttgaatgcgccgttggatgaatgggcgcagcgtgtccacccaactttcttttcccggctcaatgtccgccaggcaaatgggcgcctcgcgcattccgtccaattcgtaaatctttccgtccaccggcacgtaagtgataaagtggaaattgtcctccgccttggcttttggctgaattttatgcataattatcataatttgctttgtcaggaattgcaatggcattttttcttgggatttttgacatttttaattttcaaaatttgaatgaaaacagaaaatttttcaagagatttacggcaaaagctaaagaatgacggtaacgaaattagatttttcaaaatgtttaaaaaatccgttttaaaaactgggaatttctagtgtaataatcagtattctatctaaaaactatgattttttcaaaggaatgaagggcaaaaaaattataaaaaatggagaaaaaaaactgacgacgtccaactccacaaagtgttcccgggtgaacgagttgtgcaacttccgaaatcttcgctgttgctcag

SEQ ID NO: 19052 - DNA, 2971 bp, Heterodera glycines
tttttgcttcgccttcggcttcggcttcgagtgctaagccgattttcgcccagccctgatccggatccgacggaaaagcgattggagttccactagggggcgcacattggctaattcataaggcagatgggatggggagaagggaccgccccaggccaaatcccgtgtagcactaaacgaacaattaattaatgtgataaatgatcattggtcattattaatttcacttagggctatcgaatgattgaaataaaacgaaaaatctcaataattataattaaaaattttcattaaatataaaataattttgatcatcaaaaattctgaccataaactttcttataactaacaaaattaagaaatattgaatcattcgatagcccaaagtgtttcctattaagatgcaaaatttcaaaatatttcgctaagttacaaaaaagttatgacaaaaaatttgaaaacctggttccttgagtacttttggccataactttgttcaaacttggcgattttttttttgagattttgaagactaatagagagtgttagggctatcgatgtttttgagcaaatttatgagcaattttttgctaaaaattttaataataaaataaacaagcttgtaatttgtgtggggctgagtgctaaacagaattaaattttggcgcaaaagtggcatttccattaatagccatatttatgacaaaatgaggcaatgaatggcattattaaaagcgcactttgctcaaattccctgttgaacttttcgctgttgcacaaaaagcctttgattgtggcgaaatggcgttgcttaagccattcctcaattgcgctgctctgcttttcgtcctcttttccctcctccgactttcgccgaatttcgtgccattctctgtccaccgttccgttcggcggcggcgatgccgtgccgtactgtcggcccttcttcagccgttccagctttttgttgcgcagctcgaccctcagcttttcgtccggcattttcagcttctgttccaccaaatgtttggacatttgcaacagaatgccaatttggcgctttttcttcggcacttccacttttccattcgcctcctcaatgtcgaacatttggtcataaaccatttcgtagtaccaccggttctgcttccatgccatggtaaatcttggcatcactttacccttttcctttttcttgtcatcccataatttcaaaacatcgttttccagccaaagcacccaacagaaaatgtcagtagccaattttagtgcctgacgaggttctggggaaattgttgtgaaagcatccaggtaatgcttttgtagcaaatcggcacttcgaaaaacttaaaatggaaatttgcaaattgatttttggtcattttggtatggttaatttgtttccaggcttaattggactgtattttaaaaatctaaagaaattttaatgcgttggagccgaaagcttttagtaagaaaaataacatagaattttcatatttgttttaggcttttttaattggtgctatgatgaaatacgaaaagtgcaagtgatcaaattaaaagaaaaatattatttaaattaaacttgatataatatacgtatatatatattatatatatatatatatattgtttaaaatattcgctacatttaaaatttatattaatcataatacgtgttgagccgaaatttaaagaagcattcattaactttggctacaaaagcggatctcgatcagtagtttttctctttctttttcgaaattaattttgctctcctttaatgctacatcgagatttatggaaatcatcgtttttcaatttttggaattaaaattaacgcaatgtgaaaaaatatttgctttatgtcgcgaatattttaaataatatatgtatattgttaataaacataataatttgcttttaatttttaaaattaaataatttccttttaatttgatcttttgcacttttcgtacttcgtctcagaacgttttaattagttgaccaaacatgtcagatagcgaggtatgaaagttttctaattttcttaataatctctctgtcaaaatacatttttatttttgattttattccattttttaagtttttcagtgaaaatgtccaaatatgtatttgactatggaaagcatgcatagaagcattgaaccaagctgaaaaaattgctttttaattgagttaaagcccaaacaaatttgcatttgtaaaaaattgggaaaatccaaaaatcgggccttatttttttacctccagggtccgtgtaccgttcattgttggcaatttcaaattctatttcggcttcattcatacacaaaaatttgtgcaaccgcgtcggaccaccgcggagagtggccaattgaccccaaactatcataaaatcggaatacaattctcgattgccttttgtcatatatatccgctgagtctcgaccactgattgggcctcctcgcgctgctcacattcgctgggccaccatttgtcgatgcttttcagaatggaaacccctgaaaaaaggaagcgaaaggaaatgagccattaaaactcattaatgctttaattaatttgctcattttgcattgcttgcctttcttcgggctcaccactttgttcggctctctcagaaatgtggccaatttgctcaccatacaaatgcctccggccgttccgatccgatcactttccaacgcttccattttcaccactttcgctttgtttataatgtgctgcccaatttctgatccgttctgtgcactttgccctatgtcttgctcatcctccgctaactttgggtcggccaacaattttctgaaaattatccgcctcagttcggcaatggcattctccgagttggtccgaaattggaattgcgttttgtgggtgtccattcgcaatgcctttggcattatcactgaaaaaatgaaaaatgcaataaaaaaatgcaattta

SEQ ID NO: 19053 - DNA, 2251 bp, Heterodera glycines
agtaaaaaactgatttccatattatgtatgcaatacgtcgtgaatcacatttaatttttaaaatatttttggaaaagaaaaataattgcgtaataacatttaatgcgaataaaacattaaataaattcatttaatgcaataaattcaatttccaaaagtaaaaatgaatttgtggcatttattatttattatatttttctttatttttttaattaaatccggcaaaatccaaccaaattttgaagaaatatttggccaaagatgggacaaaaatgaaagtgaagaaattgtgataataaaaattgaacaaaacgaccaaaacgagcaaaatgaaactacgggcattgatcaaattggtggagaaaatggaacggacccaaatgatcaacaaaaaagacaaataattttgaaatttgaagcaattaaagaaaagttaaaggaaaaaataatatacaaaaggaaagattatggcaaaattgagagaaaaattgcaaaattattaggagcaaatcggcaattaatacaaaaatggaaaaatgaattaaatttaaataaaaacaaaattaaaaaggaatttatgaggagaaaaagcgcaaattcattgaacgatttgatgaatttaaagaattatatggccaaggcaaacagaaagaatttgcgaaggaattgggcatttgtgaaagaaacatttcgaaaatggaaaaaagaattgttgccaaaatacaataaaagtaagcgaatttctaactttttaaaattatttattattttcagcgctaattaaaccttcaaattatgacaaattaaaaaaagatgaagcaatattttgaaataaaagaaaatttgaattttatttgtttaattaattaaaaaagcaatttacaaaatttgttggatatgaagccaattatggtcaattaattattttttttgaattatgtgcccaaaaaaaaaaaatcattttgagtaaattgctacactttccttttaatttattttttccataaaataaattattttataaattattattttttgcaataattatttcttaaaaaatccgagtaaaaaaattgttttccatattatgtatgaattacgtcgtgaatcacatattaatttttaaaatattgttgaaaagaaaaataattgcgtaataacatttaatgcgaataaaacattaaataaattcatttaatgcaataaattcaatttccaaaagtaaaaatgaatttgtggcatttattatttattatatttttctttatttttgtaattaaatccggcaaaatccaaccaaattttgaagaaatatttggccaaagatgggacaaaaatgaaagtgaagaaattgtgataataaaaattgaacaaaatgaacgaaggaattggtcgtcataaaatatacaaatggaaaaaagaattaaatataattaaaaagatgggaaagagtttttatgaggagaaaaagcgctaaattcattgaacaatttgatgaatttaaagaattatatggccaaggcaaacagaaagaatttgcgaaggaattgggcatttctgaaaggacattttggaaatggaaaaaagaattggtgccaaaataccataaaagtcaaagtaagaatatatttttagtgaaattaaatctaatttttatttaagagcaatatacaaatgaagctaaattaagaaaaatgagaaaatattacgaaataaaagaaaaaaatcagaaattgagcgatgtattaattgccaggaaattggaaattggatcgtcaactctgaaaaatctgaaaaccaatttactacaacactaattgatcagttatgattgaacatgatggatgataatatgatcacatcgggcctctccccccgggcagtatctgttcccgagacctatcgggtagagaaagcctaagaattgtgtgattttctttcccggaataaaggcgttactgttgcatactgtattgaaatggggaagaatgggatacaatggagctacagtaatccaggagattcatgatcatggtttatcaaagcataatttgaaactctaaaaaatattttggagggaatcaaaaactgacattttttaattatttgaaaataaaaggaaaatttttcgattaatcattcttttttttttgtgcctatttcgcaatttttggggccctttttcttttcggaaaaatttaccaaaaaagtttaaaatgaaaaattacctgagatgaccgagaaaatttca

SEQ ID NO: 19054 - DNA, 1165 bp, Heterodera glycines
  misc_feature (1159)..(1159): n is a, c, g, or t
aatgaatggccgtgtctatttttgcgagcttttctctgttgagtcggagtcgtcgagtttcgccttcttggccacgccttcgtcttcggttgtctccgcctttttctgcgcctcctcctcccctccctgctccatcttctcttctgccttggctgcctccttcgcaatttgctgctcgtcgtcgttgtcagcagtcgcttcgctctccatcgaatcgccttcctttttgggctgtccttccgtcctattcgcctcgtccccttcgcgcatttcggcatcggcgttttcctctccgcgaggaatgtcctcttctctgagtgctttgtgtccttcggatgagcccaactttgtctcttcgtcgccatcgtgttcgtcgttcagtttggtgccataagtgcgcttacgagctacaaaataaatatgcaattcgtgcaaactggacataaacaatctgactggagatacacagagaacgtactaaaacaaagaaacctcgcgagctgtcagtcggaaaaaaaacatatacattggtattggataaagcagtcgatttacattgtgaatttttaattttacggacctatgcgaaagataaaatattttggggcctcaaaaattagaattcgtttttagggaactccgattatttggtttttgaaatgctcttaccgactggctttgcgcccgtctcgtcctcccctttcgtctgctcgtctctttccttttccgccgttgcctcgtccgtctcttcatccgttgtctgtttcgacttctcttccttcatttttgcatccgtcgaagttcgcgactttcttggcgactttttttcatccgctacaaaaataaaataaatttgctattgtttcaataaatggcgaaccttttccctcataatacttctccaaataatgcttcgcctcctcaaaagtgtcaaactttttgtgcattgcgctcggatagcccttggtctaaaaaaatattatttctttaaaataaaaaatagtctacatttttcttgacagtttctatgtccttgaatatgccaacaacacgaccacgagcgacagcaaaaaattttgtgaaggaatcgtccacagacactgaaaatgaagtttcggaggtgagaaatatggctctattgcagttttcacatcataanataatt

SEQ ID NO: 19055 - DNA, 1608 bp, Heterodera glycines
catagtcggactcggaaagcctttcgtcgctgcttgggcctcttggtaactgccgaacactccacgctgatgaccccaagcaaccgcataaaaaacggacggagtggaaggcgctttcggttgatgatcagacattttcagtgataaaataaatgggtacttttaattcactaaagcatatataaagcaaaagtaaaaaatgaactcgttaatttgattcacaaacaattgagaaaaatgaatttgtcgtttcatatgtattttataaaaatgagtgtaaaatagcctttctgataggatattctgaatcattgttaaaaaaaagtatcaaaaaccaaccaaagaaaatttgttggtcgataatatacacataaaatgttggaattgaatggaaacaattcataatttgctaaaaatcaatgcgtcactgagttggagcccatttgttcagcaatgaatgcattcgccgtggcaatcgctgcttctttttgccttttcttttctccgagttcgtcccgcaccgccgctggcgctttgcccaattcgccggcagtgacttcccaaagaattttgtccacttcctccttaaaaaaccgcaatatgataaattaggtaattactataggttgttttctggcaattgttaatagtaaatttactagtcccataaaaaaggacaaaaagattgggaaatattgggggttaccgagttcgcctaagtaaaatcttcccttgataaaaacagtttacctgtgctaattcttccatattgtcaggttcggtggactccattgtctcctcgatgatttcctcgatgattcccatctaaagaaaatgtcaaaatcgaattaaaaattccgtcgctgttaccttagtcatttccttcgacatgtctcgcatcacttgcataacttcgggcaccttgggcaaaatgcgaaaagtgcaattccaaatgggctaccttcaacaattgttgcatgaccttcatcacttccgtcgactgttttagtgtgccggccatacgaatagtggccaattgatgctgcatgttcatgtttatggaattgatttgtgcgattgttccgtggagtttgctcactgacttgaaaattaaacgttctactagcaaaaacagtttgattaaaatatgatgattgaaattcacctttctcgagttgactattgacttcgccaacagaatgcacacttctctgtccccctttttcgctgctgttttgatttcccgtttcaccttaaatttatgaaactctacagtttacgcatccaatcaatgccatcctcagtttcttaaaataagacaataaatctttcttatttggtcaatacataattagtctcgggaccttataaatacaagaaaaatacaagaaacgagcaaatactggcagtaaaggaaaaatacactgaaacttaaaattcaaggtttttcgagtaaattcaagaataaaggtagagccctgcttcatattttactttttcttcctcgcgttggatggcccccaatttgtcggttgagtcttgaattttcaagccttagcttacgtagaagctctcggaccttgaaaaattattttgtaatgctttaat

SEQ ID NO: 19056 - DNA, 1306 bp, Heterodera glycines
ctccctcccctcccctctattttcctccatctctctctcactgtctggcaccctctcaattctcctctctcttcctcccctttttcttgcctcttcactctctctgttttcatatttgttgagcatcgtttggatgcgcagttcgaacttccgttcctcctccttctccctgggagggtattgtcctctcgtcggctgtggcactgccaatggtttctgtcgctgcccaaaatattccgactgagggacctgatcagtttcagtcaggtgaaagcctttgctttcgtactgttcgccctttttctgtacttcgattggccgcaactttctttttgccctcaaagcgttcagaatttgaagccaacgcgcgaagaatggccatttgtgacgatggacaaattgaatttggaagagagtgttcaggaaatcgggcgaaggactgagctggcaaaagtgccgaattggcggtgcctaatccgtccaaagttcgcttccgttgcgttcgcttctccgtcactttaccctttggacgagtgccctcaaactttgcagcgccccgtggcaaacgctcggcaaaaagtaaccgccctcgagcagaaggcaaagagggacgccctgctgtgccaaaaggcccgtcatatagccgaagccggcgggggacacttccatttgcccttgggggtcgccgattcctgcgtcgaagccgcaggacacgaggacaagtccgggacgccactggtggatgattggaaggacaatgcagtggaagaaagcggcgtattcggcgtccccacaaccgacggaattcaatggcacatttatggtgttaggatctttcggaagaacatcgctgttggtctgacatgaacacgttttgcttacattggtgaactatggcactttcggggagctcgggccaaaaagtgccgcgttcaaagcggtgaatggacagcaaaagaatgccctccgggtccccctccacacaatattgcgtcccctggtgccgcgtgcacatcccaatcgacgatcagaaccctttcaacgcccaatgagcgagctttgcgagcacagatcgcaacattattcagcagacagaagccgcaagggtcgttctgcgaggcctttaaaaatgagaaaatccgaccaatggcatttgatttccttttgtcgttgaattgggcatttcccccccccccccgcgcatttgcccttttacgtgatggcccggcggtcgaatggccacaaaggcatttggggcttcactgaagagaatggatgggaaaggatagctgcactttgctccttt

SEQ ID NO: 19057 - DNA, 2555 bp, Heterodera glycines
ataatcatcaaatttgacccatttgggccaactgacatattccgaactgtgcaccaaaagaatgtctgagaggggacactccgccggggggaggcgaacgcattgggcgagcagcggacgatcgctctgcgaagaaaaaggggccaatgaacggagcgaattccgaatggcaaatgcctcgattgtgtccagaagggcacccaatcggtcgggcttctcaatgtgatcggcgtcccactcgcatttgtgttgcaacatgcgccgatcggagacgaaaaaagttggcggaacggacatttttgggaattcaaagcgaaaacggagggacaaaaaaacaaatgaataaggaaaaagaacggaaacggagaaactcaacccttatcaattggtgacagaacggaaaaaggacgaacaaactcttttttattacattttcaaaccaaaaattatttgcctaacgaaaatgataaggaaaagagtcgttttttggagaccaattttaataaaaattaaacaaacaaacaaaaacattttgcaaagaaaagaaaacaattttaatttgctttttctccaccgttttatgctgactgtgagaagagtcctttcaactgagaaaaaagtcggacatgttcgggattggcacacactttgaggaaacgctgaaaaggagaaaatagccttactcgacatttaaacaatttccgctcaattctccccagcccacccccaagagggtttaatggttcgggtatgggacgtaatgcacccattttatcaccttcaatttgatggtaattggggcgacgattggtgcggcggcggcgccttctcgagagttcagcaagttaagacaatcggtgatcagtgcgaacagtcgctgggccaaatgagcacggactccggcgtcgtccaactgttcgcccgacaatcggagcattcgttcggcgttcggttcgcgtgttcgacctttgcccgccgttggccttttggcgtcgatctgtgccaactcatccaaaagctgacaaagaaatgggaaaatggaagccaaaggaagacaaaggcacctcaacagcaaaggccaaactcgggacgaacacttcggactctctttggatgtccaaaagcatttgaatcgaatgaattcgcaatgggaagaatttagtggaagggaaaagccttaaaattggacagaaaatgggaaattaatgcagagcaataaaagcacctccaaagggaattgatcacttccacgagcggatggaccaactcatagaaccaactggcacttttgtcggacgacggccgaaagcgtttagagccttcgcaaatgaccaaaacccaaagttgaaggcccttgacgaactgccaattgtacacggtttggatcaaatcctgaagagccaaccaaaacgataaatataaatgtgaatgtctttttgcacctttcgtttggcaatcattgcatttcgaaggtgaatggcgaactggcggatgtaaacgaatgcgtattggtaagcttgggaaggatggacaaaagtcagttcggcgagagaacactgacaaagggaaaggaagcgaaaaagtcggcaaagtttcggcggaattaaggcggcacctgcataaagtgaatgaaaggcaatgtttcatcgtcaatggttttgcaattggcgacatacgccgtgtaacaattctgaacattaaaagcattaagaaaaataagtgagtgccaaggaaattcggactttgtaaacggcggggaaacactcggagtcgagcctggcaattttgcacaacgccacgaaggcaatgcaacggatttcttccgttttgcgactccaaaaatgggtcaaaaccttgaaaaatcaaatctctatcaaatggtcaaaatcggaaaggacctttatgagggatttgcaaagcttggggaaatgaaggaacaagtcgacgagatcagtgaccacgcgaagggtcgacagcaaaacttggacagaatcgacttccatgagaaactgaaaatggggggaaagggggagagattcaaagaagaaacccgggaaagttcgaagatgggtcttacaatttgcactgccgacagaaaagactttgtcaatgcgccgtatttgtgccaatgtttaaagtgagttgattccctcttcttcgggcctctctgcaaagctttcagataaactcaactcgaaacactgagagggcttattaaggaaagtgttaaaaatgaagatgttagtacataattcttcataaaatttcaaaaaaaatggtgaaatttttttttagacttcttattgggttagtaaactactcactctgttcgatggtcgtccctttttcccgtcgattggatgcaacaatttgaacaaacatttgcctacacttttgaagcaaagtcgaataatgccgtcgaacaccaaaattggagggattaaatccatacgaattttgtccatttttacctttttctttctccacggcaaattccgtctcctccaatttcaattggccttttccttcgcccactcgcgcaacgcatccaaaaa

SEQ ID NO: 19058 - DNA, 1551 bp, Heterodera glycines
ggaaatttaatgggatgtatgaaataatgaaaagttttttttacgaaaaaataaaaacattgaaaaatatcgacccaccaaaaaccaaaataaatcatatacgtatttacagaattagaacccccagggggttctattttttacctcaagagggaggctctatttcagggggttctaattcagaaaaaaagtataaataaatttttttttaaataaattaaaaataaatttttttaaaattcattaattacaaacgccaaccgccaacccatttaaaagtctataaagatgccgtgcccataagatttttgcgaggcgggaggcggtatttaaaagattttttttataagaaatttgtctaaaattttccataaaatttatttatgcaaaaaaaaaaataggcaaaatgtacattagctaggaaatggaaataatgcttcttcatctatcaaataattttgattggcatgcaaggaatgtggtggagagacacagtggtgaaagaatttgtgttgtgaaggcggccgcggttttattagggatttatggatggcactcatctcattaattttattaatgcaaaaaaaaagtgttggcgttgtgtggttttttggcttccggtttattgtaaatatcatcaataatttatttgatgccctgatcactgatgttctattttgagatgccttcctgctggtccaaatggcacgctctctcaagtgccaagtgatcagcagatgggatcaacccataaactgacacaaaagtgatgggaaaaaaaacttggaatccatcaaaaatccactcaaaaaaatggtaaaaccatcaaaaatccaaagtgatcagggcgactcattcatatattgtggtcaacgatgatccaaaaagtgaatatcttcgaaaacccattgatcaaaaaagtgtccattaatattgtacatggaacaagaaatttaatcaaaaaattccccaaaaaattgcatattctaattgacattaaccccatatgcttttaggcaattaaaattttgccaaatccctctccccacaccgccgaaggcttaatgatgttttcccaattaggctaatggttttttgtgggcatcaaattaggtggccggccatgtgcggatcaaatggcacaaatgccaaaaaagttggtgcggttttgtgtgtgtatagctcatagtgccgcccttttccgactatggcacttttttttgttgttgtatgccgtgccggtgtgtccgtccgtctgtggtccatgcgctccatgcctcgcgctttatggcaataatcccgcacagagtgccggtgccacctccaaaaagcttacactaatctcgctagggcagggggcgaacttccttccacttggcttcatctctctctacaaatttataaaaaatattttgccttccgggaaaaaacctatttgccccacccctctggggctataaaaaataatattaattgtttttagtgggcgttaattagggcaaagccaaaacaacaaaaattttatttatttatttttattttgactctaga

SEQ ID NO: 19059 - DNA, 1091 bp, Heterodera glycines
ttaaattcaattgaaataaattaaataatttaagtttatatttcagtgaatcactaaataaatatacaatgaatttttccaatttttatttttttaacacctgaaattttaattaataaaacataataataataatatcaatgagataaaagaaaaacaaacaaaccgtacatatgataaaataagctagaacacataacgaatgaaaaaatcaaagatcatcaatatatgcttaaggtatttaataattatggtacaaaaactgatcaaaattgttttgttggatagagagagatcagatcaacagtgatcagaattgattagtgactgattgactgattaattaattatctgcttttattgcttttttgtgccgtttccattaactgttggcaaagcggtggacgacgcttcttggacccatggcgcgtcttcttttgctccatcgttcacaattggggcaaccgcgttcacaaattcctcataatcaatctttcaaaattcaaattaaacataatgatttttcccactgtttaaaaaattaaatattttagacttattattttttagcaagtttaaggaattattccattcttaaaatgaccaaaaatgcactttaagtttgcagggctactaaaaagacaaggattttatagctattcctaaaataggttcccattttaattttttttttttctaaattaccgtatttcctaaaacagagccaacggggggctctgttttacatgccccctcaaaaggtgagcttttagttcctatttttcataatttttaatttttttttctccgatttttttaaataaactcattttaaagaagcttgcttatttaaaaaatatatcatcaacagcagtcttaaaaccgatcaaaactgcactaattttaaaaaagataaatctttaataaaaaatccatgaaaaattctacctgttcatctccgtccttgtcaaactctttgatgatttcgtccacttcctcctcgctgaacttctcgcccatggtggtcatgaagtgcctgaactcttgcgcagtgatgtacccgttcccgtcctttcaaaaactctgaaaat

SEQ ID NO: 19060 - DNA, 1530 bp, Heterodera glycines
tacgtacccccgcgtacccccccccctgggaccgtccctgccccccccgcgccctctaaaatggcaactatgttttaccacagtcaatttggatgagtgttggcgtcctgtttattcgcccaaaaatgtagaggaatctgtcgaacaattgcgcttgtattgcggaaaaatttggcgaaaacgaccgacggcggaacgtacgaatcttaaaagttgagaccaaaaattaaattaaccagaaaaggaattttgttttttagaaaactttcttaatagtagggccaatcattgcccccgtgaagatttatccatttttagcgaagaacttttcttaaaaatttcaaaaatatttttttttcagttacgtcagtgtctttacatgcctcacaagggaaccacccgaactgtaagtcggaaaatccatatgtattatatctcattggatagagtagggtcgacttctattgtgaaattttaatattacgcccatatagcaagaaaacacaaagatatgaggcctcaaaaaacgaaattttgtctgtgttttcaccaaaaattggtggctcagttggttaatttgcatttttgaagttcgtgttcaaatccaacatgaaaataaatattttttaattaatgtaaatattacaaaacaatttaaaaaagtattttttaaacttaaaaattgtaagatagtttttctttaacaaaaatatgcaaaaaataacaataaatgtaaagtttggaattaataaaagtgataaaaactggaaatggtcccttaggcgttgattttgttttttgaggcttcataactttttggtttcttgctatgggaacgtaatattaaagtttcagttatagcctttttgaaaattatacaaaatttgtccatttttgtgaaatttttaatttcggggggatggaaaggcacctgccctccacttccccttggatacggacgggcctatccccgaaaccattccatttaattgtcattcacctttcccatttgctgcagacgacagtcccccacaatgccttttatgcgaaaaccacggcccgacttcgccgaagtgccttaacagtaataaccagtaaatcaaaagcgaaaaatagttcaatttagattatgctttaaacaacagaaattttgcgggggagggggaggctaaggaaaaaatttgcttgtaaaaaccaagggtctggggctacgcccttgcataagctggggatttcagaaaaaaggcaaaaaaaaaaaaaaacatttgttacaagggaaccaatcaaaatgcatttgaaaatttgtaaacgtaaatttcaatttttcagatctgtgcgtattttctttgtcttaagaatttcaaaaaatttacagttattccttaaataatttttttagtataaattttttttttaaattccggggtttggaaagtcatattctttggttatccgacatggggaggtgataaagcaaaaaagaaattttctattgtttttgtttgtccttaccgccgccgtttgcttgcc

SEQ ID NO: 19061 - DNA, 1293 bp, Heterodera glycines
gggggggggggtccgaatccgaaagtcaattcttaggggtgtatttttgaaaatattcgcccgattcttaggggcgtatttttgaaaaactttcgcccgaacgaccttttttttttgctcataccagcgacgctgggaaaataggggtgtatttgaaacgataaattagcattttttccatcgtttacacaatggattttgaaatttagctattttgacggcttttgctccgcccctggccgccagcaaaatgtttctttgtaatttggcgttggaatttaaaattaatatattgctttcgttatgataatttggcgttaatttaaaggtactcattcggtttgtatcccccttttgggtcaaatttttttttttaatgacccaaaattagtcaataacaactgcgttttttaaacgcggtgcgtaccttggaatggcaatcgatgacgaacggcgatgcccgccgtctttgtctctgcgtcctccagacagtggcgaacaatggtaacgcgccgagcgaaaaggcgagcgattgggcaaacgacaacgacggcaactgtccacgtcgtcgtcgtcgtagtgtcgacgcgcaggcgaccgcccgcggcgatattcggcactgtaaattcgtttttttttgcgtcacatttcattttaaaattttaatgaattggcgccggcggaaagttgattttaaaggaaaattgttcgtttcttgaacatatttgggactatttgtgagcaatgggtggggaaatcggaacactggtaatagctatttaaaaaaattgttttttttttgttcacccgggggttttggtgcttctgatcagaaatatgaaatcagattggcagatatcagtttttatttggaaaagttaataattttgattgttctactagcatctaattggttaataatgatttccaaaatgaatgatttttgcaaatctgccatcatattcgttgtcatgagccccgaaaacccccggggagttagccttttcataacattaaaacaaattttttgtgaatcccagattctcaattattacgtaccttggaatggcaattgaaggcgaacggcgacggttgtcattgtctccccatttgttgtgacaacgcgacgaaatttgggaccggtgacaaaaagaggcgtgacgaattggcattgataaataaaatgaatggcactgagcaaaataaatctttggaaaaaacatcattacaaaaatgggcgcaacgaagaaaaaaaaaaatgaatcccagcgaaaagcaatgtttaaaatactt

SEQ ID NO: 19062 - DNA, 2521 bp, Heterodera glycines
gagaaaaaaacattctctgtaaaaaataaattaaagaaaataactataatgttgggaaatatagccctgtccttatttgtaaaaaccgtttttgtaattagttattttaaccgtacttgtattcaaggaccattccagccacattttgacttgcttgtgatgggacaaaaatttttggattcggtgacgcaaattatggtcaatggaatacaaagaggaaattttgacgaagaattaacaactaaatttgataatgaaagctttttgggcattttgtgctttaacgccaattttgaatgtgaaatgaacgacaattttggaaaatttctgagcaatttttgccatgaatttaaaactggaaaaaatctggaagaagcaattgaaactgtgaagaattctttgataatactagcaagaagcatcacaattgagcaaattatcactaaggaaagtatatttcaaaaaattgccaaaaacgaattttttggtgccaaaaatgcggaaaatattgcaaaattttttgaacatgccaattctgcgtttcgcctaaatttatcggcacagttggtaagaataaaaatttaaacgcaagtttttaatttattaaaaaaaattctatctttttttagtttgtaatattttaaaaatgttttagcatcattttaacaatttaatgagtgcatccgaaaatgtgccatcgacaaagaaacgaattcgtcgtatgatacgccgaggttttagcagagcaatggaccaatttcaaaatagcctggacaactcacgatatcgccttcgaaatgatcggaaaaaatgtgctttctttttggcacttagtgtcgttttgctggttggcattgttttcacgatggccaatttggccaaaatcagtgccaatgccagccatggtcaatgggcatttttcatcctgtttttcaccatcattgtcacttatttcattatgcatactgtctcatttgtacttttgtgtgttcaaaatccacatcatcaacaagaagaacaaccggaacagcagggccaagaattaggcgaaataggcaattagagaacggagaagcgagtacgagaagtgcaagactgaaatggatggcactaattggaaaatgatgatatttttaaataaaaaatattttattaaaaaatattaattatgtcaaagatattcattttttcatttggttaaggtttttagtctatataaatccatattttgggggtttccgggaataaatccatatttcgtcattgttagttaaaaaatgacaaaattttgcgcaaaacttatttttgttgaaaaatagtatttctgccataaaattttcaaaaccgcacatgcttagcctggggcgactatcatccacgtattttgtttggcatttttcaatttggaatggcaaggcttaggggatgcatttacccatccagaccttcaaatgggcaggggggggggggcttctgattccacatttggcatgatacccttgcccaatttggtatggcatccttaaagaagggaggcatttggcatgccacaggacgacttctaacaaaaaaggcgtaaatttaaaattttcaaagtttatttttgggtcaaaacttttttttaaataatgaattttgtggaggaataagcaaatggtaaatttcagtgcattcgtgatcaaaaaatcagatttttaacaatttttttttgcggcgcattcgtgacatttctgacaaatgataacagtggacatggattaattgagtttaatcctctagctgactcaatcaatgtttgacttttgggaatttaattcattggcttttcagatgaacccgccgaccacttttttgctgttcgcaatttgctttttggcttattattgccacggaatgaaaaagggaggaaacagtttgtcggacaagttgaaaaagtgattatcaaaaaaaggaaaaggcgagaaaaatgccgaaaattcaaattttattgaaaatactcaaaatgccgaaagttcgaatgccgtggaaaaggcaaaaaccaaagaagtgaaattgtatttcgaagaaggtgctccattcacacttaaagcattccatgatgataaacttttatattcgcgtaaaacagaggccgtacaaagtaaagggtggccaaggccaagaactatggcacaatatgtggtgatgcctgttgatggaaaacaatggaacggtttggctgaccatggaacgataattttcaaagatggcgaaggaaaggtaaaaaatatcaaaattccgttgataaatcaaaaaccaagaatttttaaatattttttaaatttttaacatttaaatccaacaaactttaaaattttataataataaaaattacatgttgtgcccataattcatttttgtatacaaactttttgtcaacaaattaacaaatgttaaatatcataaaataaattttagtagaattattacatacaatacaatattttttcttaattaatattattgcttttgctttattatt

SEQ ID NO: 19063 - DNA, 1149 bp, Heterodera glycines
  misc_feature (1085)..(1085): n is a, c, g, or t
aaatggaaatttttggacaaattttttttttaatttgctcaaaaaggatcacaaatttttgtttttgatatcattcaaattagtttgttaaaaaatcgaaaaatttcgttattccaaaaagttagatggccaaaaaaacgttcgatttttttttttttttttgagttttcctggtcatatatatttttttgaaatttaataaaaatcaaaaaatttaaatcgaattttgtcgaaatggacattgtccatccatatcaggcatgtaagcagaaaaaattgagaatccaaagaaaatttttttgctgttcggtcaaaaaaaaattttcggtaaattttgtctatggcggtttaaatagcgccgcaggggaaatttttttgcaaatttatctttttcatgaaaaaaaaaaaatttttcatttctagggggtgagagaggcacctctctcctctggttacgggctggggctgctggtcctcaaacatacagaacccacaaaactgatcatccgttccgatcgatcaaatttcaaccgtacaccaaccgaccaactgatcagtctaccgtatgccaataccatcattccaacacttcctatcacaaatcttccttctccgtctgccaataacgctgtaggttgttcatgaagcccgttttctgctgcaggcgttgcagctcgggcgaacgcttgtttttctccatctcagctcgaacttcggcttcaacttctttgggcggattctaaagaaaatttaaaaaaaaattaaattttatttaaattcccaaaatttaaaaaaaagaagaagttttggataattttttaaatattttggggctttttcgtgaaataattaatgtattttttctgtcattttttgttaaacacaataagcaattaaatttataattaattcccttttttgatcattttgcgcacatttataatttagttagcttaaaaattattcaaaaatttttaaaaaattaaattctttgaaccatgaattttttttgaggggcaattaattgttaagcttttatgggaaactgtacctcgttgagagtacggtattcttcttgcattcgnctcaagaagtctggtccctttggcaacaattccaagtcggccacaatcttggtactgtacttgt

SEQ ID NO: 19064 - DNA, 1364 bp, Heterodera glycines
gatcgcccacactgagcttttttgtggaatgactcaccacgacataaattgccaaccctattaattagctaattacccaattaaatttgaaaattgattactgtacccataattatttttacctcctcctcagcaatcaactcattgtaactgacaataaattgatgcacaaaaaccttcacatgcttctccaattcaatggactcgctaagaaaaaattgggaaaatttttttaaaataaataaataaaaatattaaatttttaaaaattaaaaaaaggacaataaatccttacgaaataaaattttaaacattattaaaaaacatgtggcaaactttcaaaaaataagggaattgaaatattttaaatttaaaataatgaaatttctaaaatatatatataatttttaggaaagacagtaaaagcctacgaaattaaaatataaattttttttttaaattcatgtgccaatcattttggttttgaacttacgactcgccgataattgccttcaacttgtttcctgcctcgttacgatgaacaacttcacattgatctgcttcgattttgccagcgcaaatgaacgctgcagcaaacaggaccaatgcatccgcaacgcgctcacgcttctctgcagacattttcggcccgccagccgtctgcttcatcgcgtgcaccaactgctcacgtttgtcgcgcaacttggtgttatcaagcacgcggcgataaaagtacgcaaagcttcgttgcagcctcaccgcgctgcttatacccgccacgtccatcattgcatgcaacacgaagtgcacaacatccgggtaatagtagagcaacacatggttcacgcggtagcccacgtgttccacgcgggaagcgtctttgtaaggcacgtatttgaacagttcattgccagcgattggtttagcaactggtttaaatgacgtcacttccgtgtgcagcgagtaaacgggcacattcaactaaagcattttttgaaattttagtaaaataattaatttaatatttaatttttatgaaaaatatattttaatcaaatttaaaataaatcaaactttttcatagttatcatagatttgatcaatcaacttctccatgagtttttcatatttgtcaatcatttgcctagaaaaaaaaaatgctttttgtctaataatttggcatggatgcaaacacgtacgctgccctctcttttttcagttggttcaatgcatgctgtttgtgcgcttcacataatcctactgaaacgctctgtcgtgtgcccgaagcatccccctgtgaagggtttgacgaaagcggaagttttgtttggccatttccaggttcagcaaaacgctgcaaaagg

SEQ ID NO: 19065 - DNA, 917 bp, Heterodera glycines
tttttaaaaaatgccaaaaaacatattcatattatacgccatgttcatttaaatttttgtacctttctctcgaattcatccttctcagcattctcaatttttccaattttctttttcaattcttgcatgattacaaatggaaaattgttgataaaactactcaattcattaatttcctttttttaaacaacaaacaattcaatgaattattaaattaattaaattttcacacctttccaaatttggcattttctgcgtacggcatccccaaaaagccaaccaattttcgacaaaggcacacatagaaaaacaacaacgcttttccattttcattttgcattgtccactgacttgcagtttgtttaacggaaaaactgaaattaattttaaaagggttttttaaaattcaaatttgagttcatcgctccgctctttaccgtattctttgtaaaaatacggtattaaattacttaccgtatacctgcaaatattagcatggcaaattcatttaaatttgctacctcaatgttcgcatgtaaaacaaaaaaaaattaaattaacatttagctcattgctcaactctgtaccgtattctttgttaaaactaaatacggttattaaattcctaaccatatatagaaactattattatagtaaatgatttaaatttgctacctcaatattgttatgataaacaaaaatatttaaatgaattaatttaaaatttaaattcgaattcaccaatccgctcgataccgtattctttgttaaaagaaaatactttattaaattccttaccgtataaaaaatattaattactttcataccgtataccatctattagtatgattaattaaattaaatgtgttacctaaatattcgcgtgttaaacaaaatttcgatcagatgctcaatcc

SEQ ID NO: 19066 - DNA, 1095 bp, Heterodera glycines
gaaatgtttgacatttggtcggaaattttgtcctcttttgctgctgatgatgttaaaaactcattggattcaactgccgatgtttcgttctctttttcatcgtcatctttaagccaaccaatctttaaaaattggggagaattttaaaatacaatacaaaaatttcatttagatttttgaaatatttaaagatacgtaattttgttgtgccaaatatacaatgatgggagaaaatgccggttttcgacatttctgagctcggaattccgccgatttccgattgccaaaatttttggcccattggaattccgattggcaattccaaaaaatttttcagccgtctgagtgccataacggctgccaatttcctgtttccgaattttttttttttgtacgtttcccatccctgatatataccagcaccatgggcgtttcataaattcgttaggagtaagaaaacagaaaataattgttatttcataatacgagctaaaaattttttattaattgcgggacgggatcccgtgggattacgcccgcaatcccacaatttcggaaacgaattcctgccccccgcccgtccccgattttttctttcccagtagaaggtcaagggacattcgcctttcgctttttcgccttttgggacatttcgcctttcgcattttaattgttttgccacaattggcacttttcattaccttttcaaagcaaatgctgcttccacactcacaatgaaagccctccgtctgtttgtcctcccaataatccttgccataatttatcgttatttcatcaccctgattaatccgtctccttttaaatttaaaaaaaaaattatttttattattcgggcgtttgagaaaaattttttttcaaaaaaacttttaaatatattctaaaaattgttcattgtacataaacaaataagattacgacttcctataagtagggatcgaaaaaatatggatataaaatcgctaaatatggacataaaattacaaaaatatggaaataattaacaaattgagggagttaattttccgaaaatcttaaagcagcctctccccgtcagagggaatgaaaaaccttctc

SEQ ID NO: 19067 - DNA, 1416 bp, Heterodera glycines
  misc_feature (66)..(66): n is a, c, g, or t
gtcatcgttcatccacacagagccagcgaaattgatcatcaattttccagcaaattggttgacaantttgggcaccggtcgctttctgttgaccagcacatacggcttgagtttttgtccgttgtttcgagctgtaaggcacaccgtcacccgcattttgtcatgtcctgtggtcaccactgtcacctaatttgaggaaataactctaaatagttttttaaaaacttattacatctttggcgcctttcttatctatacatcggccgtccgggcaatcgaaccaaacggccgtctcgtccattgcgaagatgccgccgggaaagttgttcatcgccttgcgcctttggcaacaaaactgatgaacttggccaccgcttcagcatagttggacgggggtttctgacaaacggatgtctttttgcgcagcacgaaattgtgcctcctcagaaatttttgcagccatccaagtgatgcctgaacaaaaaattttatttttgtagcatactagcagttttctcactttggtgtcagtgtccgtgaacagcgcagccgccctctgtcgaatgatattccttgacacaggctgtttattttttcgttttttggtgacccattcggccagttcagtgtcgatgtccggacggtgaactgggcgacctgctccgtcgagtctcattcgtttccccccatttggtgacatgctaaaatttttgatcacaaaaaaaaattgttaagtacatttgttttctcagcttatcttcatgcgcgatacagtctctgatcgttttcctgtacattttgaacttctttgctgctgcatttatggagttctttcgcgcccactcgacagcctccagttttttcgccgcatcgttgttcctgtggcgcctcttctcttttgccggcgtgccttcattctctttgttttgcggttcgtagtcatcattttctgagccttctgctatcggtgcattgccttcctcgtttgcgaagttgcacacgacctttccgccgaagcgttcgttttcaactccgccagaatcgccacagaatgtgtggcacggcaatttgcagacataacagctgtgacttcctccataaattgctttacaaacgcagcaaaacgattccatattttctgaacttttcattaaaaattcccatttttatgcataccggaagcaaaaaattaacatttttgccatttttggcgtcaattttcagaagttctttaacaaaaatgcaataaatatgattttttggcgacatgttcaaaaaaatttcaaaaattttctactaaataaatcagccgaaaaataatctcttagtctccattagtctaccagtctccaattatctaccccattctgaggaggttgataaataatataccatggcatataaaaagagtaaata

SEQ ID NO: 19068 - DNA, 1155 bp, Heterodera glycines
tgtccttcattttagaaaggcactgaaccgtatacaaaaactctcacattctaaaataactcagttaaaacagcttttaattttaattgttctgaaaccaataattttgtctgtaaaaaatagtcccatatgaaccaagacataaaaagtgcctttgcgcaacaatctccccattgacttaaatagtccatgattgcgcgccaatctccctctggtgtccttcattttagaaaggcactgaaccgtatacaaaaactctcacattctaaaataactcagttaaaacagcttttaattttaattgttctgaagccaataattttgtctgtaaaaaatagtcccatatgaaccaacacataaaaagtgcctttgcgcaacaatctcccctctggtgtccttcattttagaaaggcactgaaccgtatacaaaaactctcacattctaaaataactcagttaaaacagcttttaattttaattgttctgaaaccaataattttgtctgtaaaaaatagtcccatatgaaccaagacataaaaagtgcctttgcgcaacaatctcccctctggtgtccttcattttagaaaggcactgaaccgtatacaaaaactctcacattctaaaataactcagttaaaacagcttttaattttaattgttctgaagccaataattttatctgtaaaaaatagtcccatatgaaccaagacataaaaagtgcctttgcgcaacaatctcccctctggtgtccttcattttagaaaggccctgaaccgtatacaaaaactctcacattctaaaataactcagttaaaacagcttttaattttaattgttctgaaaccaataattttatctgtagaaaatagtcccatatgaaccaagacataaaaagtgcctttgcgcaacaatctcccctctggtgtccttcattttagaaaggcactgaaccgtatacaaaaactctcacattctaaaataactcagttaaaacagcttttaattttaattgttctgaaaccaataattttatctgtataaaatagtcccatatgaaccaagacataaaaagtgcctttgcgcaacaatctcccctctggtgtccttcattttagaaaggcactgaaccgtatacaaaaactctcacattctaaa

SEQ ID NO: 19069 - DNA, 3689 bp, Heterodera glycines
attggctgtataataagcagtcctctgcttaccggaggcgacattccaatccctctgcgacaaattacggacaacacaatcaacaccattcttaatcagttcatcaaagttgcgcagagcaaaaagcagcagaatttgacactttggggagaaccgttcacaatttcaataacatctgtggaccggagcagccttcccttaaaacgacaacttaaagggggagcgcggcgatgcatcgcacctgttcatcatcgaattcacgacaattttttgattaaggttccgaatcaaagacacagtcgaatttaaaattcagtttaagatacggaacccagacgacagaaattattgtttattttacgctctccaggcaacaatggttgctaagacgcgtggttggccaagatggaaattttatgactatttgcatgaccgatacggacagaggcaactacaaaacgacactttgcagcttatggcccaaactggagtaccgttaaatctggaagcctatgatgcagacacttacgttcctcgactgctaaatcattggaacaacgctcaacggcaacatcgtttctcagtttttatttttggtgcaactggccactacaggccattatacaaatacggcactgacgactataacactcctttgatcctgtacttcagcaacaaccattttgatggagtgcaaaaaatttcggggctctttgggaagccgtactgccttgaatgtgaaagaccctatgcccgcgcgtcaaaacatgcacaatcatgcaaagctcgttgtttgctttgctctcgcgctggtccagaatttccttgcccttcggaggacaatttccatagacagtgcactgcatgcagcaaaaattttcaaaacaacgactgctatcaacatcacctgcgctcgaacttttgcactcaatcaaaaaagtgcagggagtgtggagttgtgtggaacgttcgggacaatcaaagaaatggacggaaggtgataaacacttacattttggtctgaacttttaaattaagggcatgtctgcggtgaaaaattttgccaactttgcaataacttccacaattctgagcgcggctgcttcattcagcaaattgagcccaatgagcagctaatgtcctaccgattcgttgcattcgacttggaaacaatgcaacatcaatctgttgatccgatgcatcctgatcgacggaatcatgagccaaactttatttcggcaaaagtgagctgtcccaagtgcattgagaatggaaagtggaggacggaaactgcaggctgcattgtgtgtgggccacatcgaaccgtggctttttgccaacgccccttcaacaacacggtcattgataagattgtcgtctccgacaacccacttcaagccttcgttggctggctgatcaatgacctacctatcaaattcgacacctatgcgtatagtcattttggtggccgatttgatatggtcatcactttccgcgagctcttccggcgcggatataaccctgaaatgctcaaacgcgtatgttaatttttacacaaataaatatataatattttttaatttaaggggaataaaatgtatgaaatgaagatccgagcgcaaaagaagagaaacccgaacatcatttttcgagactcattcaatctgatgccctgcgctcttggtcaacttgtccctgcctatggattggatgttgaggagaagcctttcttcccgcacatggcaaatcgtccagacaactatggacgagagatcttcccgacccccgacgactatctcgcccaaggaatgatgcctgaaaagcgacgccaatttgacgactggtaccaacaacaccgagaagagccttttgtgttggatgaggcattggctagctattgttccaatgacgtggagatcttaatggctgcgttggttgcttttcgtcgagaattcatcgagatttcaaggcggcaagagtacgtcgatggggtcgacgaccgggagaaccacgacggaattgatgtcttacgggagtgcatgaccatcgcaagtgcgtgcatgaaacacttccgcaccaatcacctcccggctgagcacctcgccattgtacctgagcgaggatatgacaacgctcaaaatcagtccctccttgcgattcgcttcttcaaaaggtatgaagaacgccatggcgtccaactccaagctgcgcattctgccggtggagagaggaaagttggcaattactctctcgatgcttgggttgaagctgaacaaagggccattgaagtgaacggtaattttacttttaaacattttaaaatattgtttttaaaaataggttgtgtgtggcacgggtgccaaaagtgctttccggatgataatatgctgttgccaaatggaaagtcggccggagaagtgagggagcgggacgcaaagagattggaatttctgcgcaatcaaattggccgtgtggacgtttattgggagtgcgagattgagcgaatgcttgctggtgaccgagaaatgcggcaaatgttcaaaaaatatgttgattatggtccactcgaaatccgagccgcctttatgggaggacgcacgggaccattgaagctcttccggaaagctcgggatggagaaaagatttcatactacgacttcacttctctctacccattcataaagtgaaaataatttttataattttttaattataaaaatttagctttacgacgcgctatcccatcgggcacccaagagtccatgtgctgaacgaagaggtggaatggacaacatcggccgacaacccctacgatctctcacttctgaaagtttgggtcattcccccgcgaaactgtgatgtgccggttctcccagtgagagtgggtgaacggctttgctttccgctttgcatgaagtgcgccagcgatcacccgacaggcggagttaatgaaaattaccactgcacacataacgattcacaacgtggttgggtcagcacttgcacatctttggaactgaatgctgccctggacgagggttatcgggtcaccaaacttttccgcgtattggaataccaaagcagcgatgatcaattgttcaaatcgtacattgcggaatttatggcgctcaaaatccaagcatccggctttgacaccagtatcaaaggcaatcctgagcttgaggaagcgtttgtgagggagtgttatgagaagtttggcattacaattgatccaacaaagatggagccgaacaaagggaaacgatcgatagcaaagctctgcttgaataacttatgtatgttgtctttaaatatattatttttaaataaatttctagggggccgattctctcttcgcaactttgggctgtcgcaaacactcatcacagatgaccctgtggttctcgctgaatatttggacaaccggtcgctcgaggtcacagcgatcgacgaatttgacgctgaacacatactgatcagttatgagaaaaagaaagagtgggtcgaggaacatgcatggtccaatattggtataataatttatgaacacaaatacaagaataatttagtaatatctctttggacaacttcgggggctcggctggattactaaaggcaatgcagaaggtgaaaaaggcaccaggctggggactactttataccggaaaaaaaaaaaaaaaatttaaaaa

SEQ ID NO: 19070 - DNA, 1812 bp, Heterodera glycines
  misc_feature (10)..(10): n is a, c, g, or t
atcagtaacncgtttcaaccaaaacagcacccaccaaacactctctgtctctgatcacactttttataattttgtaaattcaatttttggcttttgttccattagtcgatcccttcaaagtgattgatcgatttctgaggacgtttttgaacagcttcatttagaaaaccaatatttatgaaaattgtataattattttatgaccaaaaaatatttggcgctatatggaaagtgggcctttttgaaaattttttcaaaaggggggacccttttgttttgcaaaattttttttgtgatagtcataaaaatttattctctggggtttttggggtccccgatcacgaatccttcaattattttaatcaattccgatttcctaatctaaatttgaacaaaaaatcataatttgaaaaattcaaaattccgatttttataaaatttaaattattttggtgaatttttatgtgtattctttatttctttgcataattttttaaattctttagcgttaatacagcacagaaataaattttagcgacctttaaaaccccggataaaaaattatcatggttttttatcttaaaaaaattttgcaaaactcgcgatgaatttcagcatcaaaaaaccattttctaaatttgcttttgcaatgtttcgtctcattttgctgcttcttttggttgcgctgttctgcgcttgcgctttggtcgaccacgcatccgcgcagtggggcccgtggggcggcggtcgctggggcggaaaccgctggggcggcggatggggcggcccatggggcggtcgatggggaggcggctggggacgaggtgatcattttttatccgcttttattaattggcactcatcaacaggcaattaaaaagactaaaaggtgtccggacaatgagatctaattaggcaaaaggggcggggcgtaaatgcctggaaaattaattgtaagtgattaagccaatttatattgttaattgggcagatataaaacaacaaattagcatttgaataatttcttttttcaaaggttggggatggggacgccgataaaccaacgggaaaatggcgaagatttggaggccgcggcaacggattttcaatgggattggcgacgaaagatgaacatgatcaatcagaaaaaccttctcaaaacattttttgtaattatacaccgctggacacattacaaatcgtattgtaatcagaagcaaaaatatttccaataaaatgtgaaattccaatgcttttcattactttgaagtggtaaaaaggcgttattttcaaagaagaatttttattattgttgacctacggcaaaagacatcattagcactccaaattttggcccaaaaactaagtatgaaaaaataatttaaaaaattgtgttatggttagtattaagcttcgactttgattattttctgattaaaagattatttaaaaacgcggtatattgtttttaataataaaataataaaaaattctaccttattttcaaggttcattaaaaaaaattaaagttgtattatgggtgctgctacatttgtcgtgatcacacacatttttatttaattttttgttttagaaatcaaatttaaaatattattttttttaatgattttcaattgagtaattaatttttgagtaattaattgtgtgatgctctgttgagtgatcggcgcgattaaatacctatacacaaaacacctcctgtcccaaagcccacccacataatgggccattgtcaaattttcaacacattgttttcggccgatcggctcgatcattctcattcattcatgc

SEQ ID NO: 19071 - DNA, 1184 bp, Heterodera glycines
  misc_feature (1175)..(1175): n is a, c, g, or t
gaaaaagccgccccccccctaagcagcatttaattgtgcaagttaaatttggcttttcccctttaattgccctgcccctcctctgcgggcggctttttcttttaatgtggtcagctggttgctgctaatgggcgggtggtgataggcgcgctgcgcgaacgccggcggcagcgaggggcctgcaccaacgcgatcagtgtctgatcacagctgatgagaccatcgtccaatcagtgtctgatcagagctgctgatttaagagccccgtcgtccctcctccgtttctctgatcgtcgccgcccactgtgccccccccgcgcccccggggagggatgatgcgtaatttatacattcgagcgcgaattgatcattttcgcctctctaattgcgattgtgacgcctatgaattggcggcgaatttgtttatttttcccccgcggagcagtgttttaagctttaacatttgcccattcgccgcgtgatgggtgatcggcggatcgatgacatattttggaaccaaaagtcaagtcgatgggtggacgggcctcaaatggaaataaatgctaatttgtaactaaaagcaatggcagttgtctctctctctttctcacccccctcgctctctcccattttctttatctctcataaacacactcactctctcatcatggtttcttcccagttttctccaccattttctctctctctctttttcgctctccttctctctctctctttctttcgctctctctctctctctctcctctctatctctctctttttctcttttccctattccattaaggcattaatttagccacaatgcttgtcattgctgatcaattttttttggcttacaaaaatgccctatgattttgttctttggctttggctgggaaacccaaccacctgctgctgccctcacacatcagctgcactggatgaagcgcaaaagtttttctccaacggattatcggattatgcgtaatttgcatgcacaaatgcaccacagatttgggacggccaaacaaaacgcttaaaatagcaaaacccaatggaatataggcgtaaaaacaaacattggccaaaattggggggaaaaattgcaaaaaaatggatttgatggaagaaatttgtgccgtgggctaattaattgttttgaaatttgaaaccanaaacaaaac

SEQ ID NO: 19072 - DNA, 2235 bp, Heterodera glycines
ccccgcgccccccggggagggatgatgcgtcatttatacattcgagcgcgaattgatcattttcgcctctctaattgcgattgtgacgcctatgaattggcggcgaatttgtttgttttccccccgcggagcagtgttttaagctttaacatttgcccattcgccgcgtgatgggtgatcggcggatcgatgacatattttggaaccaaaagtcaagtcgatgggtggacgggcctcaaatggaaataaatgctaatttgtaactaaaagcaatggcagttgtctctctctctttctcacccccctcgctctctcccattttctttatctctcataaacacactcactctctcatcatggtttcttcccagttttctccaccattttctctctctctctctctctttttcgctctctctctctctctctctctttatctctctcttttccctattccattaaggcattaatttagccacatgcttgtcattgctgatcaatttttttttggcttacaaaaatgccctatgattttgttctttggctttggctgggaaacccaaccacctgctgctgccctcacacatcagctgcactggatgaagcgcaaaagtttttctccaacggattatcggattatgcgtaatttgcatgcacaaatgcaccacagatttgggacggccaaacaaaacgcttaaaatagcaaaacccaatggaatataggcgtaaaaacaaacattggccaaaattggggaaaaaaattgcaaaaaatggatttgatggaagaaatttgtgccgtgggctaattaattgttttgaaatttgaaaccaaaacaaaacagggagggggtcgcgcgagacgagtgccaatgccattcatgtgaaacaacacttagggagcccatatttttaagggttgttgttggaccatttggggaaattggattggatggcatccattgagacggattttactagccatgacattttcgagaaaaatagcgcgcaaataatcctcgtggagtgccggatgagctcaatgagcaaacaaattggggataaaatggagtttaaagtaggtgtaagagagctggacgagagtattggtcattaagtctcgaatacttttgcatgaggtaatggatacaaaactttatccaatttagctcccaacaggatctctgtttttcaacccccgcggaggggggctttaatggaggggggcagctatcaaatctcgacataaaagccgaactgattccggcaggctgcttttgttcttaattacaatccgaggcctgctgtccttgattccctgcgcttgccaaaactgatcatcaaactgattcctgccaattctcggcccttgcttaaaaaggcaaaagccacgcacaatgtgaagcaaaattggaaggggggggaagtgatcaaaaagggaagacggacacgaattggatgatgagtgaaaatgagttgagtgagtgagtgagtgagggcaaggacgaggatggggaatgggatgggaagggatttgggagattgaattgatcgtccgcgagggaggcgagtgaatgagtgactcctccgcgaccccgcgcgactttgtgctgctgctgctgctgttgttgctgctgctgaacaacacaacacaacagcggcggcaaggacgccgtcaaatgcaacgggcggcgacggaagagaccaaagattgccgccgtccgctgcttttgagggtcggtggctctcagcagattgtaaatcggaacagtagtggaggatcttgtattgaggaggattttaggagaataggcttggcaaagcttatccatgaactgcttgaactccatttatgtcccaggccccggttttttcggtgccctttttcatggaattctgggaaaaagttcaaatccaattttttgagacgaagagaaatctttcatcagagtccgatccaaaatcatattagctttcgagaacataatagcctttctcaaaatgtgcccgaatcaaatgagtgtgccgtcccaaaattcatttaaaacgttttcgcgcaagcaaaatggcatgatccaaactgatcaggcttctggaccatttttgattatccaaaatggccttatttgccaccagtgagtctcggcattgcctttcgtggccattctcgtctttaattttcgacatacaaatggccattatcaaagcattaaccaggtttgtttcctacgcccgtgg

SEQ ID NO: 19073 - DNA, 1620 bp, Heterodera glycines
cctctctctccctcgtccctctcttttctgacccattaaaacactctctcgatcgattctccactcactttctgctaatttcgtctcctgcgcaattttacccccgcagccattataatcaccgcatcatatgtaatcatccgacactttcacttgcaaaaacacacttgttggtcgccctttctcttccactcatcaacatttcccccccccccccccctccctaattttcctttaccttcggcccttcccttccctccatttcctcctccaatttgtccttcaaaacattttttggctttcaaataaaaatctctaattgccttgaataataatgacattgaaaggccaatcaaagcggttcattttgaagggatgaaaaatgggcggggggacggaagagggcaaaaagggaggaaagggagagagagggcggggggagagggaggggaagaggaatgagggggcaaaagaggaaggaagggagagagggggagaaagggggaggagaaagttagggggggggaggtgagattgcacggttggcggaaggttttaaaaatgctacaacagaatggcgtttttccaaggtcgggtcggagaaaataaacgcgacagtttttgcaaccgtccgaaggggaggcaaatgaccgaaaattggcgagggggcaattaaggagggatgattgaataatcaaataaattaaacacttttcgctctctcccaaacattttttgtcattttaaaatgcgtgctgctcactcaacaaaaagtgaacttccaaacaacggacgattcattcatttcaataatcttgcacaactcattgcttaaatgccggaatctgataaaattaataattttccttttcatttttttagctaattgtcctttaaataattcgttaatttttcttccaactttaaaaaaagagttaaaaattccattcatttttctttccaatttcattaacaattccttcccttcattcttttggccctttccgccgttgtcgccgttagcggcgaaagaattcacaaaccataaaatttcaaacagcgaaaactgtggactttagtctttttaatgcccaacattataaaaataatgttaaatatttaaaaattaaatagccattcaacttaatgaccttttcatttcacctaaattagtcattggtaatgatgttttgctcgtttttcagtttagcttttccaaatggtccgtgtcagcggcagcggcggcgaaagatttccctcgcgggagaacggcggttcgccgagcacttttcaaatggaaaagcaggaaaagcgaaaaaagtcaatccattgccaaaactgtgtaaattgttctgtgctttgctcagtttgttcaaatgggccgcctttttcgccgcccttttgtgtgtgctttttctggtggcaacgattgtattggcactcaaattgggactaattctaagcgaaaaaaatgggcacaaaacgaacaacggcaaaaacagcggtgaacaacagcaatcggtgaatggaactgtgaagggatcaaagcatatggaagaggcaaatttcgaaattcgaaaatgaaattggcatttgaaattgaatggcattttgaattga

SEQ ID NO: 19074 - DNA, 1865 bp, Heterodera glycines
  misc_feature (9)..(9): n is a, c, g, or t
  misc_feature (78)..(78): n is a, c, g, or t
  misc_feature (969)..(969): n is a, c, g, or t
  misc_feature (1850)..(1850): n is a, c, g, or t
ctttttttntacagttcccttccatttttttacttccttgtgtcctaaattgcacccctcgttcccatccctcccaanaaaattgtcaactttttaaatatttttaatggcttatgcctaatgcgtccctgccgaccgcgagatgcattgccagcagcgctcggcccggccggttcgggacgcgtccatcatttattcattgggcccctgcccccgttcattgtttgccctttttctcccccttcctcccgcctccccgttgttgtacgggtcaaagggtcttcagcagttgggaaatgaatgagaatgaatgaatgtccccccggggtccgtccgtctcatccgtcgtcgttcatccccaaaagcgtcagtccacgagcaaaaaggcaaacaacaaacagtccgtccgaccgggtaaactctaagctgtgctccttccgtcccccctccccccccccattctgtccgtgctcggctctcactcatctgccttatgcttatgccatggctaccaaccaaacacacaccacaagactcttgaatttctgtcctcctcacagtggcgagaatgaaaccggaaactttttgggcctattattgtcatttatttattcatttaaatctttgttattgttgttccattaaggtcacaaatctaaaaatgcatttaagtaatttgtcattggcttcaaaagttttcttagaaattggccctccatgaaagttttaaataaatttttctgatttttcaagagcgtccttaattaaagaccaaatcttcatgtttgatgcctaaaacaagcctatggagttatgtccttaatttctgaaccatggagttataataataataataatacagttaccgtccttggctccaaaactgtattacaaaactgctcttttatttacggtaatagggattattattttttattattattctaaaccgattattaactttattanaattaaatgatttttcaattttttttaattgatgttctttccaagaccctccttatatttaaggactaatttattagtgtttttccttttgacgcccgacaatttttccagtacttaatttttaaagtttcactaattttacaagcgctatagatgttttttaacccattttttttgtatttgtttcgctttaaatcaattcttttttgctccaaccattgaatgtagaattaccatccgccgacggcacaaatattgcttatggcatcacaaccccacaaatccaaggcattttttgcctatgggagaagaagactcattcgcctctctcagcgtggtcttcctccctcccctaattacccccctccccccttatttgagtaacccaatcaaaaaacttttttacttttgtgacggcgcaataaatttggttggtatctccaccacatgaaaaggatggtggtggggatggacacacggaaaatgaatggacttatctcagtccctagaagatgaggtcattcccagcatggactttgccccctccccaaccatccaccgcttttttgaattggcgccaaattggcaaatacaaaaaaataatccctccgggcaaggacattcgcttatgtgtggctctccccagcagcagaaaaacagtgaaaatgttgcttctatgtacagcagaaagcataaaaaagcaaatttccataggattatgtgagaaccaacatttttaggcatttttttcgttttgtgcctaatttttttgattttgttttatcatcaaaaagcgcatttttgggaataaatgccacaattcgaatcataatgattaatagataaacatatatttcgtgatttttgttgattttaaatcnaaaattaccctcacg

SEQ ID NO: 19075 - DNA, 1748 bp, Heterodera glycines
gaatccatacaatacatataatgcaatcccgtcttccccagtcacgtcatcctccacggtgcgtgtggtgccatcacgtcatgtcatttttacgctaagagaagggggggggaaatttacttattggctaatgaaccatttttggagtggcggggtggggggggggggatttgtcatccaattgaggggccgggggcaatgtttgtgtatcatgggaaaaatgccaattttgttgggtgatgatggtcagttttggcacagccaattgtttggtgaatgtctaatggttgggatgaataatgtgaatgagttggtgaacaatggagcaatggtcgattaacctttttatggaagcatgggttcaacaattgtgggttaccttttttaaattaccaaaatgccgaagaattccttgaatgccaaaacattttggcgtttttttataatttcttttttatctttttaaatattttatattataaatagtattttttattaactacaaaatattgcactttatttgctgctattttttttacactaattgatttgccccgtcaatcatcaatgttcgtggttcgatgttcattttcttatcatttttatattcattacccaacaaaaaatatatatttgcataaaataattcgttggatatataatcgggttggactgatataagtgctattttttgaagaacataattttttcgttatttccttttgaagatttaattaatccaaattttaattaaataaaaataattgaagtgataatcatttctcacaaccaaataaataaattaaatactattactttctgttttgtaatttaaaagctcgtttacttaaaactttatttattttttttattcatttttccaaggttaacaaaaaacttgcaagaagaatttcctatgaaaattttccgatcaatcagtttttgctccccccccccctcccctctctaaacggagatgagatttgacggcagcgataaacgcaacttttcctcatcatcatcatcatcatcatcatcatcatccaatccccctctctcatcatctcccatcatcacacagttttcttccgttcttccgtccggcccacggcgacggtgttttttgctcgcccccaatcttccgccgcttctgttgctccccgacacggcgttccgtccgttttcccctcttccgcctcggacgggtgggggccgtgggatgcggggattacccccaatcgccggtgctgagataaatgagattatctttgacataaattggaaaaatgattttttttttccttttaaaagttattatttttaattgggtgccaatagaaggtgaattggttttctggaatcatatatttactttaaagcaaatttttattaaagaattttttaaaaatttatatgattttcagtaatcgcagaaccgattgaaaaacaaattatgaagtggattttaaatatgaaatgggaatttaaattagtgtttccccattagaaagatttattaggcattgatcagaaccaaggctgccttagcattgttttgcaacaaatctcattctgtcaggttccaaagctaacaaaatttaaatcaagtaaatttgttttgaaaaattttcatttaaatacccaaattttctgtttttcctacggcggatttacacccaaaataggggagggagtgggggcgagcagtcaggggtcacacctattttgcattcaaaaaaaaatattta

SEQ ID NO: 19076 - DNA, 1510 bp, Heterodera glycines
atttatgattaaaattgtgcataaaggtcaataaataattttcttctgggagaccgaaattttttgattgtacaccgtaacccttttaagtccaatgtccaaaataggacgataatccttggcaaaattagcctatcagtatttacgaaccttttctgctgctaatcgctacctttaattagatagcattcgcaattagattatgagttcgttattcaaattgccctctaacgtcttggagtaaaaactcgcaatattttaaccactaaagaatcaaatagatttgtttttctagccttacgcaaacatttcgaaatatttcgccggcatttgtggcaattcgacactagaaaagtgattttgttggttttagaaccttagcgtcctagtaatgaggtacaattaaatcctaatttatgattaaaattgtgcataaaggtcaataaataattttcctctgggagaccgaaattttttgattgtacaccgtaacccttttaagtccaatggccaaaataggacgataatccttggcaaaattagcctatcagtatttacgaaccttttctgctgctaatcgctacctttaattagatagcattcgcaattagattatgagttcgttattcaaattgccctctaacgtcttggagtaaaaactcgcaatattttaaccactaaagaatcaaatagatttgtttttctagccttacgcaaacatttcgaaatatttcgccggcatttgtggcaattcgacactagaaaagtgattttgttggttttagaaccttagcgtcctagtaatgaggtacaattaaatcctaatttatgattaaaattgtgcataaaggtcaataaataattttcctctgggagaccgaaattttttgattgtacaccgtaacccttttaagtccaatgtccaaaataggacgataatccttggcaaaattagcctatcagtatttacgaaccttttctgctgctaatcgctacctttaattagatagcattcgcaattagattatgagttcgttattcaaattgccctctaacgtcttggagtaaaaactcgcaatattttaaccactaaagaatcaaatagatttgtttttctagccttacgcaaacatttcgaaatatttcgccggcatttgtggcaattcgacactagaaaagtgattttgttggttttagaaccttagcgtcctagtaatgaggtacaattaaatcctaatttatgattaaaattgtgcataaaggtcaataaataattttcctctgggagaccgaaattttttgattgtacaccgtaacccttttaagtccaatggccaaaataggacgataatccttggcaaaattagcctatcagtatttacgaaccttttctgctgctaatcgctacctttaattagatagcattcgcaattagattatgagttcgttattcaatttgccctctacgtcttggagtaaaaactcgcaatattttaaccactaaagaatc

SEQ ID NO: 19077 - DNA, 1452 bp, Heterodera glycines
  misc_feature (14)..(14): n is a, c, g, or t
  misc_feature (60)..(60): n is a, c, g, or t
  misc_feature (62)..(62): n is a, c, g, or t
  misc_feature (69)..(69): n is a, c, g, or t
attttttaatcctnaatttttagtcatttgtttttattacctctgcgtacccgggaagancncgctacngctcatcaatgattgaaaatttatgatttaaagtacaaaactcgaagaaacatcaaagctgattggagagactcatgtttattgatgccggtgaagcttgagtcgctgaaagcgacatttaatttggactgtgaggacaagccctttttcccctattattacaacaagaaagaaaattatggaatacgattggaacatctgccaccgatggaggactattcgccgggatctatgaacaaggataaatttataaaattcgaaaaatggtaagaaaagaaggacaaaattaacaataaaaaattttttttcaggtacaacgaaaacaagggggcgcccttttatttggatgatgaattgaaaaattattgccgaaacgacacggagattttattgctgtcaattattgagtttaggaggatattgattaacgatattacgaaaggatttgacccactaccgaggagttgtacgaatgcgggggttgcgatgaatatttttaaggcaatgtttttgttgacggagcagttatcgattgtgccggagaagggatatgagcggtgtgatcgcgccagtgtgatggcaataaagtatttggagtggcggagccagcgggatggaattgagatacggcacgcggggaacggacgagaggtcaaagttggaaaatataaattggatggatttattgcgaataacggagctagggacaaatgcatcgaggttatgggatgttacatacatggatgtttgaattgttatgacccggcggcggaactgattggaggaaggacggcccaggaattgaacgatgagactcaggagagattggcggagctacagaagactttggatgtcgaagaagtttgggtatgtttatttgacatttgaatttataaattctactttttaggggtgtcaaattgagaaggaattgaaaaaggatgaggaaatgaggggcttcttcgacgacagaggaaatgagaaggggccgattgatccgaggatggcatatgcgggagggaggaccggaccgatgaaattgtttgcgaaatcggatgagaagaaaaagattagtgtttacgatattgtgagtctgtatccgtcagtgaattacggtacagcttacccgattggtttgccggagattattataccgaagagtgatgagattaatgtaaattggacaagaccggaggatttgaagtttaatggattgtataaagtgagggtcaccccgccgcgagggttgcggattccggttcttcagttgaagtgcgatgagagattattgttccctttatgttggagatgtgcgtcaaaatttaagaaggaaactacgagatgtgattacaattgccccccatgatgaggcacagcggagat

SEQ ID NO: 19078 - DNA, 1635 bp, Heterodera glycines
atccgcagccaagcggattcgaaccccagaccctcgtctcatgacccctaacaaaggaagggtacccaatagtgatgctcgagactctcggtctcgagtctcgactcgagaaaagtctcgttttttttggtctcgggttttcagtctcggtcttcgagactcgagacttttttacacccctaatgattggattttggtaaacttaaatttttataaattttaggccattttttgttcatttcgttaacatatgcgtggtctagtgggttgtgttctttgttatgttcttcgttttttcgttggatcagttcccctgaagtggttcattttcttctaatttttcaaaattattcctttttccgatgagaatttaatcacaactttaacaattaaaagcattcgagattcattggacccaaaaaattcttgcgatgcaattgcttcggttgaccattttttgtcggagtgtgaagcagggctggacttaattacggattacgtattacagattacggaaattacggcctttttggagttacggattatgggttacggatttttgggatttttccgtaattttgatccgtaactggcttttttagaatagttttcaagacgatttcttgtaagattattttttataaaatgaattttttttctatttttattaaaaggctacccaaatttcgatttaatctgacttattcttggtaatttgtagtattattaacattcataaagggggtgggggtgggaggctagcaagggcaaaagaggaaatgtcgaaaaatttgactattttttaacaaaactcgttaaaattctgaaaaattttactcggcgacgcttatcggcactgcccacccccaaaactcctaattatttttaaatattagctccaaatcttagtcatttttagacaaaatcttatagcaaattgcataaaattttcaaaaatttttccgacggcgcctttcggcgccgccctggaaccaccccctatcttccccagttttttggaaaaagcacaccgcgaaataagctgttttaaaaatcaaaaaaatgatcgtcaattaacaatagctgggacgggaccccttcacaaatcattcccaaaatcaatcctcaaaattcaaaaagaatgaatttttacgtcacaaattataatttatttgcctttcggcaccgccaaaccaggacaatctttttaattttgttttagaatggcttctaaaagggtgagatattgataattaatgcaaaaattttgaaatttgcgaccacagctctgaatctgccatttttacccctatttttgctatttttctcccggtttaggcccatattttgggatttccacctcaaaaaacatgcagatcttttattctgatcattaattaatcttaaaaatttatatatagattgggttttttaaaaaaaattttaaattaaaaaaaaaatttttttttttgaaaattacggattacgtattacggattacgccaaattacggcctttttggacctccgtaatgacgaattacggatggccgtaactaaaaaaattgccgtaattacggattacggacttccgtaattgaaaatcagttacgtccagccctggtccccccccccc

SEQ ID NO: 19079 - DNA, 234 bp, Heterodera glycines
caagagccgtcataacatcatgaatttcggcatcgttgttgtatgttgcatccgccaaaattctcatgatgactgcgtcctgcagcacgtagcgtttgtgtcgtttgtgtatgaagttccttgctgacctcgctgcgtcaacttgtctgtcgatgcttccgacgggcttaaaattttttaaatctaacaattatgggaatttctctatgcctggctgcaatgtcgtcgttgatg

SEQ ID NO: 19080 - DNA, 3419 bp, Heterodera glycines
  misc_feature (2660)..(2660): n is a, c, g, or t
  misc_feature (3317)..(3317): n is a, c, g, or t
taaaaaaaacttcttcatgatacaatactattcaagaaaaatttcatggaagctcagtttttcctcaaacagaaaaattattatttaataaatgagctaccatacacatccaaccctgattaattattgaaatagtaattgaaaccttttgatattttaatacaacaaaatgtatgaataaaataattcatcagaaaatttttcttgtttaattactagaaactcaagaccggtaatattttcaataacgaagaaattgactaataatttaagaatggcattctgttaattttatcatggtcattgaattcgaaaattggctggatttcccgtctttaacgtgggcaaatggcgcgaattaatgcagaggggttaagttttaacaaacaacgtaaattaggttattgtcaactcgaaatgtggagataaaagagagaaaaaaatgttatgacatatgcaaagtattcatatagaactcaaacccaaaagcgtaaaactaaagtacctatattttcgaaatttttctggcattcaggcattcgatcacaatgatgatgttgggataaatgataattcagccttatgtcattgtttggcaaaacttgttgatagaccaaagaaaacttgactgtttccccaaaggggagaaagtgatgaaattaggccgttgttacaaaaaaaggttttgttgatcacttctgcgcagtgattaggcaaggtacaactttacggcattcacttaattataattggtcaactgcaccggtagaggtcaactccgtctggccaactccatctcagcaatgttcaaaaagctataacttttttctttgttggccaaacttcacaatcatggtatcactcgaaagccctagatgtttagaagatatttataagctatttctcagtgattaatcagctctcaaaaaagttgtcagttgaaaaccgcaaaaaaggcagaattttcgaagttttttatttctatcttttttttatagttcgaaattttctgtaatttttagtaggctaatagagcctgtgaagagctttcgaataatgctttttaatcattctcaaaaaaaaatgatgcgtctggatactgacttctttttgatgtaaaaaacttatacttgtaggcactttcttaaaaaaactaatgtcttgacagctttcccctaagagaatagaataaaaaatagtttaagtaatgacaaaaaaatttcggaccaaaattctggtatgtagaagggaagaatttaaatctcgagctaatatgaaataatcagaaagggcacctaaaataatagtttatggaattgtgccaaaaattgaaatccatgtactatcaaacataattttggtatctagtttatttataaatttatataaatttttatccaatccacatgaccaatgataggttaaataatgatagttggcacctcttggctctcaaccttagctttgcttgacgacaaggttcgttttaaagattaaaggttctcactgttcacttgagtataatcgaactgatagaaatctggctggttgttaaatcaattttttgaggtattggatcattactgacaagattatacatttacttttttttaacactttcgactgcaattaaataattttttttaatagctcctgtcccttcattcttgacagagttgcccgagggctttgatcataaaaactcagattggaaatggctcggatgagcggtcaataattcaaatattaaatccttcagcttcccctgtgaggtctccttgttaataagctgttgtgagtcatttgtactgaaagtttcatttcgttttttgctaataaacctatctctatccatgatgatttcttccattaaaaaatcagtgatttatcgggtacctaaggagccaaattcgcatggtaaacccagtgttttctgaacctttagattattctcacttgtcttttttggtttgccaatacagttacagtaccccttaaaaattcggaaatggtccatcattggaagctaagagatctccaagcttctcagtctgaaaatagacttggtataaaattgatcaggtttaagaaagccaaaaggattaaaaaaacaaatccatgttaggagcctatcaaaaatttcaaaattctcctttcatgtgagcttaatgaggaattcgcaaaatccttccgctttttgaatttgtaaagagccctttgtgattagtgaattaaggcttgatttctgttttttgtttgtcatatcattaaggatttgtatcattcaaaatttgagattagggtaaactgaccaaaagaataataattatttcaaattttatttctcttccataacttgacagattgccctagagccaaaattctgaaaaataaatattcaataatttgtgatgactaaactgtctcacaaaaaaaagtcaatgccataattataactccggtacagtcggtgagagtaataaaaaaattttatgcatacacgggcaaacttcatcatggcgaaatgggtatccaatgacccaaaaaataaaatgttttcacccaccatattttgacaaaaggcacaaaagccgtgaatattttttttattcagagagccgagagagcagaatcagaatttttggccttttttcaactanattttgccttatgcaaaaaatggatcatcacaaaaaaaaaattgtacttctgctgatcataacaatgttagggcggtctgaaagttcctcaatgtaaaaaattgaaaaaaaaaaaattggccgtgagcggttttaattttctgtttaaatttggaagcatataaaataatatttttttttaataatttgagtggcctaataacttccggagcagtctgttttagtgcgtgcacgcagggtaaagctcagcaaaatgtctccaatattatgtccaaacaaaaaacatcaaaagcggattttttttctcttataaggcttttttttggcgattaaatttcaaaattttaaatcgcccgtttaacaattctgccttagtttggattcttaaggctctttggcacataaattttcaatttcgccattcaacatgacagaactcccgaaggagcgacgttccttaaatgtctaggcttttgctgatatgaattaaattgcctcacaaaaaagaactaaaaaataataattattgcctgtaaaaaaataacattcaattgcattgaagcctcattcactcaaagccattgaactaccaaattaaacgcttgaaatggtccatctttgggtagctaaaagagattcaagtttctcagcttgaanttttgtttgtccttaatatatttggtagcctttcagcaaaaaaaagtctggtctttaattcaaatcttcacaattgtatcgattaatgaattgagctgcttg

SEQ ID NO: 19081 - DNA, 2164 bp, Heterodera glycines
  misc_feature (2124)..(2124): n is a, c, g, or t
  misc_feature (2142)..(2143): n is a, c, g, or t
tgtgacaattacaaactcaacttttgtttttttatgatatttttgttctactcgggggtttatgtttaaagatctttttatgcatctaaaattgcataaaacaaacgactttgactaaaaaggatgacgaattcgataaacattaatctttaacgcattcattggtccaccgacgtcagttcctaacattgcaatgtttgatctcaatccaaattttttttaaatcctagtttctatggatattttcggattttgtgaacaattcccaaataatgaggaaacaattggttacatgcgtacactttatttagcttgggaggggttggacatgtcgtacaaatagacgaaagtcttgttgcacgtcgaaaaaaccaccaaggacgggtcgtccgccaacaatgggtctttgggctttacgatgtccatgctcatattggagtcattcaatgggttgctgatcgtatccgagcaaccctcctgcggcgccaatttcatggcaaaaagacacttgcagcatttgaaaacatatttgatcaaattgctcagttttaagttgtcaatgcctgatctgtgcaactttagatgcataaaaagatctttaaacataattccgtttttggatcaaaaaaaaaattgaaaaaaattacttgatgaaaaatcaaagatttgaaaaaaatcatatattagatgatgtcatatgacaaatctgatgtcatattcgtgatcagcgtccccgatagcccccgagtagaacaaaatatcataaaaaaacgccttttttttctttttttagggacaagtaaaagtaaccattaccgaaattttttttaataacccgatactgaaaaaaaaagaaaaaagccgctttaataaatcataaatcaatattgtaaaacccaaaagataaacaataagaaagaagctaaaaacagcaggtccataggatgataattcaatgatgagatttttgccagatcatattgggtatttatgaaatcctcaatattcgcttctttcacactgacatcaatggccaatgtcactttgtcctcgctttggtcgtaaaagcctttgcttgggttcatcagttccttaattatgttaaaatttaattgggcactatttatttgaattggcactcacagcaaatgaaatgtaattgtatcccctgttgttctctttgttgtcaaaaacatggtcatcgagttttcttctgaaatccgcaacgccgctctttagagagacaattcgaaagtttgccgaacatttgcaactccaagtttctgctcaatatcaattaattaattgttgttaatatatatattaattattagtaattttgcaccttcttttggagcatcacacaaaaggaaaatggcgaaccatttctcatttttgtcagtgctttcatctttcttttcaatttgtgcccatattttccatggcaatcctttgatgtgcacagtttcacttttacgttcactcttaaagatttctcgcgcaaattccgacactttttcaatttccataaagagtgtgcctttcgaattgctttgatccaaattgaatttgtccacttttggttcatcaacagttgtgagatcgatggtcaatttcactttgtcttcttccctgtcgtaaaaaccattgttaaggtccatcaattccttaatttaaatcatctaatttaatttttgtttatgcgtggtcaattggttatgttttagaaattaatttattttgttatgatttctttacaccaggcaaataaataaatgaacttcaatattggctggtccacgaatgtcaaattaaaatatttgtttgaattggcacttaccgcaaacgaaacgaaattagtgaatcccaaattatttgattttttgtcaaaaacatgatcacaaaatgtcccaatggaattcttagacacgttgttttgcgagacaattcgaaaagtggcagaatgaacgaagcagcgccaattcgaatcttaatgattattactcatcgtagttaattagcatttaataacagttaatttgcacctttttcagtagaatatatttttaaaatagtaattaaaattggaccttcttttgcatcgtaccataagtaaaatcccanaatatttcttctcatcanngtgtctttcgtaatttctgct

SEQ ID NO: 19082 - DNA, 1340 bp, Heterodera glycines
aaaaataattgatgcgctaccctaagtctccccagtattctgcgcatgctttctccacgcgaggggcaaagccgcgaatttgtttcattttcctccttttgtcttttttcatgccgctctcgaccctaacttcagcacggggtgggcgtacagcagcggcaactgcagcattcaatgcagctcttcaaaagctgtccgaacatatttttctttcttttctaacgcatctccaagcggagttacacccatttttggacccgtatcttttgtaccccgatcacattctgaaaaaaataattgatgcgctaaccctaagtctccccagttattctgcgcattgctttctccaacgcgagggcaaagccgcgaatttgtttcattttcctcctttttgtcttttttcatgccgctctcgaccctaactcagcaacgggtgggcgtacagcagcggcaactgcagcattcaatgcagctcttcaaaagctgtccgaacatatttttctttcttttctaacgcatctccaagcggagttacacccatttttggacccgtattttttgtaccccgatcacattctgaaaaaaataattgatgcgctaaccctaagtctccccagttattctgcgcattgctttctccaacgcgagggcaaagccgcgaatttgtttcattttcctcctttttgtcttttttcatgccgctctcgaccctaactcagcaacgggtgggcgtacagcagcggcaactgcagcattcaatgcagctcttcaaaagctgtccgaacatatttttctttcttttctaacgcatctccaagcggagttacacccatttttggacccgtattttttgtaccccgatcacattctgaaaaaaataattgatgcgctaaccctaagtctccccagttattctgcgcattgctttctccaacgcgagggcaaagccgcgaatttgtttcattttcctcctttttgtcttttttcatgccgctctcgaccctaactcagcaacgggtgggcgtacagcagcggcaactgcagcattcaatgcagctcttcaaaagctgtccgaacatatttttctttcttttctaacgcatctccaagcggagttacacccatttttggacccgtattttttgtaccccgatcacattctgaaaaaaataattgatgcgctaaccctaagtctccccaggtattctgcgcattgctttctccaacgcgagggcaaagccgcgaatttgtttcattttccctcttttttgtcttttttcatgccgctctcgaccctaactcagcaacgggtgggcgtacagcagcggcaactgcagcat

SEQ ID NO: 19083 - DNA, 2531 bp, Heterodera glycines
acaacagcaaattgatgtcccgatggatcgggacagccccaaacgaaattttcggatgcagcgaaattgaaatgcacaacatccgttttcgagcctcatcacggtgctacactttcatacccgtcatggcaaccatcgatgcgcgagactacgaagtctttctcgacccagaattgagaattctgtcgacaacggcgcagacagcaaactgcgaaggattccgataccactactttgcgatgaatgaggaggcgaaagagtgggtgaaaatcgacagccgaacgggaacaatcggacgaatggaacggacatccatccatgaatggaaagacggaaccctaggaaaagaggggccagcggaaatgccaattggattccacaattggatcctacggaacgattcgaggagcagttcgtccatttcgccgagagagagagatattcgagagttggcagcagcgagacgccgaatacgcgatgaaaagagcgacggcgcttggagcactacccggaggactcgagggagtggccaaaacatggctcaaagggctgtgggaacaagtcgtggaggcctggatgaaagcagcctgcctttatgcgacattcctgctaatccgtgatgtgctgatcccattggcactggcctatctctcagcccgatccgctcgagtcttcgcgtattgatcggaacacggcgcagacgaccacaagcaagagacaatctcgaggatacccggacggcggaagaaacgccgatggtcgatctgacccgaggatcgatacgggggagcacgaagagaaggcccatcacgttgggcctgaagcaacaaatcgtcgctttccgcacggaaaacccaacttgttctcccgcccggaatgttgcgactgcccccggaagggcagaagaaattgcgaaatgagggaagggggcgcaacgggggaaaacgaaagtgattgaacgaatgaatgatcggctgggcgtcaatgatcaacatgatcaacaagaaagaagaaaaaggggaaaacaaggggaggaagaatttgccctgaggggaaaacgagatgtgcatgtgaaagggggggataaaattgacaataataaattttgttagtgtacaatcccccctaaaagttgttattggccaaaatgccattcgaccccgcccctccctcacatattgtattacccctatgatcacccccaattcatttgtgatttacccgccaaaccgccaaccccccttttttttgtccctcctcccctcccattttattttcatattttaattgtatttttatccaaaatgctgacaatttaacagccgaagtgagtgattaaaaataaaaatttttagggcaccctttgaaaatttgatgatattttattagttttattcattccaacagtcctaatgcgcaaacttttacagggaatgatgcaaagaatgcgcaaatttgcaagagagccgcacagaaagtacgaaaggtgagaaaaatcaaaggggaaggttgggagcaattggaaaattgaagaaaatttgtaactcacaattccgacaaatgatataacattcaaactttcttggtctgtcaaatgaatttttaggctgagaaagcactttggccgagttatggactcgggactgaagtggccaaatgccttagggactgaaccgtccactgacttaaaagcaaataataacagcaaaatccatatcaatttattccgctcgttttctaatgcgtgtacacttccttttctcgaaatttaagtcagtggacgaacggttcagtccataatagagcccggcgagaacgggaatctcgagggaaaagcagggaatgtgttatagggttttcggggttgcagatcacgaatatgacatccaattcgacttatttcgaatacaggacccgaattcgaacaaaaagttgaaaatttaaaattttcaaaattctcacttttgttcctaaattgatcaaaacaaactaaattagtcaaaaaccattataacatctaaaattggtcattttgtacaggtacgaacttaaaagtgaattttgaaaattttaaaattttcaactttttgttcgaattcgggcctgagattcgaaattggtcaaaatgaatgtcagtttcaataataaaaaattttgtggaaatttgttaattgcaataaaacattttttgtaaaatagaaaaatttttacttggggcccaaacgtgctggggcccaaacgtgtggggcccaactgacgtagaccgtccataaggcatttagtcacttcgttcccgggtccataactcgggcacaaatgcttccagtcaaagaattcttttggattggtgtctttcagattaaggggccagggttcagattcgtccttgaatggcaaggacgtgctggaaatcggttcagtcacttgaaagttgaaaatatccttgaattcaagatgtccttgaaataagtattcaaaagaaaacattcaaaagtttaattttttgaacctttgtgccaaatttttattaa

SEQ ID NO: 19084 - DNA, 861 bp, Heterodera glycines
caccaattgtgaatgaataccaatggtccgtagccaatgatgaatggaatttgtttaattatttcactgactatttaagcaagagaatatgtctaaatatgccaatttaaattagttaaaatattaaaaataacaatgtaataattaaattccagacaccatgaaaatatcaatcatcgacctagtattctttggaatgctttttgcatttcttggaaatggtgcatctacttttcccctgaattcggctgtgatggaggtcgagaaggacgaagcggacaattcgactacggtggaggccgaagacaattcgactacggtggacgctgagacggaagaagcggacaattcgacaacagtggaggatgtgacagaagacgctgacaattcgactacagtggaggatgtaacaaatgatgcggactcgactacggttgaggctgaaacggaagaagcggacaattcgactacggtggaggctgtgacagaggatgcggacaattcgactacggtggaggctgtgacagaagatgcggacaattcgactacggcggatgatgtgacagaagaagcggacagttcgactactttggaggatgtgacagaagacgcggacaattcgactacggtggaggttgtgacagaagatgcggacaattcgactacggcggaggatgtgacagaggactcggacaattcgactacggtggaggctgtgacagaagatgcggacaattcgactacggcggatgatgtgacagaagaagcggacagttcgactactttggaggatgtgacagaggatgcggacaattcgactacggtggaggctgtgacagaagatgcggacaattcgactac

SEQ ID NO: 19085 - DNA, 1064 bp, Heterodera glycines
ataggcaccaaaaaattgaaaaaaggcatgaaaaggcacgaaaatcccgaaaaaggcatgaaaaaaggcatttaaaaattttttattaaggatttttaggtagcaaaacacgtaaaacttaaccaaaaaacttaattttggtcatttaaatgattattaaatattttataatgttttcgaaaaaggaaaatttttaaaacttaaattttttaccaagaaaaaaaattaaattattttttgagaaaatttttaaattcttaggggtgtattttctgaaatcatatgcctcaaaatgcgagctctatttattagtgaagcacaagagaattcaatggccaactcgaaaaaatggaaaagccaagaaaaaaaggccaaatgagtcccaaaggtgggagtccccggggggttgttatggaaactgaaaaggcaaaataaaaacaaaaataaaatattaaaaaatgttaaagcaaaatgcctataaagattcaattctaaatcggaatttttttcggtcgttttcgagttaatagcaactattttctagttttttatttttagcacgtaaaaaatttatgaaaaaactattttttaactaaaaaagcccgaaatatgaacaaaaagctcaaaaatggaccaaaatatggactaaaaactgtcaaaatatatgtaagaaacaaagactctcgaccatctctaatgatcaaggcccagatttataaatgctgaatatagatagataaaaattgaattcaaaaattttattcaaattaaattatttaatttacattttggttaaaattaaacaataaaaattctcaaaattaggtacaaactaaattatttctttaataaaatttgattcaaattaaattaggtaattaaattaacaaataaaattaattaattaaaacacaaatttggttaaaattaaattcattaatttgaattattgaacagattacaattcagtcaaatgaacaaggaaaagcttcggaccgcaaaaaaggatgagcaaaatcagtagatcccttttttgtgtgcaaattcgacaaaaaatgcctttc

SEQ ID NO: 19086 - DNA, 1086 bp, Heterodera glycines
ccttgtcgccttgcctgaattttcggaggttttcatggggtcacagtcggtaatcccgtattttctggaaattgcgggataatcccatgggatcccgtccggataaattttgagttccagtccagcagcgtgatccaaaaatttgattttttgtgcgggatcccgcggaatgcgcattgtttttttttgaaatttaaagacagaatgccacatatttttaaattatttacaacttaaaacaaaattcatccaaaattagtgaaaattttccggggtttttagcccgtacaaaatacgagccctaaatcatggcccaacaattgcccaatttgtctgtcatttctcaaccgcagaacataagtttgtttcctccacctcccatatttgccgagcaatacacagcggaaaacatcaaaaaaggatttgctcttcctccaccgaatcttccaacaaagtttgaggtgttcgccgagctttgtgatttagatggggtgactaagaataatagaaattgtaaaacaccaatgcatttgttcagcctcttttgccaacactcagtgaattgggctgtcagcaactttattcgggcagtggcaattggcgtgccgaattgaagaaattgaaccggagtttagtcgcagctttcctcgatctaatagaaattcttatcaggtacaaacagtgccaggcatgaacggtcgtatccctatcctttttcggcaaaaaatttctcttaaaaagtagtctaggtcatgtttccgtcaactaatcacgaatatgggtaatactatagatggtacccccccccttttttgaagaagtctttttttgttctgaaaagtcttggaaacatgtctttgcgggttttcagggtcgctgatcacgaatctgacattcattttgaccaatttcgaatcccgggcccgaactcgaacaaaaattagaaaattcaaaattttggcgctagtttaaaagagggccttttgaaaattttttgcactttttggtctaaatttttccaaattttcggtttaaaaagtcctgaaaccaagtacccgtgggttttcgaggtcgctgatcacgaat

SEQ ID NO: 19087 - DNA, 2021 bp, Heterodera glycines
gaattgtgtcctctgggaaaaagttttttttttacaacgaacctggttaaaaatgcattgataaataatttggttaattttcagagtgttacggagcaattgaacagattgacgaaaatgggctcagatgcttgtgagacgcttagagacgcacttcatcggtttacaattgaaggaattccaaaagaatctgttgacaacgaattggacttgaccgaaggtaaacattttagagtaattgataacacattttttttgcagatggagaaatgatttgttctgcacggacgggaagcgatgatttattgtcagcactcgaggaaaacattcagcaattgaagccaattgaaatgcccgtaagggtgacgagaaaagacattccgggcgtcagaatgcaattgcagagagaatttaaccgaatgaatttcacgattggcaattgttaatattttgagaaagtaacaatacactgactaaatttcctaatgctaattacccaagaaaacattcgaaaatgcttcagggaggagcgaagtgtttcattgtcaagcggacaaacttcagactgtggtttagattatcataatacaaaactcaaaaagtataacttgaatttttggcaaaagtaaatcttaaaaatatcctatattaaaaattttgttagtaagaatttcgttttgatttttcaaacagcaaaaaatgggaaactaaagataaaacaaacccaaaaatttattcaacataaatgagtcccttttcatcaatgcgtgtgctttcaacatacttcggtgaaattggctgccaaatcgaagaagaaaggtttgattggctttggctctttcatcatcctggcttttttcttctgctgtttggtgctttcagtgattgccttccctatctaaaatttatatttaacaaatattcataaaaataactatacaacaattttcaaaaattttgttgagaacttttcgcgccctgggaaatttgcggagaatttaaagtaaaataacacagattggaactttaaattctaagagattgactagttaaattaattgaactcgaaattcttctttatatttgaaattacgaagagctacactgaagaggttccatagaaaaatttttctcaaacgttctaaagaaatatttattttatttccgaaaattccgcaaatgtctgtcccagtctgtaagccattttttgaataacgacctataataattcgtaatcctaacaactaaataactaccaattgctcgggcgaaggcttccggtcatcttcagaagcattgagatttactgaactgacagttgaaagcagaacattcgcatctcctgtctgagcccggcacaaaatgagcagattttcgacctcgcgacaccttttaattgctctttaattattacaacatatttggcgaactttgtagcataagtttcgctgagatcgctgtttcggacttgttcaagcagttcggagtaaccgattctgaaagcaactcaaatcaactaacaaacaaaagcagacaaaccttgctctgtcaaaagtttcgatggctcgtttccaatttttcagttcgagttccaaactgccgaagatgaaagacacgtaagaaacagtttcaacacgagtgacctcatggacctgaaaaacgaagaagataagcatcaataacaatccaacagtgaataccagcggattgtcatcaataagcgaatgtaaaaaatgagcacttttcactgcccgacgcaatttttgtctcatgtgaaattttttgcgagaaagtggcaaatcgatcatctcaaatttcatttgcattgcgtaagcccaattacgttcgacttcgaacacggcaatttggagaaatctgacaaataaaaaaagtcaacaaaagtgattcgaggtttggaatgtcgaattcctgttcagctaattccatgataaaagcgactaatcagtcaattaattacctaaaatctccgattaactcagcagaaacatttcgcgcaatga

SEQ ID NO: 19088 - DNA, 931 bp, Heterodera glycines
  misc_feature (921)..(921): n is a, c, g, or t
tgtttaatttgagccgccatgggatggatgaataatgcaatgcttcccccccccccccccaccccctccccttctattcaatcccattcacatttcaattcattagtaccttttaattaccctccttaatgttgctaattgattgttgttcattttctcgaccgtttccccttaaggacctccgttcgctgcagttgcagcaacaattcaccgcccttatgcagtcacaaccccaacaaccgcccgctgcccacgcgcacgcggcacaccaaacagcgcagcaaaatgtccaccaacaccaccagcagcagcaggcatcgcagttgtcttccgcttttctgccccatcagcagcatttgctggaagggaccgcgcaaagttccaacgcctccggcgtgcccagcggtgcccccgcgggcgctttgccatccgcctcgacgcaattgtctgccgcaacggtcggcttttaccagcagctgctcgcacttcaacaagcccagcagcagcaccagcacggcggaggtgcaggcggtgccagcggaagcgcaagtgcagccgcaacaccggcagtggccacgctgccgcaacaattcaacacagcacttcacttggcaagttgccaacggcagagagtcaaaatttcaaatttgtactaatacattggaacataccggaatcacaaaaaccatgatgaaacacattcacccctttccttttgcggcttgtttaaaatttaaaatcatatccccgacttcccctctttcccccctttttcccttctttttgccccccccccccccccccccgccatttcacaacataaacgatcatttggtcttttctctgccggcgaccagtcggccgggaatttgttcgtattctttcagcacaaaaaagcaattgtgatgagtgaatgtgggngggggggggg

SEQ ID NO: 19089 - DNA, 1450 bp, Heterodera glycines
  misc_feature (1426)..(1427): n is a, c, g, or t
  misc_feature (1435)..(1435): n is a, c, g, or t
cgcagcaattggcgcccgcgccctccggcgccccgcatgttgggttgaacgtgttgctcggcgggcctggacggctccaacccgtccctgctccactcgctttcgctgctcgctggaggggtgggtgcaacggcaccgacccccgggggctcgatcggccgtttggccaatttctaatgcgttttccctttgtgctgcgcttcagcgccaacaggcggcaccggcaatgcgcttctgaccgcgttggccacccaacttttgctgcctcagcagcagcagcaacagcaaattgtgcagccatcagccaatcatttgaccgccgctttgctgcaaatgctgaacccggcaaccgccactttgtacgcctaccaaagctatttgcagcaacaccagcagcaaccgcaaacacccgcaccagcggcagcgtcggttggacaggcaaagaaagggggaaaagctaaaggggcggagggttggcaaaatgtacaattgaactcgatcagttgactaatgccctaacattgtacagctccaacttctcgcccaattgctcgccggcggaggcgtttccaccggcaccgccggaaactgcggtgtttctgcagttggcagcggtctccaatcggtgctgagcgctttccccggcggaggacagcaacagaatttgttggccgccttggcagtgcaacaggcggcgcaaccgcaacaacagcagcaacagccaacgcaacaagaagaaacacgcattttattggagcagcttatcagacaacagcaacagggcagagaccaacaacaacagcagcaggtagagaagcagaggggggaaaagagtgtgggagaggggaagaaacaaagaaggaaagacttacatgataaagagagagaaagggatagaaaaagtgtgtggactatgggggaaataatgaggaaagaaaaagagatgtgagaaatagagggagaacggtgatttcggctttttagagagaacgtgagcagcagctgaagcagcaacaaatgctgcagcagcagttgggcaggttcaacgccgctgcggtcggtgccatctcttcggagccgcaagcgccgcagctcgaacagtcgccgacgatgacggcaacagcggtggcggcatttgcatcggcgcaggaacaaatgcaacaacagcagcaacaaacggcgacggcaattgccgtggagcaacagcagcagcagcaacaaaatgagcaattccatcaacaacaacagcaatcacaacagacgaacggcaacgccctcagggagcaacaacagacgacgggaaacgccgcgggggcacagccgcaacagcaacaacggcaggcgacgcccaacgaacggctgctcacatccgaggcgttgcaggacagaatatcgcggtaagagaggaagcgttggcccggtctcnntggtgaanggctttccaccattt

SEQ ID NO: 19090 - DNA, 913 bp, Heterodera glycines
tattaagatttgtaataaaaaattattttgtgatttaatggcaaaattaaagcgaaatataaaaagagaggcggtgaaacagcggtggaaaaagcaagaggagcgaaggaccaaaatggcaaaggcgacgaaagcccgatgggccaagaaaagtgagttttttcactaattttaattcaagatcattttttttaaatttcagccgctccacagctgaatcccaatgccaaaattccaccgcaggacgaagcagggccgaggatcggggcccgaagggaacaatttcgaaaaagggatttgaccggcaactcaataagaaaaattttggttcgcgctacagaaatggacgaacttttcacaatggaatggcccaaagctatttgtaggacactcgaacacctcggcaaaattcaaattttttcaaaagtgttttgtccgattttattaagataaaatcataaattttaggcacaaattttgtccccaaatgacctggacggacttgagcgatcaattgacgatttcaaagtgtttttggcagagcaggaccggatgagtgcctttctctcaaagaaacccaaggcccatcttctactcttccacttagtattgaaatgacatatattgaaacgacatgtagccgtagaatcgatgtggaagaaattgaagagaaattttaagcaacagtttgacaacaaaactgaagcctacgacacattttcctgaatttatttggagtcagcgctttggtgatcttgaaaacgtgttttataatttttggtcgcaagtctgagttttatccatgtgaataggctcattccgctgttccttcgtgcaaatgaatcgattttgtcggataaatgtgaattttgaaaaatttgaattttcgaatttttgttcgaattcgggtccg

SEQ ID NO: 19091 - DNA, 1003 bp, Heterodera glycines
  misc_feature (883)..(884): n is a, c, g, or t
tttttctattattgttggatggtcctattaggtcttctttcaggattcccatctccattcttcgtccgttcggctggccaattcgccgaccaccggccgaacgctctatcgaacggttgtcaaagtgccgtcgcccgcctggcgattggtcatcggaggcggtgggaagacaatcaaagggttgaaggtgggtgtcatcaacccaaatggctttgctaatacaacgaatgaatacttttaggagcgttttggcgtgtccatgcgctttttgggcgacaatttcgttgcctacccgcacttcagatcacttagcatctttggacacgatcaaatgaatgttcattcggctcgcgagcacattgagcgcgaatttgtggcgaaaaatgacgaatatttgggagtgcgtaaaaacttttccaattattaaattatttatttttaaaattggaaacaattattataaatgggaattagcattttaagcaaaacacttcccaagcgaaagcaaaaggacgtcggaaattcctttccacgacggatgacccgaacaataacatcgatttgatcgatacgaatgcatacggacacaaaacggagattggcggatgggaatcggacgaagtgaggcacaaagacagaacttgaattattttctcagcattctcccgatgattaataatgcataatgactagggctgtgaattttaggttttaactaaattttttgctcgattgatttgaagaaaggggttcaaaaaacacatttctgcgttgaaatttttcgattatgttgtcactagggatgggatttttaagggtgaaaaagtccaaaataaggccgtaaataagggcgaaaaagtcaaatttagggtataatttttannattgctgttttttacatgaaataatttcagactaaggcaaacaattttattcacctgattgcaggtacaaataagctataattttagaaaatttttttcatttcttagggtatattttt

SEQ ID NO: 19092 - DNA, 738 bp, Heterodera glycines
ccgcagtttgtgcacttttcagcaacaaaaacggctcttcatgttctaggccaatggcacagtggcaaaaaagtctaagaaaactgctccgggactcatgtaaaatttcataaaaatcaaggctttacaactagaggaggtgattaaagacatttttcaaggcctgtctcccattgtgtgggtttctggaaattgcctaggcctggggggcattaatgaagcacgagaccgacaattttccgagactcggttctcgagaccgagtcaagacgcgaacttcactccgagactctcgagcctgagacacacaaacaatccgaaaatttttatcgattcggcgaactctaacaatttattctttgagtacacatcgccatactcagcaaacaataaaatttgctggccctgtgaagaaatgtcgcggttaattacagccaaaaatgtttttcaaaaaaaaaaaaattgttttttgtcggcacaattaatcaaaaatttgtctgtcgtccgtcggttgccatgtgatttattgatgatgtttcaatgttcatcaccaccaccaactgatgaacaatcacatatgttgtacatacacttcttgaacacaacaaaatcttttttcccatggtccattgtttgtccgtccgtccgtcgattgttctttcagcgcccgccccccgtcgtcccctggaggcaaaatttttcgatttttcgcgcgcccatttcccctggggggggggg

SEQ ID NO: 19093 - DNA, 432 bp, Heterodera glycines
aaatatggttttttgaattgcttctgcccataacttttgtgatccttaaggaaattttttgaaattaagcaggctaatagaggatacatagggctatcgaatgacaccaacaatgttggatttggttggcaaagaaaaaagttatagccaaaaacttgtgctcgtacgaaaacggcccgtacgaaaacgaccccgaccctccaacaacagtcagaagagcagaaaatggtcatttttcaaaaaaaaaaaatggaaaattctcccgcaaggcgcgcctctctgatcacagatcctccatgtgcccgtatgaactaaaagccgaggatgagaccacaaaatgccgcaaaaaaacacctgagaatctgcttgtacaacgtggaagcgatgaaccgtgaggaactgtcccgctgcatcagtgtgtaaatctgaaaa

SEQ ID NO: 19094 - DNA, 1870 bp, Heterodera glycines
atttgaatgcaattttttttttttgcatatccactcgtacgaaaacggcggtacgaaaacgtccccggtacgaaaatggcggtacgaaaacggcggtacgaaaatggcggtacgaaaacggcggtaccgaaacgtcctggcccgcctctgaacacttcctttttgtattattattttgcgggccaggcaatttttcatccgcgtcgtttttttacgaaaacaagtttttggttataatattttttgttgccaaccaaatccaacaatcaatcttggtatcattcgatagcattaggtgtcctctattagcctacaaaatttccgaaaaatttcgttaatgttaaaaacgatcccgacccattattttgatcatccataaattgcttcatgtccaactaaattcaacaatcttgacatcattctaaggcttttaaaaatttgaaattttttttataatttttttatatattctaaaagccaaggagatttgtacccttaaaattaaaatttaattattgaaatttgttgtgtaccaacaatttattaataatcaaataaaaataaatgcacaaaaatggtgaggtcggaggagtgcagcggcggaggagaacaaaataataaataaatgtccaatgcgaatgaatggagcggagagccatgagtgagggaatgggcacccttataaagacgcggggtcagagaaatgtggaggagataggcagagagggagacaatggaaataatgtaagacagagaaagggggaggggaaaagtcaataacagtgatgaggtgtaagtgatctttgatcctatccaacacctccctccttatgtcgattgtccctcgatttgggaattaagatcggattaagccatattttggctttgtcggatccaggaccagtcgttgaggtgcttgtttggctcttcctgatcggcgcaaaagaactggttgagcaggcgattgctgacgatttgtctgcggtttgtgcgcgatcggcgattgttgcggattttgtgcctgggtttgatcattttctacaacttgatcattgtcctccaattcaattgggaaacgtcgcctgatttggtttgcatgacgatgaatggctcggccaagcgtcggttccaagatgcgatacgtcggagatgtgccgaatttctctataatttttcccgggagccaaatggctttattgtttttcaaattccaaaaataaattggttcctcattttggaaaatggttgatttggctccatgttttgtgttgaattgattttccatctttttgatgtattgcccttggaattgttgaaaattttccaaatttgttggctggagtttttgtttttcgggatggacaagtgtcattcttgtgcgcatgcgtcggccaaggaaaagttcgtctggcgaatgaccgttgagtgccgtgtttggtgtcgtgcgatacgccaaaagcactttttgaagccaatctttgccttcttgacggcactttttcattgaccttttaaaaatgccgacaaaccgttcagcggtcccattcgacattgggtggaacggcggcgtgaaggtgtgttttatgtcgaattctttgcagaattgtgcaaattcggcggatcgaattggcttccattgtcggagacaatttttttgggaattccaagccgatgcacgaatgatttcagcattgaaatgatgagttggctagatgtcctttccatttgccatacttctggccattttgagtaagcgtcgaccaaaaccaggtatgtttggccgtcagcacacgggccggcgaaatcaatgtgaattcgctcaaaaactccgtttgctgctttccatggctgaagattcgcttttgtagga

SEQ ID NO: 19095 - DNA, 1906 bp, Heterodera glycines
tgtgctcaatgcgcgtaatttgcattttcccccctaaggtccctcttttaatttaaatttatttatttttttatttctttttgattttaatatctttttcaattaattattattattatttaatcatttatttatgattatctgattatcgcttttcaaattaattgatcccctcagggttaatggaattccgattaaaattaagcagtttttgatttttttttttttgaaagagcaaaatacattttattagaccccgtggggttcattaaaattcccctcctttttaagggcacctctaaaagatggctaattcatccgtaaattattattttttgtcttttcttttgacctccttgagttaattaaattccattttttttttgttacccaccggtttaaatgactaatttgtgcgcgaattttgattattttcagttttctggggcctgttccttttcgattttttttttgggtcccacttttttttttttgctgaattgatttttgaaccacgaatgggattttttttttgaactacaaaatttccgaaaccatgcatgggtatttttttttttttaattgaagttaatttttttttttgaaaccatgcgcatggacaattttcatttttttttattgcagagaattgtcgaaaaccatgcatggacaattttttttgtttttttttaaatatttatcgaaccacgcgtgggataatttttgatttgataaaattttctttgattcccagggggttgctggggcctggccaggactctaaaatgattggcgctttgcgcaacacaaaaacatcccctgaaaagtcggtctaccactcgaatccccctcttcccatggcccaagccctgtaagcatagggttggaaccatccggtgctaccagtaaagccgtgaagtcccatacccagtgcttaatgagggatttagtccagaggagccctcttacgcgtccgtaattaggccccgcagggcttggaagggaagggatgatgatggagctctgggggatcctcccaggcggggatcgattggccattccactgagatgactctcgactgatccgactgacccctttgactggctctccattgccttttaagcgcccctcgggatgggaggagtttatcggagtagtaaatgtgcgtgggaaaataaaatgccatttccggtccaggccttacattgttataataccatcaatatttttaacaaaattttttaatttcagacgctaaaataaaaaaagaccaagaataaaactaaataggaatttatatgcaaaacaaaaataattttaaaaaattaaaataaaaaatttcatgccagcctctagaacaatcgcactataacaaatcaaataaattaaattaaaatacactttaaaatcactccaaacgaatggacaaatgagcaataaaaaattggttcaataatgaatataaaatattaaaaaacacttaaaaataaacatattcataaattcttaatgtgtgcctgttaaagaatacaggctttatgtaaagtttgaaattactccaaatattttaccaaaaacctttatatataaatttatacgaaaatttgcaattaaaaggttcaaaagatttgctaaatacatcgacaataagtcatgaggttttatggaatctttatttaaattaagtaatggataatagcatttaaaatacgaggtaaaaattttttttaattttaaaaaatcaatttaattaattaaatcacatgtaattttccctcattatcattcacgtaagtattgttggaaacataacataatttgtcatgaaaatttaacttaaaaaataacctataatttaaataggggagatcttgacttaattaaactcttagtgaaaaataaaaa

SEQ ID NO: 19096 - DNA, 1317 bp, Heterodera glycines
  misc_feature (114)..(114): n is a, c, g, or t
gacaggtgggaagggaaatggcacgcagagaatggacgtattttgagttttttggtgaaattgccgactataaaggaaaaggaagcgcacggagtcccgaaagatgaagattgnattgacagcggagaaggaaaacggtacgtagagtcaaatgtgaatttggtcgacgacgaaatgcaaaaggaagcgtcattctgtgtatttttttggctggcacaaaatttttttagctggcacgaatttttttgactgggactgagtttatgatatgcttatatttttaaatttaattcgaagaaataattaatcatctcacgaaatccatatacaatatttattctaaaccgtatatttatttcttagcaaatatcttttcctttacgctaggcatacgcccaatgactgtcaatcccgctgggtttacactaaatgattgtcctttccaataggctcacacccaacgacttcccttcccattgggcatacgcccaatggctgtcctttccaacgggcttacgcccaacgacttccgaattgacttactttgctttaacgatttattgaaataaatgtatcatttacaaaacagtgtcctcattaggacaaagaattgaattacaatttcttttaatttttgctgttatttttctaaaatttgtcccgtgatcaattttgttaggccatttaccatctttttgagcgcgaaaatggtgcgacgcttcgtgcgcaattgtattgaataaccgtcttgtcccatatttgaaatggtctcggtgaacacgaatccatcctggcaccgcatatccccaaagatttccacggcaatgccaaaactttatgttatcatccagtgtcccttaattaagacataattagaaatgtttcttcgctttgtagtaccgttaaaaaataagatgttgattgttataaagatcattttgcagaatttaaaaaaatttcatttccattcggtatattttttcgaattatttttctaataataatttctcgttgtctccttttggcaaacaaaatttttcgcgcctttttgaggttgttctttcgggcaaagttcgcatttgttggtctggacatttctaaaacaaaaaaaggcaactcaaattgtaaaaaaattaatttggtcgcgttggtgacctcctttttaatggggcgagaacgattgcgtcggcttttcgatcagacacttgtcttgactaattcttgatcgtaaatatacctttaatctgatcaccctcatgtctacatccgataagatggcggatttgatgatagtacgtttgaaatgcaaaaagtctt

SEQ ID NO: 19097 - DNA, 903 bp, Heterodera glycines
tgaaactctaagccgcggtcgctatatattttcatagggattattttcgacttttcgaacacccgatcaaaagcctcaatcatgtcctcactcttctttgactttaccggtgcactgaagatcatccgactcagcacatcaatgcagacaagcaaatatttgtatccgtcgttatcctttttcaactgatcgaaaatgcacaaatcacattgccaatctgtatgaagcccgctgggtatcgtcttgagtcttggaaatattttcttgattggtttatgaatcgtataggttctttgtttttcaagaaacgtattaacgtcctctaatgttatatttttgtctacttttcttgcttcttctaaaaccttcaaaattcccgcatagctagctggggattttagattgaaataaacttttgataatatttgatccattattttggttgtaagaaattgtttattggtatttataatcaactttcagactcttcacctttcatatgttttcttcgcaaaccatcattgttcgaccatatgatgtcacaaaattttcacggtttcctcatttttcttattttttcacttttttactttattatgacattttttcacctgtttaacacctgctatgacaatgtttttcacctgttctgcccctttttttcacctgctatgacaatatttttcacctgttctgcccttttttcacctgctatgacaatgtttttcacctgttctgcccctttttttcacctgctatgacaatatttttcacctgttctgccctttttttcacctgctatgacaatatttttcacctgttctgcccttttttctcccgctatcacaatatttttcacctgttctgcccctttttttcacctgctatcacaatatttttcac

SEQ ID NO: 19098 - DNA, 3001 bp, Heterodera glycines
  misc_feature (148)..(148): n is a, c, g, or t
ttttccgatttttgaatttttaatgggatttttcgggaaaaacgccaaaaaagggcaccaaatcgctaaaactaatctttgtggttttttagatcaaaggagcaaacacatgttttttggctgccttttctatcattttccaaccctntagtacaccatcaaatagagtttcaatagctctacaattttactcagaggtgatctttcgctttttctattgataaaaatggtttattgtttttttgggaaaagataaaaaaattcaaaaaaaccgaaaccgaaacggtataccgaaaatttttcttcggttttttcgatttcggttttttaaccaaaaccgttcgaccgagaattttttgagtttttcggtttttttcagtttcggttttttttcggtttttaaccgaaaccgttcgaccgaccctcttgtccggtctctaataaaaactatgattttcttgattaggaattagaaaatactttgaattgtttaagtattcatttgaattgagaaaaaattcataaaatcgcgctgtcgataaaaattgatgcatttttgtattgcgttaaattcacgagttaattcttttatcatttttgataatttccgtgtcaaatctaattactattctcataaatgacagctttgctcatatgtacatattgcttctcactggtgaaattattattgaaattgttccattaatttgtttagcctttctattgtaaaaaagtcaactgaatttgagatttaattatctaaattaataataaaagttgccttcataaggcacaatttgacaatgaaaagaatgatcttaaaagaaaagaaaaaaacagaaaagagaataaaaggcaatcgagaatagagaaaataaagagaaaaaccgcaagggaaaatttaaatctctcaatgaaaatatttctgatcaaatttttaaaaacaattaaattatctagaagttaaatttttgtttagctttattttgttttgctggagataataaatggaaattaggtgatatttaaatattttgttttaatggtttttgaagcggcataaatagaacatttagagaatgaatttacatattttctgaaccagaatattttttagaattttatttaattatttcaaaactacctttccgataatttttgaaattcaaataattttatattttatttaaatctgtttttggtcaaactcataaattaaagttagttcgaaaaatctgtatttactgctgttcaaacaaaaattttaatgaattcaatttaatttcaataaaatgacgcaaatcccaattattttcttgatgagtttatggtttaattaactttagtcaattaattagtaaattcattttttaaagcttaaatatttaatatttaagatgggctgtccttatgctttttcctgtaaatttctgctcatcattttcacattatgccaattcgttgcgccaaactttagcttttttggcacttttggcgattgttttgatttgtttaacattttccacaacaattggtgcaaggagaaggttgcagtggagagcagaagcttggaccaaatgtacacttccgcgttgactgaaggcgggaaattggtggtgtacgctgggggcacaatgaggggccaacaagtaatgaaacgccgaaattgcctaattaaaaaattaaacggtacagaaaatttacaaaaaatcgatattaaaattataaataaaataagattcttttgatttttatgcaatattaaagggacccacgcgtttcggcgctggcgtttcgacgccgatgtttcggcgctggcgtttcggcgccagctcgtttttccacttaagcttttttctttggcatccaaatccaacaatcttggtatcattcgaaagctcttatcatgctctattagccttacaaaaagcggatagattttcaagcctgtaaaaaattttattaagaaaaaacttcaaaaatttcgacttttcgaaattttcatgtataacttttttggtaattgtctaatcgcgaagcaatcgcttagaaaaagcttctaaacatgttaagctttcgaattatatcaacaatgttggatttggattagatagaaaaaagttatagccaaaaacatgctggcgccgaaacgccagcgccgaaacgccggcgccgaaacgcagtggacccattgttactgcataaatcgttaattaaaaagaatattaaaaattgaaaggttgctgaatgaaaaaaaggaaaaacccatggatagaagaagcattgggaagcgtctcaaaatattttccctcttttgcatcattcagccgatcactttaacggcgacaaccgacaaccgttgttcgcccccccccccttcccccatttctctccctatcagtcgacccgggggcggaggagtcaaagcaccgaatttatccaaatgcaccgaatcccatcactcactcactaaccaccaactgttgatcatagcaaactattagaggagggcagcagagagacaggggaagaaggagagagtaggggggtagtgagagggaaatagagaaagagagagagtgagaaagacgaagagaaagagagatagaaagacgaagagagagagaatagaaagacgaagagagagagagagagaaagacgaagagagagggagagagagagagaaagacgaagagagagagagagaaatagaaagacgaagacagagagaaagatgaagagagagagaggagttagaagcacaacagagaaaccagaaaaacatgaagcagcagctgaacagaacaaaacagaacaacaacagttgccttcttcccaaagcattcctttggccaccgcattcccggaaagaagaaaagaggcgaggaaaggaaaagcgagcggaagttgcctcattgcaagcagagagagaaagaaaaagctttgatcatcgatcgatcacaggacggtgacgggaggggggggggggggggggggggg

SEQ ID NO: 19099 - DNA, 955 bp, Heterodera glycines
taaaaaatgaatttttaaagcaattagatatattttacagtaattaaaattatttatttttattgatggattagaacccgagctcctaaaatgcgaatttaaccaactgagccaccagttttatgtgaaatacagccaaaatttcgatttgtgaggcctcataactttttaatttcttcctatgggggcgtaatattaaaaattcacaatagaagccgaccctgctctatcgaatggtatataacacatatgcattttccgagttacagttcgggtggttcccttgttagtaggcgaaatgtcatcgtcccttttttatctgctataaattcgtgaatttcacttgattagaatgtttttgcttagtagacgaaatgaatgtttttgggttagtaggcgaaaggtcagtaggcgaaatgtcggtaggcgagatgtcgagtaggcgagatgtcgagtaggcgaaatttccgtacaccgtaatctttgcaactagcgccaaaaatcttattgtttgggtccgtatcttagtttttgagccattgtctcttatttaaaaaaaaacttacgaacataattggagggtttttatgaataaaaagtgggttagctaaaaagttatgccgattttagtggtaaaacttttgtttttatattttagatggcaaaaagtggtgctccaacaattgacgcatttgttcttcgtcaggcattgttttccacagctgttccaagtgcctccacaccgaatgcaatgcttcatcgcctaaaaaaattcgggctaaaatttcaaaatgctttttgaccctgctcgtccaaaagtgccaaaaattgttgtcgggcgaagggcacaaaatggttcaacagcaagtggaccttaggttttaaggcgagcaatgtgcgcatccgtggctgatcgttgagaaatgtccgaaaatttgcagagttttgcagcgat

SEQ ID NO: 19100 - DNA, 1699 bp, Heterodera glycines
gtgtgactatgtatgtcacactttgaatggattatttttcgaagcgaaagcatttgcaaaaacaaacagagaatgaaagagagaaaagagaattattattgtaacaacaaaagtcaataacatttacgaaatcaacacccgtaaattcgatttctcttttcttattattgaattattattccaatattccgaatgttaaaaataaagaagtcaaatcaaacgtttcattccgttccttgaacaaaatcattttaatagcaatttttaatggtcttgaatgtgtacaataaattttttaaaaattatttgtgtacactaaaatgattttttgaaatatgtataatcccctatgtatttaaaaaaccttttttcattaattgattttatattaggctgcggttgcgtttctcctggtgttttattttcaatcaacttttacatgaccaatcataattttcgcgatcaatcaaaggcttttgtcgatttagtatcattttaacaaaaaatcagacttaaatgttaaaatctctgaagtaattcatttattgattagttcgttgggtttgctgccgatttttttattatcggtttgttttttcaattattgtaatgatttccaattgatcgaaaatattataaaagtaattttaatgattttttaatagttttaaatttttttaaaatttttactcccattttaaaaaaccttttttcatttgttaggatttatttgcagttctgctacaattttagtctccaatcaattttatgacacccaaccacaatttgcgcgattaattaaaaacgtttaccgtattatctctaattatcaagagagagagaaaaaagtgagaaagaagaaagcagtgagagagaagtaagaaaggagagagggagagagagagagagaaattaaaagatgagggaaaatgaacgatagagagcgtgataaaaagaaggggaggaaagagagagagagagaaaggaaaagagagagagaagagatgagaaagaacaagagagtgaaagaaaaatagaaagagagaagacagaaaatttgagagaaaaagaaagagatagagagagagagataaagagagggataggagtgaaagtagttagagagtgtgaaaagagagagattaagagaagaagagggagagaaagtaaatgagagagcgagactgaaagagagaacgagagaagagattgagagagcaaaggagagtgaaagaaaaatagagggagagagacagagaaatttgagcgagaaataaagagagagagatagagttaaagagagggagagggagagaagggaaatgagagagcgggattgaaagagagagaaaaaaatagagtgaaaaacagagagagagagagagaaagagagagacagagacagagaaatttgagcgtgagagagagagaagaaagacaaagagagagaaagagaaagagaaagtgattgaggaggttaaaagagagagataagagattacgaaaaagggagaaaggatgtgagagagggaagaaagagagaaagaaagagagagtgagagaaagaaaaagagagagagtggtgagtgagagagaaagacagagagagaaggaaaaagggagagaagagagagagaggggaggagaaagatagtaagagagagagaaagaaagatagagggagggagagagagaggga

SEQ ID NO: 19101 - DNA, 1581 bp, Heterodera glycines
  misc_feature (77)..(77): n is a, c, g, or t
  misc_feature (84)..(84): n is a, c, g, or t
agaaagtgtctgttaaatgcaaaaactgtgtgaaaaaattgttataactccattcagagaagagatagaaaaaaaanataaaanataggtttagagagcccgtgaacagctgcatcggatgcaagtgccgccgttgctgtacgcctaacagttgggagcaatgacggaaaattgttaaaaaagaaccaaacaaactcatcaatgttagctccgttgacaaccgaaggggtaattgaggcaatgaatgttgggttaccgtaccagttattaaaattgatgtttttcaaaaaggatactaaaactgggataaccccattcagagacaagtcaaaaaaaataataataggcttggactaccatactaattagaaattttagaatgtgtcggttaaatgcaaaactgttgtggaaaattgttataactccattcagagaagagatagaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttggcaaaccgaagggtacattggggcaatggatgttgggctaccgtatcagttattaaaattgttgtttttcaaaaaggatactaaaactgggataaccccattcagagactagtcaaaaaaaataataataggcttggactaccatactaattagaaattttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaattgttgtttttcaaaaaggatactaaaactgggataaccccattcagagactagtcaaaaaaaataataataggcttggactaccatactaattagaaattttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagacaagtcaaaaaaaaaaataataggcttggactaccatactaattagaaattttagaatgtgtctgttaaatgcaaaactgttgtgaaaaattgttataactccattcagagaagagatagaaaa

SEQ ID NO: 19102 - DNA, 2491 bp, Heterodera glycines
atttttgtgcgcccatttcctttgttcgcacttcgcttctagaattttctgtccattttttgtctctctcacaatttgtccacgtgcatggccttttgcccgcccccttcgaaaattgtctatttaagcgcccccggtcaaggggtcgctctcttctcttccttccactccccttcgcttcatattcggtctgcctgtgaccaattcctccaattcccccgtcccatcgcccaattcgtcgcttttattcattattcgttttgctttaataaattcgtgctgaaacggcttggaggattcggaaaggagggaaaagcaccctccacactccatcacattcggcaaattctcgtgcgaggccaaacggaggcgcccattcacgtcttgacccccttcctttcctggcagccctcgtcgttctcccccaatcctcccgatcccagttcctttccctttggcattggagaatccgggagttggcccggagcgtcagcgaatttcaagcagttcagactcccgcagccggagtctcgcggatcggtgtcagtctcaagccagccggagcagccgtagggacggggcgaattcccgtcgtcgacgaaaccaagcagggcagagaaggaaggaagagccgagcggtgccaaaccgtccaccgaagggcaggcccgttcgtcgccgctaatcccaccagccggagaagcgcgcatcgccggagtcagtctcccgccagccggagcatccacgggaggagacgggagtcgaaacccgtgctcatcaagtcgagagcgaacgtcacgaagttcgagcagttcagattcccgcagccggagtctcgcggttcggtctcagtctcccgccagccggagcatccgccgcaggaaacgggagtcaaaacccgtttcatcgagtcaagagcgaagagcaactcccgcccgttcggagcagctcaaagggtcggacaagcccccttcacaaccaatcttgtcgagcaactcccgcccgttcggagctgctcaaaggggtccgacaagcccttcaccaaaatcttgtcggtggtgccgttaagcaagcagcaaatcgctgtataacatccaacagtacctgttcaattttgtcacccctcccccctcccattctcgtccccctttggcgctgatcggatcggtcagcagcatcagacccatcaggacgaacggcgaaagagggggacattccctttacggcacagcgagcggagtgagcagaggaaaaagggacgagagcggtgaagaggagcgggaaccaatcccgcctcagctgggatttacaagccacacacttggcccgcccgagtaaaagattggcgacaatgtacatattttgatcactttttgtacatatttttggcagccctacttattaattaaagtcatgcctactacggccagcagttcgaaggccttagtgcctgcgatcatttgttcatcttgacaaattggaagagcaaacatttttatttgtgaaatgttggcttccgcgccattgcttcggtctaataattttatttccttataaaaagagcataaaagaaaatcgatttataaatttatttttatttagaataaattttcgaatggaaattcttttttcaacctagattttttactgtattatttttgagaatttttaaaaaagaatattcataaaattccaattcttacatatttaattcattttagtaaatatgcatattgagaaaattttccccgaaattcttatgattttaattttattcataagtttttcggactcggcaccacccaaaaataaatctgctgaaattgtcgacgcgtcaagttcagatgattattgaataaaaaattaatttaattaaattctttaattataattttcaaaacaatttcacaatttgttactgaaaactccgcgcacaatataaattatgttgtgtaatttgcttacgaatacacactgccaaaaaaacattttttgttaaatttcatttatttattatttttatcataaaaaatagattaacttaaggaaaatatacggtaactgattatacggtcgacatcggaaaacaattaagcagatttcaaacggagaagttaattaaacaagcaaaacaatggataaaaaatgtgcaaaatgggcttaaagaagacatttgtttggctcacttttttacttaattatgaatcacatgaaaataatgatgaattcaagttgtataataatgccagggtctaccgtatcacttttagtattttcatttctgtaagcataatacggtgatcgtccctttattttctcatagttgttttgtctttccggtcatgattaacgaagatttaaggcatctatgtattctgtactgaaagcatggtttttcaatgcctgcgataattagccgcctaattaatctgctttattttatttttgagtttcaaagccaacaccttattaatagaggggctgccaattaca

SEQ ID NO: 19103 - DNA, 958 bp, Heterodera glycines
  misc_feature (927)..(929): n is a, c, g, or t
cgcacaaatgtcgccaaaatgaccaattcgatggctccccagcagtgttttgtgtccccattccttccatttcaacaccgtcgccagttcttttagccatttcgaccaacaaatccctgacaactccgacaacaacctcctcgtgaacatcaaagccaaaaattggctgaaaatgtggaattgtagagaaaatgatgtcactggcggtgaacctaaattttgccgttttttgggtgaatcgcagtcaaaaaccgacattaaaagagcagccaaagcgcctttgacagaatggagaaaggaattttcgagcttttccaatgttttgctcagcaattcaatacgatcggacagaaaaatgtccgacgattgaaatttacggcccgtgtcactttgagaagaagaggaaggaggcggaaaattgagcaatttggaaaaaagctaaaggaaattaacaaaatataaagattgaaaaagaaaaacaaacatcagagattgatttcagaattgtattcagcacattgtgacgacaaacggttatttgatgaagagctaaagagaaattcggcggattggattatacccaaacaaaaaacggaccactcctctgcactaattcagcattaaagcgagaaaaattgtagccttaatcattgaaattaaaataacaatgaaaacaaaatgaataccggaagacagtcgtgtcaaaacagatattttgcgaaaaattcggtccaacgccttcacaaaaagggcgcagtcgcttacagattcttcagattcaaaacgaccacagacaatgggttcaaaacgattcataacacgttcaagaagatggaccaattccgccttggaagcctaaattcaaaattcctgaataatttaagtcgattttccctttaactttttagatttttgaaattaatatgnnngatttcgatcacctgttttacaaaaattt

SEQ ID NO: 19104 - DNA, 1855 bp, Heterodera glycines
ccccctcggttcccctaaagtttttgaaaaaatttgcagcaaaaaaaaatcttaaaaatctgattttttgattccgtttctcaaattattaaaaatgatcatcttaggcgaaaatactaaaattatattaattgattaaattgtaaaaaaattatttaaggctatgttgttaaatgttctcatttttgaaaatctgatgtccggtctctaatttctacacataccatatcttgttcaactgccacaagctcttccagccctttttttctaagcaaatcctggacataagcttctgcgttgaaattgggtgaattcaaatccatgtgtaaaaaagaggcagtaaatttaaaaaaagtctgagaggcttttggaaaataaacaaaatgccaaacaaaaattaaatgatcgcgaatagagacaagtgcgggaacggatccccgtcgtgccggcaaaggtttttaatcccaatctcgcaaccggtgattctgcagattttgttttgtacgggattcggcaggatgcttgtatttattaaattgcaaaagatatatttttttacatttcatccgtttataactttgttatcaattatcaggcttaactgtaacaccatcaatggaacaaagcaatatcgaaactatgcggtcaaaaacaaaattacaccacgagggggtgctgtatgtatacgataaaatgagcgcttcttgcgatgtaaaattttggcgttgtgagttttccaacgcgcgtgacgtgagatgcaaaggtatttgttgagaaggaaatgcttaattgagccagtgctttcaaagggaggcttcggcatatgaaaatgcttaaattgtgcgcttttcctctgaaggtcgcttgcacaccgatttgaacggcaatgttctgagagtggtcggcgaacacgtgtgcccttccagcgctgctcgcgtggagtcacagcggataatcacagcgatcaaacgacgtgcggtggacacgatgggatccacggacgaaatcctcgcgcatgcgttacagaacgtatcaccgtctgtgcttgccgctgtccccagtaaaaatgcggcgaacaaagttagaaaaaattgaggaacggacggggaatatcgcgaaaatcaaaaatattatttatcaaacggatttattgctttttaatattgaggtattttcagctcatcaaacgcgcgcgaaatgataacaaaggaacattggagaatttcaaacactcggagaggtcaggcgaaggccaattagttttaacccgggctctgtcccaggtgtcttctggtccttattaatttgggattggatttggccggggtccgtttgagacttaactcggccaatttttaaatcataaacctcgctttcgttttttggcactgactgcacttttttggaatttcttcacttcagcatcgattctgcccattctgttggactcactttgaccattgacgctgacgggcgaaattatggcgagccgtgccatcagcagcaaacgatgcgacagaacggtgagcaaaagggaaacgataggaacattctttgtcataaaattcattgcgttaccattgacagcccaattccccgcggttgtccttcaaacgaaccaacagcaaaatgcctcaacttccgccgtcgcacctcagcaacacgtcggtccctttgaacaggcaattaacttttttaatttaatttttttttaaaattcctttaggtttttttatttttctgattttttataaatttttcttagcgtgtctaattccttttttcaccagcagcgggtgccgaagtccaactttcctgccagttcagccatatcaaactttgacatttcaccgtc

SEQ ID NO: 19105 - DNA, 551 bp, Heterodera glycines
gtcagtgccatgctaataaatttggaggcattgctctccccgggaaattagcattcgtttctccacgagggcgacccctttggcaaattggcgttgctgaacagctgcgaaatgaacggaaacagccaaaagcagcagcaaaacaacggcaacagaacacaacggcagtcgacggttatcacagcggaggacggctgccaacttttgagagtcgacgcaacgaaattcagcaggtgaacccccgcggggggggggggggggacagagtccgacggggaacaaaaagggacaaaaaaacagtgccaaatggaagggagtaaatggcataatactgatcagattgctgagtgagatggagacgaacaccgtccggctgaaggagtatatggaatgcgacaatggcaccactgaaaggccattggatgtgttggtgttgcagagggatgccggtggaggacggtgggaggagttgacaattgaaagcgttctaccgaatgccgacttaagccattcgctcatcgccggattgcctaatcatattttggagtaca

SEQ ID NO: 19106 - DNA, 1570 bp, Heterodera glycines
ttggtcacaatggtggatgagtcgttcgtcgttctgtcccggctcggcacccgttcttcctccaccaatgccctccaacccgcggccgattcgcttctcctcgacgttctcttctctcttcccttttggatgccctccaacgaattgtgcaacatgctcaagctgtactacagctttggcttttcaaactccatcgaacaaaacgtgcaaacaattggtggtgatccaagtgaatggagccgaacggcgaacacagcgacgaaacgacggactgtcgcttttgtcagtgcgtggcaaatggcaattggtcatcgctttttcctcgactccgtggccaatgcttttgtggtatttaaaaacaaaatgtttaaaattgaattcatttttaatttaattcaggaagaacttttcagcagtttgttggaagacgtgagaacagccgaagagacaacagaagcgatggaatttgaggaaatgatgcgccaaatggaaacactgatggaattccgagagggattcatgcgaaagtgctaactaaaatttgacaaagtatgctacgaaattttgtgcagattaagccgacacccacgcgttgtcctggacaaaggaaaatacggcgacggggcatcggcacccgacccaattttgccaagagatctctgtaagccgcaataggcttattgttagctcagcaattcgctttttttgccaaggcattcaacccattcatttgatgaatgcgtccgatcactccaaacggtcgatcactttacaattgcgaatggacaaaagtgcggcagaaattgcacaaatggcggcgaacgccttccaaacgcggcattttgttcacttatcaccgcacattaacggcgatgctcatttgcaaaaaggggaacaattggtggcaggaaatgagcaagaaaagggggaggaaggggtcgctggggaggacgacgaatttgtgttggtggaaatgcgcccggggggaggggaagcggcgacccgccaattcgagccaagggaatgttcggtgccgacaatgctcagcccaacggaagcggaccaactgttcgtggcacgcagaaaagaactgcataaactggcaagtgaagcatgcgactgacaataaatgccgatcaatccgttccccccccccctttcagtctctcccaattgagtcccctattcccctcgggtcggttccttcgctgtgccttcagctcagtcccatgcgaattgccaaagcgatggccctccatcacttcaaattgttagccgctacttctgcctctgaactgcttgttcaagtttccttaccactctttcccaccgtttgtcctcctcctcaggtggtcggccgtgaacatttcccccccgcgttggctccgtccaatttggacgttttgctccgccgcttccttctcgtacaaagttgggcaagtactgaagtgctgctggcaaaccctgccgaccgcttgaccattctccaagcactgatcgaattggcggaactgtaagtcatttcgcaggagagtccgttccatcgtattggcccactacagtgtttgct

SEQ ID NO: 19107 - DNA, 1036 bp, Heterodera glycines
acttttcggcatcccattttgaactataagcgtattcccccccttgtttataattttaatatttctgtttaaattttgtcataaaaattttttaaattaattaaatctgtgctaattaaggactctttcattaaaataagaaattgcttctacgccttttcaattattttgatttattaaattatgatttattttaaataatttactttttaattagttttttgctttaaccactcgtccgatcgcatcgtaaagaagtctttgggttttctaggatgtttagcgtttatttgccttataaaattgtgatttcgtattttctgctcttgatttattttattttttcttcaagtcgtcgaaatttgagtatatattttttgataatatatttactaatttattaaacatggctattatttttcaaaaaagggggaggggtaccatcgacagcattagcaaattaaaatttgatttttttatacaattttttttttacaaaaaatggggcggctgcttaactgaccatatttataggcaattaacaacgatacgtgcaaacaaatacctaaccctactaaacttcataaatgtatcaaaagaaaaaataaacatttttaaaaattcaaaagataaataaatagggctgggaattttatgtaagaaaaatcgcgaaatatgtaaataaaatatgtataaaaattggctaaatatgtatgaaatatgtacaaaaatccccaaatatgtactaaaatatgtaaataaaattttttaaatgcttattttttgggaaaaaattcttcgtaaatagtaaaaaggctcaaaatgccataaaaattaccaaaatggcttagaatcacatttagtactttaaaaattaatttttttgatatctttttaaaaaaattgattttttaaaagtttatttttcaaaaaaattttttctaaatttcaaagaatttctcaaaaatgaaatgtttacgaaaaaaattgcaaaattttgaatttttttggtgcatctaaaaattttcattaaaaa

SEQ ID NO: 19108 - DNA, 844 bp, Heterodera glycines
  misc_feature (38)..(38): n is a, c, g, or t
cttttcgttttcaagttttaaaatttttaattttcgtntcgttttcatcagacggattttggacgaaaaagacgaaaatatttcacccttaagaatgatttttttggaaaaaaacaaatcatctcgtagaacgagtgtggtttcgtgctacatactatcacctttttctttacaaaattcattgtaaatccaaaattcttcccggcggcgcctgtcggcaccgccggctcccgaaattcccctaaaattttcaaaatctgccattaaaattgtcaattttcaatgaaaatatgttaaatttaaaaaattcttattttccttatttttcttaaaacattggcccaaaaacacaaaaataaaaacttttttttaatttccaaaaatgtcataaaatgcatttattcacgaaaaccccagaaatactcactttaagtaaaataaatataataattctaaatttacaaactgaactgacccatcctgctgccgggaaaatcatttttacactgtatttttaattccttttatttcttttaatgtttttgaaatttaacctaataaaacctttgattttttatcatttttcaaagtttttagaatactcccgattttgctcttttctctcgtgatttacattcaaaaaataaaattgtgatctcatttttcgtatttttatttgcgtgtttaattaatttatctgattcaaaattaatatgaggctaaattggttgatttatataaaattgtttctctgtttagaaaaccttttaattttaatttaaaatgctttaattcaatggcaatgttgtgtagttattttgtttttattttttaatcttctcgt

SEQ ID NO: 19109 - DNA, 2495 bp, Heterodera glycines
  misc_feature (63)..(63): n is a, c, g, or t
taaaagtgaaatcgttttagacacccaaatggattgtcctccagggttttggtgtacaaatgnacgtaaaagtgaaatccttttagacacccaaatggattgtaatttcacgtttttggtgtacaaatgcacgtaaaagtgaaatcgttttagacacccaaatggattgtaatttcacgtttttggtgtacaaatgcacgtaaaagtgaaatcgttttagacacccaaatggattgtaatttcacgtttttggtgtacaaatgcacgtaaaagtgaaatcgttttagacacccaaatggattgtaatttcacgtttttggtgtacaaatgcacgtaaaagtgaaatcgttttagacacccaaatggattgtaatttcacgtttttggtgtacaaatgcacgtaaaagtgaaatcgttttagacacccaaatggattgtaatttcacgtttttggtgtacaaatgcacgtaaaagtgaaatcgttttagacacccaaatgaattgtaatttcacgtttttggtgtacaaatgcacgtaaaagtgaaatcgttttagacacccaaatggattgtaatttcacgtttttggtgtacaaatgcacgtaaaagtgaaatcgttttagacacccaaatgaattgtaatttcacgtttttggtatacaaatgcatgcaaaaggaaaatcggcctttcgcgattttcgtgcctttttttcaatttttggtgcctattatagtgcctttttagtcgagctctaatgatgatcgagcgagtttttagcacataaaaaactgtgtacagggagagagtgccaatgcgaaaacacagacctggcaaaagcccgtctttatttcatttatttttaattttccatttttataaaattttataattgaggggagggagggttacttggatggaatttatgtaaaattcaatttttagtaaatagacgcacttttttgttcattttttcgttctcatgaaattccataggagcataatttatgcgtatttatttgcccagttttatatttttttaaagcaaatattcacctggtttttgtcacacacacgggaattcatgtttacttgagatgcaaatgcacgccaaaaaggaaatcgtttagacacacaaaatgaattgtaatttcacgtttacaaaggaaatcgttttagacacacaaaaagaattgcaatttcacgtttacaaaggaaatcgttttagacacacaaaaagaattgcaatttcacgtttacgtggagtgcaaatgcatgcaaaagggaaatcgcttagacaaacaaaaagaattgtactttcacgtttacttggtaaagaaaaaaaatttaaaatgaattttcaaataatttttcgtaatcaccaaattgaaataatgactgaaggtgataatttaatagtgcttcttgctctaacaaataagctatgtcaatttcgacatacttttttttctttaatcggaaaatttacccacaactaaacgaatttattacatatagtttattaggcaaattgattaaaaaaatgctttatacaaaaatcatatcacaaatatatagcacgcaaaatttttggtgtttcacccactagccttcttagtctaaagagcttagattttgatcaggtatacctaacaattaatatcaagaacaaataaaagatataaaaatatattttatatctttaaaaagcaaaattaaaatgaattgctcacattatcaatgacaacataattcttgtaaatcaggaatttataagctaatgcattgcacaagttgatcagatcactacttaaggatgatatgaagtgatcaaaatttttagcaccaagaggaattgaaaaaagaactttttggaaaaactttataaatttttgatgttttcattcgcattaactttcttaactccgaaaaatcacatataaaattcaatattgagatgatcatccaatttaagaatttttttttgaaaattaaatccagaaaatatgacccgcaaaagacggtccgcaaatgtcgcactacggtacaagtgcacgtaagagtcaaatcattttagacgcataattgaagtaaattataatttcacttttcttggtgcataaaaacatcaaagacatagtaatttcacgttttattggtgtacacataaataattaaatcgcaatttcacgttttattggtggacacataaataattaaatcgcagtttcaccgtttattggtgtacacataaataattaaatcacaatttcacgttttgttggtgtacacttaaataattaaatcgcagtacgtcttattggtatacacataaataactacatccctacaaaacaaattctcaggtgaaacattagtatttgctgtaagaattggcatggaaagggacatttggtgattctttggaattcatcttttggtttaaaaaataaatttatgtttttcgttttgtaattctgtcatcaagatcaaaaaaa

SEQ ID NO: 19110 - DNA, 1819 bp, Heterodera glycines
  misc_feature (1777)..(1777): n is a, c, g, or t
  misc_feature (1794)..(1794): n is a, c, g, or t
atttttcaaaaaaccccggggcgctgccactgaatcttcaccccgccaattcaaacaataaaaaggtttttcaagaagaccttccgaacgtcggcccatccgtccatccgttcatttgcttaagtgccgtgccatttccaatttgctttttgcttttttaattttttgaatttccgcctgttttttctttggcacttcctcaaaaaaacaacaaaagtgatggcactttgccatccggaaaattggcccaaaatcgcaattccaaaaatgccactcgaaggcaccaaaaatttgccaaacaattcggaaaaaattgtattttatttcgaaatctaaagaataacaaaagtttaactttaaagaaagttattttcccaaattattttttttttgaaaattttcatttcaaaattaaattattattaacttttataaatttctacataatgcgaatagtaataaattttatttttccaaatatttttcaacttttaaaaattcaaaaaatgaaagcattgcttttgcacatgcaaaatgtttgttcctaaacattttcccgccgctgctgctcactgaaatgcgattctgcatcagttaccatttttaaaaaggcgtcaaaagagccgtgccaaaaatggaaaaaatgtttttttttggcatttcgttgcgtgccatttttcaaattttgttgttttatttatgtgtgcttttttggaacagcagcagaagcagcaccgcatttgacggcttattgttgttagcatcactcactgacgacgacgagaaaatgttgcgaaatccacaagcccaaggccgatctcaggtacggtaggagcaatcccatcttttctccgcttaatattaggattacagtagcggataaaatctaccgtaatgccgtctcatgttttacctgttatcttttttacggggctttaaaatagcagggacaggctctactgtatgaggataccatactctttatccactcggttaaagcagcttttaaataacgggacagtttctactgtatgagagtaccgtactctttttcctagtcactattggttctatacatacaagcatttatttacttgtattcctgacttgactgatcacagctgatctgatcgatgatagggtttatagtcccgtttacagtaggatattatcgtacccttccctccacacttctacagtccttccggcaccgacccgtgtccgcgcatggccggcgcgccggccccagcgtcggcaaccgcacgcacaacgccagccacgacggcggacgcgtcgcaggagcggcgccgttccacacccaccataacgcgtcgttgcagtctacaaaagtgaaaaacgaaatacaaaatttaaatacatacttatatgccgtacgtcccaccaaccaaatcttgtgccgttacggtaacagaaaaccctttcagtcgctcgcgcgtcgaaccgcgcatcgacgcgtggcccgagccgaagcagcgcagcgaggcggaggagcgcttcctggcactgccggacgcgtgcgactacacgcgcgtgcgacagtttaacattgacgcgaaggtgtgccgccacaggggggagggcattatgtgccattgaatctggtctgatctgaaatgccgatctctttactgttcgggtgccgtcgtcctccgatgagcgtacctggagggggctaacacactagagctcggcattttgaaagaaaagcctggacctgagtccatgtttgagctggatttcctggacaaaaatcctngagaaggccgaggcctnaggaaaaacccaggcccataaaaac

SEQ ID NO: 19111 - DNA, 1484 bp, Heterodera glycines
  misc_feature (14)..(14): n is a, c, g, or t
  misc_feature (68)..(68): n is a, c, g, or t
ggaaaaatccaggnctggatgcaggtccagcaggtccaggcctagctctaactaactctattctgatntaaatttctttatgcccattaaaaaaggtcattatcatttccctcctttccgcttcagggagcggtgatcgctcgcggcgactcctttagacgcaagcgacaacagcaggtggtgcacgctcagcgcagcaacccaatcgccacggccggcacatacggcggtgctgacgacggcgcaacggtcaccgacccgcaccaattgcccatggcgactgaactcgctgagcgtgcggcgtacgctggcgcaccggcgacgcgtagtgcggcgagcagtgtgagcagcagcggcgacagtggcgttggcggcagcagcacagtcgccaaacaaacggcactcgtgagcaacaacgccagcggcaccgtcggcattggcgcgcctgaaattgtcggcgccggcaacgatgaaatcaccaccaggcttcatcagtcgccgcacccaccgccgccgccgccggtggtgttggaggcggcgagcgacgccactggcgacagtggcgcggaagcggcgagcacttcgtccacgtttagggtcagtcgctagtgctttgtcgagagtctcgagcattaatggatttttctgaatttttcagatttgtgttcttggccagagcggttccgggaagagttcgctgatcaggcgattcagcagctccgactatcgcaacgttttttcggacgagttgcgtacgtttttaaattataataaaaactaattaagactaattgtttaaacacacactcattttaattacctaattcaaaattttctttatttattttttatgttcttctaatttttggctataatctgaatctttgaaatcccaagttatgttttaaattttcatatgaacatttctctttttgcctatttattttttttaattaaaaataattatttttcttatttttaattaaaatttttcatttttttaattcctttcagtcgatgattcaaattgtgaagcacaacaaaactactccgtttccgtcaacattggtggccatgagtgcgacttgagcttcaccgagtgcgacgacctccaaatggtcggtccattagaagcaaaaaattttaaatttggcgcgtgccgtttttcgagtccccagcccttggcgaaatgatattttttaaaatttgctaactaacattaaggaggctcacaacagacaacggaacactttccacgcctatttgcttgtttacagtaagtgttttaaaaaaataatggagaattaccgtagtaatgtaccgtaatgggaactaattggctaacaaataacattaccgtaatggaaaggctgtaaaccgttggccaatgtccgtgatgaaagggccgtaaactgttggccaacgaatcgtttatcactgtgaggagtcgcccttggaaataaaggggtttctgtaatctgtag

SEQ ID NO: 19112 - DNA, 926 bp, Heterodera glycines
agcctaatttagaaaattctttaagaatgcaaatcattttgttggctctctctatggtcgccagcctcaacagctgaaccattctcaacgcgctggcatcatcgactttagcatgtttcctcctccgccagtgccgaacagaagcgtcagaaaaacgagtttatttggagcggagcgacttatccaagtggttcataatggtggctaattggttgacttttcctttttgcttcagccgcccccgactacttttgggccgttgcagccaatgagtgccgctgcaggaacaatgctcggagctcatcagcaccaaaacgctaccattccttttggcgtttttcagccctctgccccaccgccgcctcaccatcaccacccatcccaatttgctgtcgctccaccacaaattggcatatatgggtatggcgctccccctccgcaatagacgactgaccgaccttcctccatacataaataattctcttcccttgtgtgtatcgtatttgtctcgtaattaactgggttgtcatgatccatccgtctctgattttttaaatcgatcacttgttttgtaatttctgaatcatgggacttaaaatcatcatttttgacgtcgatgaacaaaatattgctcctgtttgctatttggttctaattatcgcatctgatttattttattttgtgtggtgtacttttacatgatataaaacacaatgtgtcaatttgttcattctcgcatctctcttcacttcccaagcattttcacgagttgttttgcttctttcaaccattccgattcttcctcctcgttttcgtccccggctgaattctccgccaccgctttttccagataagacagcgcgatcttcttgtccccctttgccaagtacacctttcacaagaacatcagattctccgtccactct

SEQ ID NO: 19113 - DNA, 1079 bp, Heterodera glycines
  misc_feature (1021)..(1021): n is a, c, g, or t
aggtcccggtcccggtagggcaaccgggaaaaacaagcactggtaagaatgggggtctgagtgcaaaaattactgagaaaattggagtaaaaggaaaaaatttagaaataataattaaatatattcgataaagtagcaaaaccaattgtgtaaatgacctagtggctagtcccccttcttctttccccttgttcaatccctctacagaaattaaaatattttgaattttctttttgtatacttatggctttcctatcgacaaaatatgattttattttttttaattgtattttatcattttttaaagaaaatccgtacaaattgagcctagtaatctcaaaaaccagcctttttttgttgaaatttgttaacaaatcacactcaaattttcaaaatttcccccggcggcgcctatcggcaccgccggacccctttcttctccaaaagttttttggaaaaagcgcgccgaaatttttattaatttaaatagctttaacttttggattttataaaataaaaaccaaaataaaaatttaattatttaatattttcacttgaaataaattaaaatttgatttttttttaattttttgaatttttaaaaattcccggttggtcccggttcccgaacaaaaatcgaggtcccggtcccgacttctcaggtcccggcaagtcccggtcccggttttgcccaaaattcccggtcccgctctactctagaaaaagggaggaattgagaaattgcgaaaattaaaaaactttagataaaaggggtataggtaaatgaaaaaaatgatgattgaaagtagggaggggaaaggagagaagattcgtaataaaaacatgaaaaaatatggcgggggggggaagtgccaaattcgtaatcaaaaataatctcacaaattttgagtccgcaaccgcagaacacactttagtcccattcgttttgctgctcattctgtgataaaataaaagtgctgaaaagggttttgagagatagggtatgaaaatttgaaaattnatcgaatcggaggcttgtgagaggaagcggaattggggaaaaccgaagatcgattgat

SEQ ID NO: 19114 - DNA, 3498 bp, Heterodera glycines
  misc_feature (1324)..(1324): n is a, c, g, or t
aaaaaaaaatgtaaaaatgaaggaaaaatggctcaaaaaataaattaattaccagttttgagcacatccgcggcaatttccaccggctttggcataagggtcgtcggtcaaatgttgagcttaacggggggaatgaaattttattaaaaaattaatcaaatgaagtgatattagagcaaaaaaaaaatccaaaaaattttatgatacccagaggccccatttattaaaaaatttaaaataatttgccaattgctgccatggctcactcaccagtccaatttgtgccgcttcgtccccccgaactttgcgtccggtcaaaatcagctccttggcttttgcaacgccgaccacccggggcaaccgctgggtgccgccacagccggggatgatggccagccgagtctcgggcaggcccaactcggaacggggtgctgcaagcagaaaaaacaattgttttttaaagtttaaaatctgagagaaaaattcgtttacggaaaattgagtaccaaactctctgtaacttcaaatggtgtttagggtcaatcaaactattttttaaaatccaaataggggttcaatattacagttttggaatttatgaaagtgtcgttgaaaaaatgctaaaattggcacgattttgtggatcagcggtcgcaaatgtagggacaattcttaggaggacgaagaaaaaaaaaattaaaatccccgaattttcggaagaatgctgccgaatattttctgtttttgttcaacctggtcactttagcggaacagatttaaactttgtactatagtacaatcaaataaaatcgccaaactattgagaaaagggccaggaaaattccaagaaaggctcactcgcaatgcgcatgtcgcaggccaacgccaattccaaaccgccgcccaatgcgcagccgtcaatgcatgcaatgaccggaaaaggcaactcggacaggtcgttaatggttcgacgaaggcctaaaattttctgaaatttttatgaccgataaaatttgaacgaataaaatggcaaaaaaaaatatatataaaactttaaaagaaataaaaacgaaccatccacaaaagtggtcacttcgttggacgtcattttgcgtctttccttcaaatcgacgcctaaaaatttataatttttttatttttttgggggttgtaaaatgacaatggcttaccggaacagaatgcttgtggcacagaactggtcaaaatcaacgcacgcgtttcgaggccgtagcgcaattggtcgaccatgtcacggaactgaaaattgaaagaaaaaattattatttttttcgaaggggggggnggggggtgggtataaaaaaaatgccattttcgtgagttttaaaccaatttaaattcattttttggtctagtagctttatactcttcgaaaattccttatagggtaggctctttaaagaatatggcaaggtcgtggatccagtgaaaattacctaggttcaaagaatggcacagaattttacaaaaagggcattgttaaactcccatctcggcggcaaaaggttgtagacagtcagggcaattactttgttaagtagctttttgatcggctttgttatgattgttatttttcattttttgttcataaatttttttccttcaaaaagcgcccttttttatgcaacgacctagtaaaagactcgcaaaaaaaaatttttttgttttgttttttgcaatttaatcccaaaaatggcaccaaccgcttgtgcaagtgcgcgggagaacgcgttgcgcgtggacggcacactaatccgtgccaccaggatgcccgtgtcagggccggccaacggctccagcgtcaacggtgccgcgggcgcaaccgccggaccgccgttggtgtgcagcagtgcgcacttgtgctgctccacactgctcagctgcgtgattgaacccattttgttgttgctggttgctgttttgtgctgacgaaaattgccgctgccgttgaagagagtgatcggagcagcagaatgatagccgctgattgtggtgatctggcggtggcggatcgatgtgatcagccgattttgggacggctcggcggtgaaaatgtgacgacggagattattaaagtgatcgcgacgatggatgaagaacagcggcgggaggagacgactcgacaatgatgatgacgaagaagacgacaacgacaaagactggtgatgaagcagcaaaagcggcgatttgcccctcttcatcatcataaatattggtgtcaacgacatgctccgcctcttttctgctgctgcaatttgctgggcgtatttttggactgtaaagtgagtgaatggtgaaatgcacgtgaacagcgaatttgacggctgtaataacacggggacgagagcaatgaaatgggatgggaaatggggaaaatcggtgcaaaatttgaaataaaatggatgagaatcaatgaggaagaaaaaaaggaaaagcgatcaactcgctgatgagtcgtgttccaatttctgatgttatttgggaatggagaaacaacggtcgaaatctaaacctatgtgtcaaaaactgcgtcattaagaattttacagataaaaattttgaaaaaattttaaatggcgttccgttttatctttttctctgcatttctctccattttgcttactgtctcatgctaaggaaagaaggaagagatttaaatttcaaatgttctaattaatttttcttcaattgtcaaaaaacaaatatttgccgattgcataaaaaatccaaaaaaagtaaaaaaaaatgcaaaaattaatttatttttgaattttacaaaattaggaaattaatcgaattccgacactaaaaataggtagccaaaaacagagaattccattcattcttcccacgcctgacaatttgtacaacaaattcccattttacattctcacatttcttgacaatttaatcttacgatttgatcacgttgtgtgaacaccccaccaacaaacagcaaacattttaaaatgtgaaaatgggggaggagaaatgatcaaatcggcgaaaatggcgactgtttaaactttgggaaaaagatgggaaaacgaaacgattgatggtccgtcgatggcgatggtaggggcaaaaacgacgattgacaacgacgacaaaaccgataagacgagttcctttccccgcctgaaaatggggtcaccaaattgaaaacaaaaacaacaacattagaaatgagttttcaaaaacggcgctagaaaatttctcggcttttttggggggtcccgtctctcggcattgttattgggctttttaagccataggggttaattatcggactcggctcttgagcctcggaagtgaattgctggtctcgaatttcagtgaatttgactcttgggtgctacccgaataacaacatgacccgtggtgtattttttgttgatcactttgccgtcacgttgatcgcaaaagataaatgaaaaatatattgaaatttgattt

SEQ ID NO: 19115 - DNA, 3202 bp, Heterodera glycines
tgcttgagtattgttccgtgcgcgtgccgatgttcttcgcgtggtgattgccagaattgatgagccgtaattatcaattaataattataattaacaaaattaaaggaatttaacgttagtaaaatacagtagctcgatcttttttctgagattttcgttttgagaaattttttcgaaagtgtttataaagtcacccaaggaaacaaatatgttagcttctttaaaattattaattttgaataaaaatattttaatctgtccctttttaagacaaattttggctttattatgtgtcaatttagccctcccccgcgtgtgccatgccattctgtctcccacctgttcgccttggcgctgcagttcgtcaatgcgctgctggtgcatctgcaggtccacctcgaacgtgtcgtgcttcttcaacagtccctgcactgcagccatgttctcaccgacgttgggcgagctgagtatctgttgcttctcgttcagccaggcttcctcctcctcaacacggccaatgaaattttggaactcctcactgatgggggaaggggaggaaaaaatagggaatagaaatttaaaaaaataaatttttaattattattgggtaattcaatcaatgttcatttcgcaaaataattgactgaattttaggtatttataaaattaagcaataaataaaaagcaaaatccaaaaatttgagatttattacagaaatttaaataaatttatttggaccgagaatttcaaataaaatttgaaaatatcgctttgtgtagattttgaagagctatttcaataactttttcaaaaaatattagaaaaattggggaaaataaattcactcatatagttttgaaattttcaatgctttttctcccttttcccacctctcctgcagctttttttgccggtcgtctgccaattcgaccatttgtgtccaactttggtccaatgctttgatacggcgctcaatctccggcccgccaatttcgctggacttggccaattccttgcccttggagcgcaccacttccacttggggctgatgggtgtccaactcactgtttttgaaaaaaaaagtgtaagaaaatgacgcaatttttgggggtacattttttgtacccggtcttgagtcaacgccaagaaaaaattcggtttttcctgttctcagtcctaacattggacacctttttaaattcttacttttttgcatttttctaaattttcgtgaattctaacataaaaaaaataattggacaataattggaaaagttaggcggcctaaattggcttaaatgtgggttggcgcacggaatttttgcttctcatcagtaaaagacaaaatattgcatttatttctggcaaataaatatttttggaattttattaatgagctcacctgccaaaacgacggtgtttacggcgcaaattttgaacgccggccaaatcacggccatagtcgtcgctgctcaccaacagctaaaaaacaaaaattaattaaaaataatttaaaacttatgtatttgtaaaatgaaggtccaggctgtgtcggcaggcgtcgccatgagaaattttaaaatttcagcgccatttaaaaaaaatttacactagaaagttagtttattattttgtggtaaatttgaaaaaaaaaacaacgaatttaaataattttttaagaaaaaaaattacgtttttaaactggggttttcatgaaaatttcaaataataagttgaaatatatttaaaaaataaatccatccgattaaaacaaattcactcactttcttctcctttatccacgactcctcctcgtcaatgtcgcgcagaaattggtgaacagtgatggctttgttcagtttttcgcgacgcacatcagtcgagtcctgaaagaagcaacaactaaagagggttaagaagcacaaaaataatttttcgaaattgcaaaatatttttgaaatattaaatttgcaaaaaaagtgaattggcgagatgtttttttaatcaacaatatgataaaataataaatattttataaaaaatccattttttatttgaattaaaacaaaaattaaattaaattatagaaatgcaattcatttaaaattggtttttttccattaattaataaaatatgcttacaaaataaattaaaagataaatccacttataatttaaacagaaaggattgcgtcggtttttccaaaattaatttttaaatttcggatttccttttcacgaatgttaaatagataaatttaacattaaaatacaattgattcttttcacccactttcacttgctcatatctctcgttgatgttgcgccggcgtccgtcaatttgcgcctggtcgaactgctccgactcgagcagggcatccgcctgacggttcatttcctccactcggtcggcatgtgcgacgatgtcggccttaaaaaataaataattttaaaaatataacattttttgagattttagaaatgcattttacctccaatagttgatgctttttcaacaaattctcaatgctggccaagtcccgaccgtagtcttcagaggcgagcagtgtttcgacctgaaaaaatgaaaattgtataaaaaatgtttaatacattggtaatatcaaaaaacaatttaagagataaaaaaattagtaataaaaaagtaaaaaaaattaactaattaaaaaataaaataaaaaagtttttatcatttttatcaaagatgattttaaaaaaatcgcatcattcaaattaatgtttttaaatagtcaataaaatatcactaaatctcggaattcagtttaaaaaaatattcaaaatccttaaattcttaaatttaattgatttatttgcggcaaaaactaatttgatattgctgtcagtaaaaatcatttatttaaaaatattttaattgttttaacatttttttgatgaaattcacctctcccagccaaaactcgaggtccttcaccgctgccatgaacgtcttctgcttgtttgcctccttcaaccgatggcttttctccgtcgtcgtctttaccagctgttcccattggtcattgagggcgcgcagacgagcggacaccttaaaaatgaacaatttaaatttttaaatccaaaaactaggctcgaaaaatttcaaatttgagagaaaacaaaatagtactaattgctttattaaaaataaatttcaaaatc

SEQ ID NO: 19116 - DNA, 835 bp, Heterodera glycines
taatattttcattataattattttttgcttgatcacttttttaatgcctcttcatcatcatcatcatcatcatcagtcctgtccccaaattgccatctccgttttggtccgctcctcgcgcactctcttcggcaattgccatccgtcgcgtggtgtgtgatcggtgatcgtcctcccccctccccctcctcttccgatcacacccctccccccctggggggatgttgacattttgttgcttccccccccttatttcccacttcttcccccacttttttttgtttgcttgccacctcaaatgattcaccgtccctctcccccccccatccgtccgtttattcattcgccgattttcctccccccccccaattcatttcattgttcactgatttcatcgtcggcggaggtattaacgttttattatttttatttatcactcatttcttgtgattgatgatgaggcatccatcgtttattcccccaacaaattgggggcccaacaattcgatgaatgcgatgagtgatcggccgaatcactcactcttttgcccacaaattctttcgcaaacttttgattatttccacataaattttaatatttattctcagagacagaaccctaaatttatttcattcattttgaagattcaatggcaatgatacctttcaatttgtttctgctcagcgccgtaatttttgcattcatttggattttcaattattttcttccattttttagcttttcttcacagcgaatgcatatgacttaatattcaagaatatttccgtggtaaaatacatttttttttaattaattaattaattaaatatttct

SEQ ID NO: 19117 - DNA, 1922 bp, Heterodera glycines
  misc_feature (1917)..(1917): n is a, c, g, or t
ggaaagattttccatggggaaatttaccccttatgggggatccaattcagctcaatcctccactgaactactttttcgaagagagaacggtggaaatgcgcggatggacttttggcaacgaaacggacattggccaattccccgttttagcgacactttcttgtgcggtcgaaatctgtgcggatccgtgtgaacagagctgtttggacaaaattgtgagcacattttgttgtgctttgggtttgacaaatcttggaaaaacaaaaattttaaaatcgaaaaattcaaacaatgggtttacctgtcaaaaaatactcaaattttgcatccttttgggatgcggcaaaaaagggtattaggtaattttaaaaaaatcatttagttctaagaatcaccaattttgattaaatggatttttttttgttaatttatgttgtttttgttactatttgtccccttccgaatgccctccaattaaacaataaatggcactaatttatatataatttcctcattttttctttacagtctcttgacaagtgcagcctcaatgattttatcggtgacaaaaatgccacggatatttgccacgaaggaaatgccgccgctgttcagggcacaatcagtttttgtttgatgacgcttctgatgttcctctgttcttccactgttttgatgtttcagtgataccaaaaaataattttattttgttttttaataattctaattcgttaaagaatcaaataaatttttatttgtctccaacggattattatggtaaaactttaagaaattgttaggcattttgataataaattggttggatttgtgggttgggaggcgttctttatgaatttcttatccttacgaatataatgaatgcattttgcaagaaatagatgataattgtgacatttttcaaagtttttatcagtttattttatttgtttcttttatttctttaggagattcagttaaatttcggaatttaaattcattaatttttggtgttaaattgaaaatagtaaaaaaagaataaaatatttaattgattaaaagatatgacttataaaaatgcccaaagttttctcttttgaatggtaatgcaattaacacacaaatattgagccttttaaaaaaaattaacagacaaaaaaatttctctggtcaataggtttttttaggaaatgaataaataattgcatctttttcttaacaatgtttattcgttgttgaatttgaccatttcaatggaattgagctcactgtgtcgctttgtccagtcacgcaataaataaaacaaatgacacaattaactcattttgaggggttcacttgccttttttgaataaatttatttttttcaccggtttttatttttagaaccattattaaaaaaaattcaactttaatttaattaaaaatgccaaatttgtataaatttcaaaattaaaaacaccaaaacagtggctaaaaatataggtgtttttaagaatcccaaatatttttggtttttgacaaaaaatccttccagaaaactcaaacttttttgaacattgttgtatagttttttgaaattttaaaaagtcatctttagtgggtgaaaaaaatggccgaaggaaaaaaggacgaaatatggatttaccaacgcagaaattggtgagtgaaaattaaaaagaaagtgacatgtaatgaagtgttgttgtttttttgtctatttgctgaaatatccactgaataaaaaatattataaaaacaaaaacaaaattgattatgcgcttccggcaattagctaataaaaaggacaattcacgggggaatcatcacattttatttccgcctaaagaaatgaaaacatcctttttgttcaaaatcataataatgcttcacaaaatggccatttttgactgccgcganggtta

SEQ ID NO: 19118 - DNA, 3098 bp, Heterodera glycines
  misc_feature (3078)..(3079): n is a, c, g, or t
tctgaatgggtgcacaatgccttgactttctccttgctccaccaattgcagcgcgttcaaaattccgttgctgctgctgcttgcaaagtgcgaaaagtccgttccgtgggagttgcaccaataaactgaagttcccgcagccattgctcagttcggactgtcagttgaacgctccaaggcagcaaaaattcggaaccacttcgaaaattgggcgattctcgaatcccagtggagtgattgtacagagagctgtgcccaatacaaatgacagaaaacgaagggaacagcgggagcaattcaggcgatgatttcgaatgcggcacatgttccaagtagagacctgcgcagaaaggaaacgaatccatgtacatataacagtggaagaagtatgtagtcagtccattagggtttcccaggtgttccaaaatttaggcttttgattcataaagttcactgcttcctattggggatttagaaatgccattggcctctttttatgtaaaaaagcaactcaatttgacctttgcatttttcgagcaatctcatgtcatcaattcgctttcttccaaaactgaggattcccatttcgcttgagtctctctctcccctcccctgctcatataaatcataatgttccaaataatcggcattttcggtgggtgtcattggacgggaagacccttcgtcgccactttgtttcgttagctaaaatttggtcgcgttaatggtctcgttcccgcttttcttccttccacacctcttccgcttcctcatccaattcctcgtcttcttccgtcgattcgattcgctctttcctccgctgttcttcgacctcctcgtcttcctcaatgtcatcgccactaaatgctttgctcattggcacatcatcttgcgtcatcggttcaatgggagcttcattgcctttcggttggtccgacatttctaatccttcgccttcgtctgaaggaatttgggccgcgccgtcatcatcatcatcgaaaaaccgaatattgtactcatggggatcgatgacaacgttttcttcatcgtccacttcaaaatgggcttcgttttctctcttcgtcccacttggacttggcccttttgggttctgatcatcaaagaccattgtcgtgtcaaggtcctcgtcacttttagaggccctatttgttgctgcgtcgtgaacattgaacaaatgaaagtcgtaacgatccaaatcagcacaacaactggcaaatgtgaggtccgatttttggtaaaaagtgaagtttgcttcctgaaatttgctgtttacaatgaatcattctcttgttaataaaagaaactcaccttcagagaaaaagggtcgcttcgaatttgacgcgacagaccgcaattacacctaaagaaatgaacagagggaaggacagatgatgggaaatgagcagacaattaattacattgagtaggtttttacacccgaacagtgctccttccgagggcgcttttcatctcgagaacgactccccccgaccgaagtttcatttggcaagtcatggagctaacaataaaacaaaaggaaagggaataggcaaaacaaaagggaaactcactgtaaaatggcacaattgtcctgaattatcaccacaacaattaagtgattgcttcgattacaaatagcaaaagtgcacccgtgagagaaagtgtttcacatctttggtgcccatccatccaaagtgccgtgcagtccgttcggattcgctcgaccatcgtattttgctttgctttgcccaaagccctcggcgaacgacgcaccaattggtcacttaccatgttcaactaaagcaccaaattttaagagtaaagaaatgtaattccataattatgtattttttaaccgtaaaatcatgctcgagttgagagaaggcgatgtcaccacctcccgtcacattcggctgctggttgagctgactcttataaagattcatgccgaatccgacggaagaatcgattatgctaaaacagtttggcatttaaagacttgataacaattatctaattaagcacctgttaagcgtgtcgacttcctgcagggaatggcgcgaaaatgccattgaatatccgtccgccgccccgtccacaaacattcgcttgaggaattttgccgcttgcacaaagtcattcagactaagtgttgtgccaatatcttccacaattttattccgaatatttaaaattgctgtgtgtaggaaatagtcgaaattgtaatcggaacgacttaacactaattttttaatgagaattaaaatttagcaaaagacgtacgtacactttttgttttttggatgcaattccaacacagtttcaattaatttctgaatgcgttcagcagagaaatcttcgcatgactcttcagggtaaagggaaagcacaaattcattgtttgcatctttgggaagttcgtcgtggttaaaaatgtaaacgaaaggcgccccggaagaaattgtaatttggccaagagcattttcgggactaaaaattgtgggagtttatttacacggaaccaatcaaacaaaaagcgaattggaagacaaacccacaagcgattgtcgatgattccgtgttgcctcataaaatgtgaaacttgcgactcaatacatttctccattttttccaagagttccttctacaataaatgtatttgatgatgagaatgggatttagcagaaaggcatttgttacctttttagaattgcttagatcgattctcaacggattccgataaaagcaaaaaagcattttagggacagcaattcgaccattttcacgcagaaagggaaggttttgtgctgtgtgtccgtcgaggagatcgaaaagagcagttttaatcatactgacagacctcagcctaaatgtgaattgattggtatggtaaaataatcaaatataattgtttacagttttccttaaatcttttaaaattacattttattgaagtattgacaaaaccaaaaatgcagaatccaaaaaattgaattttcgactttgtccaaattggacccggggaacaaggttggtcgaaattgatgcccgattcgnntgtgtcacccaattcttct

SEQ ID NO: 19119 - DNA, 961 bp, Heterodera glycines
tttttttttggaggaatttgccctcctccaattttgaaaaaatttggcaaaaaagggagttaattttaatttttcataaaaaatttcattttttgggtgaggtgatttttcctcgatttatatttttttttttgtgaaatttcattgctataattcgtgaaaaaggtgcttgatttttttcagagaattggcaactcctcgcgttttaaaagataatgggcaaaaaaagcgtaaattttaatttttcccaaaaaattcatttcttcggccgattttttccttggtttaatttttgtgaaatttcgttgaaacttattataatgcctgaaaaatgcactttaaacgcggttgtgtgcgagctgattttttttttttgaaggaattggccctcctcaaatttcggaaaaattgggcaaaaaaaaaagcgtaaattttaattttctacaaaaaatttcatttgttgggtgatttttcctcgatttatatttttttttttgtgaaatttcagatataatgcgtaaacatgctcttttaatacggttgtgtgctgattttttcggtgaattggcgcttgtcgcgcattttgaaagattgacaaaaaaaaagcgtaaattttaatttttctaaaaaattttcatttcttctacggatttttccctgtccttctctccccacctatcgcagttttgtacctgcaattcagaattttggaaataacacttatactcgctgaatatcaccttacaaattaacatattttcttgggaatttctttgcgtctgtctacaccggaggatgcgttaattatttggaattaacgttggattagtggtaattaccctaaattgaaaaaatacatgtgacagttggattggattgatatatgtaaaacaaatagaaatctatttatgcacatttaaaatattgcggctctgctgaaaaatggagaattgtgaggaga

SEQ ID NO: 19120 - DNA, 1267 bp, Heterodera glycines
ttttttaatgagagtgaaatcgtagtgtagcgcccgcccaaaatcggaaatgaaaattttggggaaaaaaaaattgttttggtcaaaaaatgcacaaattggacaatgttttggcgaaaaatgctagtgtccacccgtccaatcactgtgaggtcagttccgtcccgtcaactccatcccagcccagttaaaaagccataagttttttctttaaaaagtttgctaaaaaaagttggctttctcaaaccatcaaaaaaaaaaaatccgttttattttcaaatggaggcattttggcgtaatggtggtgatggtggacacagagcaattggtggaaagcacgaagcgggcggagatgaatgtgtgaaacaaaaggaggggacggtcgattcgatgaagcggtggtgaaaagcatacaaaatgcgccgcaaattgggattgatcaaaatggggacgggacgtgcgggggaagaggtcgcgcgtcgccggcgatcggatttgtattgattgatgatcggtttaagaaattgtgggataagaagacagtagagataagctgattagaaaatttaaataacatttaataaaatcaatgttttacaattgaatggaaaatttatcagcgatttttgagaaaaaatcacgtcctttgcgattggattttgctagatcgtttaaagctgatgacaatttagaggcgagatcagtaggattgaacaaaatttaagcactatcaaaaaaataaaaagcaaagtttaatataaaaacaaaacaaaattaaatatatgagaaattttcgtattataattttaatttaaaaataaatcttataatattaattatatccaatatttgaacaaaaattttcaaaaaaatattaatttttatgtttttcaattaaatttgaacaaattttccacaatgttttcgatcaacagatggatgttgaagggggaggtggaaatgtaaaattaaaatattaaaaattaggtaaataataaaaaaattgcctaaattatagcataaattttctaaaattttctgatcatgctcagcagatacacattaccaagcagtagcaaagcaaaaataaaaacaatgcatacgaacgaaacgaacacacacacacacaaaatgatacacattcactcaccactcaccatcatcactcatcagcaccaaacattggcggagagtgggccgaaagtttccccccccccctgccaatgagctctatttgatccgatccgatcgcaagataaaagcaccc

SEQ ID NO: 19121 - DNA, 1590 bp, Heterodera glycines
  misc_feature (98)..(98): n is a, c, g, or t
gatgaggttgaaaaataatataccatggcatataaaaagagcaaatatggtatttggtccattggacagatttttgccataattttcatattttttgnaaaaaaaggatgatcgaacataataactatgaattaatacaagtaaagtaaaataaacaaattcaattaaattcgttaaaagatttttaacgtttttcaaaaaatcaccgcaaattaatgtaactgttggcaattgaaattctttatgtgcttttggcatttcaaattttgttctgtttggcaatgctgtcgctttcttaacaattattttctctgatcttcgaaaggtattttaaaaaagatatgacgactcttttgcaattcaaaaaaggaaaataaaattaaataaatttatctttatataactcttaaaatgggctctgactgtctcgcatttgcccggggcgcgaaacattgcgtgggaagtggagtagtcgaaccgccggggtccctcataaaattacccgcttacagtaattagtattaaattttaatttcaacattaatctgttaaatgctgctctgctccgactccgtgcttctgctcaacatttcgaccagcctctgtccatttcaacttgttcagtttttggacatgcacaatcacctaatatttgttcaatgcatccgcttatgtgagtagttttcaatcatttcactcaccggtgaacactttttctccatcatttttcctctccgacattttaaggtccatttttatttattcctttatattaaattatttttaaatttttcggtttttctttaacaacatttcattaacgccattttaaaatatcaattgaagagtttaattttcacgaatatattttgctcgatttcactagggcctctatttgcctgaaaatttgaaaacttgtataaaatctaaaaaaattgtaaccaaaatttaaactttaacgttattgaagttatgcaaaataaaaaaaaatcttgaatctctatgcaaacttttcgttacttttggtaattttatttttcttattttgcaatttaccagaaaagtttggtgcccaaatttattcgccgggattttaactcaaaaaataacaaattgtaccaaaatccggaacgcgaaatttcaactcctctttggaaattgttatttagagccccaattcatggttataattagggcgcggatttttaggggcgaaaaagtccaaaatagggacctaaataggggcaaaaaattcgcgaaataggggtgaaaaagtttcaaatgtaggggtgaaattattaaaatgattgtttttgtatataataattaaagcctaaagcaaaacaatttgtttattgattataattgcaaataattatttatattcgaaatttttgaatattttttcaaaataaaaatttttgaaaaagtagccaaaaaatgtgatcgcgttaaaaaaatatttgttttaattacatttttgttaaaaaaattgtgaattttatattaaaaaaaataaaaatcgcgaaatgaaggcgaaaataggggcgaaacgccaaaatagggataaaagcttattttaggggcgaa

SEQ ID NO: 19122 - DNA, 943 bp, Heterodera glycines
tgatttttggaaatcgttgtgtcggcccatttcactctcctcgctgtcaatttgtcattctgtaatttagagttctttttcaaaacaatgctttacaagcgaacatttagcccaaatgaagacataaaaaaacattcagaagggtttagagccaagtaggaaaagttttgggcatctctttcgaaattcaggcattaaatcattaaaattcggcatcccgaccctcaaaaaattatgaggaaactgaatcatcattccagaaatttgcgcgtacatatgaaaattaatatcaattatcatcattattttagcttttattattcatgatgtcacttccaggaaagccatttaactgttggaattcttctgcttgtcacagtgacctcgaaatcactgatgataagtgtttggcagtgcattataaggaaaacgaatacggtatagtttataatttacaataaaatttcgaatatattttttcaaaattttttattaaacaaataatttattccaaggggggcatatattcgagagtggggttttattcaagggtggggttcgattgttcaacccccctttttttttacaaattcctatgattttacgcatgaaatttttattaatttttgaaatatctaggtcaacttttttggctttttacacaatgatacaattaaatcttaacctgaaattttgaattgaaaatttttcaattttgacccttgaaaatataagcgaatatttgaaatagaattttaataaagcccccaccctttttttattgaattttatataattaggagtctaaaaatttttttgaaaaatttttgtggtggggttataatcaagggtgtcttaggggggagggtggggttatattgttcaaccgccctccccctgtggagtatattcgagggtgatattctaatcgagcaagtacagt

SEQ ID NO: 19123 - DNA, 2215 bp, Heterodera glycines
ctgataagagccgctgggaaattttttttgtaattttaatgctatttgttagcagattttgtctaaaaatgccaaaatttgagatttaggctaattttttaaataataatttgtacgatgccgacgacgacaaatggaaaatgaaaagagtcataaaatgaagtcgaactttacttatcaaattttctcaatttaatttaaacagtaaaaatgacggactgggacactatagtctggccgttatagtctgagccaagtttagagcatcataacttttttctttactgaccaaatccaacaaagttgatatcattcgaaagctcttaacaagctctcgaagtcaaattacattttcaaaaaattccccggcggctccttaataatgattctttctaaaaaatattcaaaaattcaaaatgtttcctttaaatttaattttacttaacaattgaaatcactgaataaattatttgcttcggttaaatttttttaaagaatggaaatagcagaatgagacaaataaacacactttgtgcacattcacaaaagactacggtggggcaaagagtttggcctttggccgaccgtcccccgccccagggccataatgtaaatgatcgattataatcatccgatccaatgcaatttctgacaaaaaaggtcattcattctcgcgaaatgatggagaaaaagagcaaaggccaattttatactgaatcagtcgcctatggaacggcccgtcccaggggcagtactcaaaatgcgactgccgggtcgtttcgtaaaactgtcaattgccaagagcatttcctaaaaactgccttggtcgggagggagcagatatattcgggtagagtgtaatttgtgagccagggcgtgacagccggctgagttaaattaggtgggggattgagttgatataaacctaaagttggttaaaatgattaaacaaaactttttagaatgatatcacaaaaataaaaagtaaaagtgaaaatgtgtgtaaatgttgaagaaaatggccactttgattagaagaggtgtcgatttgggacgcgaacgtacagctgagttggaagaaacgcacgcaatgctgaatgttggccaagcagcaactgcaaatcaacagagaaaggaaagagtgcttggcagagagaaataaaaagaaaagagtgtaagcagagagaaaacgaaggaaaagaatgtaagcagagagaaaacgaaaagaaagagtgtgtggtagagaaaatgaaaagaaaagaatgtatggcatagagaaaatgaaaggaaagagtgtctttggcagagaggaataaaaagaaaagaaagagtgtgtggtagagagaaaatgcaagggaaagaatgtatggcatagaaaatatgaaattcgcctatttttttttttgatattcctaatgtgtctaaatcagggctcccaagttttttttcttcaaaaaaggacaattaggcgcaataacaattggaaattgcattataaaaatattctcaaatattttgattatttaatggggaaaagaaaacaatcaaatccgtattgttaaaaaagtaaaaattttaattttatttatataacatcagaaaagctaaatttaaaaaatcgacaaaaattgttaaattttttagaatgtaccaaattaaaagtaaaaatgaaataaatatatgtgctaaatgtttatgaaaatggccgctttgattaggagagcaatcgaattgggacgcgtacgtacagctgagttggaagaaacgcacgcaacgaatttaaagaatgtaagcagagagaaaacgaaaagaaaagagtgtgtgttcgaagagagaaaaattaaaggaagttacgataaattttctattttttacatttcaaaacaataaagttggtggccgatcatttcgtcactgagaaataattttaaaaaattttagttaaatattgaaaattttttgctttaaaacttttttataattgacatttgctttctcgcaaattgcggacttaagtttttgtttattttttaaaaggactaatttgagtcatcatcaacagagctttatggatcacatcaaaaaatctgttaaaagggatacttaaagaatttcagcgattgtaatattttgttgctgagtatgaaaaagcgcctgcgaatggcattagagggaaaggtcttaagcgtaaatctctctatggtgatcaagacaa

SEQ ID NO: 19124 - DNA, 1221 bp, Heterodera glycines
tttactttttccccaaaaagttcgaatcccacgattttaatttaattttttttgttcccaattaaatattctttatcagatcattatcaaaatacattgttttgatctaattattttttttaatttttgctaaagaaattaattcattttttggacgaaaaatgtatgcaaacaaaaatgacctagttcgcttatcagcatggggaaagtgctttcgggtggaccttttatatcataatttagaacaaatacctcgagacttccccccccccaaaaatgccaataaatccgacaaatgtaatccatttaatggtttagttatacctgcattaattggtgctttcggtaattttttagttccttttttatttttgcttccgatgattcaaaaaaaaataaaaaattcaaaaaaatagaaaaaaaaagattaataaaaaaaaataattaaaaggaaaaaattataaggaaaaaaaattatttttttttaagagtattatcatggtaatgctccaaatccatcgccaataactgtcgaggagaagcaattaaaaacttcaaatcatccaggaggattgtttctcgaaaggtttttgaaataagccatcactgctcacattgcttttcctttctttgcaaattataaagggaagggaaaaaggaaaagccgcataactcggcgcacatgtccattcagcaaaaacggtaaaaaattcacataacaaacagggtcaatctacccacccaccaagtttcatcccgaaactccacattcacttgggggcccctcctttgtaagggaatcatttcggttgcacaattgcaaatcaaccttcaggcgtattttgctttttgaaaagtcgattcttttagggagtatattttgtagaaatcttttacctaggtcgatctcagtgcatttttatttttttactgcattttttaaagaaaattttttgttcacaaattaaataattgaaaaaataggttttttttaaaatttaacaagccaaaatagtattgacgaaaacaccttaatagttttaaatatttgctaaaaaatcgttctaattcgaaaaccgttgcggacgaaatgtggttttcgtgcgtctttcgttaagcactattcacgaaaaagaggttaaacccgtaaaaaatctcgagccctaggtagatgtgtgagaaaaagatgggaccaatttgggaccctgccaggccatgcca

SEQ ID NO: 19125 - DNA, 1457 bp, Heterodera glycines
  misc_feature (1216)..(1216): n is a, c, g, or t
  misc_feature (1367)..(1367): n is a, c, g, or t
  misc_feature (1414)..(1415): n is a, c, g, or t
atttccttcttatatacgcgttgagaggaatttctttattttttgttagggtgttttttggtcaaaaatgggtatataaaagccaattttttgcctcctctcaacataatttgaactttcatccaaaaataatgcctttcttctccgcttccttcgccgtcctttttcccatccaacccatccaaattatttgtgttgcatttgccgtatgcgtcgtcctgctgagtcagtgctgcatcggtggtcgatcgaaggaaaatgaggcaagttctgagcccacccccccccccccccccataatcaaaactcaatttttaatattcacttttttcagccggagcaaagcatcacttacgtcgacttgaacagcgcgattctcggaggaacggcaccaccggtgaagccgatcgtgggcactggaacgaaagacgacactggaaagaagggcgagcgaacgcaatttttgaattggttaataatttttctttgtttttcaggttcggcgcattccgaagccaagaagcaaccgacaaagccaaaagcagcggacaaagggaaaaaagtgccatgtaggtgttcattttttaatttgaatttatactgattgtcctcccattttagcaaacgagcctgcctgtgcagagaaagggaaggaagtgccggcacaaaagggtgaaaaggagcaccaggcgaaaggtgggcaaaccattttatttaatggcatttaatccatccctccccattttcagatgccaacaaaccgcaattggacacgagcattgctgtgaagaaatagtgccgtcaacagatgagcctaatgaattcgtgcgattatgaggaaattgatgatctccaaatgttacaatgctctaattgtcatgttatttggcctgttttgtcatatacatattcactgttgtacataatttgtatgtgtatatcgtattgcttgttatgtctccaccggaaaaaaagcacataaatcaccttttatgttatttaaagcaattctgacaataaaaaagaaaaaaaaaatttgacccaaaaggcggacccaaaccgaaagagtaccttgaaagctcctttacatactctattagccttacaaaaagcaaaaaaaattcaaccctggaaaaaatttatgatgaaaaaacttcgaaatattgttttttagactcaaattgctcttagaaacaatgatttgtacaaaaattanggggggttggataaaagcgtcactaaatcggcaaaatgttcaacaatacgtctctaatttttgatcagcaccgagccaaaacgaaatcatcctttatcgtttaccaaatacacaatatcaacacacaaagacaataataataaacgctcancattacactgataaatggtgtacaatagcatcgacataaacatatanncatacatataggcatatacacacatgtacaataatattatcc

SEQ ID NO: 19126 - DNA, 3037 bp, Heterodera glycines
  misc_feature (2343)..(2343): n is a, c, g, or t
  misc_feature (2767)..(2767): n is a, c, g, or t
  misc_feature (2777)..(2777): n is a, c, g, or t
  misc_feature (2784)..(2784): n is a, c, g, or t
  misc_feature (2788)..(2788): n is a, c, g, or t
  misc_feature (2800)..(2801): n is a, c, g, or t
  misc_feature (2806)..(2806): n is a, c, g, or t
  misc_feature (2810)..(2810): n is a, c, g, or t
  misc_feature (2818)..(2818): n is a, c, g, or t
  misc_feature (2827)..(2828): n is a, c, g, or t
  misc_feature (2834)..(2834): n is a, c, g, or t
  misc_feature (2840)..(2840): n is a, c, g, or t
  misc_feature (2843)..(2843): n is a, c, g, or t
  misc_feature (2845)..(2845): n is a, c, g, or t
  misc_feature (2847)..(2847): n is a, c, g, or t
  misc_feature (2863)..(2863): n is a, c, g, or t
  misc_feature (2896)..(2896): n is a, c, g, or t
  misc_feature (2912)..(2913): n is a, c, g, or t
  misc_feature (2919)..(2919): n is a, c, g, or t
  misc_feature (2927)..(2927): n is a, c, g, or t
  misc_feature (2936)..(2936): n is a, c, g, or t
  misc_feature (2939)..(2939): n is a, c, g, or t
  misc_feature (2969)..(2973): n is a, c, g, or t
  misc_feature (2977)..(2977): n is a, c, g, or t
  misc_feature (2984)..(2988): n is a, c, g, or t
tggttataatttttctttgtttttcaggttcggcgcattccgaagccaagaagcaaccgacaaagccaaaagcagcggacaaagggaaaaaagtgccatgtaggtgttcattttttaatttgaatttatactgattgtcctcccattttagcaaacgagcctgcctgtgcagagaaagggaaggaagtgccggcacaaaagggtgaaaaggagcaccaggcgaaaggtgggcaaaccattttatttagtggcatttaatccatccctccccattttcagatgccaacaaaccgcaattggacacgagcattgctatgttatttggcctgttttgtcatatacatatatacatattcactgttgtacataatttgtatgtgtatatcgtattgcttgttatgtctccaccggaaaaaaagcacataaatcaccttttatgttatttaaagcaattctgacaataaaaaagaaaaaaaaaatttgacccaaaaggcggacccaaaccgaaagagtaccttaaaagctcctttacatactctattagccttacaaaaagcaaaaaaaaattcaaccctggaaaaaatttatgatgaaaaaacttcgaaatattgttttttttagactcaaattgctcttagaaacaatgatttgtacaaaaattaggagggggttggataaaagcgtcactaaatcggcaaaatgttcaacaattcgtatctaattttcgatccgcaccgcgccaaaaagtcatatcagcctttatcgtaccaaatacacaatatcaacacacaaagacaataataataacggctcacaattacactgataaatggtgtacaatagcatcgacataacaatatacaatacaatatatgcatatacacacatgtacaataatattatccatgaagatatcatatggtgccggttccaaatatatccatcctcctcctccttgcgcttattgttcgaagccgtacatcaaattgccctggcgcttcagtgcgtgtaccacatcccggctcttcatggtcttgcgcctctcgtgctgacagtagatggcctgaaagcattgggtgatgtgatatatcgggattaatcattttttgaaaacttaccgcgtctcgaatgatggtttccaagtacgagcgcagcgcggcacggacctcgtcgtagactcttgcgttgattcgggcgacaccggcgcgtcgggccagacgaagaatggacgctttggtgattttcttggcactgtcgcgcagctgctgaaaattgactaaaattaatgtcaaaatcagtttgtggtcccataaaagaggaaaaaaggaatgagcggctttgtgatgttttaggggcttttcggaggcgctgtatgaaatccatttcgaaccccgaactcggattcaaacaaactcgaaattcaattttcggcaaaattcaagttatgcatcaaaacagttcaattgtaaccgaaatactacgttctccgttatagctcgtgcattttgttgcataatttgaattttgtcggaaattgaattttcgagttttggttcgaatccgggtcaggggctcgaaatggatgtcagaatcgtgttctccatccaactgtcttaccactcgtgtgcgtctctcgcctcggccgcgtcgctgtcgatttgcagcagtgtccgtcgtcatgttcgttcacgaagtgtcgtcgtcacagatgagcaaaggggaggcgaacaacagtcacagaaggcagaatttgtaagtgaagaaaataatgatggattactgcaaatttttgcatatttatacacttagacagcgtttcaaaaaacgagagatgaaccaataaatagagagtgccagagaaaaaaatacctctcattttgatgtactctttctttgtctctctgttaatagagaaaaactaaattattgtggcacattttgacgttacaaaaaatattcgaaattcgtcggttggatcttgaatttcgcgttttggcccaaaaatttggctactaataaaacgaattggccataaacaaatcgtccttcgtccatttatataaagcgaacgattcgaacaaaatgctctcattcattgcgtccgtcaatattttcttcattgtttttacgctcattggaaaggactcaaaaactggcgaatttggcgctgttttcgaccaggacaaatggcacaaccaaatgtttatgatcagcaccaatggacgaccaaccgaagaacagaaaaaccaattcatggacgaattggccgcgaaattgccatccgctggacgccatgtattccaattacggtccgtcagaaaaaccataatagcgatgaataanatttcatttgtttttcagatttggccatttaactgggttcgcctgtacaaaaatcacctcaacaatggcactttgttttatttttccctcctattttgttacgcattgatgtcgcttgtccttcttggcatcggcttcaatataatgcgacgctctgtggaaaaatataaagtgagcgagcgcagaacacgtggccacagcaaattcaatccgacaaaaccgcgtacaaaattgcttttcaatcgaaatccgatggatttttttttttgataaaatgatatgtattgagcttttgtcgtcgcgttgagtttcttctgtgttcgctaagtatcaaaaatcattgaccattgcgtcgcttaatttgtattgttttttaagttcaccttctatgtcggtgccttatgttctgtcttctgctggtatncatgtgctgngccttcntccnccttggtgctcnnttggncggncttttggncttgcgtcnncttccnagcggntcncncngatgtgccgttcgtcnctttggtgagtttgtgccgcttttgccctttgnttttgcgcctttttcnncttttnggtgcttngccttgtcntgncgtgtttgtccttctaaggggttttcttcnnnnnttcnctgttcnnnnnattctttagagggcgatggaatgatgttatggatggatggatatatgat

SEQ ID NO: 19127 - DNA, 1193 bp, Heterodera glycines
cgctcaactctagttggaaatatagccacggggatttatttttttgggcatcaagttacattatgtcccgtctcaaaagcacaaccaatgaatgactaatactcaatttggatcactatttaccaagtttaaataatttttccttattgtttggtgtactttttcagcttttcttcccttatccccccccccccccaaaaaatctctccccaatttctttcctttcattttttctcattttttcctccgacaaaagtgtattaagcttctcattaagcacttattgtatttgtgtgaagccgacaaaaagtgccaaaaatataaatcaaatgatggaaaaacaaaaagcggatgattgcacttttacttttgcgctgtcgtcgcgaggcaaagcgaagttaattagaggttgggttggctgtgtttggtcggttttgcagcagcagcagttcaaatttaatgaggttgccttggcgatggactgaccgccgctcattttccgtttttcgtcggcggttggcgttgtgtcgctggggggatgacaaattcgccgccggtgcccgccaattttgtccgcggcaaaaagccttttgtgcgcgactttcgtcgggcggacagacggacgaagaatgggtgaaatttttgttaaagcttatgttagtcgagcagatgcctttgatgtgttttcttatgccatcttcggcatagttttagcgattggctgacattggcatttggcggaacattggcattaatttcacatgtgttttttctgtgatttccgctttagccctcaaagtcttccgctggcgtttactccatgaaatttagttcaattagcaaataaattgggtttttggctttgtttttctccctcccccttcccaaaacagttaagtgtgtaataattagggatgggtcctatttctcctatccttatcccccaaaatcactcagttccatgcccacataagcagttgaagactcatccgtccaattcgaccatcccttccattcccatccgtccgtccttcggtcgcttctctcagttttcatcccctcggggaggctgcgctgggggcgacatgtcatcgtccgtttccttccctctcctcttttcgttcgcccttcatggcttccccccccccccaattttccctctctttccttcccctttcttctgctgctgtgct

SEQ ID NO: 19128 - DNA, 1158 bp, Heterodera glycines
  misc_feature (21)..(21): n is a, c, g, or t
atttttaaaatttaaaaattnttttacggaggtataaccgccccgggtgctccgtggggcctcatttgccttcgctacgaaattcgtacgattaaaaaaaaaaaatttatttttcattttaacggtacgtcttttaaatatttccaggcacaatgaatatcgcctccggaaattcagcgcgccacgaaggtatttaaatgagttttatttacaccgttccaagttcaccgagggaatcggtgtcgccgtcgggcaaaatttaaaaatagaaatttttttttaaatttgaaactttcatgacatttgtccaacacatcgaaaatagaaatgttattaaaaatgaaaatagttaaatctttttattatatatatatatattatgatttaaataaaactatgcaaaaatttttatttcaagaaaatttgtaaataaatttatgatttaatttctaccctcctgcttggctgaccattgattttccaggacattcaaattagcttgtcaaaatttttcgatgcaattcaaaattgactcgaatcgaaaattgtttttgcatcattaaattttcatatccaaaattggtctataatttatatttccatgcattttaaagatgcaagtggaagcggaacggaaaaagcgtgccgcaattttggagtcggagggcatttgcgaggcggaaaagaaccgagcggagggcgagaagcaggcgcgaattctgcgctccgaagcacaaatgcaagagcaggtgtttcaataaaagatttaattccaaaacttgaagagcagaaatgaaaaaaaaccggaatttaaaggatttaaatgatttttgaattaaatttgaggagaataaattagcgaatttttttttgtaaaacacatgaattaattaacaaaattatttaacttatttattattataattgttgtagatgaacaaatcgatgggtttggcaaaagcggccgaagcagagaaaatccaacgcattttgcaatctgaggcggaaatgcaaatgaaagtcagtgaactaccacaaattaatttttgaaaatattttttttctaaattactttaactgagtcaacactccaaggaccctttgataattttataacatttaaaataagtaaatttattaattcatttggtggtatta

SEQ ID NO: 19129 - DNA, 1396 bp, Heterodera glycines
aaaattttgaaataatttcccaattttcgatttttttatatcaaactttttttcccgccaaggttaacatggccattggacttgccaagtcggccgaaagtgaaaaagagtcgcgcgtcatattagcggaagcggaggagcaggagcaagtgattgtcagccgtgggttggcgtgtgccatcgaaacggaggccgaagctcgcgcaaaagcgttggaacgaatggcgcaaggaattgagaaaatgggcggcactaatgcggctgcctttgtgacagccgacaattacgtgaaggtgagtggggacgcgaaatttaaaaagaaaaatttaatttgaattaaaattgattatgaatcgaaaagactaccgtattcctacagttcctccaacccttacagtggtaggagaacatcggtcctaatttgtaagtacagaaaagtgtttgaaatacttacttaaaaatagtataaaaatggcaaatcgtgtgttaagagatcagtgaaccaaaccaagtaaaaaaaaagttgttgggttgggaaaaaaaccaatttatccggcatcccaaaacattccgggttagttaatcggagtcgggtaaggcacaaaaatttttgctagcgatggcaaagtacaatttttaaaattatttcatataattattttaatttaccgccttaggcctttgccaacttggccaagtcgtctaacacggtaatcatcccgtcaaacagcatggacatcagcggaatggtcacacaagcgatgggcatctacggcacaattgccaatgcaaacacagccaacaaacactgaccatttttattgaataaaaatcatacaaatcacaaaaatgatgttaaggcgtccgcaatttttggacgcaattgtttccattattaatgtaatttaaatgtgaaattgcatttttatgataatttcgtctctgaacgaaacatatccactggaatgataaatgcattttttaattcatttttaaatttcattttaatgtttattattatttttattagttgagcctgcctttttgaaaaaatcaggatcaggattcgaaaatgcaatgaaatcctatcccaaaatcaacaggtccttattaccaaatttggtttatgcttacaacttttgggtgtatcgaataacaatgtactagattaaaatgcagataatttacaagaaattgaatttattttggagagttcgaataaattagcgtagcgaaaaacgttgaagctttttttcgaaatcacggattgttgtgtgtatggtttgagtttaagacgttccgttttatccgtcgcggattaatggtcaccaaacggccagcggatgcacgaatgtcagatctgtgaaaattggaatttgaaatgggggaatttacc

SEQ ID NO: 19130 - DNA, 3156 bp, Heterodera glycines
  misc_feature (107)..(107): n is a, c, g, or t
  misc_feature (189)..(189): n is a, c, g, or t
caaaaagttttgaaaaaatcgcgctgtaaaaaacgtgtaaatagtcacctccttttcccaaaaatgttctaaaataatgaaaaatgacaaaaaaagattttgataanataatgcataatttttcaagcgaatataaagtactaaaaacatttgtgaaataccttttacttggttaagaattaaaaaatntagcctattaaaatatttagaaatttttttattatattgtatattttttgaaaaatttccgatttctcagccccttttaatgcatcccgccagcccctaaaaatttatttttcagcattttttgatttttggaaattttttgaatttaattgaaattttttcgaattttccaaaatcccgcaatcccgcacgggatcccgcaaattttaaatgcgggatttgcgggattaatcccgcgggatcccgtcccgcaaagaattttgagttccagtcccgcagcgggatccgcaaatttgaaatttccggtctctagtttatatggttgccaagtgaggaaaataattgtgtaaattagtagtaatctgtgaattttgttaaaaattgcattttcgatttattgttcgggtccgtggtcagaatgattgtgtcataattggattatccaatcgcgaacagcccaaaagtcaacttcaactcgaaaataattttaattttttttctaaaaacagggaccgaccaccaccttaactattacccagatttttaattatatttttagaaacaggaggccaatgatttgtctggcacttcattctccaaacaacaaaatgagtgcgacactcaaaatcagcaaatcaaaatggaaaacaagagcaattctaacatttcaaaaaagttacaaacgaaaataatcagcaattaattaattaatcaaatttttttggtaattgcctgaacgctgcgattttatatattttagcttcgttagactgtgtgctttcgaatgatatcaaaaagataggatttgttcgaacatggaaaaagttattgtatgaaaacccgggattgtcaattgattggactcataaagtgcattagaaccaaaattattatgaacataccttcaatgtttgcaaaaagaagtgccagtgtggatgacaaaaaattgctgctggcaaatacatcttcaaaaaaatcgtctgggaccatcttcatttggaagtgaaacactgcaaacaattcgttgaagaattgcggatgcgattgaagagcggaagtacaactgcagaacaaatggacaagccgtttccactggtcgaagccttcgtaaacctaatagggcaaaaaaacgagtaaatatagacagtaagtcattttctgtcccacctgccccacgagaaaaacgacaaaagcaaattggaattctgcaaggacttcgcgataatcaccgcccattgcttcgaaacattggaaaagtctgtcggaactgtcaatgcccgccctccttaaatttgtgtcagccaactaaaaacaaactatttgttatttttaattccgcatatttttttctcccattttgttctcctcctcactgtgatctgcgatatccgagtgaagttcagcttcgcttcctccccttcgctcatcagcggaagtccgccttcgtccgtgaagcgaatgcgcccgcggtgttctctgtccacaatcgaaagaccaaagggatcaccctgaaaaaggcgggaaaatggaaaaatgcgttgcctttgtttgcattctcaccaatttcttctccaatttcgcctcctgcgtgaccatttcattttgggacgaaatgcgtccgagtgaatttgagggggaaagacgacggacggagtttggcgtaatgtacgacgaaagggaaagccaattgcgatagtcttagagaaatgttaataaagcatgccaaaattttcttaagttttccccagtgaccttaaaagatcatcattttttaatgtacctgcgaatggataaactcccaaaaagcgatcaatgtttctgagattctcgcgaagtcgatccaactaaacaaaatgaagaaaagacagacaatttgcctaattcgaaaaacgcacttcaacttcgtccgacttttcgtcagtcaccaagtcttcctttttcgtgtcccacctcctcaaaatcacttccttttgccgaaaattgtgaaagaaagcaatgcgaggcgcacccggtacactaaaaaaagaatgaataaaaaggaaataaagaaggaaaagacggggtaacttttcacttttcgccacataattttttttatttatttgtatttttcttgggtcttcgggggcgctgatcacgaatatgacaatcatttccattcatttaaaatgccggacccgaattggaaaaaaagacgtaaattaatttttcaccaaaattcacatttattgtccaaaaccgattcaaatagacgggaatataataaaaaaaatagagattcatagccattttattcgtgagcccccgaaaacttcagaaaaaagaaatttatgtggcgtaaagtgaaaaagtaccaaagacggcacctaaagtaaatgaaatgaatgccaggaggtatcatctgcaaaaaggaaattaaaagggataaaaatgaaaagcgctgtttgttggccaactttcatcccgaggaaatttgggccgacaatccacgagcgataatccatgccgaactcacaacccttagggaagtccttgaagatcttaaatacaatatttttgatatttactgtctagtaattgagaaatgaaaatggactgaccaacacaccgccgttttcgaacaattccaacgccaattcttgcgacatttccccggtaagagaaacattttgtagctgcgactcgttcatggaaaagatgggaacaaaaaaaaacaaataagtaagtataaattaaagtaaattcaatgttaatggatttaaaccaaatacaaaatattcctccaattgcgaaagcttttcattatcaaaaatgttttttgggagcaaacgacgacgtacaaacaccagtgaatacaaaatgtaatttaaaaaccggtttctaaattatgggaaaataacaaaaatggaatggaaagaaaaaatgaactgacgcttattcaacttttgacttttttagatatttaaa

SEQ ID NO: 19131 - DNA, 1114 bp, Heterodera glycines
tagggctatcgaatgctactaaattaattcaatttggacaactatgaaaagagttatgctccaaaaatcgggctggcgcccagttggttggcgcccaatcgtaccggtccgttcccggaagcgatttgaagcagacccatttaacaagacactgtcagatacaaacaaaccctgaacacggtgtctccgtagtgcgtcacccattctccgtccacattccgagtcggacatccctcccctgttgtggtattcaattgctttttctgcttcaaccaatccttcaccttcaatgtgaagttttggcgtgataaatgtcgtttcaaatggttcttcagtgccgtcctcgttggcctccaattttgccgacttttgctgcccatgaattcgcatctttcgctttctttcgtccgcttttcgcgcctcctttccgtcgtcgtccatcttcaaattgggcccgttcagctgcttctcctcgcttttcgtccacggctccaacttgtcctcgtcattcactagcatttgcgtctcgtttttccgcttacgcggctctcttccggcttcgtcccttccgcgtccgtccaccgcggtttccgcctcccctcccgcgttgtcattgtccaacttccgtgccctttcctcctcctccttcccttctccattagcatcattcatcaacttccactggtatttctcctttttatgttcattcccctctaaaagtccactacaattttttgccttcgccaaggttaccgtacccttcgacatgtatacagaatcccgctgtgctactgtcgtccccgatggatttttgtgatggcgcccaatttttcgccgcatcgcaaatgggtcgccaccgttttcctccctcctctccgcagatgtcagtacagtcacttcctcgcccatttccatggcgcccttctcgcctaatttcccaagatatacaagcacattgttgcgtcgatcatttgcgacagcattagccgcaaatgagttgtttcgccttgggtaagttggcatttcaagactgagttggccgctgcgcaactgttcattgatatgacgacggactacccctgaacgcaccgaattctgattaatgatcagactt

SEQ ID NO: 19132 - DNA, 1707 bp, Heterodera glycines
cccccccccccctcccgtttcaccggcagtcgttgtccatgcggcacaatttcatcgattgtgtgcatgtccattgcggttgactgatcgcttctctttgtattggcgattcgatggtccaattttgtcgctctgagcaatcattgagaaatggaaactaagaaaagaattttcaacggaaattgaattgctgaattttaaataatttatttttctacagtatcaaatttaccgtaccattgccgtgtgacagtccgcgtcatcactcgcacattcgcagaacacctaaaatgtacaaaagacttactgtactgcatgtacagtatatttttggtaatttttcctttttgaattttaaaactctttttaataaatatattctttttaaaatgccatgccatcgcttgcgaaagcggagcgtgcacaaaatgcacgaaacggtgcaacgcttgcgcacaatgcgcgggccgtctgcgaccgcaggcgccgcggtggtgaccgcatttgatgcgcaattcgctcaaatgccaacggcacggctcgtccatgtcgcacagggaaagcaccgccgggcacgacgacgcccaaccgatgccattggttgtcattgcatcggaaactgaaagtaattacaaagcaatttgtcatcatttttttatttttaactcgtttttaaacaataattaattgctatgtttaaaaaataatttatttaaattaattttcaaattttatggctgtttttccccaaaaatgactttcaatttctgctaatagtaaagagaagaacagccgccagcgcagttttgtccacattttcctttatttgtcggctttttcggttgtccgattctttcgccaattcttttttcgtaatttccggtggctttatcccccggtccaacttcatttagcaagtgagaagcattgggaaggggaggggaggacaacaaaaagcattggtttgaagctgtggtgttcagaagtggcccatcttcaccgcttttgcctatgtttttgtctctgaatggccaaggtgttcgctgatgatggcccattaacgatggtgacgcgctcaaatgggtttttgtggagggccaaatgagaggaaaagtgcctttggagaggggtgagggggggggaagacgaagggtataaaaggggaggagaagggacgtatttagcagttgggggacaaatgtggctaaagtgaagaggggccaaaacaaaatgcaaacagagattgccaaccgaaatcgaatggatttgtttcggcatttgtttaaaaaaatgttttgttcatttgcaatttgtgctgttcgttaaacaaacaaaggaatttgcacggcacacattccaagcaatttattcaaaagttggcccaccgcaggagtcaatttcgcttattcacagaatgctgcttatttgcaaaaataatttcaaattgaaagaaagggggggggggggtggaagaattcaagcaaaacaaactgatgaaaagccaccgagcataaacactttaaagctgattgactgatttgaatgatcagcatttttttaaataattaattaatttaattaattagcccttattcgaatgcccttttcattttgcgttgaatttcaccctttgatgcatttgtttttgactgcttttccccaaatggcgtcgttgtactgctcgctgttgtcgtcgctgtccccccg

SEQ ID NO: 19133 - DNA, 2238 bp, Heterodera glycines
  misc_feature (992)..(992): n is a, c, g, or t
  misc_feature (995)..(995): n is a, c, g, or t
  misc_feature (2160)..(2160): n is a, c, g, or t
gagaaggaagtcttgagggcaattgttgacgtattccaaagccactttcggcagaaatgatgggtgaagctgatgctcgtgctggtcgtagaacattccaaagttgaaatcgtacagtccacgatgtcctcgaaaaacttcctaaaacgttttcgttagctcctgcctcggcagtgtattgtagagggaaatggatggactatttgtgagacacatttatgatactaaacattaaaggagacaaactattcattcccaactactaaaaaacagacacataaacctaaatgtaaaagttattagacacataaatgttattcatctaattttaaacactatccatattaaccccagccgattctgactaattagcatcaaattaccgcaccacaagcatggtcttgcaacgcattggcaggttcttcatgaagcagtcatgaacactgccagcaagtcgacggaaaattcgaaagttcatgctaagatgagtttgccattcaagaagtgcctttggctgcattaaattcttcggcaaaatgaatggtttcgagtcgagttggaaaaaatcgccaacagaaacgatgtgcaagattgtcgatgtgtagtgttgcttattcttaggaacgtagtcgtcatcctggtcaacttccccaaggacaattttttcgtcgtcatcaatcaagtacagccatcatcatcattttccctttgatgttgatgttttgagccgagcggcagaccatcgtttgcttaaagggttttgctaaggtcaacatcattaaaggataaatacctttgcgtcgctgatgcgctgactcgaccatgttttcccttgcttcttggttaattggtcggcacaagacaccaaacatctcaaagaagtttgtcatggaggcttcctgaaaatgttaaaaactgacaacaggcataacatgtgacaaagattttcaaaaattcatgcacaaattatgagacacattttcattatattnccnaatcaggaaagacacgtgttactcaggattgtgagacacatttatgatactaacattatatgggacacactatcctattttcctaatactgccccgatatgcaggaaatggatagtgtgtctctgcaggaaatggatagtgtgtctcctcaacatcgaattacatttagaatacctcgaacactacaagttgaggcgcgtaaagtgccaagaatttaaagccctttgcatgtcaatagtcattattgtgacgttgatgtccttaaaataaaaataaatcaaatcaaattagcagctagcaccttaggatggtagggtattccgtttttgttggaacaataccacaaccgatgtggaacttggtctgccgaatatgaagccgcatatttgcgcatgattctgatttgcccgagtgtcatgcatttgccggaagtcggcagacttttttgaagtccttcagaaatttggaagaggtcatcgtccgaaatcagttggtctttgagtcgggaaatttgttcggctacgtggtctgctgcactgtttgtggcacaaacgatgagaatttgcggcttcatattttgcatgcggttccggcactcctcatcctcctctttgctgtaattgcacacatatgagagtgcagcgagaatggaaatgtgagctataagctcggtttttccattccctggtggtccctgaattagaaaattttattgactgaggtgcataatattaaaacttgaatagcagacaagccctctttgttgaaagaagccataacggcagacttttgtgttgtggtcaaatactcgatagaatcaagataacactgaatcgttggcctgtggaaggattcgacgacaaagcccgtatgtttgaactttcgaagtttaagtgcggaggctggtgctgtcgcatcatcggccatagcagattccacctcactaatgcgcttgccgagcatatagacaaaattgtccggcagtttccaaggaagtcccgacgctcggtagatttgtctacatgttaatagatttaaagtaattaaaaaaaagtcaagaatgtccaaacctgtgttctttggaaataatttcgaaggtcagtttctgcctcatcttctgcccatgtgattgttgtgatggtaatgccgatgcggcagatccggngtggttttggttcagccgattgttcatgtttgtcgtcggaaaaagtcagacacattgcgcacatgaaggcttccattc

SEQ ID NO: 19134 - DNA, 2356 bp, Heterodera glycines
aggtcttcaaaaaaatttttaagatttttccttgggaatttacgttttcgagttaaatttcctcagtattaaaatcggaaaacttccgtcatttccctcgttttggttttttctttttataaatttacaataacaacgacaaatattttttttgactttaaaaattttcccgcgtcggaaaaaataaaaaataattgcaatttgcaacgtttcctaagaaataaaaacaataaaaaatgggaagcggaaggcggaagtgtggcgggggcggggaattcacggctcgtcctgggcgcttccccaaaattataaaatataaaatgttgccaattttgagcaaatacatatgaattttgaatgataatttttattttttcataatataacttataattatttttctctccgttttcgcattttccagcagagtttttgaattttatttgtctttttccattaaaatccccaaaatgtctgctgaattttcgatttgtctgcttttgctgctgtttttatccttttctttgtcggcatttgccactttcgacggccaacaaaatttgacgacagatggccaatttttgggttgccaaattaagaatttaaagctgctgcaaacaaaatttatggacagaaaattaatggaaaagtttcactttgagctgagcaaaaagcagcgaattttggaggcactttttgtgggggagaaaaaagtaaaaaaaaaggaaataaaattaacaattaattattgtctaaaatttttaaagcatttgctcctctctgatgcttttcctcctcctttaattgctgccgatgaattcgaatgtctgaaaacaaaactgaattcgatccatgctaatgaccccgctttgagtcaattgctaaacggcttatttgctgctgaaatgcgcgcaaaacgaaaattggagtcattggcaggcaaataattaaatgccaattaattagcattaattaatcatatttttttaggtttcggtgatttttctttgttgaaagaattaaagcaaagcgtcgcttttgctttgcttttcgtggcaaaacgtcgccgaattcagctgaataaatacggagagaagaaacaatttgatttaagcaaagaaagcgtaaaatatttaatggaagaattaattggattttcggacaaagtaattaattcaaatttaggaaatttattaaaatattttctaatttattataattacctaggtaaaaagttgtgacagtttcaataataatggaagaaaaggaaggcaaaatgatgatgaaaaattacttagatttgcttttagagctaatcaaatcgatttggacgaagccgcactttttaatgggcgaaagggtaattaggaataattaacggaatatttaataagttgtgtgtaaaatttgtataaattatttagacgaaaaacgacgacggagaagaaagcgaatgattaacgcatatgtagtttattttatgattttggcaatgttttttctgataattatttgtttgtgtttcatcggttgtcatgacacgcaaaatgattggcgaaacattcacagaaacaatggacaaacagaagcaaacggagcaatgaccagggtagccaactctgctgaattatcagctgatttttgggaaaaaatactcaaaatggccatttttagcctatcggaaccgccgacccccaaattcgctaaaattttcacaaatttgatctaaaaattgccaaaatctaaaaaaaatgtacaaaatttgcaatctcatttttaaatttttcagttggcaaccctggcaatgaccaacaagcgatgtaataaaacgccattataatgatataattaaattaattaacaattaattagttaattaagtatcaaataacaatttttcaattaaattaaactcttaaatggggtttgctaaaaatatgccattatttcattctgctgcacagatttggacactttcaatggcattccttcggttgtcgtcggcgccagaaaactgagcgaggaagaacggacggaatgcgcaatttgcctatgccaaatcgatgccggcacaaaagtcaaaccgttgcccatctgtaaggtgtggtgccatttgaattgaacacattaaattaatcattttgtgccgatttagcacatgttccacaacgaatgcattgaaatgtggtaagcaaaagttattaggggaaatatagttaattaattaataaatatgctttaggatcggaggcggtcataatggttgtccaatttgtcgacaagaaatattggacacggacatgttgtcaacaacaacagcaaatgcacgtaagagcataataattaattacttaaa

SEQ ID NO: 19135 - DNA, 1815 bp, Heterodera glycines
agaataaatgttcgtttccgtttgtgcagttttcctccgatctacgccccaagcaaaaagtcattttcttatcaaaatatcgcacgcaccaaatgatgaaaatttgtgtggtgactaattaggtaattccttttaaaatcaaataatgatagcaaatgataaggctaaaataaacctttattaggcacaattgtttgaatttgataattctcgagaggtttcttcataaatttgctattgcttttgaaatttgagtgttttctgtgctaaaattggcccacagcaccgtttaaagcaaacaaaagaatcacgagaatggatcatcagaatgtgtaagatgaatttcaaagaaatgttgcataataaaaaatgatgattctgcaatttttcaaaagtcggtaaaaatttcaaatacatttattataaatggaaaaatccagaagacaacgatgaattatttgaattgaatgggggaaagccacacaatgctcggttaatttagttaggcattttatttttgaaaatgtgccacttttaatctcacaatcagccctcaacaccattcacaactcttatgcatcaaaacacccttctcgttgttgtcatcccaaaaaagcgtccttcagaaggagccgaggcctcgtccacggccaccgtggtgagattggcgcgcaagttcttaaaagaattgattgttttacgggagcagcgtttcctccgctgaaaaaattaggaaatttggtacttgtgcagtttacctgatacttttaacatacatttttaaatgcctataaatgtattcatttacattgtttttttagcatggaattattaaaagaatttaatattcgtgaccaaggcagaacacaaaaaaagatatggaacacacagaagcttattgaattcgcatgtggaagaatttttatggcgaaagcgattccaaggcccgatgttttttatcacttttggtctcaagttgcatctatttataaaatttcgagaacaaatattataattctgtttttaattatgttgaaatgcttaaaaaagctatgtaaatgaatacatttataggcatttaaaaaatgtatgctaaaagtatcaggtaaactacacaagtaccggaatttttttttaatattttttctgacttattttaaccactgaaaagaaatacggcattttttgatccgacatcatttacaagaaatacgtgaaattcaaagaatcaattatgccgcaatttaattttttccgtgtggttttcaaaaaaaaaatattttaaattttttcatttcgctatggtggctacggggcctgacttcgttcgttccccgttgaacacactcaccaaactgttggttgaggccgcgctgcagttccatctgacgcatccgttcacggctcaactcggcactgttcagcgtcgacgtggccgcctcagccggtccctggacagctgccgctgcaatggggaaggggagaaataatggcacaaaatgccgactaaatttatgtgaccagtcccatttttgggcaaaaatagacgccgggaaaaaatcgaaacagcaaaaaacatttcaacataaatttgcatatttttacggatatttataatccgccggccaaaaaaaaacggaaagtgccacaaaatgagaaagtgagtgccggtgttacccgattccgcttcgtcttgttgttgctgttgttgtgagtgggctggagggtcggcggccgccactgcgccctttttcatgcccatcactaaacaaaaaattttagtatttcgtttcttatagggctggccgagagtcg

SEQ ID NO: 19136 - DNA, 1658 bp, Heterodera glycines
  misc_feature (59)..(59): n is a, c, g, or t
agtcgaaatttacgagactaacaataagaccccccaaaaaaacctgacaactttctcanccgagaatctcgagccccagtttatttggttagacatttcttgtattttaattgcaatggatgaatttcataaattttttgagtgtatcggagaagggcgtttcctccccccatgaaaatttaaaaaatatcagatggaatttttttccaaaaaatcgccggaaatttgttcaaattatgttggggacaaagtgctgattgtccctccttcctcccattcttacatcgctggaatttgtccatttgttgtgtgtcctgcgctgtggcagcaatcattgactgccatttgtgctccaattgtttctcctttcgctctgtcgccaattcggtgccaaaaacgggctgtttagaaagacatttcgtgttttcgcggaaaaattttaaatccaaataataaaatgatagggtgaaattattttatttttttaaaatggatatcgcaatcccaaagaaccaagacacttattttgtggattaggatttgtgtttcgcataattattttttaatgggtctccaattcgaaaattcgggcctggccctggcaccgaggagttcaaattattgaagcgacagccaaatgcagcatgatcacctatataaaactccattgttctactatttatgaatccaccgaccgacaaactgccctatttcccacaaaattcccattttcgtgggttttacagcggattttgcccttcaaaccaggcagtttttaatgaataaaaaccttgctgtcatcgcctgtcggttcagtggtcgttgtcgcttcgcccgcctcgcgctgttcctcgccgcttgcgccacctttgcccttccaaagcagctttcgctccttcaacatttcggcatgcttgcgcactttggtgttttgccatgacggccggttcggatcaacccttaaaaatgtgccgttttaactgtaaaaacttgatttttcaattattgtagaaaaaaattgatggaagaaatacgagggaccaaaaatttagctaccttatttgtcaaaattagatggatgacgcgtgaggtaaaaattagcgataagattaaaaaaataataatcgccaaagactgcagtgacccaagggttaagtttcataaaacatttgtttccagagggtaaccaacccgcccaagccatgaaaatcctaaaccgtaggaccgcagaatacttccttgttgcgggcctattgtcgacaaagatttcaaaaacaaaagcattggtatcgttttaacaagacaaaaagtgtgcccgtacggctcctggtccgcctcctcttcggtaaacgccggtcggtcccggcgctttggtcgctgctgcagctcgtcccgctcgcggcccgcccagcggttgtcagctcgccggtccgcacgtcgcaactgctcgtcgttgcccattgaacgccgtcgatggtatgaattggtgtcatggtggttgtggtaacgctctatgaaaaagcaaaacaaaaatggcacacacaatttaactcggaaaagagcaataatagtttggtatgtgtgcttgtggtacattttcgtttagtgagtccattagagtgccctaaaggaaagttgaaattttgttgggaaattaa

SEQ ID NO: 19137 - DNA, 2127 bp, Heterodera glycines
  misc_feature (2104)..(2104): n is a, c, g, or t
acagcaaaaaagaatcgataaatgaacaaggggatgaatacatcacatccctccctccttatcaaggatcagctgcttgggtcgaagatctgcggtttcttcttggtccgctgtgatcgtcgaagttcgggaggagctgggccatcattctgttcatcttcagcctcctgttgttgatcatcggcgtccgagtcgctgttcacggattcgttgtccggctgatcttcgaccgtcagatccggcttaagctgatcagcgtgccgcttccaaacgcctttcaaagtccgaacgagataaattaccccgtttttcgtaatgatcagaccacggaaccatttaggcccgtctcggtaattccttacaaaaaccttttgaccaatttcaaaagttcgatctcgagttccccgatcaaaatttcttttgattcggtctctgtatgtcgtactgagtttttgcttcttctgatcggcgttctcctcggttggacgtgccaaatcaagcatggtacgcaattttcgaccgaatagcttttcagctggcgatgcatttgtcgctggatgaggtgtcactctgtaaagtcccaaaacctggtgcaaagcctcatcacatggcactcctccgtccttttgacgctgcatcatgtgtttgaaagtttggacaaacctttcggcttctccattactcatcggatggtacggaggggtaaaggtatgctcaatgcctcgcgaattgcattattcgtgccattcacccgacgtgaactgtgggccattgtcagagacaatttgctcagggagtccatgtgtggcaaaaatccgacgcatttcagaaattgtcgtacttgtgttcgtggttttcattttaatgacctcaggccattttgttttggcgtcgaccattacaaaccacataaatccccaaaaaggaccacaaaaatcgacgtgtagtcgctgccaaggccgttcgggttcttcccatggatgcaatggaactttacattcctcagaagcattaatttggcatggccggcaagactttcgaatttcttcaatcgctttgtccaatcctggccaccaaactttttgtcgtgccaaggatttcattcggacaatccctggatgtgccgaatgtatcagttggagaatttcgggccggaatgttgctggaatcacggttcttattccgagcattatacatcctgactgaatttccaacgaattccgagcaatgtaaaatggtcgaaattccttgtccactttatttggccaaccctccttgacaaattttttgactaatttgagcaaggggtctttttcggtctcttttgcgatcatttccaccgtgaccggtagcgattcaatggcctggacttggatcaaatttacttcttgaccattatcatcatcgtcttcatcggtctcaacacaaggcagtcgggacaaaccatcagcatttccaaacttctttgttgaccggtattcgatttcgtaatcgaaattcatcagaattaggccccatcggtgtagtcttcttgctgccaccactggcatttcgccttttgggccgtaaattttcttcagaggctcatgatccgtttgtaaaacgaattttcgtccatataggtactgcttgaatttttctattccgaaaataattgatcgcgcttctttctcaatttgtgcgtacctgcgttcagctgaacttaaagttttcgaagcataggccactactccttcttttccacttttattgtccctctgaaaaaggactgctccaattccgtaatcagaagcatccgtggccaaaaacaaattgttttttgggtcataatgcacgagcactttgtctgaggtcagcttttccttgaccaaattgaaggcttttgtctgctcatcacgccattcccattcgacatccttccggcgaagtctgtttaatggttcaacacactctgccaagtctttgacgaatttactgtaataattgaccatttccaggaatgattccaactctttgatggtctttggttccggcatttcttttattgccttaaccttttccggtgatggacttattcctgttttgacagtcacatgccccaaantagatcaattttccttcaaaaat

SEQ ID NO: 19138 - DNA, 1086 bp, Heterodera glycines
ccaatccaatggcaccaacttttaaatgttctccctctaagcagccctaattgggctaaatgactagtaattttctaatgaatctcaccaccccccttcatttaaaaaatcggaagaccgtaaaagcaagaaatttcatatctctgaattcatttttaaaataaagaagcaatttaaacatttatttcagtgtaatcctttctttccgctttatcataaaatggcaattcgtcccaacgaacggcgccattttcttaagaattttagctgcttctcatcattcccatcccaactgccgttctccacaaacagtggtggtggtggtgcgtataataagatggacgatcggcggatgaaaaagtgcactttcccatggccccttcccccccccccccgggggagtgcatcccattaataaataaatatcagcacacgctaaataaccctaccataacggtggtgagttaatttaatggaccgtaactgaattggtgagtcacacatttaacataagcaaacaaattttaaaaaggcaaaaaagttaaggggaaaattccttttttttaaaaaaatccgaaaaaaagaaaaaagcggtaaataaaaacaaataaattattaaagggcagaagaaactctcgaaaaaaacataatggccgataaatagccattcccacgatgataagagagacaaattgccaaacaaaaaaaacaaaataaaagcgatgagaggacggaaccctaaaagtgtttgtaaggcgtgggaaaggcaccacacagaaagaggagagagaattttgtgtggcacaaagcgagcacagcgattacgacccaccggcacagaaaacaatcggccgtgggtgccgttgggtaagtgccgacatttttgacacacacacacaaaaaaaaattgccgccacatttttttgccatagggtaatataaatggattagtggtcgaaatcccccccccccccctcaaggcaaagcggaaaaaaaataaggggggggggggggggggggaaaaaacccctcggggggggatttttgggggggggggggggggttttttgggggggggaacccccc

SEQ ID NO: 19139 - DNA, 1109 bp, Heterodera glycines
  misc_feature (138)..(138): n is a, c, g, or t
tttcccccagcaattggagacaaaagaatatttccctatttttcgactcaaatgcaatgaatggtttcattttattcgtacatttggcaaatcgttgatttaaaacccaaaaaaaaaatcggggataactccgaattntactcaatggggattcattttaggggatggcaaaaaagtttataaaactaaagtaaaattgcttaaagtttcatatgtttgctcttccttatcattaagttggaattatgaaatgggcaattaattaagttggatcaattagaaataaatgaataattaaacggaagattagataagagaatgggaaaaataatggaagacagaaaaaaaatcatttctatgaaaataaaatttacgcgaattaggaaaaaaaatgaaaggaaaattgaatgaaacttaaaaaaacaaaaattaaaagctgaaaaacccactcgcaatgtgagccgtccctggagcaaattccgtcatgaaagcattccatgccggacagtcgacaatcgaaacggtgcggcaccacaacatttgtggaaagggcagtgctggcggaggcggacaaagacgacaaattagcgactgaattattttagaaatatttaaaaaataataattttttcaatttttgctccccgcatatgtattatttcaaattgttcctatttttcattttcatccttttcaagagcaacaacaattaacttttcgaacccactttcttcgccattccctccggcaattgttcctccgtcgctcatcaacagaagaatgaggagcagcgcaacaattgttgatgccgttgttgtcctcgttgcttccggcacaattcccatttcgcaggtgtttctctgcctcggggcaattggcgtgaattcgttggcaaaaggcggttaattgcaaaaggaaaaatttgctaaaaatcgaaggggtaaaaaattgacaaagggacaattgttgggggggcgtaaatcaatcaacaataaactaattaatatattaataaaatataaaaagaaagattgaaattgaattccaagcttttttttatttgtgcatataaagggacggacggggaaaggttggagggatggacgaaa

SEQ ID NO: 19140 - DNA, 2544 bp, Heterodera glycines
ctctgtctgtgcttaataatgatccctccctccctccgttcgcaacaattcgttcgtcgacccccccgggcacaacaatcgctcggccgtcgcgtcgatttgcttccccccgcccccctcaatttccattgtgtatgtttttgagcgaaataattgcgccagcagaaaattggtggcggtggcggagcggaacgtgttccctcccctctttttttgttgctgtttggtcgcatggaccaacgactgacgcgcccgggggaggccggggggagcatcgatcgcacgcacatttttaactgtccccgcgcaccgccgcggggggctgagggaggggcaccctcaggcaacaaacgaacgcaacatcgcccccggcgatgtttgttgttgttgttattgttgttgttcctattttttgtttgtttgtcatgggaattcgtttttttttgccccagcggcgatgaaactgatccgattgtgatcagacaagcagtgaataattgttgcttttttgatggtgattttcaccggtatccagtaatttgaggttttgttgccggtggcaataattggccgagattttttgacggtgattcatcctttttaagggtactaattgtaaatagaggagataatatcaattccgttcccctcccccccccccttcttgatcggacattcggatcaaaccccatgaaatgccaaaaaatgccccaaggccaaattgtccatttggcactacgtccttccctttttaacaccccccccccactttagctgcttcttccgcttcctcttctattccctcctccgcttcgtcctccgttttcatccgtcccccaccgtcgccggacgtggacattctctccttcacgcccgccccctccggcgccgtagccgccgcctccgtcggcacaattggtgcccatcagccgcaccaccagcagcactcgccgccctcgttgtcctccgcttcgtacgcgtcgtccaccgcttcgtcctgctcggagcacccggagaagaaatacttttgccagcgatgcctaaaccacggcgaagtgagagacagagggagaaaggagcagggggagagaggggaaagagagagagaggaaaattttaaaaaatgcgaaaattaacatgaaaaactaagggggaagtaatgaagaggaaattgaaaaaagccgcgtttcctctccaggaacatcctcggaaaggccacaaaccgttttgccgctacagagagtgccaatgcattgagtgccaaatggttgaacaggtgggagaagaggaggggcgaggggaagtcggaaagaacattttacacacattttgttgccattttcagcgtcgggtactgaataacgcgctgaacccgaggaagacgaacggcgaaagtgccaaaaagggtgccaatcagcaggggccaaagccgcgcgacccgaagtgcgcacgatgttcagcccacggggaacaggcaataaaaattatggaaataaattgaaaataatttatttgttgggagcatcgcttttgagaggagagaaagagagagagagagagagagagagggagggagggagagaaacaagagggagaaaaggacagaaggggaagaaaagggagttatttcgagaattaaatgtctgacgccgaaaattggcagtcaacttgctgctgatcactgaccactttcttactgatcattctgttcagagtgcgttgcgtggacacaaaaaggcgctgtgtccgtttttggagtgcgcttgtgccaaggtgggcacaagccgacatttaaatttttataacaaccgcaattagccaaaaaaatcccggccataaaattaattagggcacaataaaattgctaaatttttccgttagtgcgctttggtggagcagcgacggcgtctgatggccgaccaaatcaaactgagaagacagcagaagaaggcgcgagtgcacaccacacaccatcatcatcagaatggccaatcgcagaacggcggcgccgggggggacgaagagggacaaaggacgccgcaggggacaaacgccgggggcaaaagtccgtcgccgaaccatcagcagcaacagcaggtgggcaaaagtgtggaaaatagtggacagaaggaagagacacagagaaagagagagagagacagagaatgtagagactgggaaagagagagagagagagagagagcgacaaagagacacagacaaggaccattgacaaatgtgaacaataattgaacccgagaggcgagtccaagacccctagaaaccagagaaacttctggatgatctcatagttttctcggttaccttccgaaaatcggttgctgatcagccaatatctgatcaattaaactgttaccttttttgaataatggtcgaatatgatgcttattgatcagtgattgaacaacgccctcccaccccctcaaaagttaatgaattcgaattcagcttcggattccgatggcaatgctgctgaagaaggcgtacgagaagaagccgacctatccgtccacaatttcctcg

SEQ ID NO: 19141 - DNA, 1191 bp, Heterodera glycines
cctctccttctctctctgttctctttcctctatcctttcctctgtctgctctcttctctccctcctcccctctctttcctctctcctatccctctgttctcgttatctccctttctctccatcttatttcctagtccttatcatctctctccccctcgtccctctccttctctctgttctctttcctctatcctttcctctgtctgctctcttctctccctcctccccctctctttcctctctcctatccctctgtctgctctcttctctccctcccccctctctttccgctctcctatccctctgttctcgttatctccctttctctccatcttatttcctagtccttatcatctctctccccctcgtccccctcgtccctctccttctctctctgtctctctttcctctatcctatccctctgtctgctctcttctctccctccccctctctttccgctctcctatccctctgctctctatccctttatctctatctttatttcctagtccctctcattctctctctccctcctcttgcccctctttctctcttttctctaccttctccccctccccctctcttttctctcttctcctctctctttttctttttttctttatttctctgttcccccgacctgttctgaaaccatattttcacttgtcgctctgtcagaatcagtgaatgggcaatttcaatgcgccgtttccgtgacaaatacttgttgaaatggaactccttctccaactccagcacttggttccgcgtgtatgcagtcctttggcgcttttcgcctcgcgcagtcccttcaaacggaattttcattgaattttcttagatttcttttttcttctttatccccagggttcgcagatgtgaggatttagaaggattttgtggtctttgaagggaccaaagattaattcttttgaaaatgaggacttctttttgtgattttttggagaaaatccctaaaaactttcccatttggtcaagataacaaatcgaattaaaattccaaaatttttccgtcggcgccgatcggcaccgccaaatcctttaaattttcaacccctccccaccccctcattctccgcgtcccttcggctgttttcccaaatcccttcctttccgctctcttctcggccgaagaaagatttatggccgacagattctcaatttatttg

SEQ ID NO: 19142 - DNA, 1847 bp, Heterodera glycines
acacaccgtccgaaaaaacgagatgtgtaccaataaatagagagtgccaaagaaaaacattatctttttttctctaattttttgtctccttttggcgtactatctaatatttttattattaggaaaaacaacattcacttcgtgatgtttaactttttttctgcatgttaaatccacaccaaattttgcaaatcgatagagaaaaaaaatctgcatcgatttctatgtttattatcatcgcttaaatgttgttttaaaaagttataagataaaaaagttaaattattattctttttaaagatttaatggctaaagaactttattacggaagcgacagaccaaaaatgcacgccatacgcgtgagaacaagcgggaggagagaaaagcgcagacggccaaggcgatacaagctcgcctggccaagaaaagtgagttttttcaccatttttactcaaaattttttttttaatttcagccgctccacagctgaatcccaatgccgaaatgccaccgcaggacgaagcagggccgtcaacatctgctgcatcggccgaagaagcgatggagccaccaccaccaactccagcaccagtgccaacgccggagatggacgaggaaattttggaatttggcttttcgctgccatcgacatctgtcacaccaatcggcgatttggtgccgttttcgacaacaccaactgcgtcaatggacaccggagagacgaccccgccaccgctggccattgacgagcgatcagagcgcatcgaacaactggagaagcagctcaatgacctggacgacaccatcaaatttctgcgcaagcaggtgcgcaatcgagaagcgctgatcagtgatctgcgtcggcagctggacgagcacatggtaccaccgatggcaccaccaacgactagcaaaagtgagtgaaatttttccttttttaatttcataaaatctgatcattttttcaattttagcaccaccaaacagaggaagaccgaagaaaagactggatgaactgcagcgcagcgccaggcgcgacatcgtcgaccaaattgtgggcgtcatcgatcatcgtcgaccaaattgtgggcgtcatcgatcgtgatcgctcgcgttccgcgagccgcgcatctctgcaccggatccaccgagatatccggcacaaattcgcgcactacacgccaaagaagggcaaggagcggaaggaggggatggacgctgaggatgggcttttgctgctcgcccaacttggaacacagaaggcgtacaagcggatgaaggcgattttacggctaattggccgtaatttcaacgttttgccgccgttggaaaaagtgcaattttcagtgaatttttcgtttgatcaatgttttttgggtcatcgcaataaaaacgaagaatttgcgcagagttggaatatgatgaaattccaatgccaagcgggccccggatcgaattgaagctggtgagttgattgaaggggctttaaaatcttatccaactaattaagagggaggaggaacaacgggagcaagcggaggaagacaaaacgaatgaagaaagtgatcaagaagctgacgtcgatgtcgttgactgatcgaggattaatggtttttattttcattacaagcggtagataaattttttaaaaatttgtaaacaatttttaaatcattttggtcacttttccttttatttattcattaaaatcatcgaaatacatcaatagcatgcactgggaatcgaacctgggacccccccccccttggtgaccttctcacagaccacttcgccacacatacaaatcttttttggtacagcagctcagtttccggacgccgtgtaca

SEQ ID NO: 19143 - DNA, 2954 bp, Heterodera glycines
atattttactcggtttaaaaaaatgaaaaaatcaccttaaaattaggttaagaattaagcatattaatgaattacgttcattaacggcacggcacattcttttaccgcttgcccgccaccatcttcaaaattcacaattaattaggacatttcgaaattaattattaattcatttttgcgcaattaattatgatattaatcaacatttttcaccttaatcaatttaagcatcagtttctttataaatttatttggttgccaaataagtgcttaaaaatcgcaaaatactgtcaaataaaatgacttaattgatgctaaaaaataaagctaaaattttcaattttcactttgaaatggggccgttctaatagagaatttttcaaaaaattcccatattttcagaccgttttcaatcttaaaaaatttacatttatttaggataattttatgagcaaatctatggatttcgccgctcagggtggccaatgagatgattggctgacgcgtgcctttcctctgtcccattttgaactttttttaaatttttgaaatcaaaatcactggccagagatggctcgccgtcgttgctgggctgatcattcttcagcttctgatcattcttcagcttctgatcattcttcagcttctgatcattcttcagcttctgatcattcttcagcttctgatcatttttcggcttctgatcattcttcagcttctgatcattcttcagcttctgatcatttttcggcttctgatcactttttggctgctgctgctgttgtttctccatttctctacgaattaagcaaatttgttgggaatttagaaaggcttaattaatatttgaaaattaaaataatatttaaaaattgtttaaatggggcttttgtgtgatgagaaaaaacaaacacttttttttttaacagtttaaataatttattttttaacaatttcaaaataattttaaattggattttttcaacaaaaaaacaaaaaatatttgtttttaaattctatgttaaatttattatttgattgatcggttttgaacaatttttgcttaaaattaaaatgagtgaagcgttataaaagacaaaattggcattatgtaaggatacggtatggaagggagaaaaatacggtaaatgcttcattaaatatacatttaatttttccaaaatgaatttaagtttaattttgtcttctttaaatagaggatttctgattagcttcaagcaaaacacagattagagatggataaactcaaaagagcgagcgtgaattaatatttatttgtgggtaaaggtattaattaggctagattattttaaattttcccattttatgaccaattaaatattttcggcatcaattgatggaagcaattttaatgctaaatgatgtgaaaattatccggcagttaaatggcgttgaatttgaattggggaaattgactcttaaacccgcgaaacatgggcttgaaaagtatagtcgaatatcgaacgatggcaaaaattggtcggttattgattgacttgaaagacaatcgattattgattgccttaaattagattgattgttgatcttttggaaaagcaatcgagtattgatttttcggaaatcgatcattatcgattgattggaaaggaacagttattgattgttttgaaaaggtgcgcttttattgatctaaatcgaccgattgttcttgcaagtggctgatcaatacccatacacagcaaagtgaccacaacggattgccaaatgttgatgggctgaataaaaaaaaacactcaattttcacttctaaaaatatattgttaaattgggttgctccccagagctccactagtctcgtgacggcggcgggcctcccacacatttttgggtgttatttatcaaaacaggaagccagaacattcccccccccccccccccccccccctccctcttttatggccatatttcgggattttatatccatataatttaaacctaacccatcaccatggcggtagaatttggccaaattttgcgcgaaaggctgccaaggaaaatgggaagacaaagacccctttttctcctccgcgatcatttaggcccaatatttgcacagcagcactctttcctccccatcgacagcagcagagatttaaaaaaaatgttttttcctttaaaattgagctaacgattggtgggctaatactaaatacagaaaacgcaaaaaaatttacaaaaatatgtttgaatgaaggtgggcggcacgtacaacacattgtgccgctggtgcttcggcactttgtcggtaaagttcatgcacttatcaaagataaatcctcgaactgatcggaattaaaatattatttacaattaaattttcatagggttactacatttttcaaccccataaaaatcgtattaaaacccagaaaattatttattcttcatttccgtctcgatctcatccgtcatgaacaaatgaagattctcatcaaaaaactaccatagctttactcaatcccaactaaaatttgaattctttaccattcgatagctccaggtgtttctagtaggattcgagccccacccccgccccggtccccggggacgggactgcttgtttagcctcacactcgcccccgtgactcagaccccccgcaatccccgcctccggggaggcgcgggggtaaaaacgcacccctaagtatggcatattcgtggggtaaactttattagtcacaaataaatgtgtgaataaatggaaaagggacgattaaatataaatattaaatagaagtgagaagaagccccaaatgggcgaatagtgcggcttttatagccctagagacgtgtgcgcatgcgtacgcgcatagagagagagagaaagaaagagggagagaaccagtaacacacaaaataaaaaatagagaaaaatactaaattaatgaaag

SEQ ID NO: 19144 - DNA, 961 bp, Heterodera glycines
gagtcattgggtatatgcccaacgggggagtcattgggtatatgcccaatggggggagtcattgggtatatgcccactgggaaggagtcattgtgtatatgcacaatggggggagtcattgtgtatatgcacaatggggggagtcattgggtatatgcccaatggggggagtcattgggtatatgcccactgggaaggagtcattgggtatatgcccaatggggggagttaaatttccgcccattaaccctcccgtaactattcatgaaaatttgtaatatttattttaaatattattggcggaaatttttttttgatattcgcggagatgtggtttgttgagacgatggatgaacgtgctgtatgacacctccaaattgttgttattatttaaaaaatatttttttttaatattggtttttatttataatgtattttttattatttttaatttagataatccccaaagaaaaataatttccaaataaattcggcaatcgatttatttaatggaaattgaaaaatatattgagcaggggttaggctatctcaaaatctgatcgcaagttgggtaatcgggatggcatttctgctgattgttttcattaatttcgtggtttataattatttttatttatttgtaagtatttgttactgaatgggtggagatctcttgaaattcattaagtttagttaacacatttattttttaattaaataaaatcaagggctaaacaattcaatagtcttgccttgaaactttgtcttacagctcgtttttactaaaaaactatacactctctatacaaattgaattacattaaaatgtttgaaaaacaatattgattagaaatttaaagtttaacagatttttgtatttttaattaatgtatagcagacaatcagcaaacttaatattagttattgcatttgttgttattgatagaccataaataaaata

SEQ ID NO: 19145 - DNA, 2823 bp, Heterodera glycines
taagacttttggaaaaaaattttatgtatgtaaaaatgtaattttttttagcatataataaaaacttataaatttaggaaatttaatatttttgcaactgtctaaaaaatgctccttagcccttttttagtgttttaaaaatcaattcttaaatttatacacaatttttggcatttttgaggctaaaagccatttttggcagttttttgaagcatattttagtgcatatttgggtctttttcgggattttagggcatatttgggggatttttagtgcatattttatgcgcatatttggcattttttagtgcaaacaacttataaccctattaattagtaataatttaataaaaagtttcttctgcctatataaagaaaacctgcacaatataaataaaatcaataattaaattaaatatttttctaattaatatttgaatattgaatcaaaaaataaaaaaatacaaatttatggagcaacaaagatttctaaaaaaaattttaatgattcaacttattattaaatttcttaatttaaataattttaatattattaaaaatgtgactataacttcataagtggacatttttaaaaaaagaaataaattatatcaagaatttttaattaaatgcgtgttatttataagaaatttatttaaatataatatcagaaattttttatagcatttaaaaaatgaattagatgcagttaaataaattattgcaaactaaaaaaacacacatatagagttataaatagggattcaatttttaagcacaaaaaatcgtgaaataggcacaaaaataggcaaataggcattaagcacaaaaagtccaaaattggcaaagttaggcattataaaaaccatcatagaaaccccaaatattcccttaaaaaaattcttaaaaattaaaattattacatataactaatcaaatcataaaaaattaaatatttatattgttaaatattttaaagctaaaaattataaccaattaaaaaataattagaaactcactaaaacatcaattaaatatttgataacgatagaataaattcatcatagaaaaattttttgacgcagtgactatttaaatggaatgcgttgatcaatagaaagccatgttttaatgcgttttggtatttaaggaatttaaaaaaaaccaaaaatcaattttaataattaatataaaaatgaaatatatacaaattcgttgcattaaaaaatataatgaaaatattcggctcagtggtttaaggtatgaaagcgtgaactttaaataatatacgcgaattgaaaaactttgacttacacaaaaaggtcgtatactatttataaaaatataaacttggagaaataacgcttttattaattcttcaacgctaaacctacattatttaatttaatgttaaagaatcactgaccccttgactattagaatacaaaataaaaataaaattttaaaatttgatgaaaggaagaaaaactaattaatgacttaaaatcgtcatggaatcttccatgatccatttggccttttgggaaccgagagcgcatgagctcatggtaccgagtcaagtcaatgacaagcagggctagagcgcgcacagaaaaaaaccgcgcgcaccgcgcattggggggggggggtgttattaagtctaacaaattagatcttttctcttttatttgcaagttttattaaacaagttaaattaaagctatttattgattatctatttaaaatttatattaattttttttcaaaaaattactgataaaataattttcgaaaaatatttaacattcaaacattatattattaaaatagttatccaatttatattttaaagacaatataattttaccattaaagagatggatttgatcaaaaagtaattccatttttgattgtattgaagtgttaaatcaaaacctttcgattagaagtattaacaaagaattaatcaaaatgttaaagagctatttaaattacaatttttttaagttaggtccgcttttatttttgcaaaaattcatcaaaatttgagagcaatgtatgcctaaaatttttttatcattggcggatgttgttcatttcattttttattataaaacatataaataaattggattttgaatctttatcatttagaaccaaattattattattatttgataattatttaaaactaatttatttatatatttttttaacaaaatttattctcacgcaaaacgagatgcataccattgaacaaatttcaacgcattctggtaactttttattaacttcttatagttctgtgttctccgcatttgagcgacggcacaggcacacaatgtatcaatttataaatattttcattattttaaacagtaatttcaagcttaatcagaattttttcaaaacaagtgttataatgttattatatttttctatttttgttattaaagaaagttgtaaaaaaattatatgtttaaacatttgaatgaaataattttatttttttgtgagtaatatatgcaaaaacattaataaaatccttggacaatttaaaattaaaatctttgcataaaacatttcttgtttaaaattaacaatttgatttactaaaagtgtgcctatttctgcgaccaatatcagctcctctttttaaattcttggaatttggccctgttgtttcggatgatttgtgggagggatttcattaataagcaaattttttttagtttgaagaaaaggtgaaaagtattttcttcattgattttaaaccgtatattaaataaaaagagtgaaaattccaagtatcgtataagagcc

SEQ ID NO: 19146 - DNA, 2682 bp, Heterodera glycines
  misc_feature (35)..(35): n is a, c, g, or t
atcaaaaataaatacataaaatagggttgcgattntatgaaaaaatcggtaatggagcgggattgtggtgcaaaattcaattttttttcctccgttgaattacgaacaaaattgttgaaatttgtaaagtcgtttcggtttgatatgtacaatatttcaaatttctaaaagaaattttcaaacgtcgagctgaaatttcaccaataatctattcgataaaacaaattttctctaagttttaccattgaattgggcaaaaatttttccgtgtcaaaggatgaaaaatgggaaaaaatacggcgcgaggtatgaagaagtggacaacaaaccattctttttaattacaaaattaccatatttggggaggttgccctcaaaattctcaaactaaaagttttgaaagttaaccgaaacccgaatttttatttataaaaatgaaccaagatattcacaaaattgaaatttgacacaaatctgttacgaaatccgccaaaaattcataatatttcctcgccatcgaccaaaaattcctttagaattttgtgttttgaaagtttaacaataatagaccgcacaaaaaatcaccgataaaatttttggaaaattcggaaattgcgctaatgtaaatgttattattttagattaaaattttcattatgaatgctaatgttgtgcaatatttttgcaagtaaaaataatttttcaacaaaaacgctaaaatcctttaattaagcagtccgctgtgcacttcccactcaattcgttacggaatttgacccgacacatccgcagccagcatgtggatgacacgccattcaacatcaaaccgtgccacgctggtgaggcaatgggcatccagctcttcgaagacggaggtaattgaaaaaaacgtcaattgtaaattattggtaacgaaaaattttactaaaatcttttctgaaaatttttataacttttttctcgggatgatttaaggcgctgagtacgaatccgacctccttttttagcgaattccgaaccgcgaacccgaattcgaacattttcgaaaaccccagttttaaaattggaaatgtattgtcattaaaatcgcgttaagagagtttcgaggcaaaaaaataacaattcaaaaaaaaacaaatttagacttttttgatgctctgagcacgaatcaatgtttttaatgtgaaattctgaattttccggatgttcaaattcggcttctgggttcaaaatacaccaaaaaggaggccggttgcttactcagcgttttaaaacacccctaaaacacattttattagaatttttagaaaagatttaaaaaatcaataaaaaaagtttttgttttaacgccataattttaaggagagcgatggcgtttccggcagtggaacagtattttcattaatttttttttactggccaatggaaggctttgtcagtcagactctgccgtcaccgcctgggttgaaggaatgcaaatcatccgcggagtagatgatttggcactgaaagcgtattgatcaagttttcaagcctattcccccaataatttattctaaaattttgttgaaatgagttttttgttggaataaattttttgttcaataaaatttggcttacatatactgcttgctttccaacccgcttatgatacttttatgtattctgacacttatttcgggcgcactaccagattcccttaaaaaagggcaaaaaaatggtgatggtcgtcgcccggtgctgcgcaagccattcaagtcaaaaattccgacttgttttttcattatccataaaaagagacaatttcggtcattttgtccctttttttccttctacaatgatatcaatggtcaaagtgttactttgttctcttctccgctataaaagcatttgatctggcccatcaattctcccgttttggtcgattattgtaccaaaaactcggtcacaaaattcccagtgaattctcctcccaattttttttttttgcgagacaattcgaaaaagttgccgaacgaatgtagcagcgccattccaaatgattaaaaaataacttatgacatgaacaagcttaacggttcatgacaatacgtaatttttgggtttaaactagagttcggatacggacgggatacgtatacggatttttacggatccgtagtccgtaatcagtatttttttgggccgatacggatttttacggactacggattttacggatttttaatccgtaatccgtatggatgcctagtccgtaatcccgatccagatccgtacaattcttgatacggattacggattttttttttggcgtttttaaggtgaaacggattatatttttaaattttatgcagtcaattcgccaatactttggaattggcgggtctatttcgtaaaatttttgtgcaaaaatcgaaaaaatttgaaaaaagaaaaatttttgtgcaaaaaactcaaaatccttacgttattgaattatcttaatttgaaattttacgaaattctatttcatttttttccattttgtaaatctttttaagaaatgaatttcggttttccattttttaaaatttttaccaacttggtctttgaaatttttcaaaaaaaagaaatttcttatgaaatttggcaccgaaatcctgaaatggtgaaaaatccccagtttgcttttttttggggaaa

SEQ ID NO: 19147 - DNA, 1953 bp, Heterodera glycines
tttgaagaaaaattggaccccccccccctcgctgcccccctttgcgagcgagggggagggggtcgacctccctaaaaaatgtatcatacattaaaaaaggagggggggggggtcggtaaaaatttttgcgaaggggggtcggccgccgatgacctttttttttgcttttcaaaaaccggtttttttttggcttgaaaattcgaaaaaatggtaaatttcgcagattctcaggtattttttagggttgcttagaattttttttgtttcaaaaatttaaagagatatatccgctccgatttcagatatgcataaaatctttttaaatgcgaacttaaggcaattcgaacacaaactgccaaaaagagcagttccaaaatgcgggccatttcgtttgaagatttcattcaaattcctacgcattgtcaaatggtcgacgcgaatttcatagagcggaagcgcatcagtgagaaggttccgtgtcgcggtggatgccttccgttccttcgtccactaattaattttttttcagatggtcgaccattgcgtggcattacctcggcgaaggatttgtcgtccctcgcccattcattgcgatggcaatgccaattgttcttcagcgtgtctgaatggtgtcgaatttgtgccgctatcgccaaaatgtggcaaaattttctcgccttttttggctccaatgcttttcggatggaatcgaatggtcgttttttagtgttcatttttaaatttctttcaattttgaagttgattaaaatacgtacggaaaacggcagcaaaaagatgggaattcgaagcaaaagagtacagtacggcactccctgtggcattcgattgaatgcaattgaacaagtggccgaatatttgcgcagaactaaatttcagcaggccaaactcagcattgacatggtaaggatcagaaagacttaaaatttcaaaaatcttttcacaaattaagttctcttttgacccccaaatccgacccgaaatcgttgcaaaaccattcgatgaaaaaagcattcaaacggaagatttcaccaaagtttttctcatttgttttatttttttaatgtttttactgacagggcgaagaatctgtgccaatttcacttgtcaatgccatcgatgtctcgaaaatcgaccccaatgttcgttagttctgggggggggcaattgccttttgcccgatctctgaaagaaaaaaatgaaattattcatgacaattttcacaataattttacttataaaatttaacccatcaaaattttctggtactgtctttgtttttgtttatctgctcatttatgtaaaaaaattgaaatgttgcaaattcctcagtttgtgtatcggccacggagaacagggataaagcgaatgcaaaacgacgagggcgccgaacaaagcatcgacccgtgcttctgttcgggctgttcctgcaccgacgactgtgcggacagcaaaacatgcgaatgccgtcgtttgaccgcagtggcacacgaacgactgagcaaatcactgcaaattcacaaagcatgcgtgaagggatacaatttcaggcggttggacgacaaaattatcagtggaatttacgaggtgggcaatttgctagggaattggggggacggcggcaaatgggcaatcatttgcattattaaaggggcaaatgggcaatcatttgcattattaaaggggcaaatgggcaatcatttgcattattaaaggggcaaatgggcaatcatttgcattattaccgttcgtttcttccctttagtgcaattcgctggtgagccgcccttctctttccccttttgtgattttcgttttcaattagtgcaaatgttccaaatcgacctgttacaatcgcgtcgtgcagcaggacatcaaaatccctctgcaggtggcgccgtttgtccaaatggacgtcccttttgtttagctttt

SEQ ID NO: 19148 - DNA, 1000 bp, Heterodera glycines
cagaaaaaagtgtcaaaaacggaaaggcaagtgaaaatggaaagggggcattatgtagatgaaaaaatataaatgctaacccaattttgaaaaacataaaaaaatattttggctttttagtgccaccaatgaaattggacgaattctgtgaatatttcggggaggatttcacatatttaattgacgcaggtgttttaatttgtgttgcattgcccaattaatcatttctcatttagcaaaaatgggaaacatcggacgctttctcaaccgtatgctttttccttttatcatcactaaccttaaaatttgcaaagttcagactcttgcgatccgaattgtcatgtccaacattgtctcgtcgacactcatgaccttcggatgccgtggtgtgcgtttttcaccaaaaagttagtcaaggccggggaggagctctgctgggattacgcgtacgaaattggttccgtggagaggcaagtgaactgcaaatgcggcacgacggtgtgccggggccgacttctctgaggaaaagtgatggcaattgatagatattaattacactttgtcagcaattacctcactttgtttgtttgttatttgatggaatgggaatgaacagtcatttcgcttgctttgttttcacctttttggctaacttttcgtctgtccgtgggaaattgtcttcctttggcttgtccccgccattccccgcacaaattaataaattacctttcctttagcggagtgagtgtcccttcgggtggacatttgcccggggaacggcactgacaaattgccattggaccaatgcgtcgggtgtttggacttggaatagattaattgcagcttacaatgccgcagagggcaaaaggtgggggagggggcaccgccaatgttttgtgcttgggattccccgagaaatgtcccccccccccctccgtttgttcttccgtctcacattctatgctcccgggaccagcctcattaactgtaaaagcacatc

SEQ ID NO: 19149 - DNA, 1137 bp, Heterodera glycines
  misc_feature (1080)..(1080): n is a, c, g, or t
aaaactaagaatttcgaaattttttaaaatataagcgttgaaatattttcagtttaagttagtcctgtaccggggaatatgcctgtaaaatctggtgcaattttattaattatagaaaaagctaattttataaaattttttaaaatataagcctaaaaatgggcatatttaaaaaatttttattacgtaatttgatcatttttttccaataccccgaggcaaattttatttaaagaactttaaaataagattcatttaaatttaaaaaaaattaaaaatttctgaaaaaattcaatcatcaagccgtttcttcagtgatcactaatcagttttagggcaatgttccttgatgtatttgttgattgcctgcatctccaattgctcgtcacagaacgggtgcaccttggccacattccattgattgatcagtgcttccaattgtgtcacactttgatcaataaagttcttgatcacttcccacacttgtgggccatttgtcatgctttttatgactgctttgttgcttggatcaacatggagataaatggccgcaaatttgtaaattttcaaataaattttggcattttgtattgccattggccatttttgtccttgccgctcgtcgtggtctgcttgaattacagcaatgaatatgttaagcaaattgtttgttgcgccaattctaaatttattttttgtcgaaaaatttaaaaaatttatttacttcatttctagagttagacctggaaccagtcctggatttttcaggatccaggtccaggtccatgcttttttccgcaatcagggcttcctaggtttttgtccacagaaaatccaggcccaggctttttcaaaatgtcgagctcaattaatttgtaatagtttatttatgcaaattgaattttttagaggattaattaattaaattccgtcactttctgtgcactttttaaatcataaatttgttttacttaaggctagccaatcatattctctattaatccataatatttcaatgaactcattgtgatgaaaagagaataattaattggttaactatgaaatatatgaacgagcggngaagcctttgagggaaaactatggggcgggccggctttgaaccggcgtctctggctt

SEQ ID NO: 19150 - DNA, 1306 bp, Heterodera glycines
  misc_feature (64)..(64): n is a, c, g, or t
tccatttacgaactgccattgaaaactgaacaagtgccctcaaatcaatcagactgccaccggnaccaatttcctttcctttttttatttcttcccaattaattggaattaaaacattttataaaaaagtccaaattattgttttttagtgtacctttgtgttatctgtttgttgagcactgctgaaatgggagtataatgttcttttaaattgatcgccagtgatgcttagccaacacaacaatgtttgattttcacattttttatttctgtcgttcttaaaaaaagaggaaattaattttaggacaaaattaaaaaaattattatttaaaaatcagtgaggattaaaaatggacttttctcggaatcccaactttatttttttttaaaacatcccaaatccaaatgaaatacgctttatttatatgatataaattataaggttgctccacgccgaccttcggcggggtgagaaaagtcggggttcggggagaaattacccagaaaactcggaatgtgacctaagacattcgaaattccgcgaatcgggtcgggaacaaccctaatacattatacctatgtattttcgttcaagtttcattgaaaaaaattgaaatttcagcgtacttggaaaaaggtgccataattttcgttcttaaaaaaaaatgttttccgtgttcttaagaaaaagaaaggaccaaaaaattaacaagtgaaaggaatttttaaattaattcatccgttcattaattaaaatgccaatttcctaattacattttcatttattccgttgaacggcgcttccaacattccaaccaattttcgatacaatcgaaaatagaaaaataaaacaattgcccgtttttcatcagaattctcaatttgtttgtatttcaattttttgttgtgctcggattcatcatcactaaacaatgatttttttaattttttgatcgagaaaataaaaaagaaaattatttaactttaattttaagattttaatttaattaaaaaatttttctgctaattttcaaaattctaatttcaatttcttttttcattgtttttcttttaaaaaaaataattttgtgtatataaaaactttaaagattactggaccttaaatccgaatttttaaatggcacttttagaaaatttaaaaaatgcaattaaatgtttttcgaaagcaaagtatatattttttaatttactggtcggaaattaacatggtttacttaatttaatttttaattcttcaaaattaattaaatattgaatttgaaaaaaaacatttatttttgcttat

SEQ ID NO: 19151 - DNA, 2416 bp, Heterodera glycines
agaacgataaaaatataatttatatattttacattttaaaatattaattttaattaatattatatttaagactgacgtattataataaaagaatatgaaaatatttgccaacattaaattatacatttaaaacgattgataaatgaaaattttatctaaaacatatatcctatctttaataaaaaatattttaccaatttctttataaatggatacaaaagcttaagtcgacaccaatatcacccagtttttctagtaaatctcctcttgtctttattgcgtttcttagatattgatcaaccaagttttttgcggtttcatttgatatgaattcttcgaagtcgatgcaatttaaaaatttgaagcatgaacataataatatagttaataaaatatttgtatccatttataaagaaattgctaaaatattttttattaaagataggatatatgttttagataaaattttcatttatcaatcgttttaaatgtataatttaatgttggcaaatattttcgtattcttttattataatacgtcagtcttaaatataatattaattaaaattaatattttaaaatgtaaaatatataaattatatttttatcgttctggcagttttagcaaacgcgctggcaccgaaatgaagcataaaatgaaataatgacgcattgctaattcaccctaagaattgaactgagaattttcaaaaatatacacctaagaagaaattttgtgcctatttcatgtttttttttttgcacaaaaatagtttctagtaaattgaaataattaacactgacaaataaaagaagcttgtataaaagatttttatgaaatcaaactcaatatcgagtttaatttaattgtttcgaactttcgatttgttcatttctcgcctcaattacttaaaactgaaaaaagcgattaattattttaattgaattttaacaatttttgaatggctttcaaaaaatcgccatatttttgtcatattttatggtacgtgccatttttctcaccattagaaaaagatcggcacactgcacaaaaaacttttaaatattaaaaaaagggtagaaaaaaccagaaaaatctaaaaacactttataatttttctttaatggtaaaagatagcccattacatggacacttcagagttcaggtcggaaagtcatccccagaagctccaataatgtggaattttttatttatttaaatgccacccttaataattaactaattagaattaattacacacatttgatagggattttttatgaaaagaaaagaaataaaatcaatcaacaaaattaaacaatgatcataaaatatttcttcctctagagaatagtcaaatcaaaatttgaagtttggctcaaagtttgcccattcacaatttaaattacataggaattaaatttcatccttttaataaaaaagcaaaaaaaagtatttcttacagaaaattcgatttgggacttattttttcatttatgacaatatttaaataaaaaaattttcactctccccgtctcctttccttctctccctctcctctcattttgaattttttgaaaaatgcttaattcgaaatttctaagttcccttagcgatccggtgacgtgataccctaatacaaacaaagcatcgggaaatatttttggctttttataattattttataaatattgggaactttatttatttaaattgcaaaaatgaacctgtaaagtttatttagaaataaaagcattctgtgaataaataaaatgggaaaaacagaaaattaatttattagagatcgactaaattaaatttatcaaaattaaaaattatttatttcgtgaaaaatttaaaaataaaatgatctctaataattgcacaaatttatatcttaaagaaagaaatgctcaattaagtgggatgtcatcaataagacactgatgaaagatctgcatgggaaatcaattggtcattaagtttaattgttattaattagctaattcggttagtaatgggaatcgcttcagggcaaattctttaaattgctttagtcattaagcttgtacaatataagtaaagatagaaaaatgtatcaatttctacaaacatcataaggtatagtcatttcatttgagagatttcgtgggagccatcggagaaaaatttaaaaatttcaataaagagcaaaatgggcagaggcaaatgcatgggattggcactcattgtacggcacggtattttaagtgtaggccaaactcagcgtgaaccatcgctccaactcgcggatgcctttgcgatttgttgccgctgccagcaaaaggttgccaagcggaacgatggtggacgcgatttggaagttgtccttcagcacccgcgtttccacaatgccaaacccgcaacgtccagccg

SEQ ID NO: 19152 - DNA, 1443 bp, Heterodera glycines
ttgaataaaattttgtcattttacacccccctaaatttcaatgtttttagattttcaatttacaaaactattttaactgacaatcgctgacgtcttctatctcccgaacaactcgaaatgccacttatttgcagcatgaatctcaatattgatttggctaattttgttgctttttgaataaaatttttgtcatttcagttttacgccccctaagaaattaattctgcgtttttatatgtttacaaaaattttgaaaattttcgtggcttgggcatttttatgtgtcagcggatattatgatagataaatgattttttcttgcctttgaatatatttcttcactttgtcataaatcgattcaaaggcatggcatttttattttgcttcatcttttttcacattcgtcaaaaaagaaaattgaaatattgcttatttcttaatgtagtcagccgattttttaatttatgcgaaaaaatcaatttgaatcgttattcctacaaaaaattcttataatcatgccttaaatggttttgtaattctgaatatttttttttgatttagaatttacgtaattcggtatttaatttaattcttttttgaattttaaaaattaaattggctttttttagtttgaagaatcggctgaccattaaatccaaattcactcattccatctgtaaaatcgctcctattttaataatattgtttatttcataacgtagccaattttttaatttaattttttcaatttctgcgaaaaagtcaatttcaattcgttattccaaccaaaaatcctctatccatttgccttagataatgagtaggggttgagctttagcgattgaattaaattggcgaatttttttaacttctgttcgtgtggcgccattatttacatcaggctttttgtcaatgtttagtcgcattattttaattattttgaaattttcgaaataaaccagatagaagatgatcatttattattatttatttcttttatttgctttcttttatgaaataaaagcaccacaaaatgctgagaaatttgggaaaaattggcacaaaggcaaaaaagaaaagtgccgaaaccaatttgggacaatcactgaacaaaacacccgcaacaacactcaaaatggcaaaaattatgatgaaattggacaaactgtagtaaaatcggagccccattttgatgagagtgatgttaaatttggcgcaattaatcaaatattaaaaatgaaaaccgaacccattgaaaattatgatgagaaaacaattggacacggagcagctaaagctgagaattttgtgctaaaacaggagccatatgaagtgaaaattggagaaataatagaggagcggtgccaaattaatggtgccgaatttgatggtcaacaaagtgccgagtggcctatcaaaaggggccaatcaaatgttgggaaa

SEQ ID NO: 19153 - DNA, 969 bp, Heterodera glycines
aattaaattaaatatcgaaatttaaaaaaaatttagaaatgaaaaaacaagacagattgaagaaatgggaagtcattgttaacgaatttatggaggaaaagggaaaatatttgcgtaaaaaagaacctaaaggcaaaaagaatatccatcatcgagaaattgatgagcaaatcgccaaaaaatggggcactaatagcagaacaatttacagatggaaaaaaaaattgggacaaactcgtgagttttattttatttataaatttataaaaacaaccaaaaaatgccaattaaatgacagtcaaaaaatgatcattaccgataattagggttacaatttttcagctgaaaattttggactaaatgtgtaagtaaattttctaaaaatggttgttgctaaaaagtcctcattaaaagaaataattatttatttgatgatatgagggccttgatttttctgttttattttttttcattaccaacaggggtctatgaaaatttgtaaaaaatggtggcgtcataatccgacccattaaaatacagaagaaagcacaatttgatgaatgataccgataattatagataagatttccatcttatcctatttttaatttgatttatttataaaattatataaaaggcgtgaattaataaaattttctttgatttttagaaagttataattcattttccgaacaagaaaaacgtaaattgatcaaaaaatatgacacggcaaaagcaaacaatgaaattttaaaggcaaaatttgactataacattctccgttacattcgtaaatggaaaaaaggtaacgctttggaaataaatatgttaaattttttttacatataaatgaataattgaagtgaaaattgaagcaaagtcaaaacaaaaaaaaacgaacaaagctaaagccttgttgatttaaacgctaaaatagaaaaaatccaggattttttttgtcattcaaaa

SEQ ID NO: 19154 - DNA, 2618 bp, Heterodera glycines
tcattatctaatattgaaaatatattgtcactttttttgtattaaaaattcccgtcacctttacttttttcgttcacttaagatgcgtgaaattgatccgctcgttgtctgtgttgcttttgcgatttctgccaatgagctgtttgggtttgcttgtttgaacttctgcaccattttgcgtcgctcctctgaaatcgatcgtggacgtccacgtggcctccccaaagctgaaggaaacatttaaatttttcaagaagcatccaaaattaaacattcttagtattcgatagccctaagaatcttttattatcctgcaaaatttcaaaaaaatttattgtgtccaaaaaatttatggccagaaaatttcaaaaagttggttttctaaacatttttggccataaattttttgaaacccaacaaaattttttgaaattttgcagactaatagaggattcttaggacttcgagtgttaactaagatatttaaattggatgcttcttgaaaaagttatggtgcactaaagctgcaaaaaaaaattatggtcgtattttttttatggtcgtgtgaactgcaatagagccggggggaattcccccaatattttaaacaccggaaaagggaaaaaaatttttgaccgaagagcaaaaaaaaatggtccaccccccgaaaattttctcttgctacgggattgtataatttattttattttcagattatttatttggatttaccgatttccatctcatcttcctcagaatgcaaagattgcaatgtttcgttgacatttcccgatctggaagattgaaaaaaatttaaatattcaaaaattgtcttacggaagaaatttcaagaaagcatttttttctcgtttttttcgtcaacatagctagtagtgtatgaaaatcattataaaaaccaaatgtgcccaaagtcataccccttgcaattttcacattttcaaatcattaaataaatatttaatttactcattttccagtctgtttgcttccagtggttcatcatctcttaagagttccatgaactaaaacaattttaaatatatttatatatttttttaatcaatattttgcctgatttcttttaaggtctaaagcattgaaggcaagttcaagtagtcttggtctgaaaatgacaacacttcaattagcgatttatctaattatataacaggtatggcatccagatgccccaaaaattttcggaatcgaaatacccaggaccaataattttataaaatcgggattccgccgaccccaaaaatgtcgtaatttcgaaaattgagtggctatattaattattttacactaaattaatcattatgacttggcaaaaaaaaaattccaaaaatttcagaaatcggtattctgtcacccaagatttttcgaaaatcggaatttccccaaagatgttgaagtgaaattccataacttacttgttgtcaggaccaaattgacatgaatccaaaagaactttaagagattcgtagctggatgctccagcggccaaacgaaaacagtcatatccttcattgtttgtcatatatgggtctgctcccacttccaaaagaaatctgaatcgattcaaattttgatccagtggtgaaaacgccaatagtggtcaaaaaatcggaaaattatgagagaaatgaccagggcctgaaaatcccaaacatgtacataatacatattcgcccgatgccagttcagtcggagtgagagttttggtcgggcccctatcagttggaatcagggcttccaccgaaattttttcaaaaacagaacatagggtccaaaaaatcagattttggggtcgaaaatcagaacatttcgcgaaattgcttcaaaaaagttaattttacaatttatttgatcaaaaatgtatcaaatatcatatttttcttcaaaaaatcggattttaagcattttttgcggcgcttttttccgaaaacttttggggaatgggacatgcagagggtcaggcggtgccgataggcgccgccggggaaaattgttttaattttagggcaaatggacaaatttttaaaaacaaaacattatgccataaaatttaaaaattatgagtgtgtttgagaaatcagaacaaaatttgttcactaacccaaaatcagaacatttctgacaaatcagaatatttttttatcagatttggaccgtccaaatcagaacatttctgttaaatcagaacaaatggaagccctggttggaataaaggcacgaaaaatttgaaaaaaaggcatgaaaaggcatgaaaacccggaaaaaggcatgaaaaaaggcattttaaattttttattaaggatttttagggagcaaaacaaataaaacttaaccaaataacttaatttggttatttaaagattaataaatattttataatgttttttaaaacctaattttttaacaaaaaaaataataaaattttggcgatcaatttttgggaaaaatttttaattcttgggatttttctaaaatttttcaattctggggtgtattttctgaaaataacgattttgcaaaatctgagcctcagttcattcacatttaattattttttacactagaaaaacggataaaat

SEQ ID NO: 19155 - DNA, 2462 bp, Heterodera glycines
  misc_feature (22)..(22): n is a, c, g, or t
  misc_feature (85)..(85): n is a, c, g, or t
cctttgtgcctttctcattccncccccccctcctttttgtcacccccccccttttttttgcccttcctcctcttcaacccctccnccttatctcctcccaatggtccccctttcgttttttcctcctaacttttcccaatatttctcctcccccccccccgtttcttccagcactttcctccaaaagcccatctgttcccgtctgatgctcccttccgtcccctaccgttcttcccaacaatctctccacgtgcttttctccgccgatggcaactttccggacgtaattcgcactcggtccgttttccgtttcactttgcttccgtcttttgacttctctcattcggctgttcagtttgttctgtctgaatcgcaagtgcggctttcggattcgtttgtggtcctccaaattcgcctgcggtggcgtcgtggacgatgactcgggccaactttcccttccgggctttcccgataagttggtgcccaatctgttttgccgttgggactttcgtgccgggattggcagccgctacattctcgaattggagtttcccaccgggggcataaaggttaggcctggcgtggcagggggaagaaggggagggtgattggccacggggggagcgggagggtgattggctgtccgtcattgtccgtcccttggtttagccgtccctttcgccgctttccgacattctctggcgctcctcctgctacagtaatctcgaggtgccactttccactcccatcccctcacttctgatttctcttttccattttccgattgccaacggcgttttgcccgcgggtatcggttctttggccgattcgagaatattactccgcaaaaacgaactgtttgtcccaattcaactgtctttgtgtccagcacagatttgttctcacttttttatgatgggaaaatggtcagagaaatggccatggcaagtggcatttccatttcggacagaatgggatggctatttgatgtgccttttttgatcaaatacacaaaggtcttggtgaattgaaggggtcgacatcgccattttttaattggcatttcaggtgccaaaggacttcgacaactcatcttggtaacgggtgtttagttttgttggcacttttttaccattcacccaaagtatggtcgaacttaccgaatcgggcactgtttacgttgaaaaggcatcggctttttcccaaaaggcattttcgcattcgttttgccacttgcaaattcggaagcctacttcggaagtcactgcgcagttggaactgcatgacttccgcttccaaaattacattggcattctgcgcaactcaaagcgctgtgaagaaatcgacagtcgcttggtgatcaccggtactgaaaaatcccccccccccgcctcaaattgcgccgtttctccgtcagacgaaaactccgacccgactccgctgagcacagtgatctgtcgcaacaatctccgaggtgccaaccgaacctcactgacttttctgaacaaccagttggagctgtacgtttacaaccgctctttctacccgctcagcttcaatttgtcgctcactttccatggtttttcattttgccattttcatttgtcaaactctcttttttcacagaatgcggcggactgatcgacgcgaccgatcgcggaatgtctggcgaagtgagcagtcccaacttcggagtgtccaattattctgacaacagcgaatgtttgtggctgttgcgggcgcccgagggacgcgttgtttcggtgagagagggggagaaagaatgatcggtgggaatgagcaaacgcacagatcgaaatcaccttcatggacttggagagcaacttggagtgcaaccacgatgttctggaggtttcttccggttggtctttaattccctccccttttgccccgctaattcagtcgccttttctgtccctttttcttcttccaattcctccccctttttctgcttttccctcctccaattttgtcccctccgtctctttctccgcaggtgaaagccgttccgcggtgatccatcgttactgtgtccaggaggacgaaaagctcgcggaccgtttccgtcgcatccgcagcgtcggccgttcgctgactctttacttctccaccgattcgtccgtcacccgcaagggtttctccctccaattcgccttcgtctcgcccgaattatccaccgaatgcggatttaatgccaattcactcaacggcaccattcaatcgcccgcctttcccgccgattatccgccaaattcacaatgcgtttgggacgtccaagtgccgatgggctttcatttgctgctcactttcgaatactttgacattgcccaatccgtggactgttctcgcgattttctaagggtactttttccccatttttcttgggttttccctttttttcctcccccccccccccccccctccaaaaaaaaggttttctg

SEQ ID NO: 19156 - DNA, 1025 bp, Heterodera glycines
aaggaaggaaaagcatgaagaggaggaagcgaaagtgcttagagcgaggaacgagaaaaagcttagaaagaagcaaaacaagaactaaacattttattcgacattataaataacccaataaaaaaaaattcgatgaatataaacaaaattaaaaatacgataaattaaaaaattaaaacttacaaattataagtccaaaacgacacttaagagaaagtgaggagatagaagaggcgattagagaaaaaaacacaatctttgcaaaatgacataaaataaaattagaaaaattataataaaattccctccagcaaatttccaatttaaaggtcattttcacttggcaattattccacataaatcctcggtcccccacaacgtcttctcagtttaagctcttcagcaaatggatttgggggcagctgagggtaaatgcgtgccgttgccgccgtttgtgccggcactgagccgacggaatggcgatttattgccgaagagcgctagatttgggaagtcaatgtacggtagagaaaggcaaattaccgtaacactgtccaaaagttcgagtggcggagcagagggactgtaggggggaggaggggtgccaaaggaatgagtgatcggcgcattggccgtgcgattggacacaaaacggtcgatgagccgagcgccggcagctgaggacggatcacttcggcggtgtctttggcgccgctcgaccgaagagggcgcgttatatgccaattgcaactgaatctaccgcgttttccaggcactttccaatttcacactcttttgtgttcttctcctctcccttcctcccatctctcactctctctctatcgctgtttctcttttttctctccttccctttttctctgtctccctctctctcccatctctccctccccaattatttttaatattttatcaatgtttttctctttctctgatcactcgcctcgcccgtctccaatgatcgccttagctcgatcactttttgtttcgtctgtgatactcccccg

SEQ ID NO: 19157 - DNA, 922 bp, Heterodera glycines
aaacactttcattgtgaaatgatatatcaaatgttgttgttttttcgtacttattttaaattttattttattatattttccatttttcccttcattttatacactttcatttgacatagttttcataatacttcctcatattcatgctggttaattttctaatattttcatctgtttgcttatttccttggcacttccgccggaaaaaaaatacgtgggcccaatgtaatggcaaaaaattaaatattcaaatggaaatatgccaaaaaaaattattatggcggaagccactataaaaaatcattattaatttacagggatgatgaagaaaagggtcaaaatgacgcaatcattcaaaaaacaattcttctattggaggtggatttggttattttctttttatttgtaattaaaattattattttttaatatttttgaaaagtttttctcttggaggtttttattaaaacagatgtccctcaccgtccccccccccccccgccttttctcttctgctgctgcttgtggtcctcccattcggttggactttgtttggtcattgctaattttggcttctcaaatgcaaatggtccgtcgccctttcgtttcgttcgtccgtttctttcgctgctgcggtcactcattcatttcccgaaaatcgatgcgttgaaaaagggtcatttggagggtgaaaatcgaatgaatggctttgcagcaaagaaaggacgaaaatggaagggaaaaggcaaatgtttaattggtgggggggggtattaaaaggggtgggaaagagccaaagggaacgaaaattgggagggataaatttaattttgttgaaatttaaataaaaataaatcataatttgttcaacaataaaacagaaaaggtaaagtaagctaaatgaaaaggaaatgataaattg

SEQ ID NO: 19158 - DNA, 1905 bp, Heterodera glycines
tttattgttttaggaataaatgaaattgaaaaaattacattttcttattgaaatttgaaattaaatgaataatttaagtgttttttaattgttgaaattataatcatgattgattgaagcagaaataatattgttttaaacactgcagttttaagaatgttttataaaaaattaaatttatttgactcctattttcctttttctcgaagagtgagctatcattcagatcaaacatcttttattttagcaaaaaaaaatcaacccgaaacattttttctatttatccttttcgttcttaaaaccatgaaataaatggtagataggaaggtggagattaagtatttgagaaaatatctaaatcgtaactaaataaataaataaattttatttggaaattaaagggatcttttttattacctacacaatttttcgcgtgctgggacgtttcgtacaatccgccatttttgcaatttttcgacaaaacatggtataactttgtttaaaatcaaccaggtggcggattttacgaaacgacctaacaccaatttttcttttttcaaaaatttttaaatttgctgtatctctgggaattaaggttattcctatttaaataaacgccaaaaaatattttatttataaatatttttttttattattaagaattagtgttcatattttatgcattaaatttgttttttcaatttttagttaaaaaataattcatttctgctttgcattaattacattttctaatcactatttcatctttttttattatcaaatagaattttaaaaagtattattatttttctttgaattgataaaatggatgtgaaactccttttatgcaagacttttaactataccattttattaaaggattttaattaatctttatttgaaagattatttttattgagttgaaatatttctcttaaatttttcagacattttattaaatttcattatatatttttatgaaattaaaaaattaatatctttaaactcagcagcaaaaagctggtttggattttaaatttggtaattttgggataacttataaataattttctgtcaacaattttcatttaatagtttattttgtaataaattttttgttatttatttaaaatattcttggcgacgacacattgtaatgattttactattgactataaacttttcgatccgccagcaggttgactcttcgtaagctttactaatttgtttgatgttcctagataaaaatttgaaatgagtgcttcatattttaattcctgatcatattatgaatttacgatcgaattattgctaacttctttactttttttatttatatttttaaacatgagtttcaacttatgccacaaccaaatgatcatcatccacaacaacaacaagcacaacaaaatttagaacaacaacattttcaacaaccaataacctactgcaacaacaacaaattttgtaccagccgcagggcgaaatacaacagatttacaatgaaattgaggcggtaaattacacaaaaaatcaaaataattatgaatggtgattaattgatatcataggatgtaatgctagtccaatcaacgtctgctggtgctacggctgccaccaatcatgccactcgaggaggaccaaatgtaaaataaaatgaattaagaaaaaatataaaaatataataaaaaaaaaatattgcggcggcgccgtgcgactcctgcggggcgaggccgtgggggcggacggcaaaatttagtgaattgatgagaaaattaaaataaataagtgcgatttttagtgatttaactttttttgtacaattgtttgaagaaaggagctcaaaaaaaatctgttgaaataggaagattctgattccactaaaatcaagaatttgtcatccct

SEQ ID NO: 19159 - DNA, 1370 bp, Heterodera glycines
attgtccaactgtcgcattgtccaactgtcgcattgtccaactgtcggattgtccaactgtcggattgtccaactgtcggattgtccaactgtcggattgtccaactgtcggattgtccaactgtcgcattgtccaactgtcggattgtccaactgtcgcattgtccaactgtcgcattgtccaactgtcgcattgtccaactgtcgcattgtccaactgtcgcattgtccaactgtcgcattgtccaactgtcgcattgtccaactgtcgcattgtccaactgtcgcattgtccaacttaaacttaaattaaaacattctatttcaatttgttaatttatatcctcctgttttgaatctttttttatagctttataaaaattcaattaaataattattacggtagtttttctgaatattttggaataaaaaaattaattaattgagttgaattatcaaaaaagagaaaaaattagtttttcaaaatataaaatttacaaaaatacaaccaaaaaattatgacgctttgttttgagcatttatgatagatgaaatgtaatttgtacaaattaatttttattgcttttttcaataaaaaataatcgtctctatcattaagtttgtctcatttttttctttccgtgtgttcgcttttgtacccaaatggcccctcattaacaaattgataccatcattccttccctatttcctgtttaaattcgatgtttttgagggcattaaaatttatttccaattctttggctaacttttttatgacgtaaaacattggcgtcaaatgtacaaattaatggttttttcttctaacaaaatctgcttcttctctctcccattattaaagtgtctgtcacacttttttttccgtgtgttctcttttgtacccaaatggcccctcattaataataaattaatgccatttccaatttcgtgacttttgagcgcattaaacaatgctttccacaataatattttctaatttctgtcactttttggaatatttagccttaaaaaaggctgaaaaaatattcttatgcttgtaataattagatatgtttgtgtgtaaatttatgattctttttttattcatcaaagcaaattttggctaaattatattttataacttaccaaaaactcagacgcctctcggaattgtcgggacacccattaagtcaataaatgttgaaatatcattaagtcaattcccaatctgagaaattgagaggattcaaatttcaaagcgattaatcatgcttagacgacatattttacacagaaagcactgaaattttataattttgaacgtttaaaattatttttttatatgctacatgctgccccaatatgattttttt

SEQ ID NO: 19160 - DNA, 951 bp, Heterodera glycines
agttttgtcctacaattatgatgtgttttgtgcgaatgttgttcagcccgatcgtgctgtatggctttaatgtgcccgttgtggccaggcctttgattacggtagtggcacaattccaatcctacagtttggtcagtatgcgtttgcatatggtagcaatggctgcaaaccgtgcccatgctgtgctattcccatttcattatgcacaaaaagtcacaaaaaagtgggtgataattattaattattaattttttaaattgataaataatagttgattattatggcttataattatatggaaatcgatatcttttttcccggactgttgaaggcctgaaacgcaggaaaaacatcacatgtttttagcttagtttgaagcctctaggacggatttctatatccatatttttccatatttcgcgtagcgcagggtcgacttatattgtttttaatattatgcccccatagtaagaaatcaaaaagttatgaggcctcaaaaacgaaattttggctgtagtttcacttaaagttgatggctcagttggttaaattcgcatttttatagctcgggttcaaatccaacataaaataatttatgtataaaaaatcatttttttaaattaaaaaatgtatgatagtttttctttaataaatttaatcaaaaccaataataaatgtaaaggttgtgaattattagaaggtgaacaaagctgtaaattggtcgctaggcccacaatttcgtttttgaggcctcataacttttttttttggaaaatctttcataatctgtcacgtaaaattgcgtgacaaagacataaataaaatttgagtttttatgatttattttaaattaaggactgtatttattcaatgtatgctcattcatttgttggccattatttcagttccattttataatggtaaattcattttcaaattttaaacaatttt

SEQ ID NO: 19161 - DNA, 1027 bp, Heterodera glycines
aacggacactgaaaaaatcgattttttgttttggggcagtccccccgaaccgatgcgcccagattatggggagaccgatcctcggggaatagcttccctatagcctgtactttaattctgcgttggatttttgctccccataattgtttgagtaccccaaacggacacttgaaaaaatcgatttttttgttttcggggcagtccccctgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagtgcaccaaaattttatttacaacttaattttagcactctgatgctttagtatcaaaaaagaagatggagaaaaaatttttccttataattggttatatcgttttgcttttggtggggtgcttggaacaaatcgatttttttggtttt

SEQ ID NO: 19162 - DNA, 1069 bp, Heterodera glycines
ttatgaaaattatttatatttattaacaggatttcctctatattgacaatagtgaaaagggtgaaaaaaatgctaaaactgtaggagtgccaaggaggatgaaagtgaaataggaaaagaaaacctagcaaaagagagccaacggtgaagataaagaaaaagagacctaagagacaggaaaatatggtttataatccccagactcaaaactgaaaaattataatatcaatcgcctcctctcggtctccaaagcaagaatcagaaaaatttgacggcaagcaatcacaaagagttacattgagtcgggctggaaatagacacttcagtcccgagcagggctgggcgcaaccggattttcaattacggaaatccgcaaccgcaattacggcgattttctcagttactgaaatccgcaatccgcaattacgggggtccaaaaacccgtaatttcccgtaattcgaaatccgtaattttcaaaaatcaatttttgtagaatttttgaaaaaaaattttttaattgaattattaaaaatcaaaaaacagatttttgggatgcattttttaaatttaccaaagaatgtccgaaaaattcatttttttgaatttttagggtccattttggaaaaattttgaaagtctgagcattataattagatttatgtatatagttaattaaaccttgataaaatagccagaaaaaaaatttcggggggggggggaacccgaagactttttggccaaaatctttttagtgttattttaaaaatttcagcgccggagagcaaaaacaggaattgtagccgtttttagccaaaaaaggactaatttttgccatttaggagtcaaaatttaaacaaaaaaatagggtaaaacgagtgaatcaggatccgggggtgccgataggtgcctccgggaaaatttatctgaaattttaattattttattaagaaaaatagattaaaaaattttaaactgccaatttttcctggaaaaatttttaatttttcatttcgggtggagggaatccctccccctcccctgagtaagtttttatgaattttcataaaa

SEQ ID NO: 19163 - DNA, 1627 bp, Heterodera glycines
  misc_feature (126)..(126): n is a, c, g, or t
gccctggtcccgagtgggtactcgtagggcaatgttttccgctaattttcagattctcgctttagagacgagagggagtcgattgatagtcccattttaattgttggtattataaaccatattacncaagagacataatgacaaacatatatcacatcatatcatataattctgtaggtatccaaaataattattagtttggttactctccctcagaacaaattcagcgagtcgtaaacgcctccgaagctaattccgccctccgctgacgacgccggtttagtgcggacgaggtagccgtgctgtttgttgcgcacaatgcttctgtcacgtttgtcacccagcaggtagccgaacatacccaactcgacgattgtgtcatccaacacggcctcctccatgggacggaccatgaaattctgcaaagtgtgcgcacattttaatgaaattgcgcagattttcaatagtttgaatccctaatttgtaagtcccaaaataattgatagaaatattgatgctatgatgttaggcaaaaaactattaaaactttttgtttattactttgctaaaaagcaacaaaatttttaattcaagaaattctcaggttgtccttaatgttatttaccatcctacacaatttcaacaaatttcgttaagtttccaaaaaggtttagccctttttatgggttttgagtaaacgttcaaggatcgaatttgttcattaattgattactgctgggtttccccattttattaccttcgctgtcaccggccaaattcgttgcatcagtgtgtgtgctgctcgctcttcgcgcgtgaattgtagcagcttttgtttgagttcatcatcaaaataattgtgtcctccgccttcattttgcggtttcagcacataaagactgggattggcgatagcatgctgaacataatgtaaaaaataagataaaaatttttgaaaaaattgatgttgtttttgtcaattctattttgaaattttttaaaatgttaaaaaattaattaaatatttgtaggtaaaattttcctaatgtagaacataaaaggtaacaagcccggtgggactcgaacccacgacaccagcaatccgtgccgtgctctaaccaactgagctacgggcgcctcttttagaggttctctcaggtcctttatcccactttctcccacactccgttccttctggcatcacactaattttaaatgaaaaatgaacattaatgaaaaaactttctcgaaaattttagattttttttactctgttggttcgtttcttaaaaactagggttagacaggtccgagtattaggcaaaaactgggtccggtattgccgggtctacaaaagccgggtccgggtccaggttttgcaaagtcccggtatcgggtccaaccgggtcctgaattaatatttttcaaaaactaaatgaatttcacgaaagaatttgtaatttttcatttaaaaaaataaaaatattttctttagattcggtagcaaatcaaataagttatttttaaaaaaattcaataaatggcaaaaacactattttttgataaatggttcttcaagtgtcttaatgaaactgctgattggcttaataacaaaagttaaccgtta

SEQ ID NO: 19164 - DNA, 2129 bp, Heterodera glycines
aaaagcgctgaaaaaaaatcaatttcgatttttcatactcagattttcacaacaatgcttactatttcaaataaaaaattgctcaaattgatcatggacagtcaaaaatactgaggctttttgacccaaaatgaggcattattgcttgccgaatgaggcttttgaaaattttcatctgcgagccctggttataacgtaatgaaaataacaaaagttactcatttttttgaaaaattttccgagtcagtgtattttagggtatccgataaattgttccggatttttgtgcgctaaaatttaagaaatcctatcattagtcacaattcagttctttctaaaaaatcgaaactaagttaatattgatgtaaaatgtttatcagcacatatacacttcacacaaacatacatacggaaatatgaaaatgataatgacaattgacaatagattttgaggagcttgtgatatgtagtgggtttacacacaaaatgataaggggaattgtctgatctccagtcgtgttcccagggcgcttctccatccttctgttctgttagtgttcggtgctcatcgtcctcaggccggcgggaagcgggtgatgctgtggctcaggttcggcgcgattgtcagcgttgctcccgtgttgttgcggccagtgtagcgcggcgccgagaaaagggtgatgagccggcggccggcgaaatattccactccgtccatcacgacctggaaaggggaagtgggaatttagtccagaagcaaatgaaaaaaaagaaaaaaactcacttgatgcgcccgaatgatgtagtcgaggcagagcatgtcgcacacccgctccaccacgtcctcgccgaatgcgatgcccgctcctctggtgttcgggatgacgccacgaactccgcgcgcagggtccgcccacaaaagatcgatctccagcgtccgaagcggcgggtcgatttgcggacgattcaggtggctgagctgctccaggctgttgatctggtcggagaggccgccgtgcatacctgaaaaataatgaattagtatgaatggacaacaacaacaaaaaatgtgactcacacaggattttgtcgccgatcaggccgacgtagggcatccaggcgaacgtctgattgaagaggtcgtagaggcggcggggacccggacgctggtagcggcggttgacctcatcgaagaagccataactgaaaatggggggggggaatgattaatcacaaaaaaacacacaaaaaactttttcacttacactctgttgatgttggcgcactcgtggttcccgcgcagcagcatgaagttcgctgggtatttgacctgcaatggttttggggtgtaatttggtctgttaaagattcacaaaaccacaccttgtagcagaagagaagaacaattgtttccagtgactgggggcctcggtcgacgtagtcgcccaggaagacgtactgctgctctggagggttgccgtgcgtgtggaagatcctctgcaggtccgtgaattgtccatggatgtcgcccacgacgacgaccgcggctgaatcctgacgagtggcggttgcattctgaagatgttcgtggccgccatgcagagttggttgagctccaagtcggtgatctgtggaaaaaatgaaattttttaattgttgaaatgtcatgtcaaaaaaatcccacctcatccgtgaagcgttggacaggcgactgcctgaccttcctgatgatcgcgtccacgaagctgcttgacaggccatctccctcccagcgagccgtcgttccagtcggcgcgtgtacaagtgttgaagatgtcgtcgaaggccgagactgctccgccgctgccgttgcatcgaagcagtagtcctctcttgccattgttgcgccgggcacgtcgcttcgtgggattaaagttgcagacgatgagcaatatataataacaataatatgtgggcaatgaattatgtgagcaaacactgcaaatgcgctccttttatatacattatttccgttttcactatgggtcaagtccagtgttagacaaaattattcatttcgccaaatagcgtaattggcataattttttgcgcactaattcaaaatttacactggtaaatgccttttttgt

SEQ ID NO: 19165 - DNA, 2816 bp, Heterodera glycines
tttttggcgcagatagaaaacatcccgttaataaaaatctatttcgcctcccaccaaaaaaaaagtctttagtcctggtaaattgtaaaagtaagaaatatatcagcaatgactttttttccgtatccatactcaccttgtccaaaaaaactaaatttactttttgctattatgatcgaatttctctagaaattctcgcaaaaaattttaaaatatgttgtgacagaatgtattttcagctacatgtgctatgtgtacatgtcctccaaatgctcgtacgatgcacatgctgaccataatgtttattggagtaccatctgaatgtggtcaatatgataaaattttatttagatttggtagatgatcctggaattttgggccggaataatcgttttagaaaaaatttgaaacaattactagaaataattctgcgggaaagaattaaaatcattctcactaatcacagtctggatcgcgggtcattcatatgtggtctatggaccgtagaagaacgggctgacatcggtgatatttgaaggggtgaccagctatccagacacatccggaatgtgccgaccggtccgatctctagtattaccccaccctctacccataaaagccccaagttgaataatagtaccccagggattttattagaaatacagtcattgtaattcgtgcaatttctctgaaaaatcggcggagctgaaattgtcaaaaaaatgtgggccaacaaaattaaacaagctgagggagtcgatcggaaaaactaaatcattgagaactatgcgaattttccgaaatttcagaccatacatacaaaacaacacaaataaaatttatataccaacaatgaatgtgttaaatgaaacatcgctttgaataccgtaaatataatacaataatacgcacatacaatacataaacatatgcatggctaaacacagaatactggatacaatatataatataggtatatacagaatacaacaccatcattcaagcatcttcaatcttcatcatcacgaatcgtttccggcacttccacgccatgttccgccgcgctcggtcgcttctcggtggtgccggtggaccaaaagaaattggacagtttgcgctttgtgcctccttctgacttcggctttttgggaacaggcttcgtcttcggcacctcttccgcttccacgtccaaatctgttgcgcccagccgtttgttcgagttgtagtcgcttggcacggcggaaatcgtcgacactttcagttcgctttgtatcggcgatttgttgtcctcctttccgtgctgctcctcctccttattgtgctggtcaatgtggtggtggtcctcctccttcttgtcgtcagcagaagtgtggtggcgacgtttgcgctttttgttgtcctccttgtcgtcgtcggcagaagtgtggcggcggcggcgtttgcgttttttgcagcagcagcagcacaccacaaccacgagcaggacaatgattgcaatcagtgcgctgaaaaaacaaatggggaaaaatgtgaaattactactgctttttatctgctgtgatgatgatgaaatcccagggtccaaaaatgccagaatttcgtgccattgccgacatcccaaaaacactcattcgtcagggtcgatcccccaacaacccaaaatgccggaatttcgtcccagtgccggcactccaaacactcattcgtcagggtcgatcccccaacgatccaaaaatgccggaatttcgtgccattgtcgacattcaaaaaaacacgccttcgtcatggtcggtccccaatgaatgatggtaaacaaggacaaacgcacccaacgatgatcagcacaagtgtggtctttccgccaacagcatccgctaatgattcgctccaatttttcgtcgccgtcccatttggcgtcgttggcgtcctgctggtggtgatggtcgtcacagtattgctgaaaataaaaattttataaaaatttggcattttgccatcaaaaattgtttacttttccattgattgcgcgtcaaccgagcaaaagcactcactgagcagcagcagaaacgcgacaaaggcaaattcccatttgaatttgatgaaaaatgaacgcgacggcatcatttgttgttgtagttgaagttgaaacaaaaaccaaaatgacgaaagtgaacacagaaacccccttataaggggagagaattttgcgcataaatttttgacgccttttttaagcggccccttttttcgctgagacacgaaatatccaattttttaaatcttaatccggtagatgaatcatataggatttctcggtttcgcagaatacagatcatcctttcccttgaattaagtgttgattgattcgcatgttggtgaatgtgccaagagatgttttaaatgcgttgttcatcagcagcgtcatgcatcagcgtcgctataaaaacgcctatcgcgcgtcatttcccattcatgtgcattgcacttctcacgacgccttgcactgtcacgcaaattgtgatgagtatgtagctgtctgcggtcctcatgcgtggtatttcgactgttgccatgggcaagctttcggatgtgaaagcaggttgccgcgattttttgcttcattgtcggtcaagtatgatcgcattgatcagcagagctcattttaagttcagcacagttccatcgtcttagaagtgcagcacagtttcatcgggtgtgtcgaagtatcctgcaaatgcgaaaaaaggaagtattctcgcctaactatcagttcggtgcaccattgtcatctccgttataattgggtgagtttgtct

SEQ ID NO: 19166 - DNA, 1893 bp, Heterodera glycines
gaagaaggtcattggggaagaggctacaatattatccattaggcgaagaaaaaccacaccaaaacggacggaagagaccgacgacgaattcagcggagggaggggggacactccctcggatggtgccgtggggaaggggcgagagaatgccgacagccattctttattcctttgtttgtttccgctgggattggcacaaattggacagataaacgcaccgtaaggtaataaaggggcgtaagtcgtccttgtgggatgttccataaaagaagggattaatgaaataatgaaagtaggtggggaagtgaaaatggaggaaaagcgcgaaaaaacaacgggggaggaagaaaatgagggaaacgagagaaacggggaggggcggaggggggggggaagagggtaaggaaatcactttggccgtcttttgatgatgctaatcggcccgcgattaaatgaaataaacttttgtttggagaaaatcacatctctgctgctgatgtggatggaataactgctcgggctttcttccgattcgtctctctctcctcgtttctcccttcctctcttctctctctctctcctctctctctctactcctctctctctcctcctctctctctctctcctctctctctctcctcctctctctctctctctctctcctctctctctctcctctctctctcctctctctctctctctctcctctctctctctcctctctctctctctcctcctctctctcctctctctctctctctctcctctctctctctctcctcctctctctcctctctctctctctcctctctctctctctcctctctctctctcctctctctctgtctctctgttcatctttctatcactgttcaccacacacctcctgctcaatgatttccttggccaattcgatcacttccgcttgcaatccgccgatccatcgtcctttcggctgcagcattatgatgtgatcgttcaaatagcacttccaagcgtaagtcatgcacaaatcggtgaagccgacctcacgagtcgaagaattgggcagcaaaacgggcacagtcaaattgtggagaatgaactcaaatttagtagttgaggtggaatatcaaattgtttagttaaacgtggggagggaatgtgatcaagaattgtgatcagaaaagactgactaatggccgtgccgttttgccattccattgattaattgggcaatttgccattttattacattgcccccattagcctttctctctctctctctcactttgttaattctctccaattcgttcaaatagtccctcgacagaatgttcggcctctctcccccttcgtcggaatttcttcgtcccactgcgatcacatcgacgtagccgaagtaatcgtaccttttaagtttggacaattctcgcagtttaaggccgaatttctccgtttgttacgatttgccgggccaaaagtgctgctcgtccaacggccaatgctccgacagcgcggcacgttcgaatttccaacgcgcattctctggagaaaagacgaacaaagggtccctggtttcctcaagaaccgagccaaatcaaagattaaaggaaggaaggcaattggcaatttgaatttggcaaaaaacgccaaaaatgagagagagaagagaccactcacttggtcattaatccaaaggaagccaaaggcgaggaaagcggtggtcagaaaaggtgccaagaaaaggggccatcgaaagcgatggacgagaaaaccccaaagccaaaagagacggacaaagcgacggtcgagcgcaaacgaagcggcggaaggccaaggaaatttggaccaatttgagagtaacgaacggaacgatgccatttggggagtaaaagaggggaaaggaaatga

SEQ ID NO: 19167 - DNA, 1790 bp, Heterodera glycines
gggaggcgtactgtgaattttgacgtagtgttctcctgccccggtgtgttcgaaggtagtacaatgtaaaaatcatccatctgttttcactaattcctggttataaaatatgccttttattaaatttccttccaaatcttcgatcctgtatgaatcgggtgtagttgaattaacaataacgattttaaataattcttcggtaaagtttgggagatacccctttgcaaattttcctttttccttggtaattcgaacgatatcgccaattttaaatttgttctttttcgaaattttaaattccttcgccttatataatttttcccagagcgcccgggcattttcaaaagtaacggatactggcttggcccccaatgtcctattcacactgttgttaatgtttattattattttgtctattacatcgacccatcgtagagtgtctttctttgtaaaatatctgtacaagcgctcctttattgtccgatttgccctttcaacgactccggcgtgaaggtcaggactatacatcacatttttgataataaatttttcctcaaaatattttttcatttttccagcctgaaactcgagtccgctgtcgctatatattttcatcgggataattttcgacttttcgaacacccgatcaaaaacctcaatcatgtcctcactcttctttgacttggccggtgcactgaagatcattcgactcagcacgtcgatgcataccaacagatatttgtaaccgtcgttatgctttttcaactggtcaaatatgcacaaatcgcactgccaatcggtatggaagccgctcggtaccgtctttagtctcgggaattttttcctgatgggcttgtgaatcgtgtatgttctctgcttttctaggaatttattaacgtcatcggtcgtaatttccgggtcaatctttttggcctcatttaaaattttttgaatcccagcaaaacttgccggagattttaaattaaaataaatttttgataaaattttctctacagtcttgcccatattagtggattgaatggtttcttctctcgtgctatgccgtgtgtttttatagattttattgcctttttacttccacgtccccacatgaccttcgatttatcaaccatgtcttttactgttggatccttcagtaaaaaagaccgtttaaaagggtcgggtgtataatagttttggtcggaacgggtgttttgagtgtggatggtgtttggggttccggagttaacgcctcaagggtatcattatctgattcaggatcaggagttcgctctttaagtcttttcctaggaataattattttccgtggttcttcggtctcctgtggtttggattggttattgaggcccagatatggtgcaacatttggaccgggtacatgattctcaatcacgaccttctgtggcctattttcaagtatcccctttaccgtacgtctttctttatagagccaatcatgtctcttcgccttgaggtcctcgcttatgccggggtcttgtaaattctgagaaatttttgcgtctaaactcgctttttcattttggagataatcaccactattcatcgcactcagtagagccaaatattccgcctcgggaatcattaacattttctttgcaaatttcatgatgttattttttctaataaatgttgagctaaaacactcagtaccgggaccaagacagctcccagggctataccactcccctgttgtatcctttttcttgccgttttatctgaacgagatttggcaatttccctataaaaat

SEQ ID NO: 19168 - DNA, 2487 bp, Heterodera glycines
tctagagtcatttgttcgagtcgtttcggacaaatcactgattaaacatttcaatatttattgtgcttattttgattttattgtcagttggatcactttctttgccccccgccccccgcggcgccgcatatttttgctgggggcggcggggaattcatttcgcacgcgttttgctgccgcgacttttgacgcactttcacagccattgatcggctatatcatcgcctgttttctgctgccgttggcaatgccatctcttttcctttttccttttcttctccgtttgattctccgactgattttggctaattgaatttgcccggcgttctttgctcttccaatgtccatttctccaaattgtccctttttgcttctatttttggcttttttgccttttgaaatgagtgattattcatctgaaagagcgatgactgagtgaataaaaatgggcgaataaattgagggagaaaaagttgcgcttatttgttaagtggggcaaaggaagggacaaagggacgacggagggacacttttgaggggagacaccgccgcaagggacaaccagcggaccggcgacggagggtcaatccctccgaccaaatgatccatccctttccttccctagccaatgcttttcctcttccgtccaccaaatgcttaaccccccccccccaaataatgattggatttactttcaatttttggctaaaacccaattttgaatttaatttcacagagagacggaggagcgattcgttcggcggatggaaaaagagaacagcggccgttgttgcaacattaattaattgtacaactgttgatgactgtgccaatcccttctttttggccatttggcaattctttgcttcaaagggattcgtccctttggcatcccttcggggcattttcgtgccaaatggcgaagtgtcaaaaggaaggcgaccaacgaaagtcactccatgggattcattggcgtcgctttggcatttcgtctttcctctcaaactgctcacaattcttccacactttgctgctttttctgttcttttcatcgaattttgtcgctttgatcggtgccaacaaattggacacgttcagcatcagcaacaggtggtgatgtgatgtccattctccctcagctttgtccaattgtccgcctccgttcagtgattccgtctctccaaaacggtttttctctgtcctccgacttcgcatcgaaaacgagtcgcaacttcgctttctgatggaccaatttctgcggaacagcacacgactcgacttttggaaggagccgtcgtccgtcggagaagacgcgtgggcttttaaatgtctttttcaaagcttttttaccgctttaagtcacgtgatggtcgcccgaggcccaatgcttaacgacttcagtgaacgcctgcgagaacaaaacatttcgtcgcgagtgatgatcgaagacgtaagcgaactgattagaagacgtgcgagagagacgacggaaagggaagccaaacagaggaaaacggaaagcagcggcaactatcaaagggtgggaagaggaggacaacaattaggtggacaattaatggggggggggacaaaatgggttgccaattaatgatcaataaaattcaaatagaatttaaatatggtctgatttggtctgatccgatcaggatgagtccatttggcctctgtctgacgatgactcggccattcgaagcactcgccgacgaaaagcgagctcttcgggtggttttgcgcgcttctccatgtccaagtaccactccttctccgatgtgattcatcatttgtgcgtctttcatttcccaaaagaattccgccaaaataaattaatttttaaggaatgctttggctgtgaactttccttcacgtgtccaagtgcaaccgatcggaacgacgcacgagggaagacagatccctctgatcaaaattggcaccagtccggcgggcacaaagccggccgtttggatggacggtggcattcacgcgagggaatggatatcccccgcggcagtgctttacatgatcgatcaggcaattttggggttgatcgatcggtcgatcaatgtttgtcttagttagtgacgggttatgactctcagccggcgattcgtcagttcgttgatcacttggattggttcattgtgccaatgctgaacccggacggtaagctttgggatggttttttgaatttgttttccgctttcgctaggctacgaatattcgcggagcagcgccgaccccgaggttcgcttgtggcgcaaaaaccgttcgcccgttcagtgcacccaaatcagcacgggtaagcgaaggaatgattagaggtattgagggtcagagaacaattcactgattggcgaatgaattttactaagcgacattttcgtccgatcatcgcctgctaattacttcccttgccatgtccgaccatcgggtgctaattgcccctccccctctttggcttttgttgat

SEQ ID NO: 19169 - DNA, 3063 bp, Heterodera glycines
attttcaacatttttccatttctttgtcactcattttcggcttttctccttttatttgccaatacattttcattttctccattttttctttctccgctattatttttcggctaattccaaattgcttcatccattttctaagtatgaaaaggccaactccaattttcttacaaatttgttcataatttttgttccattctttttttgaatattttcttcctttttctttgtattcatttatcatttcaatgaatttctgtacagtgtcaagtttttcttcttcagtcattgttttgtagcaattcttttgatttaatcccaattctttgatccattcataaatatatttgcgatttgtgcccaatttttttgctatttttccttcaattttattccattctttttttgaatattttcttcctttttgcttaattttctcttttattttataaaattttccaattatttctctttttttctgttcttcgtttcttttttcttcccatttttctccaaatatttcatcaaatgatttttgttccaattttttattttctgatccgatctgatcagttcggatgatcagaaataatattgaacagaataataggcacaatttcaaatgcattcttttaaaatattactaattttcaaataaaatgctcaatttgacagaatttgtttaatgttttgaatatattattaaaaataatccataaatttgatgacgttaattagaaaaattttcgcctgtttattggctttttcaaaatttggctgtttttgtacaaatttttgtacggtttcaaattctattttcaccagcagatttcaaaaaatttaaattcggaaaaaacccaaaaatccaaaaattttcttttcatttttggcagaagtgtcgggccatggaatacataaactgctcgtgcttttgctaggcgccgcggtccaatcaccacaacgtgaacatttcattgaacgcaatggattttttccaacatttttttttgttttcactgatcatttgagcatgaaaaatcgaagttgattttttttttgcggtgctttttccaaaaaacttggggaacaagagggggccggcgtgccgataggcgccgccgggaaaaatttttgtaatttaatgaggtttgttaatagattttgtccaaaaaatggccaaattttgcaattttgagttctgaggaggttgaacaataatcccccatggggataattagaaaatatacggtaaaaggcatatacataaatttccataaaaattttcttttcccaacttttcccactaaaaaaattgtgttaaaacaagcacatttttaaatgcaattataaagccgaaatttactgattttttaagttatgccacaattaaaaaatggaagaagcaatttggcattagccgaaaataataacggaaaaagaaaaaatggagaaaatgaaaatttattggcaaataaaaaaagaaaagccgaaaatgaatgacagagaaattggaaaaattcaaaaattgaaattaggtaattagcatttgaaatttttcaaaaaagagaaaaaaattcaatgaatttttattctaaaaaattatttataaaaaatttggcaataaaattcatttattttcaataaattgttttcttttgcagaaacatttaatcgctaagaattaaaaaaataattctcttgacacttttcccgcacaattaagccctccccctccctttgatgtccccgcccaggggaaaaagcttcttttttttaaaatgtgcttatgttttacataagtaatctaaaagaaaaaaaaattgtcatgaattacataaatccctaattttaattagccaatcatagaaattaattatttgtaaaattgcgtcatcaaatttttaattagcatttttagatggaagaaacaatttggagacgaaataatggaggaatgaaaaacggatgattctaagaaaataaattgacaaattttgcctaaaaatgactgatgaaagtgtgatttaatggaactaaaagaatttctttaatttgtaacaattaatgttgagtagtgaacagggcttggcgtaattatggattacggaaattacggcattttttgaaatatttatctcaatacttggcatttattttgttgctttttggataaaattttacaaaacaggcgaaaatttttctaattaaattaacgtcatcaaaattatggattattaacaattttaataatattttttattaaacattatagaaattctgccaaattatgcattttattatcaatttaaagcaataaattttcatttgcctcatttgtgatgccaaataattcataaagcttaaaatttcctaatttccttcatcaaaattattaaactgccaatttataagtttagcaaaataataatataattaagaagaaaatggaattaacacgtatattattctgtttaattttatttttgatcaccctaactgatcagatcggatcagaaaagaaaaaaatgaaacaaaaaacatttgatgaaatatttggagaaaaatgggaagaaaaaagaaacgaagaacagaaaagaagagaaataattggaaaatattataaaataaaagagaaaattaagcaaaaaggaaaaaaatattcaaaaaaagaatgggggaaaattaatggaaaaatagcgaaaaaattgggaacaaatcgcaaatatattcaaaaatggatcaaagaattgggattaaatcaaaaaataaatcattcaaaattaaaaactgatgaagaaaaactcgaaattgtactgaaattcattgaaatgacagataaatacaaagaaaaaagaaaatattccagaaaagaatggaacaaaaattgtgccgaaatttgtaagggaatcggagtaagttatggcacaattacaaaatggaaaaagcaatttggaattagccgaaaaataacggagaaagaaaaaatggagaaaatgaaaatttattggcaaataaaaagagaaaagccgaaaatgagtaacaaagaaatggaaaaatgatgaa

SEQ ID NO: 19170 - DNA, 1720 bp, Heterodera glycines
gaatatgttgaacatgtcgccaaacaacggtcatctcgtcaaaaaaaaattttttctattgaattttttgttaaagaacttctgaaaatgaccccaaaatggcaaaaatatgtaattttcttgcttccggtatgcataaaaaattggaatttttaatgaaaagttaagaaaactcaaagttaagtaggtcatttgtccgaaaaactggtcaaaaagggaatttttccgaatttttttagagttgcatcttttttttgcgcccgtagcggcttttaagttgccgtgggtaatgggcgaggtggtttttggttagagcattttgaggcggttcttttaaaaaatttgagtccctagcccaaagttgagttggtcatttgtctaaaaatttggtcaaaaaaatcggcttttcgcagtgagtgggggattttgggggtaattgagtgcgtagagcttgatatttggttttaaatgggttaaacaatgttttgacaggtctaacaatgtttgggagtagtgggacaaagtgtcgacaagtcggtcaaaatgtcgaaatttttaacatgatcaaaatgaagttttttttgtaattttttatgttttgaggcatagaaacagccttctgggcttttttgcgcgagtttagggcaactgaaacggttaaagatggacgaaacgatcacgaagaagccggccaaataaattattaaaaaattctatttatccccccccccggcacataaatggagactgggagattatttttcaacctagttcaaagggggtatataattggagaccggcagattaatggagactgccccctaaaaagcccccggccgcttcttcttcaggcaacaaagcttttagccaaaattgaacaaatggagcatatatgtatttggcgccccgggcagaagacacggtaaatcccggcggactttccctcccccgggggctgtccaatcttcgcaattgcttttgcctttgtgtccaaaagggagaagcgccagcacaacggagggggacggacaattcaatcaccgaaaacaaaaaacgttttttgcttttgattggtccaaatgatggcttttttaagatgaacattgctctttctggggtctcgtgctcgtctccgggttttaaacgagcacccaaatttaatttaaacccgggttaatggcgacaaacccgggttaaaaagttggtaaacccgggttaagggttaacccgggttgacaaccaaaaaacgagcacagaaacgctataaacccgggtttagcgtaagggacggaaacccaaagacgagcacaccaatagtgattaataaaaatcaaaaaactgattttcttgatggagtttcttcattttttatttaaattttacaaataatttataattttgtgtctgatcaaatcattctttttgaatttatgggttgatttttgaaaattttttgaaagtctgatcattataatcggatttatgtatatgtatataattatttcaacattttaatagccagaaggggggggggggggaattcctcccctcacctggctaaggttttttgaattttcataaaatgcgtgaaaaataggtgtgacaaaaaagtgatgcctctattttataggcgaactacccaaatagccttaacaacaacaaataaaaaataataaatctagctattttaattcttaaataaatcgaaatacgggtagcc

SEQ ID NO: 19171 - DNA, 1215 bp, Heterodera glycines
cgacatttgcggaccactatttctgggttgaactgtcaaaaaaaaacaaaaaaaaataataattttttcaaaaattgagtgactaagtagttttatttggtttgccaatttaccacgccctcagagaaatatttaatgtcgacacttttgcgctttcgtatacaaaaacgaaaaacaaaaaaaaagttgccaaaaggagaaaaggaaaatgccaaaattgcgaggaaaaaagtgtacaagtggttatgtgataatgccaatttgattgtttcaatttttatgccgaaactgattttgggttttactactgccaatgatttttgttaattaattaattaattattttcccaatttccgtctttcttcgtccatttgcgcatcgtctcgcactttttccgccaaagtccgaatgccgggaaggatctgcaaaattggcaaagaaagacgagacacaaactcgttatgttttaaattcaaatttaagtcaaaaatctctttttggcattttgcccctttcggtctcttccctttccctttctctttccctttttctcaccttcgccgcttcgtcattaatttgctcctcggggaataaaaacccgcggaattgtcctccaaaatagcccgaactcagctccatagtgtacacatattttatgcccaaactctgcgcataatcgtcgcttccgccggcggccgaatctttcagaattttggagaaaatttgtcagtgtttccatgccaaaattggcatttttcttttttgaatgggctttggccaatgccttgtgccttggccattgttttgcgccttttccgttccttacagagaatgtccggtgccgtgcctacttcgaattgcgttccgcccgcttttacaatcgcttcggccattgcatttgccagcgttcgcttgaacattttcgattttccattgacttttaattcatttcttttccttcgcccaccaattccttcacattgtccgggtacgtcttcggcttgtaattccacggatggatcagcaaatttccgtaagagtgcagcgtcaaatacgccttcagcgagtcgcggttgttctgcatgaatttggccaaatgggtgcactcaatttcggagagcggcccatcgccactgaacacttggctaaaggggaggaggaggaaaggggacggggtactcctaatggacggaggggagagaggggcaattggt

SEQ ID NO: 19172 - DNA, 1010 bp, Heterodera glycines
tcatttaaaaatggcatttttattgcttcacatacgatctttgtccacgaatggacgtatccgtccgcgttcagaatcggaatgacgtggacatcgatgtgacggagcaaagaatggaactgagggtcgttgaccagcttgaagttgacgggcatacgaaaataaaaagcaaaaccaaatgccgaactgaccgcgtccacaaaatgaagtgccacggctggcgctacccattccctggcgtggattccggcatcgacgagaagagcgggctttttggagttgttattggagggatatccgagctgaaagttgggaggattgggaagggaaccaacagcagaagggaggaacggatcaaaaaatgccattggattagatcagccaaaacaaaactttggcctatcactcaaaaaatgccgaaaatgaccgtcagaatgggcaattggcgcccctcaaaagattgtccgatggtgccaaagcgagcgaatgccgaattatgttgggcaataagttgcaagtagtggacaacctgaacacgacggaggcaaacattagaaaggcggcaacaaaagcaattggccaaccgagtcgaatcggtggaaactgcccaagtcgaattggtccggccgttggcactgctccgtcggctcgtccatgcttcgccatgtctctgctgccccccgcattatttgtctgttgccatttttccaaattgaccctcgttcccgtatgattttccttactttccaaagtctttgaccgccgtataatggggaatgcggttgtgttgcagatactgcttcaacttctcctggtgctttggactcgcaaatatttccgtgggtacgcctaattgagggcgaagcttccaaaactgaactccttcatgaccagaagcatcgtaatggatggaaaggttgcgaagaacggccaaatgggaggcggaggaggggagggcgaagatgagacggtaactgacaatgggaaaaaaggggggggggggggggggg

SEQ ID NO: 19173 - DNA, 1295 bp, Heterodera glycines
gccgagtatggcaatggcaaacacagcaatggacgagcatagcaatagcaacaatttgttgggccaagtgaatgacggcggtggtgtcgatgccaattattgttgttgttgtgtgacttggccatggacagaggacagattgcaaaaaaatttaaaaaataagagcaattaaaaaatggacattcaaaaaacagtgggaaggaattggataaaacaaattgatgaaaatacgcatatgcattgaataaaaaaggcaataatagcagatattcacaagtgataaaatcaggggcgtatctagaaacatttttcgggggggggggggggacccgaccttttttttttttgctatttaaccaataactttttttccactgctgggtaacaactgcactttttcactaaaaatgaccaaattttggccgttttaaggcaaaaaacttgtaaaaatagtggaagtaggtccggcggtgccgataggcgccgccgggaaaaatttttggaaatttgagtgctacttgttacgaaatttgcctattaaactttttaattttcgtttggggggggggaattcgaaaaaaatttccattatttgctggaaaataggcaaaggcactaggctcagatgaaagctaatatacactctcattatctgctaattgaaccgattgacgacaggcagaaaaaatggacacgtttaggacccaaaaatatttttggcacacattgacgtgcccgttttgcaggagcttaggtagcagcgcaaatgtttcaaatggtagacaaagtggtggcgacgacgtttttgatcggtgaaaaaataaaagtgatgacggggaaagagaagaagcattttgctcggccgaggaattgcggacaacgcaatgggaaattaaggcttatgatcaattggaaatgatggacggggcgaggagtggtcagatcatccgtggccaacacacacactgtgttcgcgcctctcccaatcacttccatcacacaaatcctccgccgccgaaggcggacggagccgcagcggtttaccccatttgccgtttgggattggcctgcttgctgcacacagccgtggccaaggcagcaaacaccgcttgtgcgctcaccactcagccgtcgccgccgtcggcgggcggggacggttgactgaatgatcagcagatgatcagcggagctgatccgcggccgctgatcgtgcgctggcggtcactcgagtggggtgggccaaagtgtgtgtgtgcaggcagggacggactcactctgctgatgactgcacattt

SEQ ID NO: 19174 - DNA, 968 bp, Heterodera glycines
acagcgtcatcgttgtagtcgttgtcgtcgtcggaagactgactctcactctcgactcactctcgaccaccgcacattggcccataacacacacagaaacagtcagcggtcgatggatgtgtgtgctgcttggcccccgctgtgtttgcgcacgacatcgacggattgggcggcggtggcggcggcgactccccgccgacggggatttcttcagagtccacccccaacttcatcgatctgctgctgctgtccgattgtctgtttgttgttcgcgacattcgacctcatctgcaacaggagttattctcaatagccttctcaatctgctgctgaatgttgcttcctcattggttcaacaaatttcttggaaaattccaatggggggcaattagtgacaaatttgttgctcaataaatatttgtcatcaaaatggccaaaactgtgtcaaattctggcaaattcaaaagaagaaaagagattgtgcaattaaattaaatttggcaaatagatttggcattacaaaggttgagaagcattgtgaaaaaacaaacgtatctttttaaattaaaaataatccaatgtacattaaactccgattttcctgggcctatttcaattcagaccatatctcagatacgacgtgtcatatatcatatgcacgtttcaattatgaactgacgtgccataagatcatatcgtatgcggaacttacatatgacggccacatatgacatgaaatcatatgtgagtgtcatatcagttttgggctgtttcaattaaaattgctacatatgatgtatttctatatatgatgcctacatatgataccaaacactgggataaatataagctcattaatgagatctaggccgtttaaatgcaaataaattaacaaaaatgaataaaatgttaacttttttttatattacgtacaaatatttttagtgtgtaaaatatgtttagagtga

SEQ ID NO: 19175 - DNA, 1391 bp, Heterodera glycines
ttattttttcacaagatatttttctaaatttttaaaaattctcaaaatatgtaaaaagaatgaaaatatgtacgaaaagtccaaaatatgtaaataaaagtcccaacttttgttcgcaaacacaaaaaattaagtgtttttcctactatttagagcatggagaagccaggaaaacaaacatgtatttacataaaaaaaagtagccctggtgatcagatgtctgtagcttttccgagacaattttatcgttgagatgaagtgttcatgactggaaacatgcgtgtaatctggacattttgctgtggtgccatacgattttgatttaaaattcgtttgaacacaaatggaaactccgtttgaaatgcccgacgatactccgtactaaaatatgtatataaaaatatctatttaaatattttagaatttaaaaaatacaccttgtcaaatataaaattggcccattcgatgccccgccaaagttcaatggaattgcggtgattatatgccaaaaccaagcagtgatcggtgacgaaattgaaggcttgatcaaaccgccataaagcattgtgatcaaatagccgccaacattcactgtgagaatgcaacaaagtgatcggaaaactcgatggttgatcgtctcagatgagggcaaaccttaattagggcaattaaaatttgtgtgtcaatttttcattttattaccagctgatttaaatttgatcacaattccaacaaacaaatatataatacaagtcgctacgaagatgtagaaaaatgtcatgttaaagaatgaattggtatgctaaaatttaataaaattgtaaatgtggccataaaaaagtgacgactaaaaatccaaaattaaacatatttttcccaaaatgtgagttaaatttcgcagtttttgtaaaattaaactcgaatgaaaaaacctattgtttatttataaaatattgagctaattttattatcaagattttgttgaattttcatatttttcctggctgcatttgtcggcatagtcgaacactacattgactgaattttttttaaaatttgatcaaaaaagctgaaaatttgtcattttggcgaaaaaaatgctaaaaattccctttttttaatttgtaccaaataaaagtcagcaaggcaaccagtgatcaactgatcaccatctaattttgcgaaataaaacacattgatacagttacagcaaccatataatacagaaaaaattgtcattgagcctaaatacaggcgaattttgaatttggagtgcctgaaaaacaataaatttttgagggatttctttgtgaatttacatttcattgaaaatatcacaatcaatcgatcaatgccagtgaaaacattgccggcgtataccacctaaatta

SEQ ID NO: 19176 - DNA, 1966 bp, Heterodera glycines
ctgcaaatgcaccacttggggtttgaagaggtgaatttcctttgaaaaccagcgaaaattcctttcgaaattcctgccgatatgctgtactaaaagaatttttttaaaattattttcatatttatttagcattttctaaatttgcaaatacacacctagtgaagtataaaattggtgcatttgatgccgcgccaatattcaccacaattccggtgataaaatggacgaaccaagcagtgatcggagaagcgattgacggtttgatcagattcaaataaaacgcattgatcaaatagccgcccacattaatgacaatgatgcaaaaaagtgcacggaaaacgcgctgattgacctcatcagcggatggaaaacctaatgaatgagaaattgatctggatacattatcaaattacagtatcattcaccggaagatttcacttttaccacaaatccaactaacaaataaacagtgattgtcaatgggacgagggaagttcggaaaattgatgggttggggccctaaaatatttgaaaaaactatgtatttgattttggatatacaaaaaaaccttgaaaaaatcgataagacatccagtgatcagctgatctccatacaaatcgatactttggtataaagttacacaaaaatcaacgcagaaggcaatacaaataagcgttatcatggtcaaatacaatcgcattttgtgtttgttgtgactgaaaaatatcagctttatcattagagctcagaactatatggacataaataaaatcgcaaaatatacgcataataaatttaattattatttttgtgaaaatatccacaaaaatatgcatatggaaatacgtcaaagctagaaatatattttcgtgcgtttcaggccttctacagtttagcaaaaaaatatgcatgtgcatataatttcgagccctatttacattatcaaattagttttttttaatacatacatttcttcaaaaaatattccgatcagtctgtcaatgccaatgaaaagcatcgccgggtaaattccaccttaatatatatattttttttaaattgaggattggttgtgtttaaaataccgagcccaaacattgaaataaaaacgatctgaacggctaaacgatacgcaatgaaattttgtccagaaaatgcggtatacacaaaaagaaaattgccaagttgatgaagcaattcaaaaaaggagcaaagagccaaaaggtaattaacggtgccacggaatgaccttaatatgaaaaacaaattaattaattttcaatccaattaatttaattgcccactttgtctgaactgttacccaaataacagacaaattgaaaatgattccaaatacggcgatgcttccattgacaaacgaacagctgatcagcggccagttgggatttacatctttgaatgacaaataaaactgaaaacccaaattaagaaaattattttccctataatttaccgaaatgttgttggaatcagccattaattttgaaaccaaagcttttatggaaattaaaatttattcaggtgcttggtcactccgtaattttgttgaaaagcaagtgtcgcgtcaaaaaaagtattattttttatttacacattctttaatcttattttggcacctttgaaatagtttaatgcttttcggtctcaatgatgtgatggagttggacgagacgtgttgagtcaagcaaagacccaatcgtggaaaaccaaaaaaagactacaaaaattggcattttgggacaattgaacggaaaaaaggttaaaaaaaagcaaaaaattaagaattaaaaaagatatttaaactattttagaaggccatgcattttgtgcagcaataaaaaatcggaaaaagaaaaaatgtaataaaaaaatatatttttatatggcactttttaagtagcttctatagtctctctctctctctcacaagcatgccaactaatt

SEQ ID NO: 19177 - DNA, 1813 bp, Heterodera glycines
ccggggatctctagagtctttaataaatatgttgttttcagcaaaagaaaaaatttataaaaaagtgaaattcattgaaaaaggaaaaacaacggattcaaaaattgatagtaaagcgacagtcggaggtttttaaattcaacagcttggatatttttgacaaaaatccgtttcaatgttgcctaaaagctgtcaatttttcattgttggtatgtatctgggtagccttaattcagcaaaaaaaaaaaaagttaaatcgataaaaatcacatccctactcatacataactagggctgggaattttatgtaagaaaaatcgcgaaatgtgtaaataaaatatgtatcaaaaatgctaaaatatgtatgaaatatgtatgtataaaaacctccaaatatgtaaataaaattttaaattagttattttttggacaattttttcttaaaagttgaaataggaataaatgcaataaaaatgaccgaaataagctaaaatcacattttagtattttaaaattaagcataaaaatgtgaagtttagagaccggttttaattcccaacccgaactcgaacaaaaatcgattattcgagcaattagaatccaaaattgacacataaatgaggttttatgcaaaagaaaacataaaatataattcatggaaaagaaaaaaaaatggatgataaattgatagaatgataaatgacagtaaaagcgaaccattagaagaaaagacagaagatagccaaaaacgggggacagggacatcccagcctcattcgttcatcccgttctacctggctctactgcattttacgcgtccaatcaaaattttcctaaatcgaacatccttttgacataaggtgccaagtagggttgcatccccgacgtcggggttggaaaattcggggttcggggttgtcggggttggaagtgtcggggttcggggtcggggttgccaaatcgttcggggttcggggtcggggtttttcaatttttgccttatgccaaatagtcaaaaattttttaatattttttcggaaataatatttattaatttccataataatatttgtattgtttttatatttttttatttcttttttatcagaaattttgtatagaattaatttttttttcttgaaatttaaaaattttttattacctttttgttttccaaaacatcttttttcacgtcgctcttttctaaagacttaaggagaaagggtacggcgtccggcggtgccgataggcgccgccgggaaaattttgaaaatttggttagatctgttaacagattttgtccaaaatatgctaaatttttgcgattttgagccaatttttttaataaggtttatgactttttgggccctgtgatgccgataggcagcgctaaattttggaattaagctctattttctaagatttttcaccaaaaaaatttatgaatttcggtaaatttttgtttttcttcgatatgtattttgtcaaaatatgccaagattggtcgatttctatgagtatttaatttaaaaaaaacaatttgtaacaaagaaaaaatgattaaagaagaaaacgtcaaacggtatcgaactcacgacagaaagtaatgtaaatgtgatgcactaacctctacaccacattacaaatgtccaaaatcgagcaaattttctttatttaataaaaatttggcaaatggttaaaaaaatttaaatttcgtctaacttttttgcattttctcccacgaaaatgccattcttaggggtgtatatttaaccccgaccccgatcggggttaagggtcggggttgtcgggg

SEQ ID NO: 19178 - DNA, 1327 bp, Heterodera glycines
gcgctaacccccgctagttttattaaaaaggttactgtcgaaaacacctggtttaaaactagcctaaaaaataaaacgccaatacattcaaatttaaaaaaacttttggtgggctttcatttttttctgctacaaattttttgtttatcttggaatgtacaaatgcacgaaaatgcatttattagtttgtttcatttggctccctcttaatttagcaaattccaaattttactaaaatgagcgaccattcgtcggacgattcaagcggggctgagggtggtgatacttaccaagtttgcgaaaaaaacagcgtcccatcactttttggaatttcaatggattttttctaggttgaacgggtgttgaagaagcgcattatcaaaggggggaaggtggaatattacatcaaatggaaggtttgaatttagaaaaactttttttacattttaaatccgtcccctttccttttcagggctacgaaaacatagaggacaacacatggtaaagatgctctgtttttttttctgaatatttgcatttttctttacgggtttccgaccccggcgcattacttttcgattttatgtgccttgcgctttttttttgttccacgcgctaccgccaaatttgtgagatcaaaattgtcagagtatgggtcctgaaatagtgtccccccccccccgcaagtacggaatctgggacatacgcccttttgttaaatttaaaaaaaattcggatgaacgcacaaaaccgaaaagtttaccggtgtgggtttgtaaatagagcccgacttggtttttccggaacccttgcctttaccggtctttaaatgaactcagttcatcattttaaacagtttttgtctcgaaactcggtccttgtgcaattcccaaattccggccctgaatttacaaattactttcctagtagtgagtggtcaactcagttccggtcatggtcaaatgacttactgagttcttcttggccaagaaatcatctccctgcaggcggcgcttatatgtgttgccgcaccaaacgattttccgttattttaccccgaaaatctatgtttctatgttctgaacttgaaaaaaaatcctgtcaaccatcggggcatgaatttttttttatgttaaattaattttattcgccaaatttcagggagccagaagagaactgcgactgtccagacttgatccgcgactttgaggaaaaggagaagcaacgggaggcgtccaagaagaaggcgagaagctcgaccagttcggcggccggagggccggccaaaaagcgcaaaacgtccaagtcaatggtttgttttccctta

SEQ ID NO: 19179 - DNA, 1465 bp, Heterodera glycines
  misc_feature (1310)..(1310): n is a, c, g, or t
  misc_feature (1363)..(1363): n is a, c, g, or t
  misc_feature (1433)..(1433): n is a, c, g, or t
caagatccccaattggggtgaggcatatttgtattccttcttgtctgggtgattttctttaacgttaagaatctgtagggctgggatttttatgtccctttttatgctcaaaaaggcaaaaatttgtatctcgctctgattgaaaagaaaactggtaaaaatgctattttgatcttttcatgcgatagcatattcgcaaaaatacgtcaaaacataaaaaccctatccctggttatctgtgtgtaagtatactttcactatggtttacaatgggcattgataagagtggttgctgctgatattgaagtttttgctgattttgtagttgccgacttggactgttaaagtttgttggtccaatgtttcccatttgtcccatttctggccctatttgtgacatttggctttctgtctgcatatgtggtgtcagatgaacagattgaccagattgcacattcggtccatgataattcgttaagcttgtcgatccaatttgttctgtcatttttcctttttgttgtgcgttaaatcgagttggtccaatgtgcgtcaaatttcccgtcgtgttcatggtaaaactttttgacccgccgctttgataaatattttcggcggctggcagcatagtaaagctggcagagccggttgaggacggcatgacaaagcttgaagagccagtagaggatggcatgataaagtttgaagagccagtagaggatggcatgataaagtttgaagagctagtcgaggatggcatgataaggtttgaagagccagaagaggatggcatgataaagtttgaagagccagtagaggatggcatgataaagtttgaagagctagttgagtgcatattgcccgtgtgtccttcttttgtttgttgccattgaattttttgatttcctgttgacggcatttgtgatggattctgcactgattgcggttgcagattctgtccatgataatttattgggaattgcctgtaattataaatgcctcgactcaattgctttactacagaaacaactttttacacttaagaactcgaatctacggcactaccgaacaatagaatgttctaaccaattacagaactttattttaaaagtatcactgacgcattttccggtcacgctttatcccatttcatcaattcccatattcttttgacattagatacccattcagttttactataatatttccagttagaaaaatattactgattctttatgccagctagattctgttgacccataaattgattctgctggtgaattctttgggtttgctgttgcactgactgagcncattgttgttgaactaaggcattttggctggcaattgatcctgcacaatttgnggttgatggactgttgtatactgtagattggtcagtggctgctgtactgattggaaatgttgagcttcangacctactttcttttgtttccgatcacttttc

SEQ ID NO: 19180 - DNA, 1974 bp, Heterodera glycines
gttatatgtataagtacaaatgataatatactgtaataccttggtttgctcgaatgacaaattggccatcggatctgctaatgttggttgcattagtggcggttgttgcccttggtattgaaccatctgctgcaaggactgttgaaattgaacattttggttctggtcaaacatatactgctgactgctcagtggttggatttgctgttgcattgactgagcaaatgcttgctgaactaaggaattttggccgacaaattgattattttgcgcatggtggtgttgaactgtttggttttgcgcttcctgatctgttgctttctttggtttccgatcacttttctttttactctaaaatttattaaacttgctaaattttggcaaaaattggtctttttgataattctttttattgattttatagaaatttgatttactttttcatttgtttaacgtgagaatttcttcttagtttttcacaggcaaaaatgatctatttctagggtttgagaaaatatgaaagatcagaagggttaagtgtcagatggtgccgattggttcgccgtatttgaaatattaaataaatccctggcgtctaattggggtaacacataattgaacttgttaaatgtttttaattgtataaaaacaatttttatttgccatattagggttagaaaaaaccgacccaaaaatatattcccggcgcagtttttcaataaaatttctgaaattgcgaaaattggtaaaaaatatataagtgcgaaaggtcagaaaaatagggctgtttaaggtttatattgtactaccgtcgcttgctctaatgacaaattggccattggaactgctaatgtttgttgcattggcggtggttgttgtccaaaattttgatattgaaccaccgaaaattgcggtggaaattgaatgtgatcaacgctttgttgccgcgcttgcattggcggttggccaagcggtacaaatgatgacggacccacgccgccggcattggcatacccttgcggaagctgaaaaacggtttatatttaggataagatttccattaattagcttaagttaaatatccagtggaaataaaaataagtacaagagttgttatgatgagagtcttgtaagagagatgtctcaaaccccgtttgcctgccgaagccctaggatttcactcatttctcaattttcattttcctttgtttattgtaccgccccttcctgatgaaccgattgatcgatcacttcgctttcacctgtatttaatgtttatttctatggaaaaacaacttatatcagttcagtctccccgagaataaagccacttggtttagcctaggccttatcacctcatttgggcccttctttgggcgcgtgcgaatgcccacccaatgttccccaaccgtgtcggaaatagtcgctgaaaatgcgcccgtaggaaatgtgtcagtgaatcagaatttcttgaaaaacgtgatactgtagtatttattattagctgaaacagtaagcgtggacgttttacataacttgacctcttgtaacataatacttcatgctacagtactttattttaaaaatactgtattactgacgaattttccgagagcctccccaactgccctctcaattggaaaccctaagtcccaatgccaacacgtcctccgtgcagagcaatgccactgtatcaatgaagagtttaaagtcgagcaagtcttaggctttggattacagtcagcattgtgtcttctttttatattattttcggactcttgtggcaagcacattgaattaatgttaaagaccccgaagcattcctaactcgatgccgatgccaaattcgaaacgagattctgaccaggagagaccaaaaatcgaaggacttctcgaccaattttagcgagaaaattgcatgtgatcagtaattttaagaaaagccttttttgcgtaagcataccatgtacgggt

SEQ ID NO: 19181 - DNA, 2212 bp, Heterodera glycines
cataatgggatgtatgaaggcgattgtagaaggaattggaatcgccaaaattttgtgagaagctttttgagcgtaattacgatttttacttagaccttatttttctaggcgtagatcacacgcgatttttgtccctaagataaatatagcgctgcataatggctcgtatgaagaagattgtagaaagacttgagacgcgctataatagtataagtagctttaagatgcttagcaatctgtattatgcatacccattcatttttgtatatcgacaataagcaaaatgagtaataaaattgaggattgttctctcttatcctttattaaagtagaaaaagaaaacactgagcggacgaagcgactgatcggggcgaacacgcaagtgtgaccgatcaatcgataactgatcgatggccattgattatttttgatcgccgattcagccactgccaattcgttctttcattttgccattttcacttcaaacacaaaaacctctcccttcgttttcttcattttttgactgtttatctgccaatatttcactattatttggcattttctaattatttaaaacaaaactcagggttttgctgtttttgtttgaatccgttttttacaacgattaccgtactctctccacagcacgctctactgtttttattttttgatgtacagcacaagattcattccagatcttataaacataaaaaataaactcgacaattgtttttaatttcctgtaaaatataaaacaaaacaataaatgggagatgctaaaatggagtccaatggtttaaatgactggttatcattcacttcttcactttggccgtcttcgctctcgatctgtccctctccgttcgtttggtttcgtccgcttcagtgtaaaggacggacggttgtgaaaactgaaattaaaataactccaaacgaaacactcccagcaaagtctgacctggtgcgccgtggaatcgtacatgtccttggagaccatcgtgaacaaattgtcctgtcccgacaacatttgcatctcttcttcgtcctcctccgtcgggtaaaaggtcggaaacggtggctcttccacccgttttttctttgcaaaacaatccttcagcagaatccactcgttaatatcgcccggcacattgccacgcacataaataacctgaaaaagcggatgaaaacaaaaatgaaaggccaataaactcaacaaccaaagagtgactgacctgctttatcggattgatccgaagcactttaattccaaccattttccgccattcgtaacccatgtgaccgggcagacaccgacccggccaaacctttgcctcgcctttcgtccctatggcccccactcgacgatgcgcttttgtcggtcccttactgttaggggaaaatgacacgacaattaagcgactaaatcccttacgaagggtggacacttactggagtctcatttggcccttcatgccccatcggtgcattacgccttgaaagccccaatcgatggttcggcccgaggcagtaatccattgtccaggctgacaatgatgcataaagacaagttcaatccgggttgtaaagtagcgcaaacgaccttgaaatgtcggacgtccatccttgtgcccggtttgacgacggcatcgctggacaccataaacccggccaagaactttttgcacgggacaccggctcgttcaaacagcgcccggtattcgttggtcagaaaaggcgagtcgtaatcttcaacgccaaccatttgctgaaataatggaagtttggcatttatttccgaaacaatgacattatggaagaacacaatttgatttgattaaacttacgctccacattggtggggcgcattgatcgatcgtcagaatgcctcggaaagccttttgtttcccggttaaactgtgccgataccacgtttctgggtcattggcggaaaggacatgattgacgggcacgtggatgagagtacaaagacagcgagtgccatctttgagcctgaaatgttgaaaatggatccaaaaatatcaaagtggaaggatggaccactgaagagtcatgccaattttgcgaccaatcagaccaattcgcttggaagcttcaaacgaatattgattttgggtacaatccggcggattcgaaacgccgggaatcaaatggaacgtttcgtagggggagagagacaatttgcgtgaattta

SEQ ID NO: 19182 - DNA, 1383 bp, Heterodera glycines
cctcttctctatttatctcacaaagaattaaaattttcatcggttcgataaaaatatataaaatttataacgatcaaatgtttgggtatgtgaaattgtcaagttaaacaaatttataaaattggttttggaaaaaaataaaaaaacatcaagcaagttctaagaagaagatgatggaaacaaacttattaataattcaaaaaataatttgcgataatagtctcaattatcatttaaatttaatattgcttatttatgtgtttatttttatttgcaagttgtgtacggtcaatttttttatcaaaaaattacattgataatattcctgctctgaaaaaaattaacaaaatagatagattttatgaaggtggtgatgactctgcctttgctggaattgatggatataaccagttaaattttattttaaaaataagtttttaaaaacaagcaaataatattttattaaattattaattaatccgctttttagtgaatattttttatagataattcgaaatgcatttaaaacaacaataacaatctaaatggctatcaggaacaataaattaaaaaatgcaaaaagtcttaaattaattacttacattgagcatttattaacatttaaaacaaatcacacgatgtgttcaacaggaattaaagtcgatgttactggaaacgaaaattgtgagaaagaaatgaagatattgttaggaccacaagtccaaacaacaaataaatttattacacaaaataataaattacaaataaatgcaagaagggggagcggagcagataaattggggaaacaaccgaatgaattatgccctgaatggggaggaataattgggaagggcaaaggtcaatcgatatgcatgtgtgtctgtctctaacacggagagagcagacactgcaaaacagtgaggtaaatgaagagtgaaataaataaatcgtgggcaaaatgtgcctgcccgaacacctccccttttaggctgatcagttcagggcccgggtgtaaatcggtccggctgacggcgttgaggataccgtcgtttaattggggcgtcttcgatcggagcaactaaattttcctgaatgggattcgccgcctcattttccaactgattgggcactaaattggcattttctgcggcgggtggttgattgggcagggccggaggcaatggcaaatcaaatgcctcatttaatatggccaatgtctgatcaaaattatcgacagttttccggtggcgaagctgattggcatgaaaatggccgaataatccgtctggaaatttgacgtcaaaaatcactccaaatgtgccactgatcactccaattttccaattttgagaggagcgatggcgcgcaaaaactttgtcattc

SEQ ID NO: 19183 - DNA, 1167 bp, Heterodera glycines
  misc_feature (66)..(66): n is a, c, g, or t
  misc_feature (137)..(137): n is a, c, g, or t
  misc_feature (147)..(147): n is a, c, g, or t
  misc_feature (152)..(152): n is a, c, g, or t
gccgaaggagatcaatcgttgtcctggccttcgaccgagcagcagttcagcgggacacttcaaatngggaagtgtatcgtttggggtcgtccgataggtgatcagaaaaatgtcgatgatctccttgtttggcttcncctcaccttntaatnttctgaatgctctcttaaatgtgtcgacaaatctctccacttgtccagttgaattggattatatggggcgtgtgtgatgccgttggctgcaacaaatttggcaaattctgagcttgaaaattgcgtgccattgtcagaaacaattgtttcttgaattccatggcgtgtgaataaatagcgcaatttttcgattgtgacagttgctgatgaatttgtcatctcaaatacctcagggtatttggaaaatgcgtcaacgacaattaaaaatattttgccgaagttttggagcgacactgtaggtgtagtgtttgtactcctgttcgccaagctttccaatcaataattgaactttggatttgtcttgcaaatcctttccatcctggataataatttggccatagcgttttagccatgcctcaaaagtatgccctgtttcggggtcatagatgaatttgtccagtcgggcgtcgatggaagaggctaaagttgctgaattggacgaatttgcttggacgtcttgctgttgttgcgacacttctctctccttttataattttccatctgcatgtatgacctaatatttcatcttatatttttaataaattttttaatgcatagtttttgattgattgccaacaaataatattctttatatatattatttttactttaaatttttaaagggtaagaaatattattaaaaatttggattaaagaaatcttgatgattttaaaatatgaatttataattaacggacattttaatgaaatatttaagggtaaaaataacaatttattttttaaagataatttatcatattgtttttttacttatttgctcgttctcttcagacatttgcaagaattattcacgtcctcaattaaataatattttttaaatttttattcttaaagaatactgtattttattatcttttgagttcctaataattaattgctcatgatcgcttcatcaattatgacatgagccagtgttcattctcagtattggtag

SEQ ID NO: 19184 - DNA, 1364 bp, Heterodera glycines
agcattgtaactgttgtcccttaaaggatttgctgtcctcactcatggatgggtccgtttttcctaccgcaaatgcgtcgtccgcagccgctgcagcagcagcagcagcagcggcggcggcggcttccgccgctgtgtccaacacttcgccacagtcgtcatgctcaaacggtggcaacaacaacaacatgaatagtaacgggggcacaaatggaaatagcgccgcgggcgacggcggcgacgcggagggcgtttggagcccggacattgaccaggcattccacgaggcattgcaggtggcggcgctgggggcggggcgggcggggaaatgctggccggtcgtcggccgttcggcctccctctgctgctgttggtggctgacaaatgcgaaaaattctttggatttttaagtgtgctcaaggacaggggtgtagaaaggggaggatggataaattcactgggttattttaagcgaaattctgctgcctggaaattcttcaaatttttaaatagcaattggcgagtgagagagagagaaagggagagagagagagagaacgccaaagaaagagagagcgacagagagagagagaatgagagagaaagggagaattcgtggaccgggctgcactgaaattgtaaaattcctaaaataaaatgcgaaaaattctttggattttttaagtgtgctattcttaaaataattttactgacattaaaggacacaaatcagcaagaggcaacaaaccgacgaataaattttccgggccgtttttctgatttgtgatcatccaatttttgttgtttttaatagaaagccaaagttcataaaaaaatattcataaacagatttatccgccgtgtggacggcgcaaaatcattctcagcgacgagggcaaaatgtacgggcgcaatgaactgatcgccaggtacatcaagattcgctgtggcaagaccagaagtgagtatcacttatcatcataaatattaaaggaactggcaaattatataaataaatttttttaaatttaattactctagaaaaatgtgaaggaattttgatcaaaaattcattaattatagcattttgtctcttccgggttatgctccccccccccccccctaatgaattttttaaattttgggagggcataaccataaatgcacaagttctatccgtaagtctctcaactttgtgcgtcttgcttggccccggagattccgtgctttttttttttataaatatttgaaaaactgttagtttttttcgaagtctttgagggggcgccgaatggcgatggaattcttgaagccaatcaaaattgaattttcgattcatcaggggtgaggtggggggggggggg

SEQ ID NO: 19185 - DNA, 1148 bp, Heterodera glycines
gatgccatgtggtggtatattaaaggaagagagaaaatattttaaatttttccaactttgatagattgaaataaaaataaaaaatgtgatgggacaaatactatatgtatactagagcctggtgccaagattttggtattgagtcgggattttcgcactaattcaaaaacttctctatgaaaaatttgaaaaaaaaatttcgaaaaaatctttttccaaccttacaatttattttgaaggaaaatgccggcgggcaacaacggtttttcaactgactccaaacgggatttttggggttttcaaaacccggattttttttataactttgtttaaagttattggatttgagttcatattggcaagttctaatgataataagggagataatgttgagaaaattttcaagttttttcattgagaattttttgaatcagagcgaaaatcccgactcagaacctaaatcccggttctgggctctagtatattatacccacaaaaaaattttcttgttcattcagcacgaaagcaagtgtcatcgcacatccaagttttagcaaggaaaaaacaacgggaacaccactccaggatgaaggtggaaaaggagaatgaaatattttaataaaggctttgcgtaattaatcctgtttgatcccgcaccacaatataagccaaaagtcaagaaattaaaaattattctttaacgaggattctagaaaatttcatgaaatttttttttgtaaaattaagctttttttgttgaaaaatttgttcaaaaaaattaaaattttttattctcgaaattagtttggattttttaaagaattaactaaaaaatattatttttttaaatttttctgcggacacggtaagcgggagggcgggaaacgagctgcttccggtttaatcaatcacacacaacatttatttaatgctagtcaaaaaaaaataaataaaaatctataccgtaatttctcacatttaattttgattggataattttataaaataaataaattgtccgtcccctttcaaggctccccatcagcgagcaagatgttcagccgacagactttggcatggctcagcatcatcaccaacaacatcagcagcaacagttggcactccctccgttgacttctggctgcatt

SEQ ID NO: 19186 - DNA, 2260 bp, Heterodera glycines
  misc_feature (2233)..(2233): n is a, c, g, or t
taatttcaaaatttaatttaaaactaaatgttcaagtttttatagcaataaatctctctcttataaatatgcaaaatcatttcatcgtaagttccattggcactatgaaaacagacttttattagcaaataaaagtgccaaaatattattatttttttctacaaattaaaaactcaaacctcattcatcccccccccctcctcaattaaatagtaaacaaattatttaattttcctttgctaataaatttattgtgctttcccatatcgattgacttaactacacataaaagcacattaacattaaattaactcattgagatgcacacagtctgccactggtttattattccctaattatatttaatccaattccataacaaacaaaaaaacattgggatatagaaaatcggtgactttttttactcttatacttccaaaaaacttcaatgtttctttaaaaacaattagggggcgtcggagacaaaaagccttttttagcccatctattagcagattgtgagccaaaaatgacttttgaagctttttgaatagggtcgagccgggctgaccggggataataaaaccattggtgattttaagaattagcaagatgattttttttaattaaagtcttttcgttagttttttattaaggaaaacctaaacacattttcttcgccaaattttcgaaatatttgattgaatcataaaatatttttataaagaatttaaaaaaaaaaaaaaattgttttttggtttataagcaaaaaaagttcaatttgcagttttttaccatattaataaaccctttcatttatttttttctagcgggcaattatataattcctttattactaacttttatctcataacatgattaatgtagcttctctaaaatttaatctaaaaaatttttgtgaattatataattgcccgctagaaaaaaaatgaaagggatcaaaacttttgtacataagcatttttgggtattttgcactaatttgaggattttagtataatttatcagatgggctgcgctccgcaattaaattcgaataggacccgacatttagggacagacacaatttcaaaaaaaaaacattaagtgaaaacttttttccatcaaaatatgaaaacaaagaaaaaagccttgttgatcacttgcggacattcataaaattccaatggcggagcatataaagcaataaaatcccgagatcattcttttatttctgacgtgtcttgttactttgcttggtgctctaacattgagcattttctccattttagcttaaattattgcacaatacctgattgaaaataaatatggcccactaggcaaccaaattccaaattaatttgcccaaaatcgaagccggatctgaatcgatcaatgtctacgtttaattcttttcactaaacaatgaacataggcttgttttactgctaaaattttaatttattgtatcttagataatcaggtaagtcttgaccctttcgaaacccaacttagaaagtaatgtacagtaattgaagctataatggagaaaatgctccattttagcaccacgcataaaatatgcactaaaaacccgaaaaatgcccaaatatgcactaaaatctgccttaaaaatgccaaaagtggatttttaccctcaaaaaaggttaaaaattgtataaaattcacgattgactttaaaaacgccaaaacaatggctaagtagcgtttttagataattgcaaaaaattttgacttccatatttatatcgaattccgattttttaaaaatttttttaatatgctaaaataaaattacatttttttacataaacaaattttttcgaaaatttttacagaaggctgcaaaattttccggttttaagggtgtatttttaattcccaaaaagtcgatccttacgcgatgtattcttcgcatgccaaaatatggacaaaaatgcaaaaatgtcgaaatatggatttatttccgaaaacccccaaaatatgcatttatatcagggcttccatttgttcttatttctaagaaatgttctgattttggggtagcgaccaaaaaatgttctgatttcttaaatatattcataatttttgaaattttatggcataatgtcaccattttatcaagaaaataagatttttggcaaaatttaaacaattttttggacaaaatgtgttagcaactcgcattaaaatcacaaaatttttcccggcnggcgccgacaggcgccgccgtaccccc

SEQ ID NO: 19187 - DNA, 1938 bp, Heterodera glycines
ttgcattgtagtaagaataggtatctcagaaaatgttatcccttattctacatcattagacatgtgggtatcagccaaatcgcattactatctacggttgagccctacaaatggtcggttcgaaattagcatagtaggtaagaataggtattatcagaaaatggctatcccttttttctacatcatgggtttacagccaaatcgcattactatctacggtttagccctacaaatggtcggtttgaaatttgcattgtaggtaagaataggtattctcagaaaatggttatcccttttttctacatcattagacatgtgggtttcagccaaatcgcattactatctacggttgagccctacaaatggtcggtttgaaatttgcattgtaggtaagaataggtattctcagaaaatggctatcccttttttctacatcatgggtttacagccaaatcgcattactatctacggtttagccctacaaatggtcggtttgaaatttgcattgtaggtaagaataggtattctcagaaaatggttatcccttttttctacatcatttgacatttgggtttcagccaaatcgcattactatctacggttgagccctacaaatggtcggtttgaaatttgcattgtaggtaagaataggtattctcagaaaatggctatcccttttttctacatcatttgacatttgggtttcagccaaatcgcattactatctacggttgcctacaaatggtcggtttgaaatttgcattgtaggtaagaataggtattctcagaaaatggttatcccttttttctacatcattagacatgtgggtttcagccaaatcgcattactatctacggttgagccctacaaatggtcggtttgaaatttgcattgtaggtaagaataggtattcggagctcgctgacacggcagtttaaaattttggcgattttttccgtaagaagcaccattttgagaatttggaagctacaattttggaaaaattaacgaaaggaagagtgcaatttatagaggaaaaatgcaatattaatgagatgaagacaacaaaatgtaaaaattaagcaagtatacatgctatttatattgatttcgaatgagccaaatttattttatgggttaaataaacattgaaaggtataaaatgcaaaatttttagttctttgtattattattcttccattttcctaaaaatgtccacatcctctaataaaaattatttaccaaaaaaccaatgcccaaattgtgatggtaattgcaattttttcaatactgtacaataattttttttttaattttagatgatgaagttgacactgaccctccacccgaagaagttgagaaatggacgccgaaacaagtgattgagtgggaccagcgttgctacgggaaaatgccagctgaagaagagctttggcaagaattcctcgacaaaggagaggcaaatgtcagtaaataaaatttttgatccattttttaaattatttctttaggttcggcgtgagttctttggcggaaaaggggcgcttgaagttgagaagagccttcgagaatacgcgaagaaaaaggaacgccgcgacgcaattctgattgagaaaagaaacgaatacaaaaaaaatgatggaaaaaaggatgaaaattgaatgttcgaatttctccatccgctatatcaatggcttttattttatgcaattattttgatttttaatactcgaaataaataggtttaacaaacaaaaattgggtataaaattcgaaaaaactggggatgtttttttcatttaaataaaataactcttaaaataatccattcaccctgaaatatggctgaaaatcagaattagcaaaagatgaatgggagcacagatgaaataattccagctaaaaacccaagaagcatcaaatcctggaaacttttc

SEQ ID NO: 19188 - DNA, 1775 bp, Heterodera glycines
  misc_feature (14)..(14): n is a, c, g, or t
cggcacagtgctcncacttttggcattccatgcgcaaacacttttcacttgccgccctcctcacgctgtgccttcgtctgatcagtctgttcatgctgtcactgatcaccccggtggtgatccggcgtctgttcgcctccaactttgtggagttgctgcaaccgcttgaattcatcttcaagacttgctcagatgagttggccggtgtctgctcatttccggaggcccaattttcattggccgaggcaattttttcaaaaaaatgttgaaaataaattcatattttcaaatcctcgaaattttgaatttttaaattgcttttttactgacaatgagagtatccattgtttctttttcgaaacaaattatggaatttattgaaaaattgttattaaaactcaaaattttttctttgggaggggtagggataaagcgtcattttttttttgttttttttattattattccattttcaaacccaaaattcacaggaagacatccatctgcagcccggctattactacagttttgtgctcgacgttattctcttcgacacaccgcagaacagacagctgagcattgtgttggccagcgtaatgctcaaagtaaacccccggggggggggcaaattggcaccaattcgaccacaattcagaaaaaattttgattggatttttagggttttggtttaggtactgactggtgtataagtaagtaatggtgggtgttgtcttcgtaatttcgacataaaattttggggtgttaaaaacttttttgccataattttttaaggatgaacggatgaaactgttgttccaattccacaaaactgtgcccattttcaatgctttctccgcccgttcggtgctctcccgtctctacacattggtcagaaaatatttatgcaccgtttaggaattagactacattttttcaaataaaatcaaaagaaatcttaatttttttttaaatttttccggttttctttaatttttctatttgtaactttagttttttcttttcaaccaatccgttattatatttagttttatttagagcaaaaaatatgactttaaaatcattgaataaattcgataatatatttttttgcatggtcccaaaagttgaaatttacttattgttttgcagcaaaaattattgaagctaaaaaatttttggtttttatttttattttataaaaactttagaaactcctttatcaaaaaaaaaatagagtggaattattagttaccccgattttcaacaacaaaaaaacattattttttcagactcgcaacattgtgttctggcccctgtacttggtcggcttcttctccaccgctggtcatgaggtgtccgagctgttctccatccattttcccaattattatttggaacgtgaagggcggcccacccgattcattgtggttcagctgcagaacaaattcatccaggtcgtccaccaaacgggacaattttcggtcaggggaatgctttttcttttatttttttggcatttttacctgtttcggtggtgggctaattgggtcccgaccaaatgagtcctcgggcattttttaggatttaacgaataaatttgatttattcgacagccccaagcctctaagtgtttctatattagttgcaaacttaaaataaattgttatggttaaagaaagttagggtaaaaaaatgtttagaatatcaatttttgaggtttttataagacaaaaggaaagaaaaaaaatttaaaaatctttagcaatttttgtaaa

SEQ ID NO: 19189 - DNA, 847 bp, Heterodera glycines
tgaattatatagaaattttgtattctgtagtccatacctccctatagtgaaggactttattagcgtcttgacatttatcttaaatttttcttttaattgactgattttaatatgataaatttaaataaaatgtaagttttattaatttaaaatgaataattttaaattacaaatagatttaatctaatcatatttgaagtaaattccaatatttatcaagttatttagatttttaaattgttttttgataaagtaatttatttattaagtagcgaaatattagttatccctcgtttaggttcgtttttttctccttttttgcacgaaatgtttattagctagtttcgtattttgtacaattttatttatgaatacatacgtccaattttgctgaattttgcgaatgtcattttaatttattttttaataaatacattgattttatattattccatcaattatttatatgtttattgtttattttttctttaaaaaattaacaggttatttgattaaaatgacaatcattttttaaaaaaattcttcttctttttttttgcaatatttgtaaaacaagaattatttaaaataaatataatatcaaattaattggattataaccaattttatcctattttattttattatgttaattcttgttccaatttgaaaaaaaaataatttttttttcattttaggtgaaattatatttaaatttaagggcattatttgaattgataaataacataattttaagtaccagaaagaattttaaaaaaactttgaaggtaaaaagtagaaaataatcattaaagaaattaaccattatgattcacgaccttaatta

SEQ ID NO: 19190 - DNA, 1051 bp, Heterodera glycines
  misc_feature (972)..(972): n is a, c, g, or t
acttattcattgtatttattattttacttgatattagacaccctcaggttctcacttatatatacataatattttatttcattttaataaaatatgcttttcttattttatacataattctatatccttaggtatttttatcttttaattaaattttaattttttatgtgacaatccatgatactttaagttttagttttttatttaaatattaagctataaaaatagtcaatatggaatcatttgacttaaaaattcattaaatcaaaattatttaaattaaaattttcaatttatgtcagaaaatatttacaaaaaacaaggggctaataatttgaagaaaaagaaaactaatgaaagacttgccaaataaaattttaaattaaataaattaaaattaattataatttcaaacattcataagttaaaaaaatgaaatatgtcagcgaatcaaacattgtatggtgattaattaataataagaacaaaaattaataacacacaatgttatttattaaaatatacttaaataatgttataaaaaaattgttatcaatgtcctaaattcaaaaaatattggtgttttgcaataagagcaaatatgatagtgcaaaatagctatttatattgcgagttttgattatttaataattttattttttaaaaaacaccaaaacattttttagataaaattatttaattaataaattttccttcatcaaatacatgctataataatataatttttttgttcaaaatataagaaattttattttacatctgaaactgtcatttcccaactatattttaaagtttacgtatataattatttttaattttctaacaattaattttaaatgtttatgatccttttgattaactttttactattttagtctaaggccataaatattatttttaagtaggaaatatgtaactaaaagcgcgagttattaaaatttaatttctcanttttcgtaatatatgtaaatatgaaatcatttttgtttaaaaaatttaataacttttaaaaaaataaaaaaattttttt

SEQ ID NO: 19191 - DNA, 3005 bp, Heterodera glycines
taaattccaaaaaattgtctaaaatttacattttcatccaatttttttaatggctaaaattaataattcataaaataaaaaattaaatgattatttaggctttattctgtcttataaataggtggccataaaatttttttttcagcttgagtcaaatttataactatttcaagaaaatttgattctctaacaaattactacaaatttatatttgattagaatatttatgctgatccttctcttgaattgtttcggtgttactaggccattattaaaagaaattatgccaatctgattataatatcaaatagcatatctaaatggtcgacacattctgaaaaagtaatgcaattcatgtttaatttgtacctacaaatttaaaatcaatatcaaaatgtaaattccaaaaaattgtctaaaatttacattttcatccaatttttttaatggctaaaattaataattcataaaataaaaaattaatcgattatttaggctttattctgtcttataaataggtggccataaaatttttttttcagcttgagtcaaatttataactatttcaacaaaatttgattctctaacaatttattataattttatatattttttttgataattttataaaataaaaaaattaaacaattattatttctcttcaattgaatgaacaattaattcaataattttttcgttaactttaaatcgtctaggcttttaaaacaaacagttatatgtaataaatttattcatatattccattcaacggtcgactttgatttggcaaattaattccaaatcgtctcttaaattaaatttctaagcatttaaagatggttaatttttagcaagaattatttcgttcaactgacgactttgattgggcaaattaattccaaattgtctcttaaattaaatttataagcatttaaagatggttaacttttagcagagtaattataaataattcttttcatcaaaatatgaaccttacagaaaaattgtttttaattattttgtccaaaaattaaaagatatttaggtggtgcatattacatatattttattcctcaatggattttttcattgttactctgctctaccatttgactcttaacctagatgtaaatgcagcacctacgaagccgacaaatctgcgcaacttaaatctttccgaatggcaaaatgtgtgtactttaatcgaaatatttcagtttttattaacgttattacgcattaatttaaatttataattggttccctttatttttgaatatttataactttcacttaaataattaatgagtattcgaaaggttttttaataaattatatgacatttgacattactcataaatcaaccatagaaaaataataataattaaaaatatataccaaattttaaaacttttatttaaaaatagtcaattactagaaatcaatgttaggttaattcttaatacagtgagaattcagaattattttcgaatattcctctgccgaaaaaatttagcattaaagaaaaaattctctatcaaaagtccttcggcaatgaaaagtacgctatcaaaactcctggagccatcatactgaaaaaaataaatttataaataaagatcaaaaattaattaattcataatttcaggtggtgcaagtatttggaattgatactgatgcgtcagccttaatgggatcaagaaaagagagttttttaaattttttatgtatgataaaattaattcattattaaataggattggcaaaattaacgttttggaaaatttataaagttaaataataaaatttgtaatattataatattgccttttatggtaaattaaaaaatactactagaaaaagaaattttaattctcaagataattgaaacaaacataaatattttttaaaatatagaacagcatgtctgaatacgccaggttgttggaggctcgctgtccagcacttcatgaagctggacatgcggctgctgctcgcttcaatcggcatggtccgcgagttcaattcgtgagttaataagaaaaaatatttatctgtttccactctgatcaatgaaagaaaataatttaaatatgaagaattggattataatttaaaatatctaaggaatccaaggattaattattacaagagcccagacgggccccggtactagtgctgctcggatcaaaaatttccagagactcgagaatctagaccgatttcaagactataattttaccaaaaatcaaatttttttttaataaattttttccaggcttaaaattttttgtttttagcaaggctaataaaacatgttaagagctttcgaatgataccaagattgaatgactgagcagtcaaagaaagaaattctttctaattttcttcaattaattaattaataaaaagttgaatacgataacaatgaattgtttcgaagctccaaagtcggaatcgcaaatctccgattttggctatcccgcaaatttccctaaattttgggttgcaaatgtccgacgcaaacttttgaatgagtggaaaatgtcagattttgactggggccataaatgtctctgggcaccgaaagcactgctgatgaccttctttggttgcttttccttctttatctcctgagtatctgcttcaccgaggagggacactctccaaacggtggaaaatcgtttaattaattaaaattgggaattgcgagtggtcgtttttttggggggggtggggaattaagcgattgtgcccccaaacagacggcccttttcgcggtgccccaaagccatcttattttatctcatcgcgcaatagaatttaatagaaaatgcgaaaacggtggataattgagaagggacggggatataaaagaagtaaaggaattaagtgaatgagtcggggcgggggagggggcgggaagggaatggcattttgggaaggggtggagatggtgttttgggaggggatggcattttgggaaggggtggagatggtgtttt

SEQ ID NO: 19192 - DNA, 3369 bp, Heterodera glycines
ttttgattttttatgagtttaattgtctcatttatggtaaatcatatattcaacataaaaaacgaaaaccctgtcaaacatttgaaagaagtttttttttttttgttgatttgaacctaggatgttgaaacaataatccaaaatgtgttgaaaaacaaaacataaatcatctttgccttttaagaaatttattttcggtcaaatctaatgttaagactatttccactattttgaaaatcaaaaaaaaaaaacaacaaaattttacaaaaataccttatctcataaaaatgaatttgctctattttattgtcacttaatagaaaatattaaataaaaattatctttaacaacataaaaatatctctatttaaaaaaaaaagtcattaaaaattttttattttttctaaaggtttaacgagacaaatatttatgttccaattcacaatattttttttttgtcagagtttagggtaacatagaaaaaaaaaacgaaaaatatatagtgtgaacggtcaagcgttttaaataatttggaatttaagcgtttctttttttgatagaacgaaggagttgagaatgtccaaaatatgtttaaaaaaaataatgtaaaacctatcatttttgccttttcggtctttttttttacaatatcttcatataaaatattatctttaacgtcaaaaatctttctaaaaaaaattttttttttttcatatttattagactattaacccttgagatagtattataatatccaaacatttttacaatgtctaaacgattttgtttttccttacacatacttgtccttcgtctttggtcagcttttgaaattcggcaacacgatggcggagtgttcttatttgtcacagctaatttcccggcacaaacgattgtcctctcgtgttggtcaaaatgtttcaattttcttggcaatatgtagatagacagagtgagtgcctttgatgccactgactaattcttgttgttttactctatgattcgtattttatatattattcggaatgacttaatggatatccttattcttatgtcggataacttttgatgtataataaatgtctagacagaacaacgcggattttacacataatctgattcaacacgataaacaattttttttttttgcgcacgattaaaaatactacgattcgtggtacattaaggagataattaattgtttagccgctccgtttttttctcaaaaatgcggccgccgacttaaattcatggttattaattgccttaactgtcaaaatgcaataggagacaatctccgctttgatcttcgcaacaattttacattcgttccgtgtttggctctcgaaaacttgctctcacattttgactgccatcgaaaggttgtctgcatttttagggtgaaacagtgaacagatttctgtatatattttggcggctataattacaccgttcacatatccaataaaaataatgcgtaggactaaatctgaaccatccgtccaaaaatttttggctgcaatgtcacaaaattccaaatcagaaggaggtggtgaaaacggtagacaacatcatccagtggatgttttctaccgttttttccaacgtttgcacgatgcccgcgggggtcgtcgtcttgttacgacccctgcgacatcgattttccatgacaacagggtcccgattttgtgtaggttttcctaagatatttaaaatttcaacattaaaaaaaaaattatgtagaaatgagttactgtaacctttttatattaatttataagttaagtgccaaaaatatttcttgcgggttcaaaaatgaacaacaacggaaaaaattccaacaattgtgactctgcggatgaagcaaggcggagtaggaaacgcgatcgggctgatctcctgcacgaagtcgagatggacaaaatccgtgaagagcagcgccgccgtaggcagagacgaaagaatgaagaggtacaacgtcaacgtgctctccttcgccttcggacggactaccgtaatgcacggtgtgcggtatcaacaggacaataccgtatgtcgtgcactggtacgacaacttttgtggcaattcctcaaattgtaagtttattttttcattaaatgattagttaggagggtttaacgaaacaaaaaaatcaaaaataaggattattaaacggaaaactaaaatatggtacaactcaaaattttgaataattgacagggtttgagaaaaaaattttttaggtgattatcaatactcattattgcatttttttgttcataagctaaatatgagtcgtttttaaaatttttcacaacccaaaatagttgactgttggaaagatattatagttttgctgatgctatcggtctaattcaaaattttggtaaaaccattttttgtgtctctctttctttcatcaaatatctgcaagatagatagacagaaaaatcctaaccctgataatatataattaaacgattttttaaacggaaattttcaccaatttttcaaacacactaattcaaatttttataaatgatcatcattgtataattaatcgagaacaaacaaattttcaactaaaatgataataagcatttaagtaagcatcaaaaatgctaaattaagaatgagataaacatgaaaatggtaaataagcataaaaaccaaaaaattttttttgttttaggcatatttttaagttgacaataaattcacatctttcttatcgtttgacattcgaaatttttcttagcaaatgacaagtttaaaccaaaaatttttagggatgaatttaaaaaattttcaatttatgatggatttattgtttaatttttaggttgcttcttaggagtgtgtttttgtttttattagtgggagacgttattttattcaaaattgtacaaaaatatcaattaaacacaaaaataagcccgaaaatattaaatttaaaaaaaaattttaaacaaaacaacatgaaaaagtaggacctagaccctcaaacaatgttaaaaaaagaagttttttttcatgttattagcatcagattcggcaattctatgaaatccggtctcatgtaattagtagggttattataggcgcaaaaatctcgaaatagactcctaaaatagaaagaattggaaaataggaatttaacagatattatataggtaaataattttttttattaatttcttataattattttagggtcaatctcgcgggcagccggcaatgccatttacgttggctttttcgtacgaacctgcactgccgattggggcacgcagttgaccttttcggacaatcttttgttggtactgctcaaggctcctgcacctacagttggtgaaatgtcgagtaac

SEQ ID NO: 19193 - DNA, 1193 bp, Heterodera glycines
  misc_feature (1042)..(1042): n is a, c, g, or t
aatccttaaaaaagtaagtctttatatagcaatctcagaatacttgtccccatgtgatgggtttgcattgtcatgaagcagcacatagtatttgaaaagtgtgtgttcgaaaaaccatttgggaagggcacaaaatgcgggtgaaagccgagtgcctgaggcaatttcttgcttatcaaaaagagcaggaaaataataaagaatgttaaattaaatttaaaatttacttgttcattcctctgggcgaggtcgagttcttcgaatgccttgagtgggtcagtttcggttgtgctggccacgaaaatgcagccgatgtacgcccgaaggaactgaattaaaaaaaacgaaactcatggaaattacacattaatggtcggtcggttacttcgtgctccgcgggttccaaccaatgaataaaagtcgaataaaatgttttggaaagaatgctttgaccgtcgtatttgtagttggactcggcagaatgttcaagaacactctgacaatggcaaggaatatttgagtaagtattttcagaatattacttcttgaaggatgaaacgaaaaacggtattctccaaaagaaagcctaaaattggaaattcgttaagtttaaaatgttagattcgtaaaaagaaattatgaaaaaccggcggatgataaattgcaccttttcgccgtatgtcgcgaaagtcgagacgtaatcggtgagaaacattttgactcaacggatcctaaagcgaatcattgatggggaacacaacttgcgaattcacgaactctgattgaaatctcggtgcaggaaaagggcaacagcaaatcgccaaaattaagtccgtttttgccaacagaattattcgctccatcggtggcgaggacagcgaccaaaggacagaaaacgccaggcccttccaaatggtcagcacagctcatgtctcaaaaatggatcgcaatcacaacaaaaaagaaagtaatttatcagccaaaactcaataaatgtgagaacaatgggaaaatgtaaatgataatatttatttatcaaaantattggggcgctagttgcaaagaggtccattttgaaaattttttcaacttttttttggtcaaaatttttttttgtttttttacacataatgatgaatattaagtattaacagcacaattatggtgaataaaatgtatattcacgattttta

SEQ ID NO: 19194 - DNA, 1795 bp, Heterodera glycines
  misc_feature (1741)..(1741): n is a, c, g, or t
  misc_feature (1755)..(1755): n is a, c, g, or t
caaaaattttacgaatgagagagataactatgtgataagatttttgctgcaaattcgaagtttaataattgcaagcataaaaaaaagcagagatctgtccgtcggtcgctactcgtcgtcctcctcctccctctcctcctcgtagtcgtcgtcttcataatcacccgcaaagtcgagatcttcttcgtccgagttgtgaatggcgttgttgtaaaagccgctgccctggatttgctggtaacgagatcgcttcgccggaattggcctcgagcgattgtccgtgtcattgggcagtgcgtagtcgcgatttgtctgcggcggccgtctccggcgtcggtttcgcaatgtgtcgctgaaccatgccgagtcgatactgtccaaattcacaacgtcgacagaagcgcgttgggaagaaaactctttgagaaacggataaattttgcggatagaagcgacaacattcgcctcggaagttgctgcaatgtttcactgactgtaattaacaaaattcatttttgacggttcacctccagtgactgtgacagtgccagtggtgtgaattcgcaaatttgcctttggctctttcaaattccattgaagaccgaccatcaattccggctcataaagggcttccctgtgctttcgacccaattcttgaatacgaatatcaaaaggcattcgacaagtagccaatatgttagaaacctaaattttttaattaatttctttgaactcgctttttaaataatttttggtaaaagcattttggcctcaaaaagactactgagtgctaaggatggatgttcatcttcgctttaccctgtagttacggatgcaaatccgctggtccaaccgtcccgtgctccgttggatcattcggccaattgcgcgtgcgactctcttgcaatcttcttcgcttaaatgtgcagtttgaatgttttgtttccttttgccaccttttgcagccgtgaatcaccactttgccactgtttgcaattcgaattgaacaggacggcttgcgcaactgtttgtgcaaaatctgaacaaagcatgaacaaaacaagtcgaaattgaaatgccactgaccccttttgctctgttatagtccacatttatgctgccatatgcgacctgtcgtaagtcaatgtgcatgggcaattcatagcagcacaaaacattgtggatctgaacaatttgcatgatggaacaacattttaccatcagcagaatggtcaccttaacaacaacttcagtcccatccacgagcacaacattgagttggttaggctctccagaagctctttggggatgggaacatgaactcatcgccccattctgttcggtcgttccattccgttcaggtcgattcacaagctgaagagaaaagaaaaaataacatgccaagcacatagttgatcattttatttgataaaagcagcagcaaaaccgggttgttcggatgtgcttgccagtagttgtgatccatgatttaaaaaaccactgatgaatgaagtcagaccaaacgaacaaaaaacgccttacaaacgattaaaaaaacgagtaagaaaataacatcagcttgtttttaatacaaaaaatttaaaaaaataaaaataataaggcaaacagtaaattagggtttccgaaaaatagtttaagtatttttcatcatccaaaaaaagctcattatagtaacagcgaaaatttatggcatattgttaagatgaaaaattaaaataancccaaatgatctancggtttaaaggattgtgccacatttcttctttccgttgcg

SEQ ID NO: 19195 - DNA, 1070 bp, Heterodera glycines
tggttttatcataaatatttaagcaaattctaatttgagagaaactttagttaagttccgttgtctgtttaaaatagttctaatttggcagattttctccggtgctcctatcgatcgccgtttatctcttgtttaaaatgttaatttattttcctatacatattctttaaaacatttcctttatacattaaaataaaaaattttttgattgataaataatttctgcttgaatattaaaatcattaattttatttttgtgatattcggtaagaatttcgttaaatattaaatttcttgcaatctctgttaaacacattgtattcaatcaatgggttatataaatttaaacaatttgagtaaaaatatataatgcataataggaaaaataataataaaaaaaagactgggaaaaagtaaataatatcagaatttaattgtaaaaggcgattaaaatatctcagcatgaacgaagatgcataatcggtttaatctattactataatttaaaaccaaagtacccatagcttaaaaataaaaattacatgtataatctttaaattctatgtacacactttcagtcaggagatattttttataagggcaaaaaaaataataaaaattaaaaaaaaaataaatttttttttacttttttttcttattattaaaaaaaaattaaagctcaattgataataataaagattaaaaacattgcaatctttgataaagtcataggaacaaaaaaagatgcagaaaccaaagaaacattattttataataattatacatttatgcttatattaaatacatgaaaataataattaaagtatgcaatgtaatgccaccgaatttaattaggtttcaaactatatcaagctaatagaaaaaccacttagtttttatgagaaattgttaaaaatttaaagaaataaattggctaagacaatgcttttatgaaaagcaaaagttaaatagacaatttaggatggaaaataatttcgttaaagataaatttataaataattttttttggtagcacaagaaggatttttacttaatttcttatcaaatga

SEQ ID NO: 19196 - DNA, 2019 bp, Heterodera glycines
cagtgttggaatagataacttaatcgatcgatttggactgggaccgcgcaaggacttgggctaccgccattattaaagtaaattcagaaaattttatttgaaaatagctctaacttttgaaaaaaaaattatattaaaataaaataaaaagaaaattaattttaataatttatcttaattatttttaatgaaatattaaatttataattcaaatatataacaagcaatataaattataaatactaacaataagcaatattatagatgaataaaaatcacaactagcataagtgaattataaaataaataaataattatataaataaaataaaaaaatcagtaagatatccacaataaaaaacacacttatataaaaagaaatatacttttatatgatatataaagtaaaaattgtagcacttaaaaattgaaattcgtttaatacattttttttactgtgaactttctattttggatttttttcttatattttttcattttttttacatattttgtagaattttgaaaatttatagtgaaaaattttttggaaatgtaccattgaaaaataccaaaaagtaattttaaaaatactaaaagatgattctaagcttatttaagtcatttttatggcattttgtacctaatttcattttttacgaggaatatttttttccaaaaaataattatggttatttttttgtaatattcttattttattacaatttttatttaaattacatcatattttggccactttttggatttctatatccgtttttccatatttcgtgatttatatccatatttccatatttgtccatattttggcatttaagtccatattttatgtccatattttggcatttttccaaaacctctattagaacggctcccagcagcatttcgcatttcgggttaattttcgccaaaaattagtaaattttagctttatcatgtttttttcttctaaaatgatttttattagcctttttaaatgtattttactagaatttaatgaatttgaagaaattttgaaaaatttacacttcaatttgaaacatttatgtccatatttttgcaattttatgtccatattttgcgatttattgtccatattttatggccatatttggtgattttatatccatataattttacgccctaatgataagtagggatgggatttttatgtgctaaaaatttctgaaatatgtaataaaatatgtgataaaaaatcccaaaatatgtgctaaatccataaaatgccgaaatatgtgcgaaaatatgtgttctaataaccgattgagcatattaaatgcaatatttgcggggccttgctcaaattttcatgcccagacccggatgaacacaaatttcattgaaacttactccattaaaaaatgaaaattaacaatttaacatcccaactctgctgatttatcagcattttgctgcttatgcttatcaagaggtcattgctgatttttttataaaatttactggtttaaaatctgcctagtccacccccaaaattctgtttaattttaaaaatttgacaaaaaaattgccaatattcagtgaaaatccgatgaaatggcaaaaaattctaattttcccccagcgtcacctaacgacgccgcctgcccccctaaaatttttttttctgataactggctcaaaatcgtaaaaattggactttttggtgaaatctgttgataagacaatttttattattgcaaaaaccacgactgtcatgtttatacttgaaaaaacggaaattttgttaaattttttgataaataaaattttattataatttaataatcgaaaagaatttaaatttacaatatgtgtttatagtagttaacccaccctacttatcgcagtgcgcgaaatgtttttcgcgcacaaacgccagggtgtcgggcggttgtgtgtttgatgttgccgcttttggcaggtgttcgggagtggtgggagcgggattctctttgaaggggccgacatcccgagggt

SEQ ID NO: 19197 - DNA, 1411 bp, Heterodera glycines
cactgccacactcgaagagcaagaacgccaacgcaccctggtcttcattggcctcccggaaagcaatgccatccgcccatcggagcgtgttcaggaagacagggaagccatcacaaaaatactggaccatcttgaagttgaggcccaaccaacggccgtctttcgactcggacgatacgacccgcagcgaacaacaccacgcccgctcaaggtggtcatgccaacgcccacacaccaacatgtggcacttggaggatggaagcgcgagcgtgttcggctccgttcccaacagaacctgaaccgtctgttcgtccgtccggcgctgtccaaagaacaactcaaagaggaatacgaagcgcgtctccgaaaacgtcaacaaaacccagctccaccggcacctccaacccagctcccaaaaacgacgaatgaccagactcccattgttgcaccaaaccagaaggaggccagcgaagacatgtccaaaccgccggaagtttttgaccaaacaatcatcgtttgttatgaagcattaaaatcattgccaccaaccgacaaaatttctcaccaaattcaatcactcaaagaacaataccctcatcttttcaataaatagttctttcagacctccaaacatttcctcaattaaaaaaaatacatttgttccagtacttctaatttctctcaaaatttttcctcaaaaaaaaaaaaaaaaatttttttttttctctctttttttaaactcttaaaaaaaaatttcttttcgttggaggtctgactatatttttctccaaattcaattgtcttatttcactgctatctgactttatactttccaatcaaatttcacaatgttttcttcagtttgttttcttttatcaatacttcacatttgacctcatttccaccaaaagtgtaagtggcatatgcccttcttttggtatttttatttttgaataaataaatattttaaataataaaccggtttctatagttccagatatagatgatgattcgttattgtttattaattctggagtttcaacaatgaagcgttttttttctaatccagattttttgacatcgaaaaacatagttaattttcaaccagttgttagaactttagatattgatgagattaatgtaaattcttttcatcagaccacttttgagatgttgggaagtttttctgttggaggaaattttaaaaaagatgttattcctattgtatgaaattgatttgtatcaaaaaaatgattaaatatagagattagtaagctttttattactgtatgggagaatgatatagagagttataatatttgaagaaaagtatctatacctgaaaaaaatattgttttaggagacaggtgggggtaatttttgagacatgggcgacggaccttgtggacct

SEQ ID NO: 19198 - DNA, 2633 bp, Heterodera glycines
  misc_feature (99)..(99): n is a, c, g, or t
  misc_feature (110)..(110): n is a, c, g, or t
acaggaaatttgtcttttgcgattacaaatgcgaagtcttctagtgaacacagtgaaataaatgacaagcagaacaaaactttaataatatgagaaagncgtggaaaggnaggttgcggtagacgacagggacggagatggaaaaggttttggttcgacctcatccgctattgtaggggcatctgtaagaaacaaagacctttaaaaaagacatttgctgtggattctgacaatattctgttagaaacgcacagtttgcccactttctcctctttttccccattggtcttcgccctttcataaacttacacataagtggcgggaaaaacgcccgtccgattgttcagtgtcccttcccaccaattttcgtcttcgcgttttgtcactaaaaacacaaaacaagacactaagaaaaaatggacggtgtgaaaggacccgtgataatgtcgccacgttgaaagccgagttcgcccgcttcttgaggggtgaaatcgaagagggcctgaaaggataaagcgaatgaaatgttattcagactacgaattagcattagcgagctacaaagggcttaaattattagtttcaattaaattgaaaattttcgttttttatttcgggaggtggggggggggcaattgcacgccctcccctggacaggtccttataataaataaaaaaacacctgaacaaggccatgtttattggaaaaggcggagtccatggaccggaggaggatgttgtgggttttcgatatgctattggccctaaagaaacatttatttccaatcagaaagcttttagtgcaacttaaatttttataaattgtggctttacctgtgatagttaatgagttcattcagactgttaaaccgttttgcccacaggtaatattggccaactttggtgtcccttagcactttaaaatgttgcacagcattttcaaatctgaaaaataatttttaaattataatttgtcttcgattttctttcaaatttgttagtcgtctatctaagtaacaagctctttaggaaatagtacaggtggttctacctttctttttgttttatttattacaattaaaaaggtaaaaaaacttgtttatacatgctcgtggggtcgctaagaacaaatatgaaatacattttgaccaattctgggctcagggccaaaaaaaaagtctaaaattcagaataaaattcgcatcattttcatttattttttcaaaataaaattccggggttcttttaacgcagccaattattaaaataaaaatgcaaaaacattggaaataaaacctacagcttacaattaacaaattttattattcgagcattgaaattatttgatgcaaaaaacaaaaggaaattttgtctttttgtttgagttcattcatatcagcactattgccgctctttctttaccttacggaaattgtgaatctacccccccccccccccttagcgagcaacggcctttttcggcacgctttcttcgaattttttattaaattttaaaaaaaactcgttcttttggtttattaggaacttacaaaaatttgctgacgatcaaattatcgcatataatcacttttaatcgcttatttaaagctgattagtctatctgtgattgaaaaaacttaagtttgatccctatttggacataggcgcaaatgttcgaagcgcaaatgtggggtaaccgtccgacgggcgccaccggtgaaaattttgagaatttaaaaacgtttcttaccctcacaaatcaattgagggttaacccatatgaatattaccaagttttcgctgggtttacccgctgctgctggtgaggctccccccccccccgcttactatgttctttagtgagggcattaaacaaaatttttttttattaaacagaattattttaataaaattattttaaattttttgtatttattgaccgaataaaaataacaaattcaaacaacaaaaatcaatttgaccactataattattcgtagctaataaatttataccattggatagagcaatctttgaatataaatttacaaaaggctataaatttgtaaaacatttactggttaaattacccgagttaattttgtccgctttttggggttggggaaaggtgaaggaacacgaagaaagctttgtgatgccacagttttctcttaagtcacctgtccctcggcactgtttctatttggcacttttccaatttggggggaacgatttttccgaaaaagcaaatgtccctttttaaagtgccaaggcatttcttccctttcagttttgcctttcacttaaacaatgattggctacgttattgaaaatctttccaaccgaaaactattcttcattctctccctccttttgcttctccaatcacttttctttctcctcggcgcacttttcggtttctttcatttaatttttatttttaattagttttagctaatttatttatttatttatttagctcccggcccttcttcttccatggaatttgtacttagcgcatgtgtggacaaaagttcgggtaaaagtggtgaatggttcactctccgacccgacaaaacggtgaagaagaagccgctaatgaggataattaggggaggggagggggggggggg

SEQ ID NO: 19199 - DNA, 1050 bp, Heterodera glycines
ttttatttttgtattcgttgtctttcatttattgttcacttatggttcgttaaactgctgaagtaccgtaggttggccaatccattggcattttgcctttgttctttcgcttttccttttttgtcagatgcttcttccgttcactcggctgctcttttcccacccgtttctcgccatttcattttctcttcttttttcttttgttcttccaataataattttgcttctgttcccgcttcaattgggcagcagcccggaaaaggttttgccactttttgtgctttaccctcgtttttctaagggcttcgaaacggacgggacgccctacgccgggccccgcttgggctggacattgctgcaagtaatcagccgagactaccaattggccgataaattgataattaaagcaactttgatctcctctctctcctccctcatctaatgggtccaaaacgatgtttaatttggcatttttagccctcattattccgaggaagtcgagtttcggtcatttctgcagagcagaaagagcggtggaaaaggaagtcgtggacggacgaactgttctcctcggttggctcagtggtctgctacgatgggcccgttccgtccagtaattcgccgtgccgtccccgccgttttccccgcgtccctttttcagtgtcttttctctctcagtttattctcactgtcccttcgctggaacacctcttctccggggacattcttcacaacatttgccaatttcaagatgatttgagcaatgaattggctgccttccaacagttcaccccgtaattcgcaatttcctttttgaattgaatgtttccttctcagtcatcgtaacatttggagctttcccaattacgtggcgtgccttactccgtcaaatcgcgtgaattgttcctttattaatgcccaggatgtttttgaattccgtcaggtacgccccccccccctcctttctccttcatttttcattgctttttgttttcgcttttcaatcgctgcctttttcacccggcgcgcaattgtttcgtgccgtcgcca

SEQ ID NO: 19200 - DNA, 1669 bp, Heterodera glycines
gtgagtgtgccatcgtccttcatcatcccccttgtggtttttctgggtggtgggcttgtcatatttttccgaccctccttgggagttgttctgatcagtgatctgccatcgcctccgttaatttcccttcctcccccagtcagtgcctatctgtgcgtcaatggtctgtcgttgccccgttacaaccctttgcaacttttccgttcctcaagtgttcatgaatactttgatcaggcattacttcctttttccgatgttcgttacttctttttccatccaacagaatgctgagcgtttgtttccgtttgtctccgataaaatcgcctccattcctttggccgatcgtctcgtttgggtgttttttatatttggaatcatttaatcattgcagcaattcatttcagggaattcgggcaatctctgccaaattttacttcgatgccaattctctgccgactcaattggaatccgacaatcatttccatctgcggacagttggccaacttcgagctttggcccaacagttagaacagatgcgtgcacttccattcgttgaacatagtgcccgattttggcctgaaaggtaatttgtttgtcttcaggaacccaaagggcatggattggattgcctttcatttgtctgttaattgggacggttaattatctaattagcccatgttttccaaggtttttggattggagtgttcgtctgagctgcgcgtctcgtccttctgctgaatcggtctgctgtaatgtgcagagtccgcactttgtggacgcacagttggacagttgcatccgccattccacatccgtgctcttcaccaattacaacgacaccctcatttgggacaattccacccatcgactcatcggatacaccgtgggcgatgccggccaccaattcgacaaagcattcgctttttccaggcacttttgcccacccatttgcgctactcccaccgttttgccaatctttccgccgcgttcgctctgttcgaccaatggctttctgttggcactcagcagttgtccttccttcccggatggtaatttgtgcattttaatgattcacaaattatgaaaataaggtacaccaccgaatggacaggtctgagcttggcactttgtagttttattctgtgttgcggtgatgtttagcgatgtcccaatggttcgacttgcaaagggcgattatttccgactgtaaaaaggcatggcaaaaaagagaacggaatggacggacaatggcaccagtgattttgtttttaagaagccaaatttaggtgaaagcaaggagaattaggcattcaattttaaattgatggaaattctgggatttttatcagcctattttccatgtttttggtttttaataaaaataattattttaaattttaaagaacacttgtgcctttgttttccgttgtccgtccgtctctttccttcgcttttccccatttcccttccccccccccttcagtcaatttgcgtttcattcgccgtcgtcttcatcttttcctctttgatccttcggttggttttacaatgcctccctctctctcccttcgcttttcccttcgcttttcctttttctctcatttcccccctttctcagatggaaagctttctgtgccacttttactattttttgtattgtcctcacaac

SEQ ID NO: 19201 - DNA, 2093 bp, Heterodera glycines
cacaatcaaacaaaaattggatttctgatttccttttcatttaccgaacaaccccaagtcagttataaatggtctttcctttgccgagttgttccttggtcgtcaacctcgcacgccactttcaatcttggcaccgtcatcccgttcagcgcctgtgcaccaaaatgcctatcaacgcaaaatgaaaggcaatacgatcatcaccatggagttgctgatcggaagttcaaaatcggtgacacggtgctcacgctcaattatggactgtttaacaagcctttgtggcttgagggtaaaattatcggtggaaaaggtttgatttggcaagtccaaataccatcattgggtattacggtaaatcgtcactcgaaccaaatgcgtaatttcttcccaaaattcccgttttacaagaatacgaagacacggaacacgtgcaggaagacgatcaaaccgaaatcacacacgttccgagcccaccgcgacaacaagtactgccagccgaaccgcgtccttagcgaaatcgaaaaccaccaaaaacattggtgatggacccaaaagctggtggacgatatgaacttcaagaataggaggacaacaaaacttgaaggggaaatgttgggaatggacattcattcacattttaaatttcccgccctttttaatgatgacatcactattattgatttcagccattcccttttgacccgtccttaaatatcagtccttcctctcagttgtcgcctcctctacacatcatttttttgcttctttactccgccatttcttctgactttcattttcatatttatttcttgtttgtcttttatttatttcttcattaaatttgcattttaaaagtaaaagacacaacagaatataaaaatgtaaaattaaaataagttagataaataaaaaaaacatcatactcagagttaaatacgataatattaaaaaatgatataataaagttaataaatataaaaaatctcgcaagcaataaaggaatatatgtgatgtaataattcaaaattcaaaagaaatatttaaaaaattgtataaacaaataaatttattttattttatttattacaaatatgtttggcacaaagcaaaaagttccctttaactgatgattatgatgccaatgtttatgcctggacatcagccgaaaattaaaaaaacaattatatgttggaaaacaaaaatttctgactttgataaaattgaacagatttcattcttcagaatgttaatatagtcatatatcttaatgaaaattaattaatatattcatatatcttttttaataaataaaaaattatattttaaaaaatttagtaaaataaaataaaaaattaatttatatttaatcaaaaaatacacaaagtaatatttgttaattgcttttttaatagaaacaagttgattatgaactaatgttataaattctatatttgatgcatttgaagaataaaaaaatgaataaaaaatagtgaaaaaataatgaagaaattaaaaaaataaataaaaatgattttttgaaaataattaaaaatctgaaaagctatgatacttaaaagaatataaatttataaattatgaaaacatatccaacttaaaggaaacctaaaaataaattttaaatagccaaaaatatattaattaatagaaattatgtgaaattagaaacaatcattaatttgtaacaaaaacatttattctctctacggtgcatgcagcaacgcatgggcatacgttgtattgagcgagaaggatggcttaaactattgcttttcttgccacagtcctttaaaaatttgaaagtgcaaaattaaatggtaaaataaaattagataaatattaaaaaattttaatttataaaactattcaatttgtagacaattttatttgaaacagaaaataaaataaataactaaaatataaatgcaataatttttatttaggtagaatagaaattgagcaataaaatatttgtttttaaatttaaaacataattatagagtatttagaaatgagaccacactgaagagttaacgtgggatgggagccttttgaacacttgaaaaagccaa

SEQ ID NO: 19202 - DNA, 788 bp, Heterodera glycines
  misc_feature (53)..(53): n is a, c, g, or t
  misc_feature (59)..(59): n is a, c, g, or t
  misc_feature (609)..(609): n is a, c, g, or t
attgtaaaagaacaaaccggtttttaaaaaattaatgctcccaccaaggtttntggggncaaagtttaaatttttttttaatcaacagcgggcgcatagaatttttaaagctacgcgccaaaattatttcggaggcataaatgcccgttgggaaaagatgaattttgcaccatttactaactgaatttaacacaaatgacttttattaagggggttttccaagttttcaaaataacaaaaactctgtaaaatagtgaatgcagaaaaattgttgccaaaaatgaatttccatccaaaaaaaaaatagttctgccttacagcaataaccatttatttgtttgtctctaaaaatgattttttccttttagctttcatattgttttaacaaattgcccgtaaattttcaccggatttaatttttcatcgaattttcaatgcccaaacaatccctggatttgattgactattttggcccgttggccgcatggattgtgttcttctccgtcatttttgtcatctccgtcacatgcattttgtggtgttgtgtcagcgaaacggatgacaccaccgtgttcgcaaaggtcgttaaaaaacattaataaattttanaaaactaaaatagtggaaatgttttttaagcgcttttaaccgggccaggcgtcctgaaattcttttttttttaattttttaaatgatggaaatatttttagtagtaatctttggttgtgcatcttcttgagaaatttggtcctaaataaattgtgtcaattaaaaaagttttgaaaaaa

SEQ ID NO: 19203 - DNA, 1623 bp, Heterodera glycines
gcagctgcagcagaaggcgcaatgaatgtgagaggaaggggacggacgacgacaacagcacaaacaccggcggactgatcaacaacaacatcactaattggctttaaaatgcgtgcggcccatccaattgacccaaaaaaaaaattccatggaaaattttgatcattttttttatcattcattagtggaggaaattgtggcaacagaacatcaccatcttggcaaaaatctttggaagcattaggaaggggtgagggggtaaaggttttaataaatgtaatccaacaaaaatttaaaattcgatgatctgctgcaattcttttttttaaatagtcccagaaaagatcgcatacatatgtagacactttgtatttcattttattatatttaatgcatgttttacataagttacataaaaaattgaaattaattttcctaaaatgtgactaatagaaaaaatagtcaaattgaatttaaattgggaaaaatgaaggggaaaaacattttaatgccagagaaaatgcgtctaaattttttgttttcaaggacagtcctttaaaattgaaaagcaatgtgcctgaaattagttacgcattgttttgcattgatgcaaaacgatcgcggaacaaaattggcacaacaatgaacacagtgacagtcaaaaaggtcaacagggagaaggcgaacagcagaaagcggtcaatgatcgatgccaatgtgcgccattgccacacaatgcgacgccgttcgtcagccacctttttttgtttcaaaaaatttcgtcaatttttcatttcgagggaggggggggggagcagcaatcaatgttgtttattgttgaatgagatttccgtgccgagaaatgtgtgtttttttttgtttcttgtaatcgggaatagctcgttacccccgtgtcccgaggccgcaaatgtccgaggcgcaaaatgccggccgcaaatgccgtttttggctggggaacgcaaatgtcgcggccgcaaatgtcagggcaccgttcccccactccccgaggtaagaaaacggattgcattccgctgattcagtctcgattctcgagtaggcctattatcggaattttcctaattttttctttcattccattttattatccccgtctaccgtacacccacctcttcacggatttcaaattgttgcagggtacggtagacgcggttcagtattttgcggaatttctcctcaaattcggtggacattgcgggacgtacggcgctcagccgaggcatgaccttgggaaattggaaatttttcaaattttttttttaaatttttctgaacacctgctccgttaacattcggttcaatatgatgctttcgcggccgccgttattttctgcacgcggcgaaggcgtgcgcagaaattgttccgatgacttaaccgagaagcaaaaaacatttagatagatatgaattattaaaagttgcaatattttatggattagagctcccctagactttgtattttttttttagattataattaaaatttattctatcgaagccaaaaatccaagtttttaaatacgaagaaattattaaaacccaaagaaattcctgaaatctacgaaattgaccattttcggggtt

SEQ ID NO: 19204 - DNA, 1810 bp, Heterodera glycines
  misc_feature (14)..(14): n is a, c, g, or t
  misc_feature (35)..(36): n is a, c, g, or t
tgcaggtcttatanaggctcatgggcttggagatnnaaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaatagcatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaagtgtctaaaaatttttgttgttaatattcagaaaacgtgtttttttagtgacaattttttttcaagagaaggggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaatagcatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtaaacaaaagaaattggcgaaaaaaattgcctcaacaatcagtggtgaaactgaaagaaaaaaacttccccaaaaaatcggagcttttccgacggcatcagctgcatttccaacggttcaacagtataaataaatattaggcaaatgaaaaatttttttccttcctctttagaa

SEQ ID NO: 19205 - DNA, 1274 bp, Heterodera glycines
catttccatgcgctcagtaatttgcttcgagaccccatttaattgctccgttttcaaacgatggatgtgcgaagattagacgacgatacgctcgactttcaatactctttggtggacgggaccatcgatttgtcttacgcgactttcactgccctcaaaatgggcattccccgagacattgtcgaccgctcagaagaggcaccccttttccttctttttttcgctttatctattacaattacatttgtttctttaggtttacattcttttgcgtgccagcggagcactcagcgaattggcgccgattgacgtgcacacagcagtcaaaacgcagggaacagatgtttttgtggggggagcgtacgatggcataaacaacagcaaacgaatatcggatgaacagaatggaattgagaaagaagaagaggaagagtacaacgatgaagaaggagaagaagcggaaggggagaaggaggacagaaaatttgcaacaatttagccagctcatgtgattgtgaatatttgttttgtgtttgtaatttagcacttctttaatcatttaattaattaatttaataaattgttaattggtttttccttctcttttttctccgtccgttttccattctctgccgaccatcgaaatgaacgcgatcataacgcaagtgacggagcaatgaacgaattggagagcgatcaccagcgaatgcatttcgccaacgcgttgggcacacagcgaaagaattgtcgtgaaaagggcgacacaaatgccgacgggcaatgcgtcggcgacgaacatttggaaaaagggcggcgacggcttttgcccccgggggatgccgtcgttgccctttcctttcgcatttagcctaattgttggacagaaaattaaattgagtgccactgccaacccacagcgtttgaattgtccaatggacgaacagtgcgtacgccaaatagggaaagggatgttcgggagggttccacaacgaatgcctgaatgggtacggtaatgccattgctaccgtaggcggtgtgcactttgtgcattcgaatctcctcacattttctgcaatttctgttcagtgtcacccaacagaagaagcacgctttggaccggccaaatgccaaggatcttttgaaatggcattaattagtcactaattagtggcaattaaattggacactttgtaaaaccaacggagcgttctccgcgtgaacatcgcctgggcaaggccataacaaaaaagggcggagaaaaggacagagccaag

SEQ ID NO: 19206 - DNA, 1902 bp, Heterodera glycines
  misc_feature (16)..(16): n is a, c, g, or t
  misc_feature (31)..(33): n is a, c, g, or t
  misc_feature (43)..(44): n is a, c, g, or t
accctccgctgaaccncctgcagccgctgcnnncgcgcatgtnngaaaagtgatgcgtccctccctctgattgacccgtgccgtcgcgcttatgcgccgttgccgtcgatttctcgcctcgctcgtctttaccctcttcagtcggttgggaaatacttgtgcaacccggtttttcttagtttaaaattttccaagtgccaatcaaattcggcattgttttaaaaattgccagttttttttggcatttcctacttttgtctgtctttgttcagccgaccttctctccgtgcttctcatccctctctcctccactgatcattcccccgcatttcttctccaacacatcgctctcttcgagggggcactgactctcgcgctgatttgtgcctttcgtccgtttggcactgtccatttcaaccccggtcggcctatttccctcatctaattagcattcattaattaattattgccccattagccgtcactttggcttctcttctcactctcaatttgcctcttttgctcggcttcgctttactttttgcccaattcttcggctctttcttcggtgcccttctttttcattcgtccatttcttcttccgcgtttattgatgcttctcttcaactcggcacacttcgcacaatgaccgaaaatttggaacaatttgagcaacaaaatgttccgcgttcgcccgtcgacgacttttcggagacggacaccaatggacggatcagtcccttctccaaccgattgcaggcaaaaagaccaaacgatgttttggcacttcgtctttcactttcttctctgttcagatgttcatttctgagtgtctctgctcccttctgatcgttttggcccatttgttttgtgatttaagcaattcggctgtcctttgtcggcatttttctgttctgcctcaggcactttccgttgcatcgactcgagtaattaattaatgactaatcaattaatggcacattctttgcccgtttcaattaattgttatttgacactttgtctttatgttgtggccaccgctgtcggcgcccgttcgcccctcggccaaagtgccaatttgggccgggccacggccaataccattctgacgacgatattcacgcgccccgatgagtttgtcatttggcgcttcttatacatccatttctttggtgccttttgttcggcaattatcggcgccgccattttttggtgggggcgggagggatatgcttagagcattaattattatattatttataaatattttaggattgtcaaatgcgctttggtggataatcaatcgccataaaatgaactcttatttctcgaaatgattcttgctacgaaaatatctatttacgtgcctaatgagaccactaaagaaggcctaattaacttgagaaacaattaattgggctttgtccaatcgaaggaatgtttgaagcaaagaaagggattgatttgctgataaccattgctttgataattgattgatttgctttggacgtcagcattttgttaagttattattaaaacaagcaaaatgaattttaaatgttgcaaatcggcgccgcttttcaattttttccgccttcgcaattttcacaatttcgtccattccatgcgcccaaattgaatcgatcgatgtttttgaaggtgctacccctccctccgccgttttgcccccccccccccctcattcactcaacaattacctttgctctctcttatcatttccccaattcaatcatttctaatatttcgcatatttttcatttgaaaattcctagatttttattttccttaatttatttattttggactctctttttaataatttattcaaataaaaatcaaagcgatggtgaccaatgctcagaataggcccaagagtgttca

SEQ ID NO: 19207 - DNA, 1585 bp, Heterodera glycines
tgcaaaattttttaatgtatattcatgaaattttgttcaacggggtttttggggttcccgatcacactaatctgtcaaatattttgatcaattcccttttcctaacctaaatttgaacaaaaaaatcataaatcgaaaaattcaaatttcgatttttgttcgggttcgggttagggattagaaattggtcaaaataaatgtcaaattcgtgatcagcgacccttaaaaccccggagaacaaattttaacggttttttatcacaaaaaaattttgaaaatcaaaagggtccctcccccctttttgataaaaaaaaaattcaaagccgcccttctttaaagtagcgtcaattgtatcaattcatacacaatcacagaagttcaaactttattaccaaattttataacattcacgaaaatgtcgtctgaaaacctcgcgaaactctacaaaaacaccggaaagtcggaagtattgaagtgtttctctgcttcattaaaaatattctcattttaggactcgcgtcgacgtcgaacagaagtaagtcaaaatgatgttcagggattagtcattgattatgagatttaacggatattatccatgaattccttctattgcagaccagcgttgagttgcgcaagaagaagtgcaatgaggagatgatgaaacggcggaacatcaacttggagtgtgcggacgactctgccacatccgccgaagaagtcgtaaccgatggggaaattggcgaaccgacgggccgtttgtcgcccgaaatgctatcgttggaagacgcagttgaagttttgcaaaaagaacaaaatgcggagagattccgattggcttttgagtcggtcaggcgcggtcagtggataaaaaattgatacaatttctgtgctcctaccgaggtttccgtttttagttttgagtcgcagcaaatgccctccaattgacaaagtgatcactcttggctttccttgtgctctcgtccaggcgctccattatgacgtttgtgttttttatttgctttctccacacttggctcattttcaggatgacaaagtgaagtttgaggcagcttggtgcatcaccaacatcggtattttgaatttgatgacggcataaggtttaaaatattaattttccagtttctgggacttcggaacagaccatgaccatggtcaacgcgggtgcggttggtccgctgcttaaactgtgctcctctccttcgctcaaattgagtgaacaggtccagttgtcttcgtggatatgttttgtttcgtcggcagtgtccaaaatatttttttgttcccttaggctgtttggtgcattgccaatatggccggagatggcgttcaacttcgcgacctgctgatttccgagggtattctgccgttgcttgtcgggttggctgaccgcgcggatactttgggcatttcgttcgtgcgcattctcacctgggccttctccaacttgtgccgccacaagaagccgcaagtgccattgcaaatgttagccgtaatggcaccgtcaatttccaaactgatcaaatatgaggttgacatatctgatgtgagtaaaactgagttctct

SEQ ID NO: 19208 - DNA, 814 bp, Heterodera glycines
gtgaatttcttcgtttaatcccttgggggaaattggcacaaaaaaatgaatgatgtgatggagggagggatgggttgaacaagactgtcatagtagagcctggcgtatccattcccttcgcataaatggcgcaccaatgagagccctccttgtggtgggcgtccctgttcacgacgagcgctgcggggtactgtagtgtgaagggaggcggcaattggtcactggcgaagcagccccgaaacactggctcggtctgccgattttcgctcaatatctttataatttggaggcgtccattctttagccaaaaaattgaacaaagttgatgaagaatcagactgaggatgagcattaaataaagggcgaacaatgccccgcaaatggctttctgcgcaaagttgctttccgctggtagatccttactcagttggataagcggtggaagaacctcagaaaaggtgttctttgcgactctttaaaaatagtaatattttttaaaaaatcacagaaatgtcctgatttggcgggccaggccgttttcgtacgaacacatgtttttggggcacccccacaaagtgtccaagccacgaaatgtccaaaagagtaaaaacccacgaaatgtccaaaatttttcaaaatttataaatacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcgacagaa

SEQ ID NO: 19209 - DNA, 1927 bp, Heterodera glycines
tcatttcaataaattttgtacaatttcaaatttttgttcatcagtttttgatttgtaagaattcttttgattaagtcctaattccttaatccatttataaattttcattcgatttgtccccaatttttgcatcaattttattccattctttttttgagtattttcttcctttttgcctaattttctcttttattttatttaaattaatagtcttttcaattctttaatgcctctttttgtgtcgctgttttttcaaaaataataatttttaagttgaaatattttttattaattaaatttcaattgaaataatgtaaagaaaatataaaatattttctgttcttttgggtaattaaaccatagcgaaaattaattaaggtcagaaggtttagtcactacaccacataagaatattaaacaaatccttaaaagaaataaaaaatttaatttttttctcaaaaatttctcaatctccaccaattgccttctcttttctcacaagaccccccattcttaccagtgcttatttagtcccgccggaaccgggactggcaaaaccgggaccgggatttcaatttttccaaaaaccgggaccgggacttgaaaaaactgggatttcccgccccggtcccggtcccgctcagctatagttcgaacttcaatctatctggtcgatttgtccccaattttttggctatttatttgaattttttccattgtttttgttttgtatattcttaagctttgcgtataaattaataaattaaagaaaataaatggtaatttttatcaacggaaaaaattcaacaatttctttctaaaaaatccaaggttttttacaatattttcatcattcttttttggcttttcatttttattttccaataaattttaattttttccagttttttctttttccgttattttacagctaatgccaaattgattcttccatctgcaaatagttccatagccaactccaattttcttacaaattccagcataattttggcgccattcttttaatgaatattttctattttgttgttttatttcatttttcattttaatgaatttttgaacaatttcaagtttttgttcatcactttttgatttgtaagacttgagtttttgaagaccaaattctttattccaatgttggatatatgtgcgatttgtccccatttttttcgctatttttccatcaattttattccattcttttgctgaatattattttcctttttgctttattttctcttttattttataaaattttccaattatttctctttttttgagttcatttcgtttttcttcttctttttcttgccatttttctccaaatatttcgccaaatgacttttgttgcaattttttcttttctgatccaattttgacaattaaaaataatataattaataaaagtagcggaaataatttcatttttgtcgtctcgaaatgattttattttatttttcttcaattaaatggcaattcattttttgaggcatttaaatgattttttctgattaaaaaactgaataaatcattattttacttaataaaataaggaaatcctgtttaattgcaaagaaataataataataattttatcttaatgacaaaataattgccaattggtaaattaatgattaaataaaattttattactttctactggagctcattcgaaaataataaaaataaaataaattcacaatgtaaagagattttagaaaaattaaagagattttatgaaatttcattatatcagaaaattggtgtaaaatggccaaaaatgaaattttagcgccgaaaaatgttgctgttcacgaaaataatagaaacttgaatatttgaatgctttgaacacctgtgggtggccaccaacctgtgttaggacgggtcatatttaaattgtatt

SEQ ID NO: 19210 - DNA, 1969 bp, Heterodera glycines
atggttcaattaccattttactgaagcagtgatgacttttagttcatttccgtgttcttaaacaaaatttgagcaaaagagtgcaattcgaaaaatttgaattttcgatgtttggttcgaattcgggtccggggttcggaattgggcgaaacggatactggattcgtgatcagcgacctcgaaaaccccagcaccagctttactattaccgttttttctcttagggctatcgagtgataccaataatttttaataagaaaaagctatggtgcattaaagttgcaaaaaacagcttatggtcgtgtgaaccgcaataggtcctcaaatccgtttttgattgctttggccaatgtcagcttttcctttgtccattcgtttaccaattcaaacggcaccatttgcattgacgacacatgaacataaaaatgaatttggtaactgaccgaagaaatggtggcacggagaaaatgctgaacaatttgaaaacaaaaatcagtgatttgtcgaaaatgtggccactcacctccttgaaattgttgacccaatcagtgttcgcttgttcgttaataccaccgcaacgcaattgtttgggttggccatcttttctcggagagtgcaaccatttggacaatgattggccagcagaaattgttgcatttggcccatcaaaatcatcaccaatcgcagcgggcaacagaacaaatgaatcgattgaattcaattggttgaggtcggtgagaattgtcggcgaagtgcgaagacgcaaattgtccaaatgatcaccatgggaaaagcccaagtgatgaatattttccgaaaaaattggccaaatttcgcgaacaaaaatatcccaaatccgctggccatccgtggtgtgtggtgatggaatccacaagtctaaattggtgcctcttttgtcgaaaatttggtgatttgaacgaagaaaagcgatgacggagtgatcgatgtaactgcaaaaagggaatgaatgcttttattgccatagctcagatttttaattactcaatatgaaggcatttaaagcgaattttgctgcgcaacagacggtcgtctggcaatggaaatggcacaaatttgtcatccatctttacataaagtttcggttctggtcctttgtccttgcgaatttcgattgttttccaaattgtcaattcgcttttgccatcgaaatgtttgtccaccaacgcattgaaacgtggcgaaagaagtgccaatttgaggccgagttgggcatggtcaaacgatgggaaaatgtccatccaaacgtcgttgcaaatccaactgaaatgggaaacaattaggctaaataagtgaggaatttgtggcttttaaaaaaatgccttaccgcctgttcattttttggcaaaaataagcacaatttggccaaattccgaatgatgtcacacaaataaatagcagaataattaaatgcgttggataaagcccggatttttaggattttcctatttttttacggatagtacttgatgagaaaaacacgaatcgcattttctatgaaaacaatttttaaatctgttcgccttaaattgttgccaatgggctcgagggtagagaaaggcaaaatcaacattatttttaaaatttcgataatttttgaaattttaaagcaatttttttcaaatgacttttggcgcaaaaataaaatggggagagagataacagaactcatttttgcgttatcgctctacataaaattataagccacttaaataaattttaaaaatttacgttggtatttgctttgatggcataatgtttgttgattttattaaatatcaacatttagccgcagaaaaatctaaggtaatagtttagatggtaccccccccttttttaaaaatttttttcaactcaaaaaatcataaaaacatgtttctagaggttttcggggatcgctgatcacgaatccaacatccatttcgaccga

SEQ ID NO: 19211 - DNA, 825 bp, Heterodera glycines
  misc_feature (818)..(818): n is a, c, g, or t
gtcataatcccgacgcgtcaaaatcccgatgcgtcgaaatcccgacgcgtcaaaatcccgacgcgtcaaaatcccgatgcgtcgaaatcccgatgcgtcgaaatcccgactaagccaaaatgagtcataatcccgacaaattaaaaatataaatttatttatttttgtacatctatttacatgtatattatatattatatatataaatatatcataatagccttataaacaaaatgaatcgaaaaaaaattgaaattcttcaaaaatgtcgtaaaggcaagtttctgaacaacaacgacggcaaaaacgcgacaacttctgaacaatgtgagcataacgacaacaacaatgaccgcgatgaagactttggagaagaacatgccatcatcaaattcgaactcggaaaaactcaaaagggaggcaattgtctttggtccgaaggtgggaagtttattgaaaaaataaataataattatattaaggcttccggtatgtacaaaagaaattggtggaactgctctgtgaggaactgtcctgcgcgcgtgacaatcaccgacaatagcgacaaaaaaatgtgcggttatcttggccaaagagaccataatcatctccctgagccacaaaaacaacaggtttgggatgctcattgttaattcaagtctgctaacaaaatttaggcagaaagtcggcgacaaaaaatactccagtgtgtgaaggccgaaccactctcatgcggcttctgccctcgcgaggaccaacaatggtctcgaagcaacccacctccatttctcagtatttgatgtgctaataaaacccanaaaaact

SEQ ID NO: 19212 - DNA, 2463 bp, Heterodera glycines
atccagttcaagactcaggcatcactggcaaagtgccctgccatcaacctttgtctgcgagaactgatcaggactttttcatttttactgccgaagcacatgaaaaacaattcccaaattttgcctatgaagcatgaaattttgacatttttaattacctaagtaaattagcgaaattattttaatttaaaacctagacccccaaaaccaaaatacactcatttcccttgccaaagccccctttcacaatctctctcattcctatcaattaacgccggtcatctcgccgtctttcttggcacacgcgcgtcacgtgtcccgctcgtccaaagctttagcacttcgttgcacttcctcctcgtccaccgcgtgtgaatgtcgtcccagtgaattgtctccaacttgtgcttcaccaattttcatcgcgtcgcggtgccggtccaatgtcctccgtcgccagtcgcttgccttccaatggtctatcggcagtcatgaaaatgggaagaggggtgttagacctgttttctgtaatagaaccactcgagtcccaccaattccgttcattcgctcagtgtcgcccgcaatctgaaatgaaatagggaggttagggttaaaaaaacaacacaattaccaaaacctttaaatgaaccctcaaaattttaaaagaatttattttactgatgatttcctaagaaaaattcctattacctttcatttcgcgtacttcaagtgctaagtcttcaatcatctctctcaatgttgtgtttcactagcacaatcatttttggatgattctcagctgaatgttcccaattttgtctattttctgaattagagggaccaggaaaatctcgaggacaataccaacattcattttgaatgtgccctggtcgattgcaaaatttgcagaagagccgagtctccctactcgtataattttgtctgaccgaagtcgagtgttttgccttctagttcctttcatcctcttttctgttgcactttgatctatttaatgaatgaatgccgaagcgcttttcactttctaccgaaatctctaactcctgaatgtaagacgtcagctttttgaaatcatttttccctattaatggagccactaattgaagcgaacgctgatactcaggcctcactttctctattagacacctacagagcatctcctccctcgctcctgatggaaattggtcagtcgttgtattcactaggggaactaaccgttttatgaactcgcccactgactcaccatctttctgatagcaagtagccaatttcctataagctaattccctgaaatgtggactatccaactttgatttgatgcttttcagagcattgcttaatgtatccttctcggttggcaaaagtttttcaaaaattgttcgcgtatgagcacctaagtgtaatttaagtcgatttattttgtctgcttccgaccaatttgatccaaagacatccacataatccagaaatttaatttgccactcataaaatgctgaagcagtttcaccatcaaatatttgagataaaggatttgaagaacctatagcagtaagcgtattcagataaaatattttaccaagctccgcattattttgcattatcttgtgcctttgtatcgccgaagcgttttaaaatgtcaaccaaaggagtcacactgaaacttcagtaaattctttgcctttgtgctgccgaagcaattcctaatttttgattttgatccctttttttcaattccccctttttattttatttggttttgttttgttgtttaattttgtttaatttaattaatagaggaaaaggaattcactttgtccaccaacagaagtcaaatgtccgtccaatcaatcagctttgtccgttcacttggaatccgccgaagcgtttggtcaccactgatgtcgctcttcacctgtaattctccaaaatgattgattgaaatccaaaacaaaacaatgctcttaaacgccttcaattgtaccaagagggtataacttgaccggaatttacacaccaaatcaattaaataccaattattttttaaattttaagggccataaaagcgcatcagtgtataacgaataattaaaagcgtaacgaagtttatttggttaatcaaatgaaagcatgttgtttgttaagcaaaacaaaaatgtttggccttcgtaatacaattccaactaagactcacagtgtccacacaatgcgaaatgtgtcgcacttttgggccgccgaagcgttgaatgcagttgacagtccgaaccacactcaaagttctcttactcagattcgccaagcgcaagtcgttcgtagtccaatgtcacacgtagtcgaacaccacagatccgtagaaatcgccgaagcggggaagaacgcaccgtcgacgtgccgaatatcacctactcaaattgtccgccttcagtcggacgcacaattcgccttgag

SEQ ID NO: 19213 - DNA, 1898 bp, Heterodera glycines
  misc_feature (1810)..(1810): n is a, c, g, or t
ttttaattaccccaaaaatttaaaagcaaaaattcatctttccaaaaatttaattgaaatattttattttttactttttcagtactcatactgatcaagtggcttcatacaatccaattgaatgaagaaaattttaacgaattggattatgattcaaatttattttttttagcccgtaaattgtagaaatgtttagaaaaattgaatttttagaattaaaattgtcggtgatttttatttgttaaaaatattgaaaaaataaaacgcaattctttgaacaataaaaaaaattgctttatatttatcatgggattaattatcaataaatattaaattttaaacaaacttcatttttacacgaaaatatatattaaacacaccgtttcagttttggcctcccagttccaaaaagatttgcatgtgtggctcagtggtttttgtaagatagtaaagggacaaagggtggtggttcgagtccgttgtgcaacatgaatatttttatttatttttgtccaaaatattaaaaaatgacgaattttgggaattatttttgaagggttttcccaaccaaattggacaatcatggtatcattcgaaagctcttgatgaggagaagctttttctaagcaaatgttaagcgatttaacgatttagaaaaaagataagagcgttcgaaaatttgttttttggataactttttagtaagccttatttttgcaaaaatctcctatattattcgatgcagaaaatttttctctatcggtatgcaaaatttaaagaacatctgtaagggagaaaaaaaagttctatagagcgaagtaaattcggttttctctattaacagagataaagaaatagtacgccaaaaaaaagagatgtttttttctctgcactctctatttattggttcatgtctcgttttttgaaacggtgtgtaaagtaatcaaaaaaaaatcatgatttttgatgattttaagccgaatattgcagccttgtgaaattaagatttttaacaaaagtttcaaaaaatttgtaagaaatacagtaattggggctgtacagtaatttaacggaatttcttatcctgtattaccattattggaagattaatataatcagaattttccgagaccaaaagcatttttatccctcccccctgtttaggccaattcttcctgacccaatggaagagttgcaactgaacatgccctaccgtgttcagcctcactttggcgacacacaagaattgttgggacgaggtaggcaggcacttttaaaaattgaattataatttaaatttatggaattggcacttttaaaaatcaatttatattaaaataaatttaaggcatgcatcccgtgccaaagagtgtggacacggcggaaccgttgcgtgccgaaatgatgtacgtgaggccaacctttgacaacataccatcatactaacaacacatcaatttgttgtgtgttaaaaatgatatttttaggaagttttatttaagtatatatgcatcataaaattgactttttaataaatttaaataattaaattaaatttctattagaataggtatgtgctgaattatttaaattatttcggaattcaaattcatgaaaaaatcgaaatccgtaacccttaattattctaaaaatggaataatttccgtatccgtaactacgtccggcctaggaccggttcttcggcgattgaaccgtcggggtcaaaatcgataaaaactcgaaaaactggagtttcgataagttttcggttcaatgagaaagtgccaaaaagtcaataattgtatcgttncaataataatttaattgaaaatttaataaatttatttgcattaaaaattttcacaatttttgacaaaaaataatatcgttatgtaaat

SEQ ID NO: 19214 - DNA, 927 bp, Heterodera glycines
  misc_feature (901)..(901): n is a, c, g, or t
ccccaagaatttttgacattttttaattaatgaaatctttttctattttttaatccaactaatttaggccccagaataacttactgccaccattgtccattttttgtccattcaatgtcagtgtaatcgaaattgtaatgaatttcaataacacaagcgacacctgccaacaatgaacaaaaaactgcattaggcatttcctaaataaaaaaaattaattaattaccaaaaatattacttaaaataattgcttaaaatccaaaaatggcaataataggtcgcttgaaatggcaagcaatgaattaaaatgggagtaatttgagcaaaattgtttttaattttagaaaaaatggcattgtttgtttattcttgttatagaattggcgaatttaaattattaaaattgaatttaatatttggcaaaaaaaagaaataaaacagggcttttattaattattattatttttttattcaccaaaaaattgtaattcttgagacatgtattttcaactttgtgacaatttgcatacagccaaatcagtgatgagataatgatcatacaggcgaacaaaattgcgacaatcttaaataaatgataagtgcataattcaattataatatttaaaaataaaataatattaattaaattttcaaaattaaattcacctgggtgaattggttttgcttttctaataaagtacatcgaaacatggattgacaatgaaaagccgccaaatagattagaaatgatgaaagcaactaaaattaaaaaattaaaataatattttattacgattaaatatttatttttggtttattgatagatccataaaatattccaaggatttggacaaaattttattcataaaaagggtgattttttataaccgaataaacagangtaaattattctacggttttctaatt

SEQ ID NO: 19215 - DNA, 1603 bp, Heterodera glycines
  misc_feature (1503)..(1503): n is a, c, g, or t
  misc_feature (1582)..(1582): n is a, c, g, or t
tttccaattaataaaatttgcaatttttagggttttttggaattttttttgccaaattttctggcactgaattgtcaatttttcaacgtacactgaatcgtcggcactgaatcgtcgtcactgaatcgtcttaacactgaatcgtcgtcactgaatcatcggcactgaatcgtcggcactgaatcgatatgcaccctgatgtcacaaagggcagaataattttgttagaaatgtttttttataatgagaggaaaaccgaaaaacataaatttttatagtcagggaaatggatttgttgaatatttatttgtacattcgttgaaaaaaattcaccaaggattcaaaaagtatgataaaaaaatgtaaaaaagcgaaattattatttattattttttcaaaattttttgacaataaacaatcacttttaatcgcttttttaaagctgtttagtccatctaggattgaaaaatgtaagtttgaacccgattttggaaataggcgcaaatgtccgaggcgcaattgtggggtgggtaaccattgtgcgggcgaattggtaaaaaaaattagtcacttttgaaatttttgtgcataaagactggatttttccaatttttaacacctattttcgcaatttgatgaagcaaaagcatttgcatgcgaatgatttaggcttatttttttggcacaagtggtgcgcacggaacaaatgcttaaaccgtttgaaaaattcttttttttgacaaaatctaataaattgtgcttgttttcatttttcaaatttctttatattgctactttaaaatttttaagttatagcgccgcatacattcccattaaaacaccaataatacgcaaaattaattttacatcgtccgattactcaaatatcgtacatcaatttcacaattcaaatattcagcagaaatttgccaaatgcttatatgatgtaatgttggtgtctttcgtatcaattgttaccatatcgtgttttcaaaaatattattattgccgcgttttcctgcagtgccacctttgtcctgtcatggtccaatccatccaactttcgttcgccagcagcccaaacactgacagtttggcggctaatgaaatgaatattttactgatgagttagcggaagatcatttaagaaattaaaataaaatatagtaatatgccgtatttactgaaattgagtcacccgcttttcccaatttgctctacataatttggctggtgtttatttcattggagactctattattaaatactgtaagttatcttttttttttaacctacgttccaaaaatatggctcaatcggctcgtgttctaaaagtgagaaatcttttattaacatatgtgcacaataacaccctttttcttgaacaccaagactcggtagaagtcggtattaagaactcgaaacttttctcggagcgagacagaaaatttccctagacttgcgcggcactagtgtcagtccggtgaggaaagggatggtgcngagaagtgatttttaccaagaatcgagaccgagaaattaccccaagaaacgatcgagaaatttctcgactcgtgaattntttcctccttcgccggcgacc

SEQ ID NO: 19216 - DNA, 1747 bp, Heterodera glycines
caaatacgcttagactcaaatgctggcacacaaacaatgcccacgccctaaatgtctaccggctgttttggcagttagcccttgcccgatgccgtacaaatgcagctccacaacactgttggccaccattggccacagctcgctcatcaccaactcccagctccagtgctttgtctcttcaatgttgcatcgaaagcgaatttcgtggcgacaaaaaacgggttgaaaatggcgcagaaatgcgatgacgccatggttgacatatctatggcattttatatggttgttagactataataattcaagaaaatgagtggaagtttttttaaattgtgcctaatttatagaaccttttaaaattgttgctcggttttttacagagttgtttgaaacactctattttttctggtcacagtcatatttggttctcatatgagtgtactaaaatatcccactttatttggatgcttttgaaatctgttatgccaagcggaagtggtgacacggcgacgggaaatgtgacggctttctgcgcgtcttggtaatccttgacaatgtccaacatccaatcaatgccgtccttggcacggcgaatttgaatgtggccaactgtccacagttttcgtctcaacaaatggtcggccaccgcgttgaattggccgctgaccagcgcaattccgaacccgagcattacaggcccaaagaaggcgagcacgtcgtagcaaacatcggcacataatttactgtagtggattttgaaaaaaaatttgccatcgtattcgagtctatgtctagctttatggtgattgggtttttcagattattcagaaaatcccatcgaaaaatttcggaatcccgaaaccaaaactttgttattttttcatgcaaatggaggattagagctcgttttgaaaaatgggccttgtattttctgtacaaaaatcaggcccagaaaaaactcaggttgccaaaaatagcctggaactatatttactcacattctcttcatttggcgctgtccttcgcgcggatgctcacacatattcaaaaaaaaaagatttatatttttgagaaaatggaaaaacaaaaaagatagagccaagaaaatctttaagaaaattattttggaatggtcctttatttcttagaactgaagcatgttttccttttttttattgaagggaatcccgatagaaagaaagttgtcattggcaacggtggccgggaaaatgggccaaaggtcagtgcaatgtagggtggggcttctagtgcatttcgaaaaaaccgccacccatgcgcgtttcgtaaatccgccagcgcgtttcgtaaatccatccgccaatgggttcgaaacaaaaaatatgtaacaaataaaattcataacttggcccaagttcaaccaaattaatatttcatggtattttttaatagctatgggtgcattctttcagaatataatattacaaaatttttatcttataaaaaatttataaatcattgaacattctaggttttttgcaatggtcaagcatatataattataaacacaatgtttttaatctataaaatgcatttgtgccaatttatttatatattcgatagctctaaaaattctctatttacctttaaaatttcaggaaatttaatttgatttttcaaaaagttctgaacaaaaaattcttgactaacactttgaaattttatgaccaaaacttttttttactttagaaaaaaattttggaatatt

SEQ ID NO: 19217 - DNA, 1049 bp, Heterodera glycines
gtgccattccccatgggttgtcccccatttaccctccctttctccccgtcccatccccaatgggtggcccccattttacccctcctcttctcccgtgcccattccccttgtcccccatttaagcctcttctgctcccgtgccattccccttgtcccccatttaaccctcctctgttcccgtgccattccccattggttgtcccccatttaaccctcctctgttcccgtgccattccccattggttgtcccccatttaaccctcctctgctcccgtgccattccccttgtcccccatttaaccctcctctgttcccgtgccattccccattggttgtcccccatttaaccctcctctgctcccgtgccattccccattggttgtcccccatttaaccctcctctgttcccgtgccattccccattggttgtcccccatttaaccctcctctgttcccgtgccattccccattggttgtcccccatttaaccctcctctgctcccgtgccattccccattggttgtcccccatttaaccctcctctgttcccgtgccattccccattggttgtcccccatttaaccctcctctgttcccgtgccattccccattggttgtcccccatttaaccctcctctgctcccgtgccattccccattgttgtcccccatttaaccctcctctgttcccgtgccattccccattggtcccccatttaaccctcctctgctcccgtgccattccccttgtcccccatttaaccctcctctgttcccgtgccattccccattgtcccccatttaaccctcctctgttcccgtgccattccccattggttgtcccccatttaaccctcctctgttcccgtgccattccccattggttgtcccccatttaaccctcctctgttcccgcgtcattccccattgaatgtcccccatttaaccctcctctgttcccgcgccattccccattgcttgtcccccatttaaccctcctctgttcccgtgtcattcaccattagatgtctcccatttaacccttctctg

SEQ ID NO: 19218 - DNA, 2209 bp, Heterodera glycines
caggtagacgttctctcgcggcttgtggcaaaaccacgtgagacagtggaggcggaagaacaagtgatcgccaacgtcgacaaaatttcacttccaatttcagatgactcagcgatcgatgaatctgaaatggccgctttcgactacatattcatgaccaacattgatcagctgcccgtcaccgcagatgaagtcgccgagcacactcaattggacactacgcttaggaaagttttcgatttttgccgtaatggctggcccaagaagtcgcctactgattcatctgcctttttcactcataggcacaaactttccgaagtgaatggttgcctccttttcggtgaacgcgtcgtcattccggcagccttgcgtcaacgaattttgtcagcccttcatttcacacatcctggaatcgtgcgcatgagggcattggcacaacaacatgtctactggcccctcatggaccttgacattgaacgttgggttcgccactgcgttgattgtgcgatggcagcaaaagcaccaacaaaaacgacactctctccatggcctcgaacaaacaaagtctatgagcgcattcgcatggactttgcaggcccatgttctgatggcaatctctatctcatcatcgtggatgcattcagtaaatgacccgagattttttaagtgaaaagcacttctgcggacaatgtcatcgttcaactcgagtggctcttttcgcgatacggatttccacgtgaaatcgttaccgacaatgggccaccctttcattcaaaagatttttctcatttttgcaggattaaaggtatcaaacaaagatttagtccgccgaatcacccacagagcaatgggtaagccgagcgttttgttgacatttttaaaaggcaaatgaaaaagtgttcacacggagacaaaaagtggatcaccaattccctgttcgcctaccgcaacacaccaaatgccgcactgaaaggtcaaacaccagctgaactttttcttggccgctcacctcgaactcaactgtcactgctcaagcctgacatttcttgctcaaatcgcaatcaaaatgactacacaaacaacatgtcgaagcaattcgatcgcaaacatggtgctcgccaccgaacatttgcaattggtgacgatatgcttatcatcactaccgtaacaacaaaaagtctttgctacagggtaaagttgtctcaggttctggtgttatttgggaaattaaaatccccgtccttggtaacgtcattgtgcgtaggcacactaaccaaatgcgtaattttttcccaattccccaaaaaagtcaaaacggaaatggacccggcacacagcatggttctcctggtcttgttcaaaagcgtcacgtacgtttcgctgatgaagtggatcaaaacggagccattgctcgagaccaaaaactaatcgccgatgtcgccgacaaacaagtcgaagtccgacgttcagaccgtcaacggcgtccaacaaagaaattggatttagacccatcaaaaccacgttatgattacatttcatgatcgttttactttcgcctacccattttttttaaaccaattcaaatttaaacggggaggtgtagagtacattgttaaatattcaaatttacgccattttcggattactgtaattccactctatttcctttctttcgctttcataaatacccatctcttttcactcatcaatcaacttcgtgtttcattattcaattcctttctcttcactcgtctttactccgacttttttattattttacttctgacaaataatttattaaattttaagttgtgtccacttttggacataacaaaaatatattaaattttcatgatttatttattgctagtcatgtaaaattgaatgaattttaaatttcaactaaaggaatttttttttttgaaaatttgggtttaatttgttaacaaattatgtctagaattgtcgattagctttaataaaatttggcaaaatggtagaaaaaaaattcaaatttcgtttaatatttttgcattttctcccacgaaaatgccattcttaggggtgtttatttaaccccgacaccgagtcggggttaagggtcggcgttcggggggttgtcggggttggaagcgtcggggttcgggtcggggttaacccgaaaaatggccaaaaatgtcggggttcggggtcggggcggggtcgggcg

SEQ ID NO: 19219 - DNA, 2906 bp, Heterodera glycines
caaactctgtgcgcttttgtggtcttgcagaagatgatcacctcacagccggcacccatgcaaatgcgcaaattcggatgggacgacacaaagtcgcgaaagagctaaaagggaaagaaaacatataccatgaaaatttaggaccagttgtcaaaaaagaccaattttgaatccattttaggggggttgaagccgccaagaatcgtgaattagtcgaaaaattctagtgccccaaatgaccgaattttcgtatttggcactcagtgccgccgctttctttgcacccgtggagccaaaagtgatgagtttgagcacaaattctttgtgacaaataacgggacaaccactgctcatgcaagtgatccgtgtggaaacgcctgggaatttgcaataacaaaaaataaaaatgtttgaaattggtgaattccaaccattttggagttgcgtctccacgtgggacagccaacagtggcgacagaagccgtggccacagtccaatttcagaagatcgccggctgagttcggttcaaaacacaccgaacattcaggggaggaagaggtcgactggtggaggggtaaggcctgtaaattggggacaatttttacgggaattaaaaaagtatccgcaaaattgttagaaattctgggtaagttcgattaaaaaagcgtccaaaattgggaaaaagaacagaaccaatgacgatgatgatgctgaggagagggaggaagaagttgcaattgctgccgacttgctccgtgtgatgattgtgctgagaggagggggaggaggaggcacattttggcgatggtcggcaaggagatggttctgaaagacagagaggagtcaggcagcattccaaagagaatgggacatttgaaattgcaattttttgaggcaaaactttgtgagaaaaggatgcttgccttgggtgcattattttccccacacgccactttccccctcaatttttttaagaaaaagtatatagataaaaaattttaaaaaaatctaaaaaatatagagaaaatgaatcaaaaaaaaacaacgaaattttgtctttgaacaattttttcgggggggggggggagaacaaaatgcattcaccctgttgcatttatgtaataaaatactcaaacaatgaactgtccccacctcaataagcagttggcgcagtccgccgcattcggacagtccgttgcacactttttcaacgttccattcgttcaggtggagcagcagacggaccaaggacggactgagcaactgctgattgttgtggttgtgatgcgtgagaccatgtttttgagggcgactgtcattatgcacaatattattattgttgttgttgttgagggagggcgactgcagctgaatggcggccatcagttcggccactgtcttgtccagcacgagagtctcgacctgagaaatttcaaacaaacaatatatctccggaatggttcggttcgctgctctctgtgctttacttgtgctctgtccatacagctgtactcaacgtattccgggtcacagagaattgagcccggcgtcggtccctggtcatatgtgtcatccgtagcgtaataatctgtcaaaaaacggtttattatcagctaatcgaaccgaaaacggcaggctaaccggtgccgttttgagcaaaaaatctagcaccaaagttgacccgaaaatgatttccgaaccaaaacgcgattactcatatttgaataaatttttgtattaaaataataaaaaaaagtgcaccgtattcttcacagcccaattccgatggacacgaatcagaagcggcgtccaaagatgaggacataattaaactgcaacttgaaaaaacaaaatacaaattttacaattataggaaggaatttttgactgtttaaaaacggataaattgtaattaaagtaatgccttttttgtttgaaaaaaatatttatttgaaattgaaaaaattagcaaattaacggcggcgatcatcgacagagaaagcaccggcggaagaacaacaaataagaaaatatgtgaaaaggcatttccttttttattcgttgtgttcgccgttccgtttcgcctccaacagacgacgactgcgccgcaaataactgatcctacgcaattaaaaatggagtaagttaaaaatgtcaaaaattgagaaaaaagccaccttcgcaatgtttgccgtgcttcggaaaggtcacgagtcaccatctgatagaaagattaaattacaatatgatttagggtgcttttccgtttgagggcgccgccacacatttaattttaaaaatgtcaacaacgaaatgatttgccgtgagaactgcaaaaatcgtcaaacagatccaattcgatgatattttagccaaaattgttgctttatgcctccaaaccgcacagattcaagaaattgaacagtgaaaaacaaaataattgcaaattgcctgctcattggctcgtcgaagcagccgatagatttccaagtccaagtcgacaagtcgttgcccaatctgagcactgttctgctccattcgttcaatgtcttccatcagttccatcatttcggctgccagtgaattgtcttccaccgtcccttcgaattcgtcggcaaaagcgcggctcgtcgaagcagtgccaggggacgtaccttttaaagtgaggataaaaataaacgacaaaattaggatgcacaatgttcacagccccccgtggattcaattagaaaatgcacacaaatttcaaaaaaaaaaaattcaatgactgctaatacccaaatttataaattaaaaaaccatttttagattaaatcaaataaaattttggggtatatattttgctctgattatgcgtggaaacaacgcaccatcgtcatttttaagcgtctcccagcaagtcagc

SEQ ID NO: 19220 - DNA, 1540 bp, Heterodera glycines
  misc_feature (1491)..(1491): n is a, c, g, or t
  misc_feature (1504)..(1504): n is a, c, g, or t
tagcatttttaattagactcccaggacttcaaaaagaaaaagagttagacatagtcaaagcccaagctgaagagcttgaattgcttcttaaaactcataaaggacaaattcccgacccaattctccaaacagttcatgccgtccagcaaaatccatggacgccaagctgtgagcgggaccaacgacagaacaacaattcaaatgatacgggaccatcaaattcttaccgcaacttttcaaacagcccacatcgtggaagatatggacaaggacgtggtggcggcattttcaaccaaagacaaagaggccgaggaaattggagaggaccaaacaacatggctgaccgcagctggaatcaacgaccgtactgtactttttgtaagagaacaggtcacatggcatataattgctttcagagaaaaaaccaattttccccaaattcaggacccaatctaaatgccattcatgactcttccgaatttcaccaagatgccaatcgtcagacatcaaatgtcacattggacatcaatgaattgctcagagcattcagtgttatgaacacccaaggcccgtcttcaagaggtggaaatgaatctgcgtcaatgaatgtcattagcacgatgcctgctgatcatccaagaattgccgaagacgcttaccaaggaacaggtggaactcagggtaatccatcggaatcgaatgaccaacataaaatctcacaatgggaagggatcggaccaaaattatccaaatattttatgattctaacagcattcatgttacttattaccggtcttattaacaccactaccgctaatgctccaaagcaccccatggtatgtcaaatggtaaaagacggaatactttggaaaattcctaatttgtcaagctgcccaaagttctcattggattacatagaaaatccgaaaattaaatcacttcgattgtacactccaaatgttttcgaacatcaaaccccggcttggtcatgcagaaaaataagaaaatcaatcaggaaatatacaagtcttacaaatgttcccatttcagaaatgcttgaaccaattccgcttgaaattagttcagatgaatgctggcaaatgattcgccatcgtaagtgtaaattggggggtactgattgaagactcgagcttatggcacactgatttaaaaattgacaattcaccccgccattggttaattggcccatggaattgggaaactttttttattgatatttggttgctaaaaaattggccccgggaataattaaaatttggccatgcgtgcctttggagccgaatcagtactcgttttatcctctcgaggaatcaaatcctgtgataaatgaatgttttgaatttcttccaatcaaaatcgagatgagaggaatccaccaaatggcatttgtcgacccagcaacaatgatcataaatccatcatcaaaaaaggcaccgtgctcaagcaatcagaaacaaatgattgtaattngatatgagctttnggaaatttgatcaaggtcagcttcagtttccagaat

SEQ ID NO: 19221 - DNA, 1109 bp, Heterodera glycines
gagtcacaagttacctttagaattcattctcagaacaaaggaacttcaattgttcacgatgaacaatggactaaaacaggcaaggaaatcaaatatttccttattggtgactgggacgggattttctggaaaattttaataattttcgtttttatcaacacagctgtacttcttcgtttaatttcattttaagaaatcagtacataaatttgggacgtataacacagagaagcggaacaataacacacacattgatgataggcctgggtcatcccaatcattcgaacgatccggttttgtaaatgagagaccagaatacaccccgatcaggccattatcagaaattgagaaagcacccctaaggaacaaaacccgaagagtttcatttaaattaagaagaaaaaccgaaacggcaacaaatcgaacaatcattggtaatgtaaatgctttaactcagataggagctaattctgaattgctgtcaatatgtcattaactaacacagctgtaatttcaaccataattaattcacaaattgtcagatgtcttgtggacaccggttcaagtgtcacggtggcgtcaagggcactgattgacatcttgggctgcaaaacggtaccatcacatgaggacgcaatcagcgcaagtggtcacataatttcatttcgtgaaaaagcaaaggtaatgctaaaagtggcagacatttgtgtcccgattactatttattttgtaaatgaacaaaaatccgtctgcaaccgagattatcaattaattctcggatgtgactcactccgacattttggcccttttaccgtaaatatagacaaaaacaaaattcaaattggaacacaatggataagcttaggctccaaaaattatgaattaatgaacaatattcgagcttttgctgccgaaaattacacaattccaccttcaagccaagtaatgatcagagcaaacattaaaactgcctcacagccaaaacacagcttagttgtggataaacctgattaataaacaatgaccttgggattgtaccaagtgtgtcggctccatttgtggaggatatcccgttgacaataattaatccatcaaatatcccaagattt

SEQ ID NO: 19222 - DNA, 2173 bp, Heterodera glycines
  misc_feature (18)..(18): n is a, c, g, or t
  misc_feature (28)..(28): n is a, c, g, or t
  misc_feature (39)..(39): n is a, c, g, or t
  misc_feature (198)..(198): n is a, c, g, or t
ttttcgtcaaaatcattnaatttattgnaatgtatcatntaatgtaagtagcacagttaatccgaggctagacaatgagtgtttttaataaagaagttctaggaaatcacacattttgatacctattgaattcaacaaactaatgacattttttcatctatttgttaaagaaagtaatatttaattatgttttaaatntaataaaattctagccaccatgatatatgaacatattgaaaaaagtcaatttattacgtacaccgcctaacaatttttttttattaattagttttatggccgcacaaatttaatttcttcgaaaagacaccaatttattaatgttaaatgtttgaaagaaatattgtttatttaattgatctttaaataaatacggtaaatcattttctttgttattatgataaacatgaatttgattaaataaaatatcataaaaccaaattataagagtaagaaagttcatattgttaaaaaattaatcttgtttgaccaaccaacataaaaataaaatttaattagttgagattttgggtataaaaaagatgggaaattcatttaaaatttaatttgactgctctatcctaaagcattaatttttaaaaacttttttaagaaaataacgaatgaaatttgatgcgattttatcccatattaaaacaaaaatcgcaaaaaattaattgatcccaagtgattttttctcacaaatgattataagcaattaggaattttcttttttaattttcgcttaatttatatttttttcaatttcaaaaattttcaagcatggaagtgttcttctttgaaccggtcgaatatgagcgcttgtacaactgcagctcctacaacattgaccaaatcccattggaaaaacgccaaaatttggtgatcggcgcaatatttatgcctatttcaataattttggaggtaatatacacaaaaaaaaatatgcaaaataattaaattatttttaaaagatactgtatgtaccgtgtatgatcgccatacggaagcacatggacaacacatgttacatggtgattagtcgggatatatttaaagaaaaaatacgaaaaaatagatatgaaaaattggttaaaaatgaaattataaaatcttttaaatttttggcaaattcaaaaattaaattttagaggagaaattttaattatttaaattttaataaaaaaaattgttgtttattttaattcaaaatgttcagctgatgttttacatttccataacggacatgatgtgtttgttgatgtgcggcattgtgacaggatatttggccattgttggcgccgtgttttgctcggcaccaagcttcatctacattttcggggcttatgggtttggtgagcacacaactaaatgcaataattatcaaatttttgagttatgctttttcaaaattagattttttcataaaattgcaaattttttaatttgtagctttatgggccaccgaaacaactgctgaaatgtttttggcgatcaatcgctgcgttgaattatgctcaacttggcttgcggagctgttgttctatgggaaaagaatttacctgtggatggtgagtaaattattgaattggaaaaaataaaaaattttctttaaaaattaatatttttttttattacatttttaattactaaatagtaaattaaacaaatgagaccaaattcatacaaaattgcttaggatgaactggaaaaattctttatttaaaataccaaaagagtttttactaaaataggctgcatgaaattatttcaaaatattgagaaaggccaaaatcgtttaatcaaattgttaataataaaaattaaattaaaaaatgtaaccaaattcttagaaaattacttaaggtgttcccaactgtgtacgggttgtacgccttcatcttcactgaaccaattctgttcagcggtttgcacatcacctggtttttgaacccgcacattggttatctcaatgatggaacaattgtaaaaaaaattttattatttttaatttaaaataaaaaatgttttcttaattttatttagattaactaactatatttatgaataattttcggataattttgtttacagaaatggaaatttgaactcagaaagtacagtagaacaaaagaaatattttttagtaccgtaa

SEQ ID NO: 19223 - DNA, 1018 bp, Heterodera glycines
  misc_feature (937)..(937): n is a, c, g, or t
atgaaacttttttctttatttttctttatttatatgaaaaagccattggccacattctgtaaggaccaattggggttgatgccactgaaactatgtcggcacttttaaaggcttattgaagcattcaacaatttctataggaaaaagtttttctattctattagaaaaatgccctcctaaagtcgaaaaagttgaatatttggcttttggaccaattatatgtaaaatggacgaatattttttaaaacattttgatcaaaattgaggccaaattttctgtttttgttaacccataacactgctagattcaaagtctcaatcgcaaaaacaatgaacaatgaaggcctaagcttctccctgttaaaaaatggggacaaatttttagcatttaccattaaaataaaaatgatcggaaatgaaacttttttctttatttatatgaaaaagccattggccacattctgtaaggaccaattggggttgatgccactgaaactatgtcggcacttttaaaggcttattgaaacattcaacaatttctataggaaaaagtttttctattctattagaaaaatgccatcctaaagtcgaaaaaagttgaatatttggcttttggaccaattatatgtaaaatggccgaatatttttaaaaacattttgaacaaaattgaggccaaattttctgtttttgttaacccataacactgctagattcaaagtctcaatcgcaaaaacaatgaacaatgaaggcctaagcttctccctgttaaaaaatggggacaaatttttagcatttaccattaaaataaaaataatcggaaatgaaacttttttctttatttatatgaaaaagccattggccacattctgtaaggaccaatgggggttgatgccactgaaactatgtcggcacttttaaaggcttattgaaacattncacaatttctataagaaagagtttttctattctattagaaaatgccctcctaaagtcgaaaaaaagtgaatatttggcttt

SEQ ID NO: 19224 - DNA, 1018 bp, Heterodera glycines
cccgaaaatttttaatatgttaggcccctttctaaaacttcatttttaaggaaatttggttttttggcaattggaccatcttttcatgcattgaattgtgaattgcatgtctcatttcccccgcttttcagttgttccattgcgcttgtgccactttgtttgcgttgttggcactgccacgcgttcgggcgagtgcgcgtgagcgtggcgaagcggagcgcgtgctgaacgaatgtgtgaggcggaccaacgcggccggaagcactaacaacgcgatgcaactgacggagcaacaacgacagcaattgacagcactgttacacatgctcaaaacaggtcggttaagaacgtaagaattgaaaatttaacataattaagattaatattttgagaatatgtgcattagctaacttacagtgcgattaaataagtacggtaggtagcttacttatattgctctcctcgcattctcaccttttttgaacattaaactttttccctggtggcacttatcgtcaattgtgactaaaatttgttaaaatatccagataaatttcaaaattttttttttcatttttaagtccctgaaatcccgattctaacaaaaaaaattctcgtcctctttattgtatttttttgtctcaatataacttgagtagctggggaagggaccaaccggataaataagcattgataagaatagtgatttgatttcaggtggagagcatgctgaagtgacggctggcaacaaaaaaagaatccatccgacagaagatttttgtgaaaagtcggaagaggaggaacagtcagtcagttttttgatcaattagctcagattgatttctgatcacattctgcttctttgaagttccccgactatttggaagcggaaattgacagcaccgatccgttggtgccatcgctaaacgaactgtttggagatgagcttctcgtccgtcgctttctgctacaaaataatggtgatgcttctcatcctcggaagccgccccaatgttat

SEQ ID NO: 19225 - DNA, 1415 bp, Heterodera glycines
agatccccggtgttgtgccagtgccacgtgctcatcacaaaacggctgttgttgccgccgaaaagttggccactgagacgcggcaacggaaggcgaggacaacacaaacacaaatttgtccgctcgaagaacatgaaaaattgacaatggcaaagacaaacggggacaaggaaattgcggcggaatgccatccatcgttggcacggatttcaatgcatcatgaacgctcaaattcggtaaaatgacgagaatggcatcatttttgcatggaaaataattaacggtctaaaaagaatgttattttcgaaatgaaaattattttgaaaattatttttaacaatttcagttactaaatttaaattaacgtcatatacaaatatgttcattctcctttccccagcagatgagttcccattccacttttgttgtggaaaataacgcacgtcgtccgttgctcgctgccagtgggttttcatcgtgtaagtatgaaaagcatggatttgaattatgtcgaatgagaacgaaggagagtgagggggtcgaccccattcctcactttcacgtatggtcaagaattaaagttcgatttcttttaaacaaacatataaataattttttgtttacaaattttaattttatgatttttgagcaacgatccattaccaaattaattcttgaatttgtctaaatatgtaattgggtgtgcttcattcatttagtagttgcactgatgagaaatgttggcggtggccgatggcaacgggcgcaacacaaacaaaagaaaatggcggacatggacaaggaggattttgtcaacttggaaattgagccaactgcagaaacgtaagcaaaagtgacgcaattatatatagagattatggaggaaaaccaaataataaatcattcatttcatgggcacgactctctcttttccattgagataactgacgatgaatttaaagaattttcaaattaatttagtccctcgggccgcgaattcacatataaaacttttttaaaaaatccattaacgaattctccgctaaaatattgttcacaatcagcaacaactattaattatccatacacatttgtaaggatgctgtttggagatgaatgttgcaccagcagtaccgatcagtgtaagcaaccggaagccaccgaagaaatatttgtgagcatggcgaaaacgacagcaacacaaccacaagcagggcgaggaggacagccgagaacgactgattcgacgacaaacgctccgaagatgttcagctctaaattgacaaaaaaggcggatcattacaaatggcctcggggacagacggacaatggttgcgatcagaggaagaagctgatcggaaaaagtagcataaagaatgggtggaagaatgtgaaagcagcaccagtgaggacag

SEQ ID NO: 19226 - DNA, 2939 bp, Heterodera glycines
aaatgaatgtttttggcttgtaggcgaaatgaatgtttttggctttagtagggcgaaatgaatgttttttggttagtaggcgaaatgtcagtaggtgaaatgtcggtaggcgagatgtcgagtaggcgaaatgtccgtacaccctccaattatgtccccctttctgaggatgttgaaaaataatcccccgtctctttttatccccccgggggataaatggaattattttttttttaatcttatttttaataaaaattaattttaattaattctaaattgaaattcatttaaatgtttaataaacatgaaaaaataatacagaaaaatcacttactttactcaaatccgaacctaacccaccccggtgctatgtcgttattagagctcggtattttgaaaaaagcctggacctggattccatgttcgacctggacctggatttcctggacaaaaatccaggaaaatccgattctgacatccattttgaagtgtatgatatttatttgccctaatttatttttctgcagtgttttataatgtttggttggatttttctcaattctatccgtgccagtaaccactgccataaaattcgattttttgttccaatcaagatttaggggtcgaattgcgtagaaatagttatcagaatctgattttccgaccctaaaaacccctaaatgagtctccgagaaaaaaaattttgaattttttttttcaaaaaagggagggggcatacaaaagaacccgacgacgacgattgctgctgattttcaacggcggacaaaagtttttgctttttctcggcaggcggtgccattaaaattgattacaactcaaaaaataaaaccaattaaaacaaattagtgagaaatataagagagttcgcggtaacggtaatactgccgatggccccccccgccctttgtaagaaatttttctgttttaaaaagtcgtaaaacaggtttatgggggttttcaggatcgctgatcatgaacctggcattcattttgttgatccattttgaatcctggacctgaattggtacaaaaagtcgaaaattccaattttcaatagtgacaaaccattgcaaaacaaaaatggccatttagtatagatatgaaaataagaattttgaaaatttggtatttccgggtttcaaaattgctgtccaccatcccagaaatgagctccaataccaaaaaagatttaaatacctgtctcagtggtctgtgagaaagtcaccaaaatgggggtcccaggttcgattcccggtgcatgctatagctgtattttgatgattttaatgaataaataaaaggaaaaatgaccaaaatgattttaaaattgtttcaaatttttaaaaattttatctaccgcttgtaatgaaaataaaaaccataaatcctcgatcagtcaacgacatcgacgtcagcttcttgatcactttcttcattcgttgtcttcctccgcttgctcccgtcgttcctcctcccgcttaattagttggataaatgttaaattcccttccgttaactcaccagcttcaattcgtcaaatctcccggtgtccagcagccaattcgggacgaaatgatgctccagctgttggcgcatttgtacaccgtccggcatcgtcttccaaagttgctcaagtcgccaccacacggaatgcagtgcctcatctcctgaaaaatcacaacatttaaaattgagccctcaaaaatgatatggccccatcctgctcatccaaaagccccaaaaatcggtgttggcgcgcaaatggaacaaagtggtgaagcagcaaatgggcctttgtcttttttgaaagaagtgtttgcaccattggttgttgatcgagaaatgccttgaactggtcgactgccgtctccaatccgtccaaatcacctggagacaatcgccgattggtgtgacagatgtcgatggcagcgaaaagccaaattccaaaatttcctcgtccatttctggcgttggcactggtcctggagttggtggcggaggctccatcgcttcttcggcggatgcagcagaatttgacggccctgcttcgtcctgttgtggcatttgttcgtcgaaggtggagcgtctgaaattaaaaaaagatgtttgagttaaaaatcacttaactcacttttcttggccaggcgagcttgtatcgccttggccgtctgcgcttttctctcctcttgcttttgccaccgctgtttcaccgcctctctttttatatttcgctttaatttggccattgaatcacaaaataattttttattacaaatcttaacatatctcatgaaaaagtgtataaaatataaaatggctgtattacactatgtagattttttttctctatcgatattcaaaatttggggtggatttaacatgcagaaaaaaagttaaacatcactaagtgaatgttgtttttcgtaataattagggctgggatttttatgttttaacatattttttttgcggcttaattatggcgagagaagcccaaaaatagcattttctccgaacaattttcgatttagagcgacttataaaaacataaaaacacatattttggcgttttcgcacataaaaacatatcgcacatatttcggggtttggcacatattttgcacatattttggcatttttgaaaaaaatatctaagaaaaacacaaaaaattcaaaaatgcacccctaaaaatcaactttcgtgccatttttataggctctcaaaattttctttatttatttcgtgtatcgaaaatcgaattcttcattaattcgttactggatatcgaagcttcttgatggcacttactcaactgatggaaaaattatctttaaaaagaatttaccaaaaaggactaattttacccccaacctggtggggaatgttttttatttgcaattgtgcgggcaaaaatgat

SEQ ID NO: 19227 - DNA, 1007 bp, Heterodera glycines
  misc_feature (885)..(885): n is a, c, g, or t
atgaatttcaaatttgaattaataatttttattaaaattttaaagaaattattttttcaaaaagttccatttatccctccggtgggataaatgaagacggggggattaatggagacggagcgataattagagataatacggtaaccaacttttcaagaagacttcgactagagatttattaataaacaaatttatattatttgaaaatttataaaatgaaattttaattgaataattaaaatataattcaaaaaatatttcctaattatttttgtattatgatagaaataaaaatataattagcaatttttcctaatatactcttacaaaaaattaaactacctttttcgaatcacttagcaatccaaattatcaaaatatattattttgctagccgaaatattattattaaaataagtcattaaaaaacaaatttaaaaaattaaaaattatttttattaagaaaaatgaattcagaataaaattaaagtaaataattaatttaaattcttttatttaaattctttattattttttcaaaaagtactttcagaatattttaaatttaattgccaaaaagacaagataataaatataatctaaataaaaaattgacaaaattagaaattctaataaaagatgaaaaaataaataaaaattatcatagaaaataaattaaaattaattaaaaatgataagtattaatattttatgtaatttttatttgcaaattaaattcaaaaaatttttattttttctaaaaaattgccagaaatcgcattttacaaattctgttaacaattattatgtaaatttttattcgttcagtcgacaaaaaaatcttaaaaaccaataaatttttatagtttataaatggaggattanaaatcttttgtgtcacacacataaaataaataaataattaaatcacaccaatataaatgtccgtttcgctccccgctggtccgtagctgactcccgcttcgacgagagcacatgggcaacga

SEQ ID NO: 19228 - DNA, 1820 bp, Heterodera glycines
  misc_feature (1190)..(1193): n is a, c, g, or t
  misc_feature (1195)..(1195): n is a, c, g, or t
  misc_feature (1198)..(1198): n is a, c, g, or t
  misc_feature (1206)..(1206): n is a, c, g, or t
  misc_feature (1209)..(1209): n is a, c, g, or t
  misc_feature (1224)..(1225): n is a, c, g, or t
  misc_feature (1236)..(1237): n is a, c, g, or t
  misc_feature (1245)..(1245): n is a, c, g, or t
  misc_feature (1250)..(1252): n is a, c, g, or t
  misc_feature (1260)..(1260): n is a, c, g, or t
  misc_feature (1265)..(1265): n is a, c, g, or t
  misc_feature (1269)..(1271): n is a, c, g, or t
  misc_feature (1274)..(1274): n is a, c, g, or t
  misc_feature (1277)..(1277): n is a, c, g, or t
  misc_feature (1281)..(1281): n is a, c, g, or t
  misc_feature (1292)..(1293): n is a, c, g, or t
  misc_feature (1297)..(1297): n is a, c, g, or t
  misc_feature (1304)..(1304): n is a, c, g, or t
  misc_feature (1307)..(1308): n is a, c, g, or t
  misc_feature (1311)..(1312): n is a, c, g, or t
  misc_feature (1318)..(1318): n is a, c, g, or t
  misc_feature (1325)..(1327): n is a, c, g, or t
  misc_feature (1335)..(1335): n is a, c, g, or t
  misc_feature (1339)..(1344): n is a, c, g, or t
  misc_feature (1348)..(1348): n is a, c, g, or t
  misc_feature (1350)..(1351): n is a, c, g, or t
  misc_feature (1353)..(1355): n is a, c, g, or t
  misc_feature (1357)..(1357): n is a, c, g, or t
  misc_feature (1360)..(1360): n is a, c, g, or t
  misc_feature (1362)..(1362): n is a, c, g, or t
  misc_feature (1364)..(1364): n is a, c, g, or t
  misc_feature (1366)..(1366): n is a, c, g, or t
  misc_feature (1369)..(1370): n is a, c, g, or t
  misc_feature (1373)..(1374): n is a, c, g, or t
  misc_feature (1381)..(1381): n is a, c, g, or t
  misc_feature (1385)..(1385): n is a, c, g, or t
  misc_feature (1387)..(1387): n is a, c, g, or t
  misc_feature (1389)..(1394): n is a, c, g, or t
  misc_feature (1398)..(1398): n is a, c, g, or t
  misc_feature (1408)..(1409): n is a, c, g, or t
  misc_feature (1412)..(1413): n is a, c, g, or t
  misc_feature (1417)..(1420): n is a, c, g, or t
  misc_feature (1424)..(1425): n is a, c, g, or t
  misc_feature (1428)..(1428): n is a, c, g, or t
  misc_feature (1443)..(1443): n is a, c, g, or t
  misc_feature (1445)..(1445): n is a, c, g, or t
  misc_feature (1447)..(1448): n is a, c, g, or t
  misc_feature (1451)..(1451): n is a, c, g, or t
  misc_feature (1466)..(1471): n is a, c, g, or t
  misc_feature (1475)..(1475): n is a, c, g, or t
  misc_feature (1485)..(1487): n is a, c, g, or t
  misc_feature (1490)..(1492): n is a, c, g, or t
  misc_feature (1494)..(1494): n is a, c, g, or t
  misc_feature (1506)..(1506): n is a, c, g, or t
  misc_feature (1509)..(1509): n is a, c, g, or t
  misc_feature (1512)..(1512): n is a, c, g, or t
  misc_feature (1520)..(1522): n is a, c, g, or t
  misc_feature (1525)..(1525): n is a, c, g, or t
  misc_feature (1527)..(1527): n is a, c, g, or t
  misc_feature (1531)..(1531): n is a, c, g, or t
  misc_feature (1534)..(1535): n is a, c, g, or t
  misc_feature (1537)..(1537): n is a, c, g, or t
  misc_feature (1539)..(1539): n is a, c, g, or t
  misc_feature (1552)..(1552): n is a, c, g, or t
  misc_feature (1554)..(1554): n is a, c, g, or t
  misc_feature (1559)..(1559): n is a, c, g, or t
  misc_feature (1562)..(1563): n is a, c, g, or t
  misc_feature (1565)..(1567): n is a, c, g, or t
  misc_feature (1575)..(1579): n is a, c, g, or t
  misc_feature (1581)..(1581): n is a, c, g, or t
  misc_feature (1595)..(1598): n is a, c, g, or t
  misc_feature (1606)..(1606): n is a, c, g, or t
  misc_feature (1614)..(1615): n is a, c, g, or t
  misc_feature (1623)..(1623): n is a, c, g, or t
  misc_feature (1628)..(1628): n is a, c, g, or t
  misc_feature (1630)..(1630): n is a, c, g, or t
  misc_feature (1632)..(1634): n is a, c, g, or t
  misc_feature (1638)..(1638): n is a, c, g, or t
  misc_feature (1640)..(1640): n is a, c, g, or t
  misc_feature (1658)..(1659): n is a, c, g, or t
  misc_feature (1661)..(1662): n is a, c, g, or t
  misc_feature (1669)..(1669): n is a, c, g, or t
  misc_feature (1677)..(1677): n is a, c, g, or t
  misc_feature (1691)..(1691): n is a, c, g, or t
  misc_feature (1696)..(1696): n is a, c, g, or t
  misc_feature (1698)..(1698): n is a, c, g, or t
  misc_feature (1716)..(1718): n is a, c, g, or t
  misc_feature (1724)..(1724): n is a, c, g, or t
  misc_feature (1726)..(1727): n is a, c, g, or t
  misc_feature (1729)..(1731): n is a, c, g, or t
  misc_feature (1733)..(1733): n is a, c, g, or t
  misc_feature (1747)..(1750): n is a, c, g, or t
  misc_feature (1752)..(1752): n is a, c, g, or t
  misc_feature (1754)..(1754): n is a, c, g, or t
  misc_feature (1760)..(1764): n is a, c, g, or t
  misc_feature (1767)..(1768): n is a, c, g, or t
gttgaaaaatagaaggcccctctctggtagaaggcccccctctaattaaaggcccctttttggaggggttgaacaatagaaggcccgggccttcaaatagcggatttacggtaatatgaattcttcaaaaatttttcctatatttctaattgagttattcatgcacaaatgttttggggcattacttttgtccacctatgaaatgagtgagtgcattgctttcataatttttatttcttgaacgagtgcttagttcccttgcctttttgcagtttcgtttagcttacacactaggctacaaacgtcaaaatcccaattgatattgttttcatgaattttttttcatttttcttaaatattaatttttgagattttgagccagaattttattaaaaaaataagttcttatgcttctttataaggagaggatttcacgggcaaacccaaaattatatttcaacaaaaaggacaattttgtgaatttttatgttaaaataataaaataaggttatatttaaaaagtattcactccaaacatctaaaactgatattttaaaagctataattatttttaaagacattttacacgtaaaaaattactatttttaaaataaataaatacagtataagatcacttaattttcaattttatattgaggaagagctttttaaaaaaaaataaaaatagataaaagaataataattttcaaattattgaaaaaatataacttctttatacattaaaaataaaataattaataatcttaagcttaattgctgcattcaaaaaacttataaaggtctttattgaaaatttgacttaattaatttgatattgaataaagatgaatattatcagttaggagagattaattgaaattaaaataaataataaaaaccatgtctaaataagtcacttaaaaagtttaaaataaaactggaaatttttctaattaaaccgctgaacatataaaaacaaacgaaaaaattaaacaggtttttaagaaaaaataattaatcaattatttttataacatgcataaaaatataatagagatcgggcccggtaccggtttttaccgggcccggaaaccggtcgttttgaaaatgcaaaaccggtccggaaaccggcatttttgaccggtttatgatatagtcagaaattcttcattttgtacatttatctttgnnnntntcnctttggcnttntgtttttttttttgnnttttcggttgnnttttttgnttccnnngtttgctnctttntcgnnnttnttngttntgtcttttttnntttnggctttntgnngtnnttcttnttttgcnnnttgggctntttnnnnnncgtncnngnnngnctntntncngtnngtnnttctgtnttcngncnnnnnnttgngtgtgggtgnntcnnctcnnnntttnnttnttttttttttgtggncntnncgncggttccggttttgnnnnnngtcntcggtttttnnnttnnncntcgcttccgttntcnctngggttgtnnnttntntggnttnncntnttttttctgcgcntntgctntgnngnnnggggcttnnnnntngcctttctgcgttnnnnttttttgntttggtgnnggtttttngtccntntnnntccntnttttgggggttttggggnntnngtcggtntttcgccntttttgggtttttngtccntnttttggcccttttttggnnnttttcncnngnnncntgttaaaagggggnnnntncncccctnnnnntcnnttttttgccttaaggggaaattacaccccacaaaacacgaaaaattgagttt

SEQ ID NO: 19229 - DNA, 2464 bp, Heterodera glycines
tggtttaattgggagagagtcgttgagcccggtggagaaatcagcgcacagacgagcagttccgttcgctttcttgaccaccaaaattggggctgaccagtcagtgtgctcgactggtgtgatgacgttcattttctccaaccgatccaattctgcattgattattggcagcgttgaatatggcactggacgggcgcgcttgaacgttggatttgcgccttctttgagcatcagattggctttcattttggaacagaagccaaggccatctgagaatatttgctcatatttttgcggcaatatttcgacgaattgttggattttggccgcatcatttgacgatatttgattgatttgggcgggactgatcattcgccgtatttcttccagaaatccaaacgcttccattgccggtgtgcccaaaagattcaatgatcccgatttggcaacataaaacggctgaattgtctgaattccgtgaattgggaaggtggcagtcccgcgtccgatgaatttgcaccgctttccgtcgaaaaagcgtgcttcctctgaacatatgtgaattggcggtcggcccattgcgttgtaatcatcttcattgatgatgatgatttccgcacagctgtccagggtgaaaccaattgctgtgccgttcacattgatcggtgctttaagcagattcgatgaatggacggaattgatgtaggccgctgggagtatcaccgtatttgttttgaaatttgtgcccttattttggtgaaatgctcggattttgtcgcattgccgatcgatgtggcctctgcgattacatttgcgacaaaaattttccttctttgagcagtcctgggcccaatgcaattctccgcaacgatagcagttgctcggcggtattttggcctttgatttgcccgtgaatttttgatttgggcgaccgtttccgcgattttggtgcttatttggcgatgatttgccatgctgaattgcgttgattttgggctttggctgctccaaaatttttgcttccgcctccgtttttagctgtgtatttaagtcctcgacgactttgtcgaataatttggacgtttttgtcgtctttgtgccctctgctgtgagacgcgcgaggatatgttggcgtaattttgcgtcgcttggtgacttaagcgacgtaagaagaaccaggcatttgaattcctcttcgtttaattccgaaaaacggaatttgcggagggctgccttaagtcggttcacaaaaatttcgaattgttcgccgtcctctctgcacactcgcaggcattcgtagcgatcgattgctaacgaaggaggatgagaaaataatttgatgagacgaagtttggtgtccgcaaagtcaaatttggtgatttcctccggcaggcagtagcgcttgtattcgccgaaggcggacgggttgagcttagtcatcagcaatttgactttggcttcgtccgccatatttgccaccgcgcaatccaatgcaaattggaagcgctccaaccactcttcaaattcttcggcattttctgttgaaaatgggtgaatgtccggcaaagtgatgttttgtgccggctgagttgcggtggatgtcggtgcgctctgctgcttgatcgcttgcgtcaatttttccaaaatatcggcgagcgttttgtccattgatgatttggaggaaggaatttgacgaagaaactgcacatagcagaaccgcacacaagattagtgattgcttttttgaagatttctgcgaaatccaaaaatttcacgagatttttgaatttccacaattcgaacaatttcaacacgaaaatgttcgaagtgaagtcctgaagaacgggcgtcgccaatgttgagccggttaattgctcaaacaattatttgtggaagtcgaacaccaaataaatttattaacacaaatggaaaataaataaacaaataaatatttgtcggagggacggagcaaattgggggagcacaaaataggaagaaaaacaacccaatgaatgaggatggacgaagggaagggcatgaataaatggggaaaatcaatatggggtcaaagagcccaagagagggaatcgcaaatatttgaattatttgcctctctaacagttatgaacagattggccgttgcccgttggtatctcctccggcttttgttgtgtgtgccaacaacaataacaaccaacgtccgcaacaacaacaacggcacaaagaagcaccaccaaaatacaaagctattgccaatgagcaaactggcagcagaagttcatcaggtaggcacaaaaaaaatgccaaaaaagagaattttttcggaattttggcaattttgtaggactggtggaagaaaaccaaaaatttaatttaatttgtttcagaagaagacatttctcctccaagctatgatgaacgaatccaagacaatgggtcttaaaatgaaaaacaaataccaaac

SEQ ID NO: 19230 - DNA, 2725 bp, Heterodera glycines
  misc_feature (1534)..(1534): n is a, c, g, or t
acttactggaaaagtctgtatgtcggaattatgactttttttgtggcggaaggcatacaaaaaaggacgagagagtgcacgtgtaaaatggaaaagaagcgagagcattagagaaatagtgtgagaaaaaggaggtggaaatttttctgttctgtccccaaatgctccccattcctttgtcctcttaaaattttgttcgatttataaatacttttttcactgccttgtcaatgcgatggctctccggcgctgtttcccggtgattttgaagtttggttttaaaccattaagatgaacgcagcgtatcggccagggccgacactgtcgttctcgccgtacccggttgaattcggctggagtcggattgagctttaactatcgcttactttttttgttttttttttcaaacggcacggaacagacgataaaaaattgtttgtaaaaataatttagaaatttttttttaattaattttattttaactaacgatatacaaggaaatctgcattgcttcacttgattataattagttgaactgatccaacaatttaattttaatccctttatttattgtgctgatttttggggcaatgtgccaaagaaaacccatttttcagtcgccttttttggcaattccctatattaaaaattttttctcattgtgaagagctccactcaaaaatggcaatacaattaaatatatatatccgaaaaactcttatttttcgttatttcattacaattgtaaaatgtaagcggaaaatgtgtttttctgacggtttacctcagttgggcgctggcacgtttgggcgccagcatgtttttggactataacttttttctttgtcaaccaaatctaacaatctttttatcaatcaaaagcccttcacatgctctattagcctgcaaaattctaaaaatttcgtcaagtttaaaaaaaagtacaagccaaaaaagttggaaaatctgatttctgaattcttctggccataacttttttgaaccttgatgaaattttttcacaattttgcaggctaatagtgtatacttagggttttcgaatgataccaagattgttggatttcgttgacaaagaaaaaagttataaccagaaatgtgttggcgcccaaatgtgccggcgaccaactgagcgagtccgttttctgataattaagttacaattgtaatcatggttgaaaattgaatctttctaatgctttaatgagatttaaattcatatgatgccaatgctgatgttgggttgtattcagtgattcgaacaccgaataactgagtcccaatgattgaaatgccgagtaattgctgagattgacaacggtgattggagtgccaatgaattgagtcagaataattgaaatgcgaagaatagctgagattgagttgagattatgaaaatgttacagaactgagtccttcaaattcggtaaaaggcttcattatctttctttagttttttgttggctttataaattctgtatttaaaaataatttattaaattattattttctcatntattcaaaatattctatgaaaaaaatgatgcaatttaaaacgaattaacaaataaacataaaacaacattccgctgagtcattttgtttttgctattagaaaagaacaaatttatttattcacattgactcacactgcttccaaatgggtgaagcaaattcgtatttttatattagcttaattctatgcaatggaaattcatttaatttgctttacaattacaattctatgtacaaattaatatttaacaaatctaaaaatatattaagtgggcacccaaaaaggataaaaaaaaacgcataatagcaattaaataggcacaaaaataggaaaatttttttattaattcttttgcggtagcaaaagaattaataaaaaaaacattatttgttatatttcaattgtaaatgaaattattaaatattttaaaatttttttaaaataaggacaatttttagaccaaaaattttatcatgaaaaataaattatatttagggaattgatttttgcaaatttttttaatcctaggggtatatatttttaaattttttcgggttatttctgtcactttttaggagtgcatttttcgtttttattaaggatttttcaaaaatcctggaaaattggcgccaaaaataaataggcgcataggcataaagcatcataaaaaccccgaaataggcaaaaatatgcatcataaattgatcatagaatcttgaaaccaagctaaaaaccgcatttgtgcatccctaattaagacaatatttttggatgatgagtggatatgaaagtgaaaaatcagagttatctgaatattttatggtaaggattttgtgaaaaggtgtttatttacaattagccacagattaccaaatggaacaacggactgctggagtcttgagcattgttctttactgtttcttgtttattgggatggaccaatgcttgggtaaattttttaaaaattattttaaataaaatttaaacaaatttttaagcatataaagaattgaaatgcaaagctggccgtgttcaggcacagacaaaccgtaaaacagcggaggaaattacgaccaaaaattgcatgtttgagcagtatttttgcctgatgatcacctgtgttgttggtaaattaatttgaagggtgaaagaaggtatatcccttggacattttcggcgatataaattaat

SEQ ID NO: 19231 - DNA, 1930 bp, Heterodera glycines
tatgtgagcatggcaataaacatttatatgtttatgtgaattcctctgaataatattttaaaattaaaatttaaaaaaatttcactgagtttaaaaaaagttaggacaaaaaaaatgttgactcaaaattttctttagctcaattttcaggacaaatatccttggaaaattttataaaatgcatgaggccgacctcaaaaatatttttaaattcataaacatttccatttttcatttcagaaaattttgatcttttgcattcattgtccgaaaattcgcccacagtttacgaagtgataaaaatggccaaaattcttggcaacattgaaaatgatggacaaattttggtcctccgttcggactcgcaaattttccattttattttgaagtatttggcaaattcaacggcagaagagagtgccaaccaaacaaaatttgtcattaaatacagcttttgttttttggcacaatttgttgaagaattattgaaaaaagcaatgaaagtgaatgaactgaaagaattgctaaacattgaattaattggggaggcaattgaaagttttgccgacaaaaaggagcaaaaatgtgccaacaaaaagtgagtgcaatttgacaaattggacaattaattaacctacgattttgcattaattattttcttaagcacgcaaaatgggattaacaaatatcttaatgaaagtatgatggattttgcccatttagcgcatgcaataaaaattgatttcactcataatggtaattgtttcttttattaagcattaaaatttcttaatatgccctatattaagcaaaaagtatcagcctaaaaatgctttcattcatttatgaaaatgtttaaattttgtcattagcgcggtgatttatatggaaatcattgtttttcccctgctggtctttgggatgccttaaatgcatgaaaagcatgcttataagcttcgtttgaagcttctaggatgtacttctatatccaaaaaattgggctttttgtcctcctaaaagtcatggaaattttccaaaaaaaacaaatcctttttataaaagtttcccgaaattatttgaatttattcttaaaattgataaaattatgtcataactaataaaaaaaggtggaaaatttcggttttaggtcattttttcgctaaaattggggaatgaattactcatgtattaataaaaatataatttaaaaattggtaaatgttataaattaaacaaaaatacctagttatttttggttttaatttatttaaaattttttattctaaatcacaccatattagccattttttgaaagtcttggtttgaaattttgccctcaatttggaaaagttatgtgcatatttttcagtttttggtgtttattttcgacatccctaattttgaattccgtttctgattattaatcagctatctcatttaaaatgtttttctaatttgaaaatttaccgaaaatgggggagggacaattcggacacataaaaaattctttattccatcagatttacaaaaaatcgttcccgatttattatttgaaatgggaaaaatgaaagaagagaaaaattggaattatgcagattaaatcaaaaggaaatgttggaatggaaactgatcgaaattgaactgatcaatgaagaaaaaatgggaaaatgggaagcaattgaaagtgcgagaaaggaatggaaagagaattttgatcgaacagtttttaatgaaaatggaagagaaaatggaaaaatagaagagaaaatggaacagctaatggaagagttgaagcatttacaaattgagaaaggaattggacaaaacaaaaataaaaacaagcaaaaggaggaggaaaaggagggaaaagagggcaaaaaagaaaaaggaaaaggcaaagttgaaaattgaaaggagcaaaacgactgaa

SEQ ID NO: 19232 - DNA, 2515 bp, Heterodera glycines
  misc_feature (10)..(10): n is a, c, g, or t
  misc_feature (29)..(29): n is a, c, g, or t
  misc_feature (272)..(272): n is a, c, g, or t
  misc_feature (2454)..(2454): n is a, c, g, or t
  misc_feature (2504)..(2505): n is a, c, g, or t
ttccttttcncctcccttttctggtcccncattatcccatcaatttccgttctgtgcatgcgatcagcgccaaacgggccaactgggcaatgtgaagccgctgctccttcgcattcacaagtgggtgaattgacgaatttggcccattttaatgcaaggtagagagtgtcggtgcacctaaaacgttgccgttgaaataaagtttttaagagaaagttctaaagttttctacaaaattcaacaaattaacctctatttgacaaaaatctatntaagcaaaatttttttaacaaaagaagaagtatagtatttccggtactagttgcgtttgtatccacatttttggtcaaatttttttttcaatttttttttcttttttattatcagaaatgatttaaataacaaataaaaggtgatttatgtgcttattgggtacaattccgcgatttgggtccacaaattataaaaaatttccggtcctccaaattgcttacgccacaaaaaatcagaaatgtatgtggaaaaaagtgatctgtgtgtgccaaatctcgtcttatgagcatgtttgaacttctgcaacgtcgattcaattgtatttgtatgttgaccagagacggggtccttgaaattctccgagtggttcaccacgtaatgtgtgtacagctccggcaatttgtcaatacccccgtacgaggcccaaccgtcgctcacaattgttgcacctgcgtgaatgtgttgctgaatcagtggtaacaaagtgtcgtcgtctcgtcgttccactgtcacaataaagcattttccactgccgcgttcaactccaccaaagtaccactattgttcgcccggcaattttccacggtgatatttgttaaaacggtctcgtcaaattaaagcaattctgataataaaaaacaaaaaaaataaaaaataatttgaccaaaaatgtggatacaaacgcaactagtaccgtatttccttaacaaattctttaaattctcgaacaaattcatgacggtgcctatcgacaacgggattcctcgcactccccctccgttgcataattgtaacccgatgaacctttttatataaatttattaatttaaagggaggtgaagccgttgaagctggcacagttcgaagacgattgtgaggattggagcgccggcggaagcagggggcgaaagaagaagaaggtcctgtgctgattgatttgtttccataatttcgtttttcggctcgatttcttttatcatactttatttatattaaaattttcacattttatttttgaaattcaaaattttttatttagatttctcggctaaaaagttgatcattaaattcgtcaaaaaagcaatataaatcccgttttaaatgaaaattattaacaagcacatattaaaataaattatgagattttcaacacataactgagttttataactagggctgcaaaaaatatggaaatccatatttttttcctggactgtgggaggcctgaaacgcacgaaaaaaacacatagtttgtagcttcatgatggatttatatatccatatttttcaatattttgcgatttctgtccatatttccatattttccatattttggcatttttccaaaaaatctatattagaacggcccccgtcacataaattgaggtattgaggttttcatctctcaaaatcgcaaaattttcgaaaagacaatttttatcaaaattttgtcgaaaatattgattaatttaaaattggttaaattatctcaaacataagcaaaaaactgaaaatttcgctttaagtttgatttttcgctaaattgagtaaattttaagttgtaatgtttttttcatctaaaatgatttttaatagcgagcatatttagcaattttttaaagttttacttttgtttagcggatttgatgaaattttgagaaattatacccccaaatttgaaaaatttatgtccatatttttgccattttatgtccatattttgcaatttttaattcatattttatggccatatttcgcgattttatatccatattttttgcagccctatttatcaccgccctttttttatgtgaagtcgataatacgccgtattcacaagtggttgaatacgaatttggcacattttatatacccctgtaccgcaaaacatagccaccgaaaaacagtcgagacataacacagccgggaataaattactaaaaaattttcaaaaaatcgattaaaattcagtagattttaagaaatttttctaagtttttttcttgaaaactttgtttgaaaatttttaaaaaaatttagtcccagctttgttatgtcttggctgtgttttggggtgtaccgacccctgtataggggagaggagggccggtgcactttaaaacgggtgcaccccaaaatttcgccgacgaaattacgccggacggaatttcgtcggccganatttcgccgggacatgggtaacaacaaaatagataatagaattttattannaatcaaatcc

SEQ ID NO: 19233 - DNA, 2213 bp, Heterodera glycines
  misc_feature (29)..(29): n is a, c, g, or t
  misc_feature (2196)..(2196): n is a, c, g, or t
tttgtataatgtattttttaattttatcntgaaaatattctcccatggatgtcttaaaatttccaaaattgacgactttacatttctctcgaaaaccaatgggcattaataatagcccataatgatgacatgtatacgtaattcgtccatatctctcttaattaggtccaatctttgctgcttttacccccctttttttctctatttatttttgaattgattaattaattgtgtatggatatcccaaaatgaatcgaccacctgctgctaagtgagctttctttatcatttctgttttttttaaattgcatatcaaaatgtgcataagtaaaattgtcaggttttaatgagtgtgactaattaattaattggttgtgtgcaaaatcgtagaattaattgtgatgttgtgacgcacattcattttgtttcatcaaatgcctgtgataataactttacatcaaaaatttaaaaaaataaaattgaccagaaaagcataattgtgttaattactcggcaaatgcgttttccattctgatggtaaaattcaataattaccgttacaccgatttaatggtaatatgtcagtgacaggactataaaatttcgtggatccaaattcctggcttaaaacaaaaatagggaatcccgactcctaaatgtcggttaaccgctgacattcctgctgctgatgctggtcctcgtccgatcacgcagccgctgatcggtgtcacccaacaatttggtgatctgctgatcacatttacccactccaaaaaactgaaaattcctttcggcaagaggtgggtacacccaccaaatgaattttttgggctttacatagcttctcattatgcttttgttcttgcctgcccacgaaaattggtgttgtttttccttgatttttttcggactaaatatttgtttcgtcatcaatcgcccaaacaaacattccccgcccccgataaatgatgatgatcaacaaaaattccattccattcattgacggcggtggacggactgacaatgatgagtgagatgacgtgtggtttgtgtgataagtgagtgtactttgctgctgcgagaggaaaggactctcgggactgtggggctttgcgagaagtttctcgagccgagaagcgagagcggcaattggcccatagaagcgaggccaagaattacatacccccagcaggggtcgagttcgagaattcacattgagagtcaagatcgagactctaacaaaaaaattttcgagatcgagaattgacttcgagagccgaagccgggacccccaaaaaacccaaacaaaacttcttgagtgagttaagaatgaaaccgagaaatgaacttggagaaacgagaccgtgaaatgcaccgaggtcgagaccgtgaaacaaaaaaaaagagaaaattctcgagtcagaaattcggaaatttgagaccagcaaggcaccgagagagtcgagaccgagaattgacttttagaaacgagaccgagaattgagtccaggggagtcgagactaagacctctccacctaaaaaaataaatcacactcagttgagggggtggggaaacgctgatcaaagtcacttccccacccacacctccgctcgccccgcctcagcatttatgtgtcatcaccatctccgaccacaatgggacaaagatcactttcaccccacccaaaaaattttgcggaggctcacatcagcagcagcagtttgccaaacaagcggctgatgcttgaaaatgcaatttgatgggccgcataaatttatttttaaaaaattcaagtgccagagattacagatattttggtcaaatataaagttttttcgaaaatttagaaaaatttatagtgctgactcaaaattgtggaaaaaataatcattttaaggggtgtgatttaattactaaggaggccccgataaagcacgagaaattgaaaaaatattatatatttatttatgaacgatgcgtggcgactccacatgattgacgtaaggaaaattttgcaaacaaaattatatagaaactaagattttttagtttttttcactcccttaaagcccaagaggacaagcgaaaatttccattttttgagcattttcggaggacaatttgaaaagccacaataatgttagaaaaattcccgataagtatttatataaaatattcattctatttttcacgngcggggtcttgattatg

SEQ ID NO: 19234 - DNA, 1617 bp, Heterodera glycines
  misc_feature (50)..(50): n is a, c, g, or t
  misc_feature (52)..(52): n is a, c, g, or t
  misc_feature (58)..(58): n is a, c, g, or t
  misc_feature (60)..(60): n is a, c, g, or t
  misc_feature (97)..(97): n is a, c, g, or t
ttttaaaatttttgctagttccctattcctaatgggaccccaacaaaaancngaaccngnccaccttttctttttcggggcgcaaaggccaaagggncgccacgggacgaaggccgctcggcggccgcagagcgcaagcggcagttcggccaatgacaggagaagaatcaaacaatgaatcaatcaatcagcctttgtttggtggaacaaattagagtttgccaatcacttttaatttccggtgggccaaccccttgacagattttgttttcaaaagtccccggaggaccaattcccgtttcccggtgaaacgatttttagtaccaaattttcccctaccgtaaccttcaaacaatgtcccggtgacaaatatttattacggtgcgaaaattcgaaattaataaataatttttaatcggagagagaagatgttcaacggattaaaaagttaagcgaatgagaacagatttttaatttttccatctttcccccttttttccgctcacggacattttccgctttttgttaaactgtgaaattccctatcgcttcttttcttcttgtctccaacgacttataaagtgatcgcaaaagcaaaggatgaaagatatggatgaataataaaatagagaaatgaaatgaaatttaaattaataaataattaaatgcaaatttgttcaaaaattattttctccgtctcttccgtttttggcatttaattctttcggcattctctggcatctcggcttcgtcggtcgtgggcgccgacaacgtttctaaacccgatcgaattttttaaacctttatatgaaaacatttattgcaggaaatgacaaattccaacctgggtgagcacacatttcagataagcttcctatcattatttcttagaaacaactaataatctgttgaacagttatttcaaataaattcgaatatattagcttattatgcatcttcagtgtgcattctaaaataaaatcattttttgttctaattttatgatttatttgttttctgttgactaaatagtcagttcttatagcaaatattaattttagcttcaaatgagcattctgccttcaatttcgaagggaagtgaatttttttataataaattgatagagagcaaaaagcacaatgtataatattcaaaaaatttatctatgcatttgttgaatgttcctaaacccgatcaaattttttaaacctttatatgaaaacatttattgcaggaaatgacaaattaacctgggtgagcacacatttcagataagcttcctatcattatttcttagaaacaactaataatctgttgaacagttatttcaaaataaattcaaatatattagcttattatgtatcttcagtgtgcattctaaaataaaatcattttttgttctaattttatgatttatttgttttctgttgactaaatagtcgattcttatagcaaatattaatttatatttgcgtagcttcaaatgagcattctgccttcaatttcgaagagaagtgaatttttttataataaattgatagagagcaaaaagcacgattgtataatattcaaaaatatatctatgcatttgttgaatgttcctaaacccgatcaaa

SEQ ID NO: 19235 - DNA, 2618 bp, Heterodera glycines
  misc_feature (2519)..(2519): n is a, c, g, or t
  misc_feature (2549)..(2549): n is a, c, g, or t
  misc_feature (2559)..(2559): n is a, c, g, or t
  misc_feature (2571)..(2571): n is a, c, g, or t
aggaagatacatacatatgtggtccaacggtgccgacgggcgccgctggggaaattttttaaaaactatgctaaatttgcttgcgaaggggtcccccattttggggcccattacgagcgagggatgggtgaaccggaaaaatcccgtcggtcccgatccagtgcaggcttatttttgtttaaactcccgtgatttattgctaacttggtagtctctcttttaaacaagcatcaataagtaaaatttatgcataacgggatacaaaagcaataactgaaatcaacaaagtgaaaaatcaagtcctcgaaattgttttcgccaatgaataccggggacccggaatgagacgttgcaaggacaaatactgctggtaggtgccgtaactcatgttgttgtcggcatgcacgttgttctggccgttgttctcccgtcttgaccttttccccgtctgagggtgaagcatgtggataatccccgcgtttgttcgcattttcaacgggtattttccggatgtgttgttgttggagatgttggtgctgtttgtgttgttgttgttctccaagtctcccccagcaaatttggtccctttgtgtcgcgtgccgtcccatggccggttaattcgtgcgcaagtttgcgaagcgtcctctttttcgtccaccttacgccaccgccgaactttcgaattttgcggagaaaactgctgattttgaccgtccatcaatgttggataagagatgcgcagaaacagatcagggttgagatcctagaaagatattttaaatgattttaaataatgatttttaaaaccggtgttttagatttcttgctgaaaaatgccaaggaagatgtaaaactaaaaaatacaagtttttagaaaaattttggagaactgattcggaggggggagcgctgcccctgggatacaacaaagaaaaccctccacacagcgcaaaattcgaaaaaagcattttcggcgctatacgtaaagtagtcacttttaaattttatcaaaaagtaaacacaaaagggggacccttcggaaaattcaaaatttttgcgccgcattttctattgagtttttggtattgtattggtaattccttcaactacccaataagcttaatttcatgaaaattaaaaattcgatttcggcaaatttcccaatttgtggaaaccataaactcacatcatcaatggaaacgggtacaacagttttagcttcgactgagttgttgtcgacgagtgctttcgatgtcgatggtttcggcatggaaaaggtgccacaatttgacagatagccatgcggatcagtcaaattgttgttctgctgaacgatggcccgagaagtactttttctgagtgggcctgcttcgtcggaatgctttcgcaactgctccaaaatgtccacaacggatttcggcaaaggcgggcaaaatgcgtccgaactcatgaaattatttcttcgtgcagtgtgcatttcttcgatgtttaaattgcgcgaagagtttgcgcactcgtcgaccaaattgaccatttcagcaacggccatttcaacgtctctttgctcatcgtccggcggggaagccaattgttccatccactgcaatagtatagtatattattattattcgtaccatacaaaatcgattgtgtcaaaaacaaatcggtttacgtagcattatgttaatctcgtttatgtactcttccgtgcttttatgcaataaaatttcatacggctaaatctgccaacctttttgtgccggaaagacgcagcagccattgcagtctgatccgccaattttctctccaaaatgcgatcccaattatgccgtttcaaaaggtattgtcgcatagccaaaatccgttttatcttctgagaatccctgttcgggttcaatttcgtaagatgcgctgaacaaaaaatggatttgtttttgtttttgagcgaagaatcacacattttcccctgagctccatgatttgatgcaatgtcctgcgatgtttttcctgataaatgatgcgcatttgttggatcgatgcgtcttgacgcctcaatgcactgacgtattgcttagcaatttcacgcttggtaaaaacattagcacggctgaaaaatctcattattgtattttaagcattaattcgggatttagggaatccgaaagaaaacataggaatacaatgaatctacttctgtggcaacaaataaaataagtattataattcacaaattccgtattaatttgtatcaaactgacccaaaagaaaaggaaaagccagtaaaatacctcaaagggttgtcattgtcatcgatgcgattgtcgcaatataaggactcgtaaacgaaagggaagtcggccgggtgtttcggcaaaagcgtctcatcgatgtcactgcgaattgcaattaaataccaattgggtaagtctcaaaaaatactctgtcaggtgaagattttgacaagagttgaaagaagagtcgaaacaatgtttggctcgcagtccctcttttctgatgcngtcgataaaacccccggtgctgaaaacatnaaataatggngagggaaatggngcacaaatggatttcaaatttttaaatataatattatcttatactga

SEQ ID NO: 19236 - DNA, 1874 bp, Heterodera glycines
taaataaaaaatttaataataaaatttgatattttttatcacccactgaagtaaaatccatttgtattagagcctaccttcatcgtaaaattaatatttttacaaaaattttaaacgtaatttactaagtttcaggaaaagatcgacttttgtaaaaaaaaaaaaaattattatcatgaaattttgcagtttaattatttttatccaacttttaattcattctaaagaaaatgatcgttttccttgtccgtcttttttcataaaattgggaagcatattaaatattgctgtgaggaatttttttttttaattttttgatgactcatttttttgcttaagagtggccagtctgatcggacagccccaaattgagaacgttttggcatttacgtcgagggtaattttgtttaaaaacaattttttttccaatatttgtgtttttcctcgacgtttttaggcacggagcggcgcctgtacgcaaccgacgccgaacccgctcagtgtgctcgagttcatccacaacggagtgcacgcctgggttggaggggacatggtgaatggactttttcaagaaaattatgggctattttgtgaaattcttactattattttaacaaattcaaataaattttcaaaaataaaattccggcaccgtcgaaaatccccgtttagtaatctttttaaaaaaatccaaaatgacaaaaaattcgtctttttcactgaaaaacggccggctaaatgatttttttactttttccgccggtgccgaaattttcgaacaaaacactggagaaaaagaaaagttttagcagcaaaaaaaatgtcttcggattccccatttcgaaattttttggcggggcatgcgacataacggaacaggacaaaacgtcgccggacaaaacgaaaaaaccaagaaaaaattgtcaaaaaatttagttacctagcctaatatgaaaaaaattctagaaaaattcaaaaaaaaatttttattaagaaaattcaaggaaataaaaaaattttcaagctttttgggtttatttccggaaattcagctaaatttagtttttattaacacttagattttcaaaaagctaaaatacttttcaattttcttaaaattttgaaaattcttttttgcggcgacgttatgtcccggcgacgttacggcggcgacattttgtcctgctcccggttgacgctcaccattttcggcctgctgttcgtcctgccgctgctgcacggagcagccgatgatgctggcactgtccatgaacatcagactgaacgccaagtggggactgaacgcgctgaacgaagtgccaagcaaagagacgaagcgtcgccggaactccacaaagaaggcggacagccaagtgccgtccgagttcagctgggtattcaaatatgaggctgcgtaatttaccaacacacatagatgagaaacatatgacaatgtgaaaaccactcgaaatttttaggaaatgcgcattctccattattataataaaattgatatgattttttattattattattagttagaaattaaatgaaaggctacttaagaattaagtgctttcattaaaagcaattaataaaacacccacataaattgggtagtaagtgcaggtacgagtccgctccatgccagcataacttatttatgtgcagtaaataattctagagaacataataaaatattatagaaccacatacaaggaatcatgcaaaaattcaaaaattgctagaaagaatgaaactttaaacacataagtaccaaatatgcaaaataaggaaattattacaaaaaatacctacatattatacataaatgcaaatataacacacgggcactgtctcaatactcagtaccc

SEQ ID NO: 19237 - DNA, 1649 bp, Heterodera glycines
aaaaacttttaggggatacctgagaaaatgccaaaaaatgtcgtgagggtgtggggtttcacttcttggcttttcattcgtttttatgggcttaaatttattatattattatttttgcgacagatttgggaacagtggcgactgctccaccaaaatcggcagcagcgcgagacgcaatttccgcccgactcgcaaattgtgccggtcagtcattgccaacaaaatgattaattaattgcattaattttgatcattttgtgtttgcagtgcgctggctcccagaattacctgctcagtgcgacaatgttcccttttcaagaccccgtcgtgctcaaccgaggcatgtccaataattgtattcaatttatcacaattttgtgtttaattctttttatgcctcagctcgcccccccaccgccgtttcaaattttttcatagaaaattcgaagaaaaaaaaatttcaaaatttttccagcgattttttcaaaggggtgcaccgttttctaaatgttgttacaaacaagattattattttttttgcaaatatttctcattttgcccatttcgtcagtctgtcaatcacttaatttgctttttgtcccctgttccagctgggttgagcaactcctacacggacagtctgtacacttacgcgccgaggcccacctgccgtgccgcaggcgactgtcgttcgcggtaggaaacattcattccggttgaactttacatttgcagcgccccctcccctccaatattcaaaaaatgtaattttttaacaagccaaacacgaaatccgccattttcaatcaaatggcatttacatgagacatgcgtgaactttttaaatgatcatccgaaaaagtgaattaatgaatgccattgatcggaaaataataatgaattgaatttgtattaaaatttaccagaaaactttttttttgaaaaaaccacgacaccctcttcaatttcactctcttcctcagttacttgttctgtgacacgaccagcggccgtccgttgtgcacttcccggattaaacccggcggcaattgtgcctcatttgtgcaaaacggtaataataataattaattgtggctattaattttagtaaatttcgcacttgcaatgcaaatccctccccacaatatctcttccaaactccgatttttgaacgtttttactattttgtttttaccttttcagggataaattcaaattaaaaatcctcaattttttccaaattctatgataaatgtgctttacattacacctgctttttctgcagctgaccagccctgtttcgcctccacttgtgtgaatgggttttgccaagcggcgggcggtgccgccgttgcagcgcaaccgcagcagcagcagcaaagggtgggcgattgattggataatggcattatttaattccttttaataataattattattattgtttttcttaatttctcagattgtccgctcgactgtttctgttccgaatgggacggcgccagcagcagcggcagtccctcggccttcccatgtaaggggaaacagcagctcgtttccccactatctcctccctcgaaattttataatattttaaacatataaaatatagaaaagaaattcaaacaaaaaaaaagatttttcagcga

SEQ ID NO: 19238 - DNA, 2274 bp, Heterodera glycines
ctctcaaagggtgggccaagaaaagcatcaaatttactttcttaaagtgaaaactgaacagtttgtccccgtcattagaaagagagtggcgagagagtaatccgcgacggttctgccgctgctccgttctcctcccagtgtgtggtccgactgagtaccgacgcacatcgactcgcctatgtgatgttctacggtaccaacccgtgggtgctgttcatccgtctgcatgcgatcatgtgcgatcgactagcaaagatcaaaaggcgcactgaagagcttgccgaggagtaccacgtggagttggcgattcgggagaggcaaaagaaattgtttgaggaaaagggcgactcggtagaggcgcagctgatgaacgccgttgacgtgcacttgggactgcgggacctgaagaaaccgttgcaaaatccggagaatttctaccagatcatgttgcaggaaatgaagaatctgctggatggacaagtcgacgcctccaaattcgaggacacattgaggtgaggtcttttcttctgtagatgaacatcagcggaaacacatttgccaattcattgtcagaagcatgttcgacaccagagcatacgttttgttcacaatggacaaacttgtcaacacgttggttcgtcagctgcaaaactttgtcggcgactcggccagcggacaatgtgtcgaacagttcgagaaatatttcgaccagcgagtcaatgggtgcgaaagtgggcaacccgctgctcgtgtggacaaagactacagcgaagcgatggaaaaggtccgatagaccagggacctttggaactcgtccgcagtttcaggtgttgctcaatcagcactgcttcaaaatgttctttttcaatcgcgaccatccggtggtgaccatcgaactgattgacacggacgagacggaaagtgaggaggaggaagaggaagaagagagtgccaatgtggtggcactgcacaattggaagcattttctcaaggacgaggcaaaccatttgaatcggggctcaaaacactcgcatttgaagggttgcgacttggacgacgactcattgcctagaaaaagggaatggaagagcgaacagccaaaattcttggccagaaatgtgcgctatcgtcgtgccttggccaaattcctccagtgtaatttcgctagttcgtccgtggcaggccaaagtcccgccaaaaacaacagtgaagagccgaccaccaacaaaatgttgcatttctatgtcagcaatggcttcattctgattcctcaactgcgcaacgtgtctgatactgaaatgctttctgatacattaatccgaaagtgcagaaatagaaaggtggacttattggaaatatgaaatttaatgttatttcgttttttctttgtttagtcatttcggaagaaatccattgcaaatacaaagaaattcaacatttggctagacaaatttcacaaggatgacactgagcttagcgtatgttaaagtctcagatctggcgttctatcccactttaggccagatggatgaccaccggttgtacttctcttccttgtcaacaccatgaattcaaatttctccgtttcaatatttattcttcaaaaagtgtagacgaataagaagaatgtaaatcggatgctactgatcaaaaactttttaataacaataaaagactcatatacataaatggtaattcctaattaaaagtaaaatatgttttatccttttgctgtcagacaatgagtttcacaacaatatttattgcttaaaaaatatttctagtttgaatcctctcgatgagaagttcaaatacgataggattcgaatataaaaaatacatgtaaaatcaaagttggctgtttgctaatattcttcaattttacaaaaatgcaaaaaaaaaaattacacttacaattagatttgttgattaaatggtctcgtcttcagctatattttttccaccacccttaaaggtgtgacatttggtcattttttggtcaaaatcagttaattaattgataaaattttcaaaaaaaaattttcagacggcgcctatctgcatagacggacggacccctttgttcctagtttttgaaaaaattgcgccgaaaaaaagcatttttgaaaagcaaaaaatatgaccattaacagatttgatttccgatctctttttaccgtctgacccattcgaaaaatcttagtcgcccttttaatgcatcccgccagcccctaaaatttcttgtcaggtttttccgagaaaattccattaaaa

SEQ ID NO: 19239 - DNA, 2610 bp, Heterodera glycines
  misc_feature (2604)..(2604): n is a, c, g, or t
acccaaatgtaagtgtcgaatttttcactccatgctgtcattattcattcaacaaaaccagcaacaggctcatctccctcggtctcgctcctttttaagcgtcattgcgttaaagggtggcccgccccacaaaaacataccagtatttgattcgctccactgctccgtcctcattcttgcatatttcacaatccccattttcaatttggtggggcaaatcggcgcaatcggtgcagctcacgcgcgcagacaagaagtttactttatgaacttgttggtgtccgccccccattgggtcaagccgcgtttctgtgtcccaacagacgatacggtaacgctgtttttccaatggaatccgctgttttttaataaaacaaccggtgtctttgccgtgatagacctaaaaataataacaacaacactgtttggttcccgcaacaaaaaaaagaaataaacagtgcagttaccttgcaacgggtgcaatatttggtgaaacatttatgtggccgttttgggtctcgctgataaacgcgccaacaacaattgcaccgcttcagcagtgaacatgtctgcccctgatggtcgtgatagcaacgttgcgagaagaagaatcgattgcatgccggacaaaggatttttacaccaggttcctttgcacatgggtgctccggcccaactgaagcaacaatgataagcgaaaaaaaaaactgtgcgtgtactttttgcacattgcggacaacggcgaatgcattccagcgtgtgcttcaatgggcgcccgtacgagcattcgcaatcaacgcaataaaaattgccaagcttgaagaagcagttaatttttctgattccatcatagtgagcgttggacaaaaagagcactacatcgaaacgacgccctgatggacctttccaaattggtttaggcaactcctctggatggtcctcaaatagtacaatgcgatacagtgcgggaaaccgctggtcctgttttggaaaagagaaattcacgtgttagaagttgttgtttgtcactgaacccaatagtgttgaacggtttgcaaatggtccatgccatatgcgtgttggccttcgggtacgccagctgcatgcattaggcggtgcactgaggaacacatcaactctcgattgatgataagacggcggaaagcttctttggtttcacaaaaatcctgcatcagcatcagtcgtgccaaattctgctgttgtggctgttgatcagctaacatccactcgttgaacagcacagggtcgtggtacgctcgagcaccaataagcgcgtggaacatacaataattgtcttcccaatctctgatccttatgcgatgcgcctcattgtagccccaatgctgatacgggtagaagcgcggtcggcccgccccggtaggtggagttaaacaggtcacagtgatctgcaccggttcgctgagtagcaatgatcgtttgtcgagcgcttcaccactattctctccaacaccaactcctccgtcttcaccatcactttggccaagcttgtccagctcagccatcagcgtgtcacagctgttttgttctggcggtcgaagcggcaatacgattgggtcatgtaagcctatttaataggtaaggaataaaagggctaccagccgaccaatcaaacctcttccctgtagcgtaacaccaattttgagaactttccggccactttgctgctctgcattttggattgcccgttccataaggatttggaatgcaccgcgcaagacttcgtccggttcctcaacgttggcattcagcacaaactctgtgatgtgtcgtgacaccgaaaagcgctccagtctgtgcactgagtgtgagacctgttgaaaaaggtcgtttccggtcgattggctgccgccttccgctctagtcccgcgtccctcgccctgctggtgttcatcatcattatcgtcatctgttagttgctgttgtggtgttgacaaagccgacgactgttcaggtgggctgggctgctcaaaaaagctcattgaacgaaagtcccagcgccttttcattgtgctgttatttaaggtgaaaaacaaattttttttttcagagtgtttcaaataatttggcaatttctctatgccttttttttgtcaggctgttacaagtgcaaacatttctttaacaattgttttttctatgctaaatgcaacatcaatatcatttaagataggttcatcattactcagcactcttgtcaattcttttttgcctttttcacggcctcggtgctggtcgatttcgtctccccaaccagctgaatttcatctccatcgtcatcctccgactcttccttcagttctccatcctctttctctacctttttcttggccttctcttcctcctctttttcgacatctttgttgtccgcgcacatggacatgattatccaatcgaaatcctggccttcgaaatggcctttggactcctgattaaacacaaagtttaaaaacaaatttagcggcacacactcaaccgaccttgatttgcactttgacgaccacctccttgtccaattttgcctccaaagatttctgcgagcttttcgggctctttttcgctcanattcgt

SEQ ID NO: 19240 - DNA, 1916 bp, Heterodera glycines
ctgactagagaaaggcaaatcaacatttttctcttagcgaaaattgttttaataaatatcaacattgacgttgatatttatttaatatcaacatagcattatgccatcaacgtaatatcaacgctatttttaaaattgggataattttttaaaatttaaagcaatttttcaaaaatgacttttggcggaaaataagatggggagagagataacgcaaaagtgagagggtgttatattcagccccagtcatacaaaagcatttttggtaaagaagaataaagaaaaattaattaaaaagagagtgttatgggaagagatttaagacagagagagaatagagaacatagcgaggaatctgcgtctcttatcaaaagaatcagcgaagaagagacatgaactcccttcccattgcgctctttattgaaattgttttctctacctccttcatcaaaaatgttttgtatgactgggactgagatccagcactctctcatttttgcgttatctctcgcactaaaattataaaccgctcatataaattttaaaaaattttcgcaaattttaaaaattacgttgatatttgcgttgatggcataatgttagttgatttaattaaatatcaacatttaaattgataccccgcaaaaactaataaaaaggttgatttgccattctctatatggaacccgttaattacttctttggaaacgatgtttttccacgaccctgaaccgtattgtttttattaaatgcacccgactccgtgggtccggaataacaagattttaacccggaaatcctgtccgggtgcagccctaatcagacaaaaaccgtcttcaaaatgccgggctctatagttcgagtttgaagcaccttatacaatactacatccccattttcattttaggaagctagcctaaataggaataaggggatatggatgccaaactaattgtaagcatcggcttctcacccatttataaaacaaggaaatttgcaaaaaaaaaaagatgattcatgcagggtttactgatgaaccacgttttaaaaaaacgaataaagcaaaacacatacataaatccataattaaggaaataaacaaaatgaaatttaaaaaaaacgcatggacaaatttttatgtgtgacaaaataaaatgtgtgcgtttggtgtaacttttgaagatcaattaggcaattatttataaatgatcagattcagtttgtttgaaccgctggtactgctcgggaccgcggctgctgctgccgtggtcgtcggcggctcccccgggggcagttcggcatgcctcgcaacaccgacggtgccctcgatgagctggtcgcgcagtgtccacaacgcttgtaccaactcatcctcccgatgcttcgaaccgttggatgacaactgaataaaaaaagttcagttgatgtgtaggtatgtcccaagccaaataaaattttcaagcgctttttctcattgttatatatatttttttgaatttaaaaatttgtcgctgatttgccacgccgcgccgccgccattccctcgtccttacccgtatccattgttgtgccaactgcttcctgttgttgttgttgatggtatcgaagaacaccgaagctgttgttgttgctgtcgttgctgatgaagatgccgccgatgatgaggcggaggaggatgatggcattgccgtggtgttccgttgagtcgcctgcaaattcttgtcccatttgctgaccgtccgctgcactttgttgctgtacatggactcaatgtaccttgaaaattgagtttttaaaatgccaatgccatcattgatccattgcccgcctctccaccgctggctgaccttacataagcctcggaatgaagcacccgttggaccttcaccgaagtggacggctcaacaaacacgggc

SEQ ID NO: 19241 - DNA, 937 bp, Heterodera glycines
tgaacgaaattcaaagggattaccgacagacaccgccgttcccccacaaaagaaatgaaattttggtaattttattaaaatgtttttctaatttattagttgaaaattgttctttctttaacatttcacataaacatattaaaatattagcgagtgaatttaaactttcaccgttattccatgaaaatgttcattttgctaattcctcctattcttccttttcctcctcctctccttcttcttcctcctctttctcttattcctcctcctctgctccttctccgcttcttccgctgatcatcttcagaatggcatccatccgttctttcgtcgtcaaatttttggtggcaaattcctccgccaattttgccgcttccgttggctcatcgtttgccatttcattttcactttcactcgtcgaaaggcattcaaaaggcggcgccggaaacggaagcaacgaacgattggacagtggtaaaacgctgaaaatgggaaaaaatattcaagaaaatggactcgtgtgagggatttgccggacttgcaaatttttgaaggaagcgtcgggaccaaatcccgatcaaatgaaaacgaatgataagacaaaaaaggagtgagaaacccaattgatcagactgttgaaaaaatacatgtgaccttttgtcgcaccctgtatttaatcgacgaacagttaagaattgggaaatttccgattcctagcgcctctcggcaccgcaagaacttaaaaaactaccaaattaaagatttttatgtatttttaaacaacaaaagttaagacgctgttattttatttaaaaaaatccgggtctagcctttgaggagccttgggtttttcctggattaggatggaaaattcccgaaggaattctcaattgaatgtaaaattaaaataaatatcatttaaattaaaattgctttg

SEQ ID NO: 19242 - DNA, 1173 bp, Heterodera glycines
  misc_feature (99)..(99): n is a, c, g, or t
  misc_feature (1048)..(1048): n is a, c, g, or t
  misc_feature (1110)..(1110): n is a, c, g, or t
  misc_feature (1115)..(1115): n is a, c, g, or t
gatcaatgtgccacaaaatgcaccagaaatgagtaataaaactattttctttatgaatgatatgatgtttttcttctcctgaagttacaaaaataatancaaattcatttccatattatttacgcttataaacaacatatggcagattaagataaagatcttttaggccaaaccaaaaatttttgtttagtaatttattttgtttattttcatttttatttacaacagtgtccaattttgtggtgtccaatttaccgggagccaataattattgcggggaattatatggataaataaattttatggagttttaaaaaactgaatttcttattcacttcgtaatttcagaatgacttgaaattttgcaggaaatgcccttggtatttatattggtattttcgtgcatattaacgccccctttttttgcattttcaaaaaatcctctgttagaatggccctttctcttttgttccctaaagaatagaaaattaaaaaaatattatataaattttagggccttttctcaagaatatacataaaaatttgacttacagtcaggtgcaaaatattgcagcaaatttttgtaatcctatgcctatataacaatatataaaataaaacctacgcatttttttagggattactaaatttgttgtgaacacatttttgctgcaatactttggcactgactgtattcaaaatgccagaatttttttctatctttgtgtaaaatttgaactaattaaaagcaagaaaaaagatacataaaaaagaaaaccatgccatttaattacaaaaaagttaagtggtttttggaaaatttaaaatttttatacacaataaaaaatatgaaaaaccaaagaaaaaagaaatttaaatgaattcaaaataaataggtaatttgtgtggatgttcgttcttcttcagccaaaatgaaaacactgtgaaaggacgggtgaataatttatcagatcacaacatcatcatcaccagcaaaaaaaggaggagaaaaagagcaaaatatttacatttaccactcacattcttnaacaaatttatttagccttcagccaaaaatgatttggaaaacaaatgtttttttattgtttnaattngaataatgaatgttgggattaggcattaggggggatcattgaagcaatttttgccaaa

SEQ ID NO: 19243 - DNA, 1521 bp, Heterodera glycines
cgaggaggcagtgatttcttttcatttgacccattaatttgattgctttctcgctcagtattaaaaattgaaaagcatccacttttcaggtacattgaccactccgtcatcacttttctacgttccaatcaacaaatttgggacagtggcaccaaattggatttgaatgtgtgttgttcatacaatgacgaggctgtccagccgatttggaatgttttggcccgtcaaattttgccaatttttgcgccaagcattcgccgtttgcaaatcctcattgctgatcatctcgtcaatttgcgtcgtctcatctccccaacaattctcaccgatctcaccaacctgaattcaatacattctggtaatctgttccccgacgcaattgctgaggatgggccaaatgcaactgcgggccaagcattgtccaaatggttgcacactccacgaaaagatggccaacccaagcgattgcattgcagaattgataatgcaccgaaaaattggaccaacaatttcaaggaggtcaacaccatatttcgtgatttattttttgtttgccccaacatcgcgaaatttggtcaatttattttcgttcattttttggtcttttttgaaaatgaaaccaaattctacaaaaattctgcgcagtctaattagtatgaaaaacatcttctttttgctatttgcgtataaaaaccgggacttttgcatatttttggtttttctgcatattttgccattttatgaacaaaatttttttttgttgcatattttgccatttttcattaaatatttttcgatttgaatatcccttaggaaaaaatttgattatgccaaaattacctaaatccaaatctgaaggatgcgcgagtgggtcaacagtgagtttcactgccgaaaatcttgagaaatttttggttttcaattgcaaaaactgataaaaaataaaattttttaattattttgcacccctaattttcaagtttttgtgcatatttggtgaatactttgcgatttttgtgcatatttggtgcatatttcacgattttatttgcatatttatgcgcatattttggccatttttcttgtatatttttgaccagccctgtttgattaatatgctgcttgaatgagtcttaagcatttttttgccttgaaaaacaagctaatgcttggttttttgggcatgccatttactcgttgattgtttaggcatttctccatgccacaacttctaccagttacacttttatcatttttggatcaacgccaatgattgagccattcgatgtggtgaacgaacgaaccagggaaaagctgatattggtggagaaaaaagaacccaatttttatagtttgattatgaaacgatgcccaatttttggggaggcggcgacagtttgccaaaaagatgaaaatttgaacaatttaaacaatgtccacttttatttgagtgtccacagatgttgcattgggtgagcaatggcattttcttttgttattaaattattactaattatgtac

SEQ ID NO: 19244 - DNA, 975 bp, Heterodera glycines
ggattatggtcataaaatggtttataaactgccaaaatcctgctttaaaccatcaaaaaatgtaagaaatttttttaaatttaacatatgaaaaagttagcagatttttgaacatatttttatttaattatttggcaaattcaaaataattttaattgttatttgaatataacaaaatttgccaatttttattattgtcttgtctaagttctaatattttattgttcccaatgtttaaatatatttattatattttaaattgtcaaataattttttaatttactttttcacttctttttgacaatcgatttacaatttctgtgtcaattcgttgaagtcatttgataattgggatgattcattatcattcgctcgtttatttctttagttttaagttttcttcataaaacaatcaactaaatgtgaacataaattcttaataattatttttatcattttttagacatttaaaaataattaatgcctttgacaaaatgaaagaagatttgaaaaatcagcagcaggtaaatacaaaaagattttcagaatctctcctttcttccgaaattttccttgcaaattaatatttaaatttcacaaaccttcattttctctaagacttttatcccccggggtattcgggatacctgttaattgtcatcaaatttattttttccaatctcaatttcccctcgctttgacagatacttcaaatcaatccaaaaaatcggtggaacccggaggattgtcacaatgagctgttccttttcaagcccaattttttgagggttgtttaccgaggaacaaaaaaatgtaaaattaataaaataataatattttaacatttatttaattatatccgataagaaattttgttcagcttatcgcacagtccgtgctgagtttgcgttgcatcgtgatggtggaattagctattttgaagtgaaaattgaattgttccacaaaggatcgggg

SEQ ID NO: 19245 - DNA, 2060 bp, Heterodera glycines
  misc_feature (48)..(48): n is a, c, g, or t
  misc_feature (50)..(52): n is a, c, g, or t
  misc_feature (54)..(54): n is a, c, g, or t
  misc_feature (57)..(57): n is a, c, g, or t
  misc_feature (66)..(66): n is a, c, g, or t
  misc_feature (70)..(70): n is a, c, g, or t
  misc_feature (87)..(87): n is a, c, g, or t
  misc_feature (92)..(92): n is a, c, g, or t
  misc_feature (96)..(98): n is a, c, g, or t
  misc_feature (104)..(105): n is a, c, g, or t
  misc_feature (122)..(122): n is a, c, g, or t
  misc_feature (124)..(124): n is a, c, g, or t
  misc_feature (126)..(126): n is a, c, g, or t
  misc_feature (138)..(138): n is a, c, g, or t
  misc_feature (140)..(140): n is a, c, g, or t
  misc_feature (142)..(142): n is a, c, g, or t
  misc_feature (145)..(145): n is a, c, g, or t
  misc_feature (147)..(148): n is a, c, g, or t
  misc_feature (162)..(162): n is a, c, g, or t
  misc_feature (171)..(171): n is a, c, g, or t
  misc_feature (177)..(178): n is a, c, g, or t
  misc_feature (181)..(181): n is a, c, g, or t
  misc_feature (184)..(185): n is a, c, g, or t
  misc_feature (189)..(189): n is a, c, g, or t
  misc_feature (196)..(197): n is a, c, g, or t
  misc_feature (202)..(202): n is a, c, g, or t
  misc_feature (206)..(207): n is a, c, g, or t
  misc_feature (213)..(213): n is a, c, g, or t
  misc_feature (220)..(221): n is a, c, g, or t
  misc_feature (223)..(224): n is a, c, g, or t
  misc_feature (230)..(231): n is a, c, g, or t
  misc_feature (235)..(235): n is a, c, g, or t
  misc_feature (241)..(242): n is a, c, g, or t
  misc_feature (244)..(244): n is a, c, g, or t
  misc_feature (249)..(249): n is a, c, g, or t
  misc_feature (255)..(255): n is a, c, g, or t
  misc_feature (259)..(259): n is a, c, g, or t
  misc_feature (268)..(269): n is a, c, g, or t
  misc_feature (271)..(272): n is a, c, g, or t
  misc_feature (275)..(275): n is a, c, g, or t
  misc_feature (281)..(282): n is a, c, g, or t
  misc_feature (286)..(286): n is a, c, g, or t
  misc_feature (291)..(293): n is a, c, g, or t
  misc_feature (301)..(301): n is a, c, g, or t
  misc_feature (321)..(321): n is a, c, g, or t
  misc_feature (336)..(337): n is a, c, g, or t
  misc_feature (340)..(340): n is a, c, g, or t
  misc_feature (347)..(347): n is a, c, g, or t
  misc_feature (351)..(352): n is a, c, g, or t
  misc_feature (356)..(357): n is a, c, g, or t
  misc_feature (367)..(367): n is a, c, g, or t
  misc_feature (369)..(370): n is a, c, g, or t
  misc_feature (381)..(381): n is a, c, g, or t
  misc_feature (384)..(385): n is a, c, g, or t
  misc_feature (394)..(394): n is a, c, g, or t
  misc_feature (398)..(399): n is a, c, g, or t
  misc_feature (403)..(404): n is a, c, g, or t
  misc_feature (406)..(406): n is a, c, g, or t
  misc_feature (409)..(409): n is a, c, g, or t
  misc_feature (419)..(420): n is a, c, g, or t
  misc_feature (425)..(425): n is a, c, g, or t
  misc_feature (427)..(427): n is a, c, g, or t
  misc_feature (430)..(430): n is a, c, g, or t
  misc_feature (438)..(438): n is a, c, g, or t
  misc_feature (440)..(442): n is a, c, g, or t
  misc_feature (444)..(444): n is a, c, g, or t
  misc_feature (450)..(452): n is a, c, g, or t
  misc_feature (455)..(455): n is a, c, g, or t
  misc_feature (461)..(462): n is a, c, g, or t
  misc_feature (465)..(466): n is a, c, g, or t
  misc_feature (472)..(472): n is a, c, g, or t
  misc_feature (477)..(477): n is a, c, g, or t
  misc_feature (490)..(490): n is a, c, g, or t
  misc_feature (493)..(493): n is a, c, g, or t
  misc_feature (499)..(499): n is a, c, g, or t
  misc_feature (503)..(503): n is a, c, g, or t
  misc_feature (508)..(509): n is a, c, g, or t
  misc_feature (513)..(515): n is a, c, g, or t
  misc_feature (525)..(525): n is a, c, g, or t
  misc_feature (530)..(530): n is a, c, g, or t
  misc_feature (539)..(539): n is a, c, g, or t
  misc_feature (542)..(543): n is a, c, g, or t
  misc_feature (546)..(546): n is a, c, g, or t
  misc_feature (552)..(552): n is a, c, g, or t
  misc_feature (556)..(556): n is a, c, g, or t
  misc_feature (558)..(558): n is a, c, g, or t
  misc_feature (563)..(563): n is a, c, g, or t
  misc_feature (567)..(568): n is a, c, g, or t
  misc_feature (571)..(571): n is a, c, g, or t
  misc_feature (577)..(577): n is a, c, g, or t
  misc_feature (582)..(583): n is a, c, g, or t
  misc_feature (592)..(592): n is a, c, g, or t
  misc_feature (595)..(596): n is a, c, g, or t
aaatttccaatgaatggaaaaaatgcacttttgctgcattagagggcnannnanacnccaccgagnaggnggggccccttttcagcngggcnaaannnggcacnnagccaaaagaggcagcngncncaagcacagaanancngangnngggccccgcacagncacaacggncacaannaancanngacncacagcnngaccncaannccaagngggaaannanngacacnnccgngggcannanacagncaaaangcgnccaaggggnnannaangaccannccanaggcnnnggcacggncagaaacgcaccaaaagaanacccaaggggaaaannaangacgacnagcnncggnnggacagacangnncacaaaagaanggnnaagggcgcncagnnggcnncnggnacaacagacnncacancnccnaagggganannnangacacnnncgnaggcannggnnagaaangcacncaaaggaaagaanaanaacccnccgnaggcnnaggnnncggcagaaangcacncaaaagaangannaangacccnccgncngcccngcgnnggncaaaangcacnngaaaggggngannaaggactctctgtagactttggctactcaataggctttgggtctcgggactgaagtgtcccgtgggcactgggagtgaaatggctaaacttaaaaaataactctggggcttaaatggtggcactgtaaaaataactctggggctcaaatggctgcgctgtaaaaataactctgggggtcaaatggcatacgcgagcaaaacattataattttaaatcatataaacctaaaactttataattttaaatcatattacaattaaataattaattacaaaaataaaactttgtgctcatccctttaaatttttctacttatcacttacatcttttacttacttacccctttttgcttttgcagtattttttaccctattttttacctcatgcgctcggttttggagttttgtcaatcgtatccctacataaatcattttttttgccctggagtgatttaattttcttattatcattttttttcaaacggtgatgtctgaaaatgcctgagggagattaatttctggtactaatttagtaagtaaaatattgaactgaaggtgtttttccaaagatgccaaatgcgtgcgtatgtaccactttacattaataagatataaactatgtttatggtgtttttcaaaaatatactgtatttcttcagaaatagtggatattagactatgaatggttaacacttatatttatgtgcatatatttcagcggagagaaaatcataagacgacaaaaaaaaaactttggaagagcattggcttctaaataatttacatatattttcttcagtttttttccattcccgaaaaatttttattttttcatagaaaattttataaaaataaatctttcggcttatgaaggtaccgccgccggaccccttcctgattttttaaaagttttcaaatccgaacgcattttatttcttataacaaaaaccatatttgctttaaaataatttgagttgaaaaatgatttctttttttttgagccaaatatttattttttcatgagtgatttatttgtttcgggaaaattttcaatagtcacactgtttttgagacttttagtgaacaggttataaaaaattgtgttaaaataaaagaaagatataataaataatatgtatacagtacatggttagattttcctaatattttcaaaaatgttatattaataataattttttcttaataaaataattctatagtagatttttatccgcttttcatcaattttttcatcaaaaaattttaattaaaaaatcaagttgcggttatttttaacctaaaagactgaaaatttgatgtttttaaatattattatagactttaatcatggtaaattgtgactaattttgatgtctaaaaccataattttcactctttaaaaatgttattaataaaaaagaagtatttctcaagtatacttctaataaataaattagtatatga

SEQ ID NO: 19246 - DNA, 1118 bp, Heterodera glycines
  misc_feature (1113)..(1113): n is a, c, g, or t
ttttatgccttggaattgatgcgctactactcattacacaaacgtggaataattactgaaaacagatggcgatggattaacaacaaccaaacaacggttttacgacaaaaagtactacttttactcagcgatgccgggattccgacaactgaacctgagtacgaccctaaaatatatatacatcaagtgcaaggcctttggagcgtcaaatatccaggcgaatacaaaatattcattttcaacgactaccagacacggcctattattaaatcagatgtagtagactaccaattcccaattctactctaccacaaaaacaaccacttcgacgggattaaaaccatctccaaatttttcaacaaacggtattactgcctctcctgtgaaagtgtctacgagcgtaaaacaactcattcaatgaaatgcactgcattatgtcacgggtgtcgggaggtgggagtcaattatccgtgtgagcctcaacaagggtaccttaaaaaatgtgaatactgcgtcaatatattctacaactacaattgttatgagcgccatcttcaaaaagacttgtgcaccaaattccaacgctgtgaagattgtggggtcatttacaacattaacgttcatggtagagaaggaagaaatgcgcaccaatgcggagagaaattttgtaaactttgcaaacaatttcacgtaaaggacgacgacgagatgaacccctgcagtagctgcttcatacaaccgctgaaacaacataaaatcaaaccgtaccgaatcatagcatacgactttgaggccacgcaggacaagaaggtggagaataaattcgaacacgaggtcaacttcgcagcggctaccatcatctgcaccgattgtatcaacaatagcagttggaactactctctgaaagggaaaaactgtgcgatttgcggcccccaccgcacaataacattttcgccttttgactacacgaaaacaacaatcgacaaaaaaatcgtcacacaaaaaccgctgcgtgaattcgttcactggttattctttgaacacaacaaaaagtttccacacagtcgcctttgcacactttggtggccgttatgatataacattgtacatcanaggaa

SEQ ID NO: 19247 - DNA, 1134 bp, Heterodera glycines
aagctaattagcgattcaggcgcacattggggcctgaattaagccatttttccctttgatcggtacaaaattggccgaaaaagagatagccattttctgagccccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaa

SEQ ID NO: 19248 - DNA, 2387 bp, Heterodera glycines
  misc_feature (30)..(30): n is a, c, g, or t
caagggcgtaatcagtcccctactctcccncaaaatttttaaaggaaatcgggatttttaaatatttttctttttaaaaaaagtgataaaaaatattagtaagtgaagcaaaaaaaaaaaatcgtgtcactgggaggtagcctgctccatctacgcaaaaaggtctggctacgccattgattcaaacccgtattacgaaaaactgttgagggaaagtggggggagaaaatgcaaataaacgtctctcgtggagggcccacggggatgtatccagccaggatgctttcttacatttagcaataaatcataaaaatgaattgaaatttttttcttagcgaccacttgccaagcccaaaaagcctcaatcctgctggatatacgtcaatgagccctcccctccccaacacgggtggacaacaatctaacaatcattgaacagcctacggcgttttccttgagcggatcgaggcacccttctattgtgatggttaactgacagagctataataaagcaatgaattgccagtattttttgaattctctctttttttgtatcaacatacccttgacgctaaattccatggtcgcattgataacgcgatatcgagcatttgtgggctgaacaatgcatttgtaagagccggaatccctaagttgtgcgttgtttaggccaagcacccaacaagtcggcacctttgaaaaaaaagaaaacgtttaaactaaaaggaaaacacatatttcttaccgaaaagtaagtgtcgatgtcatgtgagaaactttcgtatggtgtgctggtcggttggtgttggattgtatcattttggacaaaaacgaccccatctttgggaataaatgtacgagggtccaagttgacacaacagaacagataagcggcaccacccaagtttacgaaattggacggagtggcagcaaaaactacttggagttctcctgaaaggaagaatggaaagcaactaataaatcgttaagttaattatgttaatatttttcgcccagtaaaaaacgagtcaaaaattttactcatcagaattacgtttgtcacatttcattggcagccgagtgttgaaaccgggagcgggcggaagcacaaattggggatcgaactgtggcgggcaaatgcaccttttctgaactaaaattggtcaaaaaggggaaaaatgaaaaacggacgtgatagcacaacggattgcgaaagtcgtatttggcagtgtacgagtcgcccattgacacgcaactgtaatggttattctcggaacactgcacaggcacaactgaaaatacaaagcgaccgtttagccacaaaactggaaaaacggtactcaatggacatgaactcgaacagaaacagcgcccctttccatttctatccttcacacaaacgccgctggtcacacagtcgaagttcgatttgcactcggggacacctaattaaaggatggctaataaacaagataacaaaatggaatttgaagaccaaacccaattcgtctgcgttttttctcctttccaactcccttctcctccacgaattaagtaactcgtcgccgaaactcaatgttggaaaggccgacaaaaatagaaaaacggctcgccagcactcgcatttgtgctgcaccttgacgaagccgacatttttaatggactcgtttaacttttgtgccggattaatagaacagtcattggatgttttaactaaaataataattatacataatgagataattagtaatttgggttaaagccttcaatgctgtacagatatatttagctgtgaagaaatgacaaaaaataaattaatataatataattaactaaacttggagtgaattaatagacaaccgaatttttttacgaacttgagaccctttctttccccgccgcacatccatccaatcgctcatccaaaattggagtaatttattttcctcaagtattgcaatcagctgctgctgcgatgactactcgcctttggtggggtcgcgtcgccagtgaacgactcgcccaatcaaccactgccacttccggtaccgacgcgcactggtgaaattttgggcaggtaactttaaaaaagatgcatcgcacagaatagggaaaagatttagaaaggagaaggagacactcactagtcgatacacacacagagaaaaagggtttttgttaatttattgggactcaatggggggaagaaggggagaaacagtgacactggcaaatgagtgaatgcgcaaatgacagcggagaaaagggaacgaaaattaaaaacaattgtgggggggggggtgggcgatgggaattgcgcgtaggaagactaattattagaaatcttcttggcgactaatcatcatcacgtcaattctgatacataa

SEQ ID NO: 19249 - DNA, 753 bp, Heterodera glycines
ttttgcacgcagttatgataaaggggcaagcaattttaaaaagttgtcatgttattgatcaccataacttcacacaaacaacggtaggtactacgatgcataaggaaatgccgtgcattgtaggttctcatcggtaattcgcttatctggacattgcgcaacagcctcaacaacgccggcttctttttgcatgcattatttgagtgtattccgccgtaccagatttacatattgatcgaattgttacatgattgtgattgtacattgcataccaagtttttcgggatcgctgatcaggaatctgggacaagttgaggaatttaggaattaacctctggcaagacaaatactttctaatcagtcggtacctttgaagccccccccccccctcccgaatgtgctttgtctgattttaactaaatgttaactcatcttttgttttttgcctccaaattaaagtattttttatttaatttatcatttttcagtctgtaaattcaatcaatgtcttcacgtttctcaacttcttcagatgaatcttcttcatcctcacgttgttcgccaaattttgattttgattttgttagtggcattttatccaatcaattgaaaaaattcaggagccaaatatttcaaacgcttcaggtaaatgagcctctgacctttctgaaaggaatgattatcagtcaatgcctcattaagtcgcaatggggaggatacgaatcgctttcatcactgattaatgccttcgtg

SEQ ID NO: 19250 - DNA, 1070 bp, Heterodera glycines
ctatagtagggtagggcccccgaacccgtccccgaccccaaaatttaggggacattcgggctataccctgaccatgacgctgcgcaacccgtcaaaccccgccgccgaaatgtcatcctgaattgtgggtcggactaggtaatacattcctaataatgacattttgtgagggaaagagaaaatgttttgttcatttttgatttcattaactataataatcagggatgcaaaaaacatgcaaatgcatttttttcctggcttctccatgctctaaatagcaggatttttttttgtgtttgcgtataaaaatcgggacttttatttgcatatttcgccattttttggaaaatttgttaacaaaaatgcaataaaaacgttgaggaaatttggatgctactgattaagtttggtgttgacgaactcgcatagctaaagaatttttaattattttttcgaaaataaagccttcgacgggatgactgggtctgtgacgcggtcgggtacccggacccagccaggcctaatttatactattttctatttttgcggctttgtttcgacgtaatataacgaaaaatacacctaatttatacggataaattttgacaatgttcagaatttaaaaatgtaaaaaataattatttaaaaaaatattattttttgtgatcagtaggattggaattttaattaatcgatgaaacgggttatttacattattattattattattatattattaaatgcgagcactcagtcgagggagaaattattgaatttgtaattaataaatatagtaatcttgtcaatatttcacattaaaattgtgtagaacttagaaggaaaaatataaaaattcatttttggtaatattatttattactttatgtttctttcaaatctaatttatattttaactaattatttaaaaagattgatagaatgaaactatccctattcctctttctaattgcaatattttaattgctcaaattgaaattggagcagaaaagaaaaaggcacaacaaaaaacatttgatgaaatatttagagaaaaatgggaaggaaatgaa

SEQ ID NO: 19251 - DNA, 1046 bp, Heterodera glycines
  misc_feature (1008)..(1008): n is a, c, g, or t
aatttcaaattagggttgcaaccccgacgtcggggttggaaaattcggggttcggggttgtcggggttggaagtgtcgggtttcggggtcggggttgccaaatcgttcggggttcggggtcggggtcggggtttttcaattttttgccttatgccaaatagtcaaaattttttaaatattttttcggaaataatatttattaatttccataataatatttgtattgtttttatatttttttatttcttttttatcagaaattttgtatagaattaatttttttcttgaaattttaaaattttttattacttttttgttttccaaaacatcttttttcacgtcgctcttttctaaagacttaaggagaaagggtacggcgtccggcggtgccgataggcgccgccgggaaaattttgaaaatttggttagatctgctaacagattttgtccaaaatatgctaaatttttgcgattttgagccaatttttttaataaggtttatgactttttgggccctgtgatgccgataggcagcgctaaattttggaattaagctctattttctaagatttttcaccaaaaaaatttatgaatttcggtaaatttttgtttttcttcgatatgtattttgtcaaaatatgccaagattggtcgatttctatgagtatttaatttaaaaaaaacaatttgtcacaaagaaaataattaaagaagaaaacgtcaaacggtatcgaactcacgacagaaagtaatgtcaatgtgatgcactaacctttacaccacattccaaatgtccaaaattgagcaaattttctttatttaataaaaatttggcaaatggttaaaaaaattcaaatttcgtctaacttttttgcattttcacccacgaaaatgccattcttaggggtgtatatttaaccccgaccccgatcggggttaagggtcggggttcggggttgtcggggtatgaagcgtcgggggtcgagattttccccgaaaatggccaanaatgtcggggttcggggaagaggacgcaaccctatttt

SEQ ID NO: 19252 - DNA, 1417 bp, Heterodera glycines
agattttccaagcattattgatttctcaaagatttgtttactttttaaaacaatgccaaaaaaaaatccaagtccatgccttgatccatgccatgacagcctggatttttcctgggtttttgtccaggaaatccaggccattcttttttcgaaatgttcaagggcttctttaatgtccaaaaatttcagatttattttataattgctcttatttatgtacatattaaattaaggtttgaaatgtgagcccataaaaagaggggactctttctttttgctcaaaaattttcacaaaattccaatttacgagccaaagtttgagaagaacaagcaacaaatggttgagaatatggccataaatttgttcaattcattgaaattggagcacataaaaagcgaagaggaaaaaaccaatgaaaatattttggaaaatgaaaggaaaattgccgaaatgaaacggtggcgaagtgcggaaaaagcaatgaaagagcggcttaaagtgttggtgaatgatgcgagcaaaaagtgccaaaaaatgcggaaaaggttggaccgatttttaaataaaattggcataaaatttgataaaatgtttgggaaaaacaaaaaaaatgaatttgacggggaagaaaatgacagcagaagagaggactttgtgggatgcatttactattatttgtactcattttcattgaatttgattagaaacattgggacaaaaaaggcaaatgccgccgataattgcgataattatgatacgaaacaatgccaaaatggggaaaaagatacggaaatggaaataaaaaatttgagaaaaatatacgaaaatttgcgtgaaaaaatgtggcaacaaattaaaattgtttatgcaaaggatgatttgaaaaagatgaatgatcagcttaacggtgaccagaatgccgatgatgatgatgaatttaaaaaatgtgcaaatattgttgatgaagacggagaagagccaatatttaatgaaggtgactcaattaaggaataattagcgaataattactttatggttaatgtctgttgtattggcaatagaataaccatatgatttatgtaaaaaataaaataaattatgacgcataacttttttacatgataaattaaatatgaaggcttgcttttgtttttaggttctaaattattaaaaaatctaaaaaattaattttcgtcttattttttcatttgccacaaattcgcaaataaatccacccgttgttcttaagatgtgtacgggaaaagtttcgaccaacatttgatgcaatgcattggccaattccttgaatctgttgccaacgatcagttcaaataccatctttttgtcaatttttacaccaaacaattggactcggagattgaatcccggatcaatggcacagaaatttgtgccatt

SEQ ID NO: 19253 - DNA, 1057 bp, Heterodera glycines
ggctttctctcttcccatttttatggctcttcccttttgggttgttccattctccaacggtaaaggatgccgttgcggggtatgttagtgatgtgattgcgtcattttctttgtaacaatgcatgcgtgtgctctccgaaatgggtttttttgagggttgcggcaattcactccgttggcactttgtggccgaaattttacacctccaactttggcctgggggcagctcatggaatggtatttttggaatacaaaaccgattcgtcaagtgtggggggtaggttataaaaagttttttatgatccccccccaacaacatgcgacgccatcggccgttttgttcgtctcgaggcactcgctgtaattttggcattcgttgagtgaatgttttggttgtgttttttcctccctttgtggccatcggtcggcttgtccccctcgccttttcttctgccctaaactctctctcgttttcgcaatgtcagccgttccaagcgatcggctaagtcgtggaatggtcgttgtcgaatccatctacggccttcgcgtggtccgttgtgttcgttgaaattaaatcgattttcgattgacattttcagtcagcgtgctcaattctgggcccaggagtcccggcaaaatcccggcgggatcccggtcccgtccgggctctaataattatcagatattttccttttatcagatgcttatgattatgctttttttatcttatttaattttattttataatttgcatttttttattcccctcacaaagtgaagtgttggcatcgctgaacaaaagtgtcacacatcgtcttaattttgagaaaattacgaaacggagtgagaaggaaaagtgggtggaattgcatgaacagcttgaggatgttctaatgagacggcaagacaaaagttgggcggacagaaagcgacgaaaagtgcacagaaatgccgaaaaccttcgccaaaccttccaaaaatggagtgccatggccaacccaataaaacacccgatcagagatgaatatcgaaaagtgagggaactgatcagagggaa

SEQ ID NO: 19254 - DNA, 1286 bp, Heterodera glycines
atcgattttagtgcgctaggttcgatgaaactttttataatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaattggtgcgtttcagagcagtttgtgaaaaaatatttatgaattaattttgctaaaaaaataaaatagtgaagcttaaaaattaataaaaaattttaaattcagaattactggagttagcatcatagcgaaggttttccttgtctttttgatgccctcgcaaaatctgg

SEQ ID NO: 19255 - DNA, 2278 bp, Heterodera glycines
  misc_feature (380)..(380): n is a, c, g, or t
ttttgcagtaccggtatcgttttttacaataccgattccctctctattctattcacaattataaaaaatatataaagtgaatatttcatgtgatttatgattgaaaagcatgaaaaacagagttgccaaaatgttcattcagttaatttgccttaattcaaatattatatgctaaaatgtttcgcctataaatgagattgaaccaaaaatgaattagctggttgaaaaacaattttgacaaccctgcataaagctcggaaatatgaattttttagtgctttgcactatttttcatgccgtttgcatggacgcgctgtacgtggagctcatggccgcgctaagaaaattgaaatttggtgcaagaatataagcacattttnggcaatctttcggaattgtggtcccgaaaaattttttttaatttctaaggtactttttctaagcttaaaaatacgctaatcacgaatatgaactcggatttgcccaattccgaaacccagacccgaattcgaacaaaaacttgaatttttttttcaaaaatatatattaaaatcgatcaaattttggcgtaaaccgcggatttttatccaattaacaatttgaagcattattttaatcaaaaaataatagttgttgcatgaattagttttttatcccaaaaaaatgcattcttgaaatttttttttcaatttttgttcgaactcgggtcaggagttcggatttgggccaatccaagttcagattcgtaatcagcacccttgaaaacccttaaaatatgaattttaaataaaaaaaaaattttcgggaccacaattccgaaagattgccctttcaaactatctttaatctaaaaaatacgaaattctagtgcgttaataactgaacagtgaattccgactgaaccagcactacgcttatatagattttcgataattagtcttgccgttccgatttatgcattgcgtcgagtaaccccattttatatcagaaaaataaatgagatgttcagccagtggtttgaaatgaacaacaacaatagacactgatcccttctcccattgtggtccatcatcagcgtcgtcccccgccgccgccgcgtggaggccctccgcggcctcgtccacgtccgcgcggcccaccgcgtcctccacggccaccaaatcggcgttgagtgggcttcttgcgcggctcgtcatcgatgagcaaagtgtccaatggcaaagaatccggaagaacaatatagcgaatgttgtttcctgaaaagggagtatgaaatcactaggaaaaatttttttttttcaatttttgttcgaaagcgggtcaggagttcggaattgggcaaatccgaagtcaaattcgtaatcagcacctttgaaaacccctaaaaacttgttttagcccataaaaattagggacccccattcttcacattcttcaggattgccgaaatagatatcagaatcgaattctacgacccagaaaacccataaaaatgttatctcaagtttgtatagtgtttgggttttgagcgaataaactaacctctgatggagagtgtgtccaaactgatttgctctcgtccacgcactgtcatttttaccgagcgcaaatgaatgttcatggccacgtcgacgccctgaatagcaccgctcacttgtgtgccgttcttcagctcgatggtcacagactcatgggacaatttcatcaaaaagcggacaagcttcatcgcgcttactgaccgttggctcttggaattccaaaaataaaaattgagaaaaatctaaaaattaaaaaacgttaaaattaagattgtcctttcatcaacaaaacaaaacgaatccgcactgaaattcaaaaaatcattatgccattttaaaatttaaattttttgccctttcaaaaataaaaacatatagattctgacacttcctaaactcaaactcaaatatccaatatacttttttaaatttttagctggtgcttcttttaatgtctgaaaacatgggtgctatttttgagaacattgctttgcatgactttgtcgtgaaagaagtgataaacagtttcccggacaaaaaggtggcaaattacgtcaatttttgtaatttatttctctaagagcatttttcttttacttgcgaaatccgatgagaaggctttgctcatctgtaagttttttcgcgtatggatatgaaaaataattggtcgccaatttcagttagcaaaacatgttttatcatgttacttatgcaaacccatttttaaaggcaacaaacaa

SEQ ID NO: 19256 - DNA, 870 bp, Heterodera glycines
  misc_feature (746)..(746): n is a, c, g, or t
  misc_feature (847)..(847): n is a, c, g, or t
  misc_feature (856)..(856): n is a, c, g, or t
aatttaaaattttaatgttggattaattacattattattttttcttaatgagttgcccaaatgtcattttttgcattccggcataaagatcgcgcggcgtaagtgccgattttgttcggtggcataagtttcgcagcgcaaaagtcagccaagcccgaccatcagcagccgatcatttttggcaccgccggatccatttccataaaaatattcaaatcaaaaatttgtactcaaaatttcaataaaaatttcaattttctccggcatttttttgtcggcattaatattttcatccatttgtaccaaatagttagttaattaacttgagaaaagagctcaaaaaaaaatccaatgcttgtaagcggccccggcgctttcacagggcccattggggccctggttttagttgtggatgaaattttaaaatatgttatgaaaattgataaaaacaattttttaaatattttgaataagaaaattaattcaattcaaaaaattatgaccaattccattaattagagtcaaaatcgcatccctctcaaattctttgctgagccaatggtctcattcggcggcactgatcactcactggtcagaagtggcgagaaaagctgctcaacagtagtgcagaagcaacggcaccacaaattggcacaaaacatacaatcattcattttttctgttttgccgagggttgagaaaatccgagactttttctcgctcaaagattcggcgccgagactctncaacattgcgaacccgagactttcttggttcaatgacggacattacacagcagcagggaaatttctgtccacaaccagcacccccatccaattttgctccnaactcagtncgcccgtactcaat

SEQ ID NO: 19257 - DNA, 975 bp, Heterodera glycines
aaaaaagttaatggccagaaaaacctaaaaaaaacctgaatattattcttggtatcattcgatagcccttaacgtgctctatctacctgcaaaaagaaagaaaaatttattgcttttcaaaaaagttatggccaaaaatcgtaaaaaaaattttttattccaaaacttttttcaaactcgatcaaattttttgaaacttggtaagtggatagagaattttaagtgctaatgaatgataccaagaattagagtgaagcgggaccgggacctggtagcggacaactgagtaccaaggtcccggttttgaccgggaccgggactagtcccggttttttcccggttttcccagccaaaaattcccggtttttcaacccgaaaaggtcccggtcccggtcttgcccaaaattcccggtcccgcttcaccctaccaagaatgtttaattttgttggttttaacaaaagttatgacaatttttttttctcgaaaaacagtacgagttgggtttcgtccctttttttaatctaatataattttttcaaatttgcaggcttataaaaaacacttaggcttatcgtttgatatcaaaataatttatttggttgcaaaataaaaaaaaattagaaaacttcaaaattggcggcgccaaaatgtcccgcgtcaaagtgacccccgactctctccgcgtttccaacgaaatttggcagtataaaaggaacgaaatttacggccaattcccacacacacaattcatttttcatatttccgccttccgtcggctgatgcccaacacctttgctttccttcgttatattttgtcgccactccgttttttgaattagtaagtatttcaaatttcaacttaatttgattagttccttcgggatttttaagttatgtaggcaaactcttaaaaaaacattttccccaccaattaacaaaaacagcgaaaaaaaaatttttttttttgtttcaaa

SEQ ID NO: 19258 - DNA, 1619 bp, Heterodera glycines
  misc_feature (32)..(32): n is a, c, g, or t
  misc_feature (49)..(49): n is a, c, g, or t
gggggaagaaaatgagaattttgaccgtattnttagcagcttttcattnaaaaaaattcataattttgtggatttcgaaaaaaattgtattttctggctaaatttgggtgagatttccgtttgaaactctataaaaaccaaattcaaattaaataattgccaaacattatgccaatttatcaaaatttaaaagattctgaggattttccccaaaagcctcaaaaatcctcaaaatttctcaaaaagccacaaaaatcctcattgacctatcaaaaagccacaaaatgaggataaatcctcagatctggcaaccctggtttttccatatgtgaccattttgccttaccttattgctgtttttattttgcttactttatttttcagttacatgttttcatattctccactaagtgctcctttcttcagtaaatcgtttagcagcccttctacaaatgaacaacgcaaaatcgacctcaaatttacggatttatgcgaatattttttcatatcgcatccattttctggacgaaaagaaggaagcgaacataggaggcatatatatattatatatatatatatatataattcggcgctactgtaaaagttggcctttttgaaaattttttaaaaaagtcatgaaaatacatttccgggggttttcggggccgctgatcacgaatatgacattcatttcgaccaatttcgaaccccggacccggatttgaacaaaaagttgaaaatcgtaaattttcacttttcaacattgaattcgcgccgccaagacacatttatgtaattcaatattaaggagacacactatccatttccagcatatcggggcagtattaggaaaataggatagtgtgtcctatataatgttattatcataaatgtgtctcataagttctgagtaccacatatgtctagagatttgaaattacaatgaaaatttactgatcataaatccgggtccggggttcgaaattggtcgaaatgaatgtcatattcgtgatcagcggccccgaaaacccccggaaatgtattttcatgacttttttaaaaaattttcaaaaagacccacttttaatatagcgccaaaaaatttttaatcaacgaaaagcctatgaaatgtacatgacgagttcgtttaataaagaagactaaataaagaacggaaagaattagggaactgggcccttatatggtttacgccccataaatttttttttcctttttcgaataaaaaaataccgatttatagtttttcggggtcgatgatcacgaatccggcatccatttcgacccatttcgaatcccgaacccgaattcgaacaaaaactcaaaaatccaattttcgacaagaattcacatttattgcccaaaactttgggaatgataatgatggccgttcattgaacgattgacttcaatgagatgaatggtgatcctattgggatcccatatctattgacactgctcggggatcccttcctgtcccgctcacgatccctaaatcccatacttatagtaaagattgagagagagagagaatgtgcgagagagagagcggacggactgatcaacggatagagtactcgccccaggaccttattcgcttt

SEQ ID NO: 19259 - DNA, 270 bp, Heterodera glycines
acgctgcggacatctacatttttgaattgaaaaaaattggtaattactctttctttttctccatattgaccatcatactcatactccccccaccctttctcctccttcatttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 19260 - DNA, 2787 bp, Heterodera glycines
  misc_feature (9)..(9): n is a, c, g, or t
  misc_feature (1193)..(1193): n is a, c, g, or t
gaccagcgnccgaaacaatgcatacccgaaaaatggatgtcttttttagggatcatgcataaaaatgctcagcatttgttggaggtgaacctgcagcagggctgaacagcgttcatggatgagctgatcgatcaatatggttttaaccactccaatcacccattatgcggcgttattccattttttgcttttctcgttttcccaaaaagtttgccgtcgtatgtccattttgccacccaaacagacaattactcattttgccactctgtcaccccattttcatttcgacaattttgtaacaacacttactaatatcttgcctaatttttctttttaagcaaccatttaacacataaaattcctttcataattaatacccaaataacttttgtgttttcatgaaaaaattataatttgcatttagccaaaagaaaataatctttaattataatttgcattagataaagtgtgaaaaaattattggaagaatttaataaaattttcataaattttaaataattcttatattttgcaagtccatttaaataatttaactttaaaaatatattttatttatttattttatttgaaagatgtcatttttatttttttaaatatgaatagtcaaattttaagcgacaactaaaattacttagatttaaatatctttgcccttttctataataaaattttgttgaaaatatttttacttaaatggtctaatctagagtagagcgggaccgggaattttgggcttaaccgggaccgggaccttttcgggttgaaaaaccgggaatttttggctgggaaacccgggaaaaaacccgggactgctcccggtcccggtcaaaaccgggacctcggtactcagttgtactcctgtccgtgttttggtcccggtcccgctctactctagtctaatctatttgtccctttttaatataattttactgtcgaaaacaacatcaaaaataaatgcgaccaataccagggctggcaaatctgaggctttagctcattttgtggttttttgataggtcaatgaggttaaattttcaaaatgaggctttgaggctttttgtggttttttgagaaaaaccgcaaaataaagaattttttaatgaaaatatgctaaaaatatggtcaaaattcttaatttttcccccggcggcgcctattggcaccgccggacncgtaaaaattcttaatttacaagcaaaaatttgctcaaaatcgcaaaatttggtcatttttcggacaaaatctgttaacaaatcgcattgaaaattacaaaaatttttcccggcggcgcctatcggcaccgccggccccccttgcgccccaaaacttttttgggaaaagcgccgcaaaaaaatcaacttcgtttttcatgttcagaatcccaaaaaatgcttatttctagcaaaaaaatgctcaaattgatcatggacaatcaaaaatataacatttgaacattttaaacgtgtttagaatacattttgtaaaaatgaggctttttgacccaaaatgaggcttttttgcctgccaaatgaggcttttgaaaattttcatctgccatccctggataatatgattcactcgatttttaccaggttcaggcgttgcaacgcgtccacagacaatgggcacggacgtttagcggatcggcttgcaggcgatggggaggtgggtgatccgggcgcggatgggccctgttcacagatcagtggcggtgccttgaattagggatttttaaaatgcgctttgatcacaattagcggaaggatatgctcatcaacgcatcaagacgtggctggaaaaccccaaatttttcctattacggaaaatgaggaatggaaaattgctgatcattggtcccatctctgacggttttaggaaattcagttctaaatctaagtaaatgctctaagatttgttgccgatacattttggcattccgattagaagaacatttccccatgccggcatccctaaaaggcttcgggattagatcccgaaaactccaattcccgacatttctggacccatttacaactcagtttctcgggtaattttgagcaacatttttcccaactcaagctcccgacaaagttaattcccgaccggatcaccagtccggttttatttaacattgagcctctaattaaaagttgcaagcatgtggaatggaaaataaataaatccccgatcggctggtcctaatcgattcggctgactgatcggaccgctcagcgtcgaacagcaggcaaacacacagagtctgatcgatttgagaaaggcagcaacaaatgttcgttcacctcacccacactcttcaactaaccaacatttttctgctacactcacgtcatttgataacaaaaaactcttgttgatcattcattctttggcctccaccttccccctaatctgttaattttgatcacaaatcatttaaaaaaaacccgttttggtttttgatcggatacgtcattggtctttttgatcaggaaaaagatagtgtccttcggtgatgatacaaaatattatgaatgaggaattaattccaatcacgatcagcaggacataattgatcaatcaattaagcaatcaatcaattattatcaatcaataaacaatcaacaaacaattaatgttaattatcacgttgctcagtttttcttcttatcctctaattagtgtttttctgatcactttcactgtcacttatgaatttcctaagtattgcaattttaggcttcatcatcagataaaggtaattttggg

SEQ ID NO: 19261 - DNA, 2665 bp, Heterodera glycines
attaaaagggcgattaagatttttcgaatgggtcagacggtaaaaagagatcggaatcaaatctgttaatggtcaataaatttgactattttttgcttttcaaaaatgctttttttcggcgcaattttttcaaaaactaggaacaaaggggtccgtctatgccgataggcgccgtccgaattttttttttgaaaattttatcaataattaactgaatttgaccaaaaaatgaccaaatgtcacaccttttgactcaattctacaggattaatgtctatccagtggtgtcgataggcgccgccgggaaatttttttgcaaattctaggtgaaatttgagatgaaaatttgaatttattttgatttattttattataaatttattcaaaaattttggcattccgtcttttaaaattttcaaagaatgtatgcggatcctgccggatcccgcacaaaaatcaaatttgcggatcctgttgcaggattggaattcaaaattttttgacggaccggatccggccggattaatcctgcattttccaaaaaatgcaggattgcggactgggatcctgcaaaatcctgcgcaggatccggtcctgctccgggctctattcagaatgtcggtcctctaaaatcttttcttaaacatttttacagtcaattacgaattcagaaatgtcattaaatttatcctaaaggcatacacatatatacaacacgatttgcgatcacagcaacaaaaacaacaattttataaatgtcaaatgggctcaaattcattatccaactccacaattcaattaacaaatcatccattcacttccgttgctgatcacttgggtcgatcattgcgccaagaagcctaaaaatcgaaacggaaataaatttggatatctgaataagcattattcattcattcactactgacccatctcaaatgtcgatccgattccactggtcaataaaattccattcaatcgcttccttctcccattttgtccatttgctttcatctcggacaattggacaacggatcagcagaaaatggccgatatctgtcatccttaacgttaattgctcccgagtcaattcgttgatcagatcgaagagcaaaacgaactcagtaaaagttggcggaaatcgaatgaaaacgatgaaattgacgggagatgaagcattggtaaaagcctaaaatgagtgaaaaattgattaataaaagacaatttacagttggggagggggcacgaaaatcaagagtgtcgcggggcgggatcactttggagcgggacattttgacgccgccaaattaaaaatgcgccaaaaatttttgccaaaatatcgtccagagtattttttttgtcaacgaaccccaaagaccgtaaaaatgccaaataaacaccgctttgaagttttcaatccttgacgaccaattccgacaattcatgtacaaccagcatttgaacacctttggcacattgtccggacggcaagtgaacagccatttggccacggcttgtccattggaagcattgtcattgtcattggcagggaattcggcgaagaaaccgtcataataggcattgataatgcgaagcgatggacagtcgtcgagaattgacggcacgagaagtcgcaaacggcggaaaacttcgtcggacaattggatagcacaaatgtttctcgcgatcattggccaaatgttgtgcaaaaagaactccaaaatgcggtccttgaatgtatcgatggtcaaattaattggacatttggcaaaaagttggcgaaaattgccgggaaaagcgatggcattgttgttgaagtatctgtgaaaaatgatggaattgttttacaaccagaaaaaaaagaatcataatttcacttcattgaaatggctttgaatccgatgattttctttggcagcggattttgcggaattggcaatgcttttccagcgtaattgacaatatccattcccacggttccatccgatttggatttgaatttaattgccatggatctcagagtccagcgacgagtcttgaagtgttcatccacataaaagtcaaaacggtggctgatcatcgcaattccaaggccaagttgtgaagccgggagcagatcgtacacacaaagccaacaatcggcggaaatgaagctgaaaaaaaggaaaacaaaatttaaaattgaaattttaaaaatggcattttaattttacattgctttcgccatcttttgctccgcttcgtttcggttgtcagacatatgcaggtctttctaattttgattgtttggttcaaacggaagccatcgggggttccaatttcattcaattcaaaaacatcgtaaagaccaaaaatgagaaggaaaagggtaaaatgtcgagaaaaaatatgcaaaaatgtatagaatcatttttggaggaattgtcatgagaaaaattcgaagaaagcgaaaagaaatatctactaaatggcgaaaggaaaataataatgaaaaatggcggaggaggagcaaccacttttatactaatttattttgccgaagattttaataatcagtcgtattcgacgcattgctataaaagccatcactccccttccattttctttcattcgctcactttttccttcctttttgcttccacaaaggatttccttgcttttctcggat

SEQ ID NO: 19262 - DNA, 739 bp, Heterodera glycines
ttttttaaattatttcgaaaaaattcaaaaatgagtattatttaaaaaacggaaccccaaataccattaactaaacatgaacttcgatattattagctattttttcagtaaatatggcataattttgttgaaaagtaacaaaattttatattcttgcgattgttcgatatcccagatttttctctatttgctgcaaaaattcaaataaaattatcaagtttaaatataaattatggcagaaggtggcggattttacaaaatgactcattgtctccaggtgttttcatatgggacctttttcaatgtaaaaatttcaaaagattaatttgtatatttttataaaacaaacattataaagttattttaataaaaatatgtataaaacattcaaaccgaaattttaaaataatattttgtgggaaataactttttgaaagagtcattctaagcaaaaattcaaataaaattatcaaattttatataagatatggcagatggtagcggtttttacgagattaatcatcactaaggttataaattatatggactaaaaacattaaatgtctacgtaaaatatggactaaaaaggccgaaatatggactaaaaagctcaaaaatggccaaatatggactaaaactgccaaaatataaattttaaaccctcaaaaattccaaaaaatgtttataaattcaatatttgcttaaaccgacttaaaaatacgctaaaaactgccaaaaa

SEQ ID NO: 19263 - DNA, 1869 bp, Heterodera glycines
gaacgatgccaagtcccccgtcacaaaatcgtcgttttgtacatgcaattgaactgcttcaatttggagatgcacatcttgggcatgaaatccatgtccaaacggcgctttgctccacaattgtccatggggtgtttgttgtcgaacaacattcggtagagcagcaatccgacgaaccacaccaagtctttgcccgttgttgtgtttctgttatcctgaattcatttatctaaggtattatttaattgggtaattaaatgggtaattaagtggttaacgacaaactttgatttgctctggactcataaacaccacatctttcagccaaatcatctgctcttttggtctctgttctggtggaagtgtcctttcccgtgggtcttgaatatttttcgttccgttaaattcaattttcaaatttcccgccaattcttcggcgccaaattcaaattcattttgacgaatcaccgaaaaatggtcaaatgtcaaaatgccatcaaaaatcggctgatcagagttttgctgatgttttattgaccatttttgtgaggacaaaacggcaaaaatcaaattcattgcaattttttcgattgttttcgccggaacattgaaataaaagccgttataatcaacaacagcagacaaatattcgttgagagggcatttgaaatttggcgaaatgtttgtaattatggtgttttgtccaccaaattcattttccaaatttatttcaatttttggtctaataatattcttttctattgcttttatcggcttttcatttgctagaataattgttttattttgtaaatatatttattttaatttaatttaccaatttccattggtgaatgtgctgagccatgacgacgattcatcacatttttgatcatattggaatggcttttttgtttttccgatttcatttgaaccgaaaactttggcgattttccaaaaaatgttggacctttttaaaaatgatttttttattttagcaaagaaaccataatgccaaaccttggtttaaagccaaagtcattggatttggcgcagcacaaaaaagcgaaatgttggcaaaaagccaaaaaaatccgagaaataaaattgaagaagcgaagaataatgccattttattttcgaaaaatgaataaataatttattattttattaagatacagacgaatatattattaaaatgtacaaatatttgtttacggaaataattgttgtgaaattaatcaattatattagaaatttaattattatttattattattattggcagatttatttttcttattattaagctatgatttttaggtaaaaaacgtaagaaaagggtcaaaacagttagtaaatagataagataaacccaaatgatatttaaattaaaattcttattaacgattttattcttataaacgaataaaaatttaaaaaaaaaacaaaactttattgaagaaaaattaaatgacgagggatacaaattgaaaatttttccatttttttggaggggggggggtatttttaaattgttaggtccactcactgggtgttttttttttgttttttaaactgaaatagccaaattaggtaattataaagttcgagaaagctacaaaccaaatggagaaaattttatactaataaatataaaattaataaacaatttttaaaagtgaatggtaaaaaataaattctccgatttaaataggcgattttattccccgacaattgaatatgaatgatgcaaaaggttatgctaatgcaaatttaattttgccattttcaaatgatttccgtcatttttctacgacaaataaaattcaaaaataatcacaagataatttgctgaataaggatgattct

SEQ ID NO: 19264 - DNA, 2057 bp, Heterodera glycines
gccaactccgtcttagtgtataaagggccaactccgtctcagaaagaaaaattcattttaagcttaagaattttttttaaatctcagttttattaggtcgggataaccccctttttgaagaaagttttttttaatgtcataaaaacacgcttccaagggttttcggggtcgctagtcacaaatctgacatccatttcgaccaaattcgaaccatgaacctgtttcgaacaaaaatattttgaaaattctcactttggttcctaaattgaccaaaataagccaaatttagtcaggaatcattgcaacaacagaataaggccattaagcacagttatgaacataaaagtgaattttcaaagtctttcgaatgatatcaattttcggttcttgaagggtttgcggcactggcggcggcagttcaatttcatggcggactcgcttcaccaacttaaaaccaaaaatgtgaaaaagtaaaaaataaatagatttttcactttttttgtcgcgttctttgtcggaatgttcgccattactggcgttggaatttgctgaagcgcgtgtgccctgattgctgctggcgtttccatcgtttcagcggcacgtcgtttaatgccggtggtgattttttgtgcgatgacatttgccgcgctgcggttgcacgcgtgtataccaactgtcttcagaacgacgtaatttagcgttgtgtggactcgccctcggcatttgaattcgccgtgctgatgttcacagcgccaaaattttacgtcaccatcggcattcaacaaatggaagacatacaggcagccttcatgttcgagttttttattttcgttgagatttaatttcagcattttccattttcgtagtgctaaaatattaatggtactttaaaatgttaggtcagacactattttaatgaataattcttgtcattaaaataaataagtagatttaacggatgagtttttgtgacattttttaatttcttaggggatgtattttaaaattcgttgaaaaatttcttatatattttttttatctgagacggagttggctccttaggcactaagacggagttggccagacggagttggcgagacggagttggctcagacggagttggccccaagacggagttggcgagacggagttggccagacggagttggccccaagacggagttggcgagacggagttggcgagatggagttggccagacggagttgacccgtttcgaatctccctgactttcccttccgcttaccaacgctgaccaagccacgaaatgtccaagccacgaaatgtccaagcctcgaaatgtccaagcctcgaaatgtccataagggtaaaaaacacgaaatgtccaaaagtctaaaaagcacataaaaacccggaaaacggatctaatttagggtttttggagtcgctgagtacgaatatgacatttacctaacccatttcctaacccaggacccaaatataaatataaaaaatgaatgaatttattaaacattcaataaaaaattcatcacggaatacgaacaatcgaatcatcaaaattcacgaaatctttcaattttgctgcatatccttcaatttgtagaccgagcgccgtcatcagatcacgaatttcaccgttgttgttgtatgacgcgtccgccaaaattctcataatgacagcatcctggaggatgtatcgtttgtgtcgcttgtgaatgaaatggcgagcagatcgggcagcgtccacctgtctgtcgatgttttcattgactccacagatgaagtcagagagtgccgggtggtgacagagacctttctaaatatatttttaaaaatttgcccgtagtaaattaaaaaccataaaatgcagatgagttgcctccagtccattgtttgtacgagcgagggcagatgcggcctgcgagtgcatgttccaaattgcaattgggaaatgcggcgcccgacagatttcttcctcccacacgggaactaaattttttattaaatataaccgaaagattcgtgaaaacaacaagttttgtgaaaaatatatgcct

SEQ ID NO: 19265 - DNA, 2472 bp, Heterodera glycines
  misc_feature (2344)..(2344): n is a, c, g, or t
  misc_feature (2417)..(2418): n is a, c, g, or t
  misc_feature (2453)..(2454): n is a, c, g, or t
caaatcagtttatagctttattaggagttaaaactcaaaaagatatgagatatggctccattaaatttttcccataaaaatgtgtcccagtcaaaataagagcttgcgacaaataacagaatcagctgtcctattattatttattacgaacctcattaagagacagaagatatacagctgtgaggagaatcattgaggcaaatgtggaacaggtaagcactttttgaaaaataataatattccaaaaagaaaaaataataaatattaaaatcacgataaaaactgaattaataggaaaatttttacaacgaacaaatattttcgattcacataattaaaaaatgattcacaatgaaatggatgttaataaactaaatcgaaaatgtccattaaattaaaaaatgtaaataagtaatttcgctttttttatctgaatactaatttcataaaaatttaaaaaataagacaaacaaagaatcataggaaaaatcaaaaaataaaaagtcagtgataataaaactaaaaattaaacaacatcttcattaaaaacagcgacaaaattgagatctttctatttttttaattaaaaaatgaaaacttttacacataaaactttaaaatttcttaaattttaaaagaaataaattattttttaaataaaattggtgatgagaatttttgggttcggaaatggtgacaaatatggccggaaaataaaataaaatgttaacaaaatttttcattaaaaagtaattcctttttttaattttgtaccaaaaaatttttaatttctttaaccattatttgaaataattttaaatagcaatcatttcctttttaaattattgaaaataaatttggcctataatatttgaaatgaaaagcatttaacaaaaacaaaagcgtaagccatttggttacaattttttccagataagaaaaaaacttattataacaaaaataattaaaaaataaattaagctttattttgctatataaacctatgaagagatttgttaatttaaagcattataaataatttaattttattaatgaaatatttaaataaataatgaaaagaattaatggattaaattaaaaacgagattataacagaaaaaatgatacacaaacaattttgatattaagtgatttttaaattgtaacttattccgcatcaaaaccaaaaaccaaaacaaccgacaactcttcggagagttgattttaaaaaatacaattttttcgaaatcatgaaaaaataaattgcaatatctaaaataaataatatgtaataaaaataaaaataaaaaaattatttttattctttttaataattggaattcaatcaaggcttaacctgtttaaaaaatgaacgaagcaataataatgaagaaaaaactaaagcaaatttatattttaaaaatattaattagcaagaaatattaaaatgtacggaggcaagaaaaataagtaagagcagttggaagacatgagatgaaaagagaaacataataaccgataaaaaaattaattgttttacttaaaaaaagaaaacttataataaattaattaaaaatagattcaacaaacagaaaaaataaattactatgcgaaatttattaaaagaaattcgtatagaatattaaaaattatatttcaataaaaacaactaattaaaaatatagcactggaaggaagggcaacagaagaaattttagtcgccatggtaaaaaaatattaatagaaacaaagatgtttaatggataataccaatttattcatattaaaaattaagtcgaatctaaaaaatattaaaaattggagatgaatgagtaaatgcttcttaaataaatcatttaattaataatcaaattttaggggaggtgttgagcgccacttaatatttatgtattattttctcttccgtttttcgttcagtaattacgtagaaaaaattcccaacactaagaattttttcgaaattttagccgaatttcagtgtattttagcgtgtatcgatcactaactatgaaggagtgatctgatcaagttggtgtaaaagacttttttattcagcatcaaaagataagcatgcatgaattatttcagatttttataagcattttgaaattattttttaaatttggttcacttggaaagatagatataattaaactttaatttaaacaaatttgtgaatttttaaaaaaattttatttcaagaataaatttttaatttataaatttaaaaaataaacaatgtcaatagctcaaaatcgctatacacggcgacaccttgaatcttatcttgtacaaggaaataataaaaaaaatttttaattanaccatatctattatctgtaataaaaatcttgataccaaataaaaattcaattttagaaatcaaaaagaaatannaataaatttagctaagaataacataatataataannatacataaataattatat

SEQ ID NO: 19266 - DNA, 2175 bp, Heterodera glycines
  misc_feature (18)..(18): n is a, c, g, or t
  misc_feature (151)..(151): n is a, c, g, or t
ggtaggaaaacgaagttntagcgaatgcaaaacggaacaatcgaattccgctgacaaattaatgcccttttcggcgcgatttaacaagctcaaacttaagcgaggaaacattccgcggaagtattcgttattatttttacaaaaaaacttntaagaaattttttagtgcatttttttaccaataaaatttttatggcccatcgttaaatgtacaattaattcaattaattaagaaaataattcaaattgtacacatttatgtttttttttttgcttttgtctaaatgataattcgctgtcgcttatcgttttccaaaaaagaaacaacgaattgaaaaaagagaaaaggggcggacggaggaggaaattcataaattaattacaaaattaaattgtaaaattacccttaaattttgggcaaaactctcataaatcacagagagaggaaaggaaaaggacagtcgttttttaactttcctctcaaatcaattaattcccttctcagttgttttaatttaactttacgaattcggggctattatttttccaaaaaatgtaaaaagagcagaaaattgccaaataatcacttaaatgggataaatggaatagaaaaggggcaaaataaaataaaaaaaaaccgaataaatatatttaatttgattatttttaattatttgattcttcaaaactaaacaaaataataattattatattaattatgacttcggacaatcggacgctcactttgacgctgaccaatgaaagcattgttcacttttggattcaccccgtcacgccgggcgatgtcagtcaaacggaatgaccacagtacctttggaattgactgacaatttgttggatacggtgttaacctaaggctgatcagtggtgatcagcgatcgttaatttttatgatttgacttgggtttaaccaaaatttgagcgtactttctgcgttcttctgactgacagtttaagacattaattttggatttaaaatttgacgaatgaaaaaaatattccaaaaatgtgacatattcaagaaaaactgttgccatttttgtcttatttctcagattgccaaagtgtttttgtgcccttctgcaaacgatggcctccaacagcagcaacaacaggtggccgaatgtgccaaatattcaagcgatcggtggtacgaatttttcgaaattaacggcgcagcggcgggcgaatatttgctgcgatggacggagcacacgaaactgtcgttggtttatgtgtacgaaccgaaaacggtgggtcaatttggagaaattggaataaatgacaaaattgtacatatgaatcattcatgaacagcctttagggctaacagagagtcgaaatttccgaaactcttgagaagccctcttatctattgtctgatgttggcattttcggctttattaatttgttcgtcttcggcttttcaggttttagaggaaggcattcgcattattttcgtcaatgaaaatgccaaattgccctccctcgggggaagttaccatttccgggctccattcggtaatttgctctgagattaatttaaacaaattaatttatttataattttacttttgaggttggaccagcgacccgtcgggctttgtgaggtccaaagatgggcttttccatttgttttatcagcactatccccacgccaagcaatagtaaggaaagagttggttttctatttaattaaatttactccattcacaaatcagttatttgatccattggggccacgccgtcagcaaagatttggtcaattgggtccatttgccaattttcatgatcccaccaaatgtgttgcacttggacttcgaagttggctatttcgtcggttcggttgtcaatttgcccagtgatgattttggcattttttggacccaacgaattcgtaagtgtttttggaataactaattaggttaattatgtgatctgaccaacaacaacaactgttgattttagctcttgttcttcgagggactgaatcagaaaacccatggagagaaaatcaaaattttgtgtcaacaaaagtgagttttattttttaaatttagttgttataatttatatttaggatttaatccatcctgattggcacacgcacaaaatcgtgctcgaccaaagtccatctgaagaattcccttcact

SEQ ID NO: 19267 - DNA, 1414 bp, Heterodera glycines
  misc_feature (18)..(18): n is a, c, g, or t
  misc_feature (27)..(28): n is a, c, g, or t
  misc_feature (65)..(65): n is a, c, g, or t
tttataatgaatgctcancctcttttnntattatcgagtcaaaattcggacttcagcagcacgcncaataatggtctgttttgttcaggttattattacatgagtgttggaggcgagcggaaggacggctccgcgggcgttgtgctgttgtacagaaacgaaagtaaagagcgggaccgactcgacaatgactgggcttatcaggtggcggagggggggaggagtggaaatagaggaaaagcattgaaaatgggggaaaagcgaagcggcaatggcaacattgaaactgcagggcattttgtgggaggacagccgggacagaatgtgcgaattgccaatgctaattgccttgggcgacccgctcgactcaaacacgaaatggctgctgtcgtacatgctggacaaggggtcgtacacaatgtgcgcgagagacgccgaaggaaggtgatggattagttggctcatctgtttaaagggggatctcaagatttgaaaaattcatcaaaccattcccgtaagataattaccgcatgaaattctcgatgttcaattaaaaatgagttggcagttaaaagccccattcccgaaagttcggtccccattaagcccatttcgatttccttgtcccaatttcaacacaacatctgctgatgctttctgccttttagagaacgtttgaatcctttgcttgttggacattttgacgggaaaaactttcaaaaactctttgaacaagaaatggactttgctcgtgcctcttttgcttatcaggtgtttttggcatttggattttccgatttttccactttttcccctttaagggtttctatgacaaacaatcggccagaaatttcctcatcggatggatctttgactacgacatgagaaccataacaaatgatgccttaatttctgttggcagagccggcattttatcgcttacagtgccgaaggcattttaattaacaaaaaatgaaatttaattgttttttaggaattggttttgtctgaaaatgaacaatttttgctggtcaaaccattgcccgaattaaattcccttcgtatggcaaagaaaccgcagaatttaaagtgaaaactaacaaattggcattaaaacaatgaaaactttaaagaaaaggccgaaaagtccatttggagatgggccaagtcgaacttttcttccaattcaaatgggcaaatgatggcaccgaagagaaattcgaattggacttaatgccaacgcatttaaaaggcgaaaaattggaattccgggttgaccacaacggcattgagctgaagaaaacctggtaattgtctttgattaaataaaattcaaatattaatcgcacaaattaattaattaattgccattaattaccctcgagggagaaaacggacaaaaagcggatgttgg

SEQ ID NO: 19268 - DNA, 1696 bp, Heterodera glycines
attttcaatagcgcttattttttgctaatttcacctaattgccattctctttaaattaggttcgagtggagcgacagaaggaaattgtgaacagattgaacaagacgaaggtcgtgaagaaggacatcgattttcaagagcttcgggagcaaagggacgccgaggaaagacgaaaattggcaagtttttcaagcatcaaaatctaatggaatttcatatttatagtacgctgtgtttgactttggtttacaggaaaaaattgaaccaaattttgcaaaattcggccaaaatttgttattcaaacggcacaaaaccaaccctaaaaaacataacttaaaaaaatgacaattaatgcaatataaatatggcgcactatcgccaccttataaatcgcattaaaatcaaacatttttcatccagaaagagcaacaaagggcggaccgaaaacagacggaggccgaaactgaaaggcgagagagggagaaggaggcgctgagctatgaacgcgtgttcaaagaggagaggggcacaacgaacaaagacggggtcgacttggaggatgattttatgtgaaagaaaggggaaaaatcgggaaaatgatgaaacgaaacaacaaacggtcgtcgaattttgttgaaacataattattttgttattaaatgaaaggacgacgggcagccaatcgttttttggccttcttaacagagttctcttttgtttttttgaaaaaaaaagacagatagagagagagagtgagtgaagagagatggagagagagagagagagtgaagagagactgacagagagagagagagtgagtgaagagagagaggagagaaaaagacagagagagagtgagtgaagagagactgacagagagagagagaaagaaaaagacagagagagtgagtgaagagagagaggagagaaaaagaaagagagtgaggcagagagagagagtgagtgagagacaacagagagagagagagacaaaagagagagagagacaaaaataaacttacttatttacactgggagcccaaaatattgaatcgccgtgttgatatgcaaattttggtggatttaatatcggtaaaaaaaaagcttattacccccccccccccccactgcgtgatttctcattgtaattttttcgtattgccatatttgcacttttcgtatgtttatactagagtgcagcgggaccgggacctaaacacggacaactgagtaccgaagtcccggttttgaccgggactagttccggttttcccagccaaaaattcccgggttttcaacccgaaaaggtcccggttaaacccaaaattcccggtcctgctgcactcttagtttatacctaattcccgaggctttgtgctttcgtttcatcccaagaaagtaggcattgaccaagtaagaaaagattggcgctatctctatatgcaaaatgaatatttttgaattttattaaaaaccaaggggggaggaccctttgatttgcaaaaattgaccagtttagcgaatccctaacgccctaactcgaacaaaaatcggaatttaagatttctcatgtttttttttgtccaaattatattaggaagacggaattggttaaaaaagatgtcaaattcggatcaaggacaccaaaacgcctagtgaacaagtttccattactaattactagataatatggtac

SEQ ID NO: 19269 - DNA, 871 bp, Heterodera glycines
ctataacttttttcttttgcatccaaatccaaccttgttggtatcattcgaaagctcttcagatgctctattagcctttcaaaaaacctaaaaattttctagcctggaaaaaatttactaagaaaaaacttcaaaatttcgactttttcgcaattttcatgtataactttttggtaatgtctaatcgcgaagcgatagcttagaaatagcttcgaaacatgttaagctttcgaatgataccaacaatgttggatttggatgaaaaagaaataagttatagacaaaaacataaaatatttttgaaaatctgtacacagataacatataagtaccgataatattttgcaaaaaaaaaaaaaaaaatttcatatacctagtgccaaaaaagtatggcctaagaaactgaggatgaccattgtttggatgtttggatgcgattgaattacctaacttattattatgtacttaattctcaatccatttttagaatatttctgccattttttttcttgacaccacacagcaccaatgcaacaatttcaggactggttcagaggcacaacaacaacattcagccaaaaggccgatgaaaacgactctgagatagaggttattaattttgtatatctaatgggctggcattatgtaagaggttttcgggtcatccagggtcacttaacgaaattgcacataacactcacttagactaatcttgaacttaacggatccgaatcgggacaaaaaatcgaacctgagcaggtcgttcttccccctccctccttttgattctcaaaaataaacacggaaattttggcgctagttaaaaagtcaccacttttgaaaaaattttcaaacgttttttttgtaaatt

SEQ ID NO: 19270 - DNA, 900 bp, Heterodera glycines
atggattgctctcccgatatttctatctgtgcctctatgaaatcgtactgacgaatgttttttttgaaaactttttgcccaacggaaaaaatgcattattcttcccaacctaccattttttaaacttaaaacatgcgtcttttttgactgagtcaggcataataccctttcattaccgggagatgagtgatcatcttaccttacctcccacctgtctaaatattaattttatgccttaccataatatttgtctgaattcaatttatgcataaaaaataattttggtgaaccttttaatccccacgtgctatgtacagctgctactctatcttgcaataaaagcctgaagtctctgaacactattattattaagtttatttgtcatatctctacatctgatataaccagatcatgcgtatatcccatatttgataactctcggagaacaaaatgggaatcatatcttttttttggttttttcacaaattataaaaaaaaatttttaggtcccggtagggcaaccgggaaccgggaaaaacaagcactggtaagaatggggggtctgagtgaaaaattagtgatgaaaattggagttaaagagaaaaaattaagaaataatcatatatatattctttcaaagaaacaataccaatgtgcaaatggcctagtggctaatctccttgactttcccttcatctttcccatggtcaattcctctacagaaattaaaatattttgaattttctttttgtatactcatggctttcctatcgacaaaatatgattctccatttttttaattgtattttatcattttttaaagaaaatcgtacaaattgagcctagtaatcccaaaatccaggcttttttgttgaaaatctggtaacaattctcactcaa

SEQ ID NO: 19271 - DNA, 974 bp, Heterodera glycines
  misc_feature (962)..(962): n is a, c, g, or t
gacgtataaaataattttttgaattaatgaaaatatgaacagatttcctgagtagttgccttaagttcaatatttgaaatatttcatattttttttgcattggacttcaaaattaaagtgacctaccaccgttaggggcctattcgtaaaactcttattttaaaaatacttgaaaaaaatcaatgaaattttcaaaaaacgctaaaattcagaaatgagaaattccatttttctgctcatttagctgtttagtatttctcaaacaaattatcttcataatgcaaacgcagtgacagtgtatttcccggaatacatttttgagagaacagcgacgaaagtagagaagggcaaacttaaaggaaaactttatttggaatttgagagtaatttttttaaccaaaacgcggatgatcaaaaaacatatttctcttttaaaaatggctagattaaggtaagcaatcactataaactgaaaatcatttattcattttttttgaaagatctaagttttttttacaaattgaactcagtcatttaaattcctttttcagtgtcaacttcaagtgtcagatttgcgtaaaaatggtcgagatctcgaagactacatgaccaagccataaattgtacgaaaagcatgcatttgatccgtttttgaatatgtactttttgaattattgagaaaatcttttttttatttcatagtttattaaaaaaatgttgctattctagagtatcgctataatgaatgaatccgaaggaatttttcgaggtcgaccatttcttaatgagttacagatccggtactgaagtggccaaatagctttgggactgaaccgtccaaccgataaaaacgcttgaatggtcagcaaataaaacattttttacctcaaaaatgtgccgggcttgtttattgcacgaaaatgcacaataaggtatttacttatatggttcgtacgccacanaattaaaatttt

SEQ ID NO: 19272 - DNA, 1677 bp, Heterodera glycines
atgaaaattatgcaaaaagggtggattaattttccagtaattttctgatgaattggccaataaaaaaagtatttgttttttatctgtgccacaatctttgcaccaaaatgtgtggtcgttcgtccgcttttacttctgctggtggcttttcgcttttcccccatttttttgtccccaattttccatcacttcttttccatcgacggattgcgtccacaacaccaacaaaatcgcacgtcgccacagaaattcagtgattggtccaactatttattccacccatcaatccattccatcatctattcgatcgcacattccattttcatttaatcatttggggtaaaatatttttacatattatctatcattaataaaaataaatggacattttccttaaaaattgaaaaaatttcccgtgaccagtgaatttatcactttttttatcttaatttcagtccaacctctcataagaaattctcggctcggttctcgagttttgtaaaatttatgggacataatcgatggtttaattatgataaattgcctatgacttattcaaatcttttcaactcttagaaaatttaatcaataaattttataattataaaaattacaagctttgtatagataaaattgttaatataaattatgtctgtgcttcatcttctgctgctccttgcgcttcaatttgactttggtgaccaaagtgagcgcattttacgcggaaaattcagcatgaaatttatgtgcggcaaaactttgcccgccacaggccgacttcagatgaaattcattgccaaaactgtggtaattaattaaataaaatggtttaatttttcatattcatttaaatctccttggaaaaggaggctttatttgaaggggaatggaagatagagcgaaaggatttctttttaacccctcgggatggataatggattgctgatttacgttttacttttcaatcccttgggaagggggtaagggattttgcctatatcagtgatgccgcgggttgagaaaaatttcgggttcgggtttcgggtcgggcactcaaaaaatttcgggttcgggtttcgggttgagaaaaacctcgggtttcgggtatcgggtttgggttgacatcactggcctatatggttatatctagagtgccacgggaccgggaattttgggcaaacccgggaccgggaccttttcgggttgaaaaaccgggaatttttggctgggaaaaccgggaaaaaaccgggactagtcccggtcccggtcaaaaccgggaccttggtactcagttgtactcagttgtccgctaccaggtcccggtcccgttgcgctctagttatatcagaggaaattagaaaatcttttttttttaaatttaagttagtgaaacgtgaatcgatcatttttgacactgtgttggactgggaagatggaggagaatttgttcaaaatgtcacttccaaagttgaggttatgcaggccaccggctacgaatttcagctcaaacttcgcacaaattgcttcattttgaacaaaattggcgaggtaaaggcaaaattttaattaattttaaaataataattattataatcagagaagacaaatttcaatttgttttttaatttttctagttttttcctgaaaaaatttgctttaatttttttgtacgtttag

SEQ ID NO: 19273 - DNA, 2901 bp, Heterodera glycines
ctctacaattttgccctaaggcaatttttggctagaaccaacccccgacgagttatgggcccgggactcaaatgtcccgcttaggccaaaaaatttttctatttcctggaaaaaatcgaaaattttctaaaaacatcactaatcgatagagctcgaaaaactatgttttggaagtggtctccgtttctctgggaaaaatcgttaaaaaatcttaaaattcaaaaacccaaaaaccgttttttaggcctaactcgaaaaattttgaaaattatcgaaattttaaaatttggaaaaatcgagctcattgagctctacaataagtccgctggcgaccccctgctccgagcaaacccttacgagctattcgcctggtactgaagtgtccaaaaaaagtgattcttacgttgcctaacctacaggtcaggcctttgatctgatcaaaaattttttgctggcaaagttgtaggccatagttggggcatttcgcttttggggtccgctaagctctgaaagcaaaagcaaaaaatttcgtaacactgagactggcggcaaagtcggtttttgagccgctggtactcagttggcccttggaccggaaaacctatatttttcccggatgcgcctcaaaaagttgtaagacccttccactactttcagggcgctcccggccttcggccgggagattttgtttttgcaaacgaaactccttgtcaatataacgtatatactagcgggtgcgtgaaccgtcggctatttagctgggaaaaagcgcttcgcgctttgggagcttcgctacctagattaactctggttgtggagattttgaatttttaaaaaattatctgggacttttaggccgcttcgcggcatcgaacgggcgcttcacgcccgttttttaaatttttgttgggcttatacgggcgctttgcgcccgtttctaaatttgtttggctattaaggcagcttcgagacctcagacgggcgcttcgcgcccattttttagcttgttaggccgcttcgcggcctcagtcgggcgcttcgcgccggtttttcaatttttgttggccttgaacgggcgcttcgcgcccgttttttaaatccgttgaactcatacgggcgcttcgcgcctgttttttagcttgttaggccgcttcgcgtcctcagtcgggcgcttcgcccggtttttcaatttttgttggccttgaacgggcgcttcgcgcccgttttttaaattcgttgaactcatacgggcgcttcgcgcccgttttttaaattttgaggtacaacagcgattagaagagtgattagaagaggtacagcagtgattagaagaggtacaacagtgattagaagaggtacaacagtgattagaagaggtacaactgtgattaaaagaggtacaacagtgattagaagaagtacaacagtgattagaagaggtacagcagtgattagaagaggtacaacagtgatcagaagaggtacaaaagtgattagaagaggtacaacagtgatagaagaggtacaacagtgattagaagaggtacaactgtgattagaagaggtacaacggtgattagaagaggtacagcagtgattagaagaggtacaacagtgattagaagaggtacaaaaatgatcagaagaggtacaacagtgattaaaaagaggtacaacagtgattagaagaggtacaacagtgatcagaagaggtacaacagtgattaaaaagaggtacaacagtgattaaaagaggtacaacagtgattagaagaggtcaaaagtgattagaagagttacaaaaatgattagaagaggtactaaaatgattataaaaggtacgacggtgattagaagaggtacaaaaattgaatgcaatttattataaattttaaaaaataaaattaattattccttttattaattaaaaagagaattttgaaatgtacaagaatttgatatttaaattaatatgaaattaatttttataaattcaatttaaaaaaaatatgaaattctatattaaaagataattattattagggcagcaacttttagtgacgaaaaatcccgaaatagttaactaaaatagtgacgaaaaagtgccaaaatagtgacaaaatagtgaaaaaagtccaaaatagtgacgaatagtgacataattttcagccaaaaattgagcaaaaataatttttattcactgattgcagttgcaaatgagtaggactgggatttttaagaccaaaaaacccaaaatagttacctaaaaaaatttttaaaattaaaaatttttgccaagaaagtaaatttttgagaaaattttttttcatttcataggagtatattttgaaaaataacaaatctttaaatataaattaaacgcactgaaaaataacccaaaaatgcatagaaaaataatgtacaccgcccggatcgaacctgcgccccccccccccccccagaagatgactcagaatccccaatcacacagggattctgaggtcttaacgatgtcagaagtaaaatctgatcatgtattcgtgatcagcggcccaaataacccctaaagacatatttttggaagatttttgtgagaaaaatttttccactcaaaaatcctgtccaccccctttggtcccgaaccccaaaatcacttttatttttgtatcttattttaaaaaggtgataaaaatgtaaaataaattttatttaatagagcaaaaaattgcggatttttgtagtattttacttttacagaatgaattttcagaaccgagttctgaatttttttctgaaaattcggatttttccagaaattcttgaataactttttttcatttccagatataaatttcaattaaatcccaataaaattctcctgattttttctctatttttaag

SEQ ID NO: 19274 - DNA, 2065 bp, Heterodera glycines
tccattggcaaagtccgtccgataggaaagtaaaaggagcccataattgatttggcagacaagaactgaaattagaagaaattttgaaaaagaataacaaattggaaataaatatgcttaatagtctcaaaatctgttctcttaaagaactcacatctcgccgcgcgttcaatggcatttgggtcttcgtagtcgacacgttcggcaagtactcgttccaattttttgttgaatatttcgagggatgtcatgccgcgcaagtccatcccctcaacaccgaagtcgaaatcgactcgaaatcttatcgcaatcacatcgaatatggtcgacaggttacgatcgaacaatttcccggtcactttcgacagttcgctgttggctgttgtcagcaattgtttctgaaatttatggcattttttaaatctccgagggcattaattatcatccgtactttctgtgcaatttttatttgaagtgcaaattctgtcttcatccaaacacattggatttttaaaacgaaatggtcaaatgccaatgccacgcggtcggtggcccatcgaagccgaaaagggagggaatggcaaatttcaaaaagcaattcggcagggattcgttttttggacatttccaattttcaggcaaaaaatgggcaaagaaatgagtgaccatttgttgagggaacactaaatgtgcctacaaattggacctcaccggagacaaacataatttttatggcacataaaatggaaaattttaacagtgggcgattggaatattaaggcctcgaagggactgtcattttcgtgtttgaggatcaccatgaaggagtgatctgatcaattcgcgtacatttttggactttttaatcagttaacttttgagtgtactgtatgctttgcatacagtaaatcactaacatttcaataataataatatttttttggaatgtttgttattttaatttttatggcttgagtcaacgtagaaggctcaaaccaagtggaatttttatgcttttgcttttgagtcaacggatggataatccacacaaacggcaaaatttaatcagaaattttacggatttaagtttttttcattaaaatactaaaaaaaattgtgaatttttttgaatgtaaaaatcagttttatcacttgtcgatcaaatctctcaatttttatgcaaaatgttaatattgtacaaaataataaaaattagtacaaataaatatttttaaaatttaatgacatataaacaacagaaaattcatcaacaacaacaacaaaaaatcgaaaagcaaatataaaattttttggaatagagcaatatcaaaatcctttaaaatttttgaacaattttttaaaataattaatcatccatcattcattactcgtccatcccttctgctccgatcagttcaccattgaactctcgtcattttcgttttcgttgtcgttggttgcactgctgttgtccttgttgttgctgctggtggtggttgtcctccaactccaagccgaacactctctgcgcatttgccgtcgtcgcattggccaattcgtgcgccggacagtccatgaaggcagcaaccagctcacaaatggcggccaacgagctgggctcgttgcgcttgaagtcggagtgtttgtgcagggcaagggcctgaaaattatgcaaaaaaataggggaaattttttaaaatcattagaactaatgatttctaatttcaagggcagtaaacagctcgttctctccgtcaggcccgtagccaggggaaaagtgtgggagaactcccccctaaaaaatcgagtccaacccggacaccaaattctcgattatttggtagttcaaatagttttcccgcgactgtccattttttaattcgttttttccctattttctgatcccaaaattgtcgctttgttgctgctggtcatcaatcaaactgacttcggtgctgatccgttgccgaatgtcaatgtctttgcgcaattttttgtcctccaaattcgggtacatgtacggcgcgtccgtttccaacaaaaggcgatccattcgaatggtccg

SEQ ID NO: 19275 - DNA, 2404 bp, Heterodera glycines
  misc_feature (2397)..(2398): n is a, c, g, or t
tttcttaaaaactgccactatgggcgtttcttaaaaactgccactatgggcgtttcttaaaaactgccactatgggcgtttcttaaaaactgccaagtgggcgtttcttaaaaactgccaagtgggcgtttcttaaaaactgccaccatgggcgtttcttaaaaactgccactatgggcgtttcttaaaaactgccactatgggcgtttcttaaaaactgccactatgggcgtttcttaaaaactgccactatgggcgtttcttaaaaactgccaagtgggcgtttcttaaaaactgccaagtgggcgtttcttaaaaactgccaagtgggcgtttcttaaaaactgccactatgggcgtttcttaaaaactgccactatgggcgtttcttaaaaactgccactatgggcgtttcttaaaaactgccactatgggcgtttcttaaaaactgccaagtgggcgtttcttaaaaactgccaagtgggcgtttcttaaaaactgccaccatgggcgtttcttaaaaactgccactatgggcgtttcttaaaaactgccaccatgggcgtttcttaaaaactgccaagtgggcgtttcttaaaaactgccaagtgggcgtttcttaaaaactgcaaaacaaatatatttatttattaaaaaatgtttatgtcagttgtttgccaacgttataaataataaaaatatatatacatataatttttacatcatttgtttgtcaacactatcttcaacaccaagctcagtaaaattaaaatattaataaatttattgcttctgatgattgtagttaataaaatttacaaatgagctcaacgatatatttaatattttttcttttcttgtgctgtttaaaaaatgtcttttaggtgataaaaagtcgctgaaaatcgaaaattgttcggacaaaatgctgttttttggcttatctcgtcatagaagagcgtacaatcgcagaaaaaaacaaatgaataaagacgattcttctgacccattcaacgtgcccgaaaaattacagatgactaaacgtggagcaataaaattaattcttaggaaaaaacttactagtaatgatatgtaagaattcttttttttaataagctattcgaaatttggatacaggtggctcagattccgagaaaatgaaataggtgttatgctttttataacacctacccagaaaaatgctgcaagtcactgtaaagtgttggtttcagacggaaccttcgaattggcacctttgagtttccaacaaatttggacaatacatggattagttagttttgactatggattggttcttctgaatttaatttaagattgaaacggctaatggggctgaatggacgccgctattgatggctctgatgatgagacggttaagaaaaaaaaactggatttataaatattgttcccaagctcagaacacaatcagcatatgaaacaattcttacaaaaactacagaaatatggggagaagaaattttaatgggtttactagaattcatagtgattatgaaactgctgaagttaatgcacttacgaaaatatttggagcaaacaaggtctatggatgtatcgtacacttcattcgagctgtagttcatcacattaaatcaagttttcaaaatttattccgtgaatttaatgaacgaaaggatgtttggaaatgggtaaaatatacaaataatatacatatattctcatattttgttagattcgcagactttttgcccttccatttcttcgtaaagaagaaatgataaaaatgtggccaaatctgataaatttcagaaatgattttgagggggtgcttagagaggaaatggattcgtttgtagcttatatgaataatcaatggattaaaaaaattggacagggcaatctattttcttttaataaactaactagaactcggtcgacaaaccctgtcgaagcgtggcacagcgtaattaaacggtatcttttgatgaaaaattaaaattaaattaaataatagcgaccacgcgagcgtaagacatgcgtctttgccaagtgttctgaattattttcaaaaaatttttgctgaaagtgatgaacgagtagtgaacattatcgctggagcaaatcccagaccaatggacaaaacttatgaggagattgataataaaataataacatccttgaaagaatatgaggtttttaaccaatttctataatgaaccgacaagaactcttaaggaaatgattgataaaggcgaagttactgatgatgatttttcacagacaacccaaacatatttaaatcggttatcttatgtattgttgcaatttgatagtcaaggaatttcaacgcggagggaccataaaattaaagaggtttattgattttctccttgaccnntgcagg

SEQ ID NO: 19276 - DNA, 1418 bp, Heterodera glycines
gatcatcagtctgaagaatcccaaccacattttcggaatgatagcgccgaccctaattttttccgaatttctttctgggcgagtttgatgtcgaaaattttggaaaaacgcctatctctttttctgatcatcagtctgaagaattccaaccacattttcggaatgatagcgccgaccttaattttttccgaatttctttctgggcgagtttgatgtcgaaaattttggaaaaacgcctatctctttttctgatcatcagtctgaagaattccaaccacattttcggaatgatagcgccgaccctaattttttccgaatttctttctgggcgagtttgatgtcgaaaattttggaaaaacgcctatctctttttctgatcatcagtctgaagaattccaaccacattttccgaatgatagcgccgaccctaattttttccgaatttctttctgggcgagtttgatgtcgaaaattttggaaaaacgcctatctctttttctgatcatcagtctgaagaattccaaccacattttcggaatgatagcgccgaccctaattttttccgaatttctttctgggcgagtttgatgtcgaaaattttggaaaaacgcctatctctttttctgatcatcagtctgaagaattccaaccacattttcggaatgatagcgccgaccctaattttttccgaatttctttctgggcgagtttgatgtcgaaaattttggaaaaacgcctatctctttttctgatcatcagtctgaagaattccaaccacattttcggaatgatagcgccgaccctaattttttccgaatttctttctgggcgagtttgatgtcgaaaattttggaaaaacgcctatctctttttctgatcatcagtctgaagaattccaaccacattttcggaatgatagcgccgaccctaattttttccgaatttctttctgggcgagtttgatgtcgaaaattttggaaaaacgcctatctctttttctgatcatcagtctgaagaattccaaccacattttccgaatgatagcgccgaccctaattttttccgaatttctttctgggcgagtttgatgtcgaaaattttggaaaaacgcctatctctttttctgatcatcagtctgaagaattccaaccacattttcggaatgatagcgccgaccctaattttttccgaatttctttctgggtgagtttgatgtcgaaaattttggaaaaacgcctatctctttttctgatcatcagtctgaagaattccaaccacattttcggaatgatagcgccgaccctaattttttccgaatttctttctgggtgagtttgatgtcgaaaattttggaaaaacgcctatctctttttctgaacagcagtctgaagaattccaaccacattttcggaatgata

SEQ ID NO: 19277 - DNA, 2334 bp, Heterodera glycines
atcaccaaatgtcgcgtcgcctaagttccaaatccccaaaagttgcaccacggaaaaatttagcttttttgaaaatcatgtcagaaatttgtctagtatttcgttttcaaaagtggtgtaacttgttctttaggaaaggtccaaaatatgatccctagtgaagaattgacgtttcttcaagtccggttttttcatatccagctggactcgatgccctttacatttttatgtttatttttttttctctttttcatcaaattaataaagatactattaatttagatacgcttaaaaaagttaacaatttagcatctgttttggggcccatttcccattatgtttttcttaataaattaacgaagaatgggcaaaccttagcattttcctcctcattcatccttcctatctgtaatgactcctaaccatcattaaaaatattccttagtgcggaaaatcataaaaccggtttttgaactggttcgaaactcgaaaaatggagagaatttggcacttcaaaactttttaaaacaatcgaactatgacaatttagtatcattcaaaagctcttggcgagctaaatctaaaaaaggggggatgaagccgaactggaaaatccaggaaaatacaggctcctcgaggcctgactccaggcctgggtcggttccagctcgaactctatcatattaatatcatgacgagtacctgtcgagggtattttgctaaaaatttgattaataaaacataatattttaattaaagaaaatcgtaaaaataataatttttcaagcttttcctcatgaaaaaataagtaggttttcacacgattattttttatttttgcttctttataaatttttatttccagcaaaaatttttttgttaataaaaaaatagatctgctgattcatcaacgtcaatatatatgcattaatatattgattatgagatatcaaatatagatctggcttcaccaattttaatatatatccatttgctaagcattattaatgatattgaatacaattttttgctttttctcattattttaaataaaattttattaaaaagcaaagattattcacaaaatttaagaaatatgaatccaatttctgacaaaaagatgcgtcgtcctttctccaaatgctccgtttgctgtaggaaatgcaaatatttttattatggcgccaaatgttgcgaaggtaaaattaataaattatggaaaaaaagattctttagcgaaataggcttatcgtaaagctcttttataccccatgggggtatttttcaactccctcagagactgggggataattagagacagtgaggaaaaatgtcaaaatagtgacaaaaaatccgaaataatgacgaattgtgtcataatttcagccaaaaattgagcaaaactaattttatcactgatttcagatgcaaattaggtactatttttctaatattttattagcaaatattgactttttaaatcaaaaatttttcaagaaaagaaattcgggggatgatatcattcaaaaccttaacagttctcatttagcctgcaaaatttcaaaaatttgtaatcgtccaaagtatcggattatacaagcaaaaataaaataaaatcgccaagaaaaaatataaaatgaggtcaaagtcaaagagatcacaattaccaaatcacttagaaattttaaatattctgtaatatgtagttttttgttgaaaatttccatttgatggttttttagaataacgccctttttgttgtttttttatatgtaacacattcattaaataaaaaatataattttactttagcttataatataaatttaaaaattcgaaattgcataaatataaaattttgaaaatcaaattttttttgcaattgtccaaaaaaggctccttagccattgttttggtatttttaaagtcaattctatatttttactcaatttttggcatttcctgaggttaaaagaacattttttcagtttttatgtcatattttagtgcatatttgggcatttttcggatttttagggaaatttgaaggatttttagtgcatataattttatagcaatactatttattaatttagaattattaatttttattaaaattttataaatatttttttgaaaaataaaattccatttatccctctgggggacaattggagactgggagattaatggatatggggataccaagagcatttacagtaattaattaattaatgctcataaattggctttttgttcatgtttcagcctgcaaacactttttccgccgttcggttttgttgctgaaggatttcaaatgcaaaaatggggaaa

SEQ ID NO: 19278 - DNA, 1841 bp, Heterodera glycines
cggagaaagtctatagaatttattatcttttaagcattttgccgaaagcgaacgtcttttttcagcggcgggattgatcataaatgtcttgagaaaacgcttgacgcccaaaaatgctgaaatgttattgtttttgctagagcccgacgggatcgggactcacgcggggtttttacggggttcccggtcccgcttttttcggtgaacggggaatttttacgggagcggttatttttggacaaaacaaaatctgacaatgtattgtattcaaattttttccaggcggcgcctatcggcaccgcatgcctccctcctcctcctttgtcccaaaaaagttttttcgaaaaatacgccgcaaaagctgttaaaattaataaagggattcgaaaatactaatttaataaactttttgttcgaataaattttaaaaaataatttatttgaagcaatttgaaaaaattttccgattttcgaccccaaaatctaaaatttcgccttttcgctttcgccttctcacttccgctttttatttttatttttacacatccctgccaccagtcactagttgacaaaaatattctttgacgcaaaagccagttttttcgctttggtgatgaaattttaaaaggtattcggattcctccttccaaatttttttctggctacgggtctaaattagggaatagaaggtttagatgacaaaacaaaaatgacggaataaaaaaaaaaaccaaaactttttataatttttattacaataaaatagaatggctgtataattatgttacaataatttaactacagaaagacatgattgatgaattggacaagaaaagcggaacagaatgcaaaaacaaagaagtgtattgtttttgtgtaccgttgcactttgatcaaataatcagaggaatgtgctgcgacagcaacaaaaagtgcgagtgttgtaagacggtaagcattctgttttaaacgaaaatcagcataaataaaataattatttatttgcaccccgagacccaaaagatttgggaccgtaaatttgtcatcaaaaatttaaaaattttctggatcagcagccacagcaatcggtgaaaaacatcccaaaacaaaaatttgtaaagtattttacaaaaattttcgtattcgaacatttttggtcatacctcgcgggtctttgacacttagccgcccgttttattaatattttcattgtatataatgtttttaggatccggaaataaaaaaaaggccacaggtaaaaatcgttgttgtttttctattaatttaaaccaataaaagttgctaactacgaagactgtgtcggatgcatgctataaccagagttttgccctctacttcacagggtccgtgctataagaactcgctgccccacaaaatttccaggccacgaaatgtcctggccacaaatctaagcttttttcttatttgggtgtgtacagagttaggcaagggccaatataaaggttatgttcgtattcagcgaaccgaaaaccctaaattagactcttagaactcattttgtttttaagagttttttcaaactttggacatttcgtggttttttactcttgtggaaagttggtggtcatttaaccatgactatgacacgcatttttacctgtgctataagaaggtagttcatgctcatttgacgggagttggtggttaaaaaagttatcacccatacccataattgcaatatttaccattagcattttgagacggaaatttatgagatttatcgaaatgttattttaaaaccactttttaaatcaaaactagacaaaaaaattttgagagacaacgaatttttacgaaaa

SEQ ID NO: 19279 - DNA, 1376 bp, Heterodera glycines
ttttttgagccaattttaaaccttttttaaaatttttttaaaaaaaaacgaattgaaaaataaattttacccctttaattgggcaaacgaatccccccttttcccataaatagaagaaaaaataaaaattttaatgcaaaatttaacacaaaattgcatgtggtcaaattacccgatagaataggaacattatagttcatggtcgtttgacggaggttggtagtctaaacggcactgaaggtcattttcttatagtacgggtttaccatcaactttgtggtcatttgaccaggtcaaacgcggtcatttaaccattttcttatagtacgggccgaatgcgcagatcagtttgtgttttgtcggaaggatgggaggcatcggcttgttgccccaaaaattaccaacttgtggaccttgacgacagatatgacgaaagattaattcctttgggtctttgggtatgttttaatgtgaaatttgcgaaatcaataagtctattgaatttaatgatattcatcttgaaattttgcttttttaggtattttaacaataaagtattttagtagatcggatttttagattttttatcacattttctccgaacttcttagcatctaaaaacacctaaaacggtggttagcataatttttttttgtcatattcgggctttagcatctatttgggctttttcctgaaatttcaatgcaataaaacaaaaatacaccccctaagaatcggtcccaaaaaatttaataaaatatcccctaagaaataaaaaattttccaaaaaattcgttcgtttctccaaaattgatttatctattttcttgacaatttttgatggtgcaggcaaaattgtattaccttttcagtgtttttagcaacctaaaaattcgattttctattaattattttaaaattattatttagcttgctgcggaaccagaacttacatcagtaagctcctttaaagttttgtattttgatataaggaactaataaaaaatatatacacctttgtagaaaaaattataaagaaccaaattattaagttctatttttcatatgtgctaataattgttttgaaaaattcccaaaaaaggctgtgcaaggaatgaatcaccgacaccctctttgccccaagcagctgccatggattcatccattggtttgcgcttttgagtggtattttgtaagtttttcattgatacatataaatagggcagacaaaaaatatgcacatgcaattttttttttctgaactgccagagagctgaaatgcacgaaaaatatgtttttagcttcgtttgaagcttctaggaaacacttccatatgaatgtttgtgtatattttaggtgcatatttaggcattttt

SEQ ID NO: 19280 - DNA, 985 bp, Heterodera glycines
  misc_feature (492)..(492): n is a, c, g, or t
  misc_feature (494)..(494): n is a, c, g, or t
  misc_feature (521)..(521): n is a, c, g, or t
  misc_feature (532)..(532): n is a, c, g, or t
  misc_feature (547)..(547): n is a, c, g, or t
  misc_feature (553)..(553): n is a, c, g, or t
  misc_feature (558)..(558): n is a, c, g, or t
  misc_feature (579)..(579): n is a, c, g, or t
  misc_feature (581)..(581): n is a, c, g, or t
  misc_feature (584)..(584): n is a, c, g, or t
  misc_feature (588)..(588): n is a, c, g, or t
  misc_feature (604)..(605): n is a, c, g, or t
  misc_feature (611)..(611): n is a, c, g, or t
  misc_feature (628)..(628): n is a, c, g, or t
  misc_feature (658)..(658): n is a, c, g, or t
  misc_feature (688)..(688): n is a, c, g, or t
  misc_feature (696)..(696): n is a, c, g, or t
  misc_feature (707)..(707): n is a, c, g, or t
  misc_feature (731)..(731): n is a, c, g, or t
tatccaaaaaaatattaaaaatttgaaacctttacaaatatctcaactgagattttttgaaatttttttgttcaaaaatattttttgaagaaactaataaagtgttaatataaattgacatcttgggccaaatattcgatatttagttggcggtaattcctattaagaaaattccttttcaaaaaaaaaaatccaggaatccagaaaactaaaatgtatacccttaataggtggaatctaataaaatcattaacattaaaattaatttttggccaaattttgcgattttaaagcttttaggggttttatgtggttaatcaatatcgtaatatcgacccgatatttttctatgccttaagcattgagaattttaaaaagtctaggttatggggaagtgttttcaattatctagacattttcaaaagctgcataccagatcatgtcaccaaaaaagcattttctagggaagaaaattaatattataatttaaanantaaaaatgtagaaggtttaaaatggtntgggaattganaaggattgtattttnataatnagagnattatttgtatataaattagntnagngggnaaattaaatgaaaatnnattaanattgagttgggttattntattaaatttgaaatagaaagatgaatggnaaagaagaaagagtaatatttttaatatgntatttttnaaattaatagnaatagaaaattttttaaaggaaantactctcatggtcttgggaaattcataaagcttttaggataggcggcgaaaacaaagcctaaaaccaaaacctataattagtgatcaataacaaaaaacattttttttgatttgctgtaagaagaacggagttgactttttttttttgttgaaataggtttttgaaacttacggggaagctgtaaaaagccggcaacttcaaaatatcataccgctccaaatttatgcatttggactatttacccaaatattga

SEQ ID NO: 19281 - DNA, 1583 bp, Heterodera glycines
  misc_feature (57)..(57): n is a, c, g, or t
aaaatttatgcattgggactattacccaaaattatgaattctttttccattatatgnatggtaaattgcctttaactcttaaagtaagaaaactaattaaactcacgtcggctgaggtatgtggaggggtgaaaggaacaaaaaaaagtttgctacgaatgactttaaacaacatacattcagaattttcaattaaatgggattttaattatctttcggtcattgagctgactgatgctaattaattaactttgcttaaaattttcaaaaaataagaaacccatcaatcaattttgcttagtaggttttcagaaaatgttggtcaaaatttgcggattcgttttcgatgttggaaagaaaaatggtacactcatcatcaattgaaagtttcatttttttgaatttataaatttaattttttcgtctattttattaatttggttttaagattttcatcggcctattatttctttacgtttatggttcatttaaagaacactttcgctcttcttttctcgcaattggctataatatgtcgtttgagtgatgaccgctccggtcggctgaggcggggggaaggtgctggggaagtgaagaaaaaacgcgcggtttacgaacattttttttaaatcgcactcttttaaaatttaggatttggaaatttacacgtattattaaaatttaatgagcggcattcaaagaaaacagcgacaaatatttgggatttagtgtgcaaaaaattgaagtttggtgaaattattttcactgtcacatttgtggcaggaaaatgattgattatctttgctttatagttttttctggtaattattaattttaaaaatttaaatcaaaattaatgaaaatattaaataaattattaaataaaatgcaaatataatgaattaaaaaacacatcgaaagaaattaatcaaatttttaaatatgaaaatggtcgaactaacaatagaatagagggctggcacagagtttggaacgtgggcataatataaatgggatataattaaatcatactaaaacagactaattaaagcgcaaaaaagtcaattaaaaattaattaaaaagcagccaaaaattaaatataaatcagcaaaaaaaagataaaaagataaattaatatgaacgattaaaattaaaatagctagaacaaataaataaaagaaaaacgagaattaatataagtaaaaactttatcattaaaatgtttaatgtaaaaacaaaaatataaatgtaagaatataataacgattaagttgttcaaaagaaccaaaagaaataacttatatttgcccaaaaacaactgaatataaatataaacaaacaaaacttaaaaaacaaataatacagaattaaacgccatttcatactgtataaaatttttagaagataagatagtttaaaaaacaaatttcgactcaacagggattctgcgaaagaaattttattaaaatttggggttcatcgttttagtcgttttttaattatgtttttttttataaccttaaatatacctttaaatgcaaaaaatattgaaaaaacaaatattcattggttcattaaataa

SEQ ID NO: 19282 - DNA, 1713 bp, Heterodera glycines
  misc_feature (1389)..(1391): n is a, c, g, or t
taaaattcaaaaatgccccatctttatgaattgctctgtccgtttgttgtggcatacaaccaccgcatttaaattaagaacaaacttttccattaaaaaactccgcttgtacggccgaaatttcgtgagtcgaggccaaggcacggcaaaaccggcatttttctccggcggagaccaaacaccgaaaatatcgagctgcacttaccgttcccaataaatttgttttctaattttgaaaaagaaacaaaaagcaaaggttagaggattttttggattttttaaattccctccaattaccgttttttaattttttaattaccccccccccccgtttatttttgtttacattaccaatacatacgtatttgttgtgcctgcccattgcttctttcaccgaaaaaaagggggagagaatggcgaaaggggcgccgccgtcgcaaaaaaaaacaacaaatttttcccccaattttttgccctttcgccgcgcctccgccgcccctttcatcgcccgtcgtttcccccccccccaaattttcattttctccacttttttttgtgtatttatttgtctgttctgtgtgtgtgtacatacgatgggatggacgtaatgtcactatgtgtttatttgtgttctgctgctgatgctgttttgcccgtccgcaaaacaatggcattggccaattcggcgccgccggaggacaattcagtaaacgaacggcgtgccgttttgactgacaagcttttgttggcattttttcacttccttgtgtcccagtttggctggctaaagcccgagagtctcggtctcgagtctcggcatgagaaaagtctcggctcggtttcgaaagcatctcccgcccggaatgtggagaccgattcataatttttcagtcccattttctcatctttggctcctcgtgcttttgtgcgcggccttttcagtcccttattttgtcactttttccaattttttctcatatttacacaagttattcttctgttctatttatcatatcattatcatatcacatgatcgctgttgttgttatgtctaatgagataaaaaaaattttgtgaaattatttattaaataaaccgaaaaaaaggcaacaaaaatatgaaaattatttatttttgccaattttaatttatggggcaacatttttgctgtctgtcttcccatgtccataaaatttgtgccgaaattgttttttcgacatttttgctaatttgctgctcattggtctcttgaaatggcgacgatggcacttcttaaacaaataaattaaacttccgcaattccctgttcccacactgggtttccctcctcacaaagtgccgtcgttcgtaaaaagtttaattaaaatgccattgggctcatttgctccnnncccttgttgtgtttacgtcgtcgcgtgcgtctgctcaatttttgcattttttgaacataaaaagcgcaaaactaagcgttatattataatttgttttttcttggaaagttaattaaaatgccaaaaatggcccggcatttttggattcatccgtcacacacacacacacacgtacattttccaaatttgggtccaccgactcttccatcttaacgcatttttactgttataatggtgcacttaactctcgagactgagaaaatttcaaagactaggccgactgatgacgccgacattggtgagagccaaaactgccccattt

SEQ ID NO: 19283 - DNA, 1723 bp, Heterodera glycines
ttttgtgccaaaaaatgatcatcatattcattgctcaatataaattttcaaaattaaatgatagtccggctttttgcataaaaattcacaaatccctttaacaaaaacggggtaaacatcgccgaaaacccaaacgaccgaatcgatcgatcaatttattatggttaatttgtcattttgttttttaattgcccccccccccccttcgcgctgatcgcaacatcagagtgattaagcaacaaacataacagcaccagaacaaaacaaaaaactccatacacaactcacaatcaaccaatctatctgatcaccgcctattcattagattaattaatttggtaactgtaaaaagattgattagtctaatcaccgcatactgattgatctttagtctgatcacggcacactgattgatatattagtctgatcacaccgcatactgattgattggattatatgagcaccgcacgattgatcgattgagttagcctgatcactgtgtttgattgatttattattctgatcactgctggttgatagatcggtttatctgatcatcacacataattgataaatgtcgtccactggcggattacggccatatctacgaatgccgtaattaatggcaaatcaaaacactgattttaccacaaattttgaccactaattatcacagtgaatgttgtttgatcgaccatttttagtgcttaatttttcggtttttcaaatgctatgaaaaacaaattaagaatttatcattaaaaaaatttttaatatttgtatatatatttttaaataagtgccaataaatttggcacttttccctctccccctttttttccatttgattatttattttgtcggctgactgttgagatgattttgcttgcttgcctttgttttgtgcgcatttcatgtgcagaaaaatgccatcgaatcaatggtgccaaaaatgcctcaacccaaaaaaaaagaaattggcattggcattggcatgctaattattatttttttttctaaaaattaacgcccttaggaattctctgacataaaaatatgccaactctcccccgcttcacttctcacatataaaatttcgcataaaattgcgaaaaaccccaaaatctttttctagactcaaaatgtttaagaaaatgcagatttctcgtcctctgagccccatttccaaggacagatgattaaccaatttctaagcaccaaggacaaaaaattaatatatccaacgatattttgtggtaaatcggggttcgtattcatacttgaatgccaagtacatacttggatttcggcattcatgcttggaaaattttaactgtacttatttccaaagattgtattcggaaattgatattttggcatacaagcttaaaatacatttgtgaaaaaaatttaaatttttggaattctgtcatttaatcacaaatttttgctacactacgtatgctcaaaactgtacctggatttcacgaatttttgccattatgtacttgggaattggtatcatctctgtacatggaaaggaattctggattaaatgctttctcaattaaaatcgcaaaatccatcctaaacccatagaataataataataataataataatcaaaaatccaaatttatttccctaatagccccccccccaccatcaccatcatacatcataagtccacccccacttttccattgtttaggcccataagtct

SEQ ID NO: 19284 - DNA, 2383 bp, Heterodera glycines
ttgttaaccacttttgtcaaaaactgaaaaaattttggggtttttaaagaaaaataaggatttttttgcgccgccggagaaaaattttggaatttttaatgaatttcagtaaggaaatttattcaaatttaaagtttttcatcttttctccttcgctttgaccccccgccattacgacgaacgaggatcggggctgtctttttttttggggggggggggtgagaaattgtaccaaattcaacggcaattcccgctacaaaaacaggcgctgtccgcgctggacaatgccgtgctgactgctgctggccatcgacgcgatgcggccgcaattgttgcccaacaccagcaactgctgcagggacaaggacagctcggtgcaatgggaccgccgccaccaccacgggtcagtggtgtttagaggggacaaattggcatggatttagctggggtggggatttaaccataaatgcacaatctatgcattggccaaaaaatgtgttatttttccgcttgtttactaatgatcggcaccctatgtaagaattttgggcgaaaaattgttattttttgcgcccgtgttgctataattttgaaaaattacactggaaaaactggacggatagaaaaaacaaaatgtaagacttttgttgcccagactctgctgattgtgagtatatgaaattattttactacaaatagtagcatcatgatatataatgttttttgcgttcgtttgtttaggtgttgatcaacgagcggggcgaaatggtggcggaccagcgaactgtggtggtggtcgaaaacacgacgacggaaccgaacaccgacatggacacagtgaacgatgtgagaaaaaaatggcaaaaatgggtttataaaaacttttggtttaattcagacccttcgacactaagaaaaaaagttcaatctttatatttttcgtcttctactagtaattactgttttttgttcgctttttatggcaatttgggatccggcagtgcctactagcgatgcttttatactacaaattttgttttttcaaaagtttctattttgtgtcaccagtaggatagctatttaaataaatttttcttttatcagatttcaatcgcaaaaaaacgattaaattttgagtgatttaatgaacaatgaatgaattgtaatttttaaaattagtataaatgtatatttccaaaaaaatcaccaatttttattagttttggtccatataaaaagttttattatttttactcatttttatcgtcattaaaatgtgcaaaaattttcgctttcagctgaaagagaagcgcaaagtgccgacctccaaggacaagctggtcgatcggaagcggttcaccatgtccgacctggtcaggtggaagccgaagacggagaacacgctgaagcgcaagtgggccgagcggcgccgacagctcaaggaggacaccgtcgatggggaggcgacggggcagccggaacaccaggaccagcagcaggtgagcagccgctcccctcggagcagttcattttacacccgcatccatcgacaaaaattctcgaaaattttaaattttttagttttctcattttttatttttcccaaaaaaaaactaaacacatatttcttcaaaaaaatttttgggaaatttagaagtaaaagaattcagtgtcgggaaggggaggagattttctaatccagaaaaaccaaggggcttcttcacacatttattattaattcttttgtaaattttccaaaaaaattgcaggcgttgccggcggtcaacgacggagggaccagtggaagtggtcagcatgactgtgtagtaccaactgcagcacaaccacaaaaacagggaccgagcagtgcaccgacagcagcggcgggaccacgggtgggttaatatctttaaaattagtcgccgcaatttccagaaaaaataaattttaattaaaaaaatttcgatgtgctaaaagcaccgcagggttccaattttcttatattcgccaaaattttggcgtaaaatggtcaaaattttgagaaattggctaaaatttcccgttttttcccatgccaaaaaaatttaggaaaattacactggcttgggccggtagagcgaacaaaaaaaaactccgcgtaaccctcccgaaattttattctgattatattacagttttgtcctactccgctaattttgttgcccctttctatcaactgttttgttcaggtgatgatcaacgaacgcggcgaaatggtggtcgacgaacagtcgcttgttgtcattgagaacccggagcagaacaccgcgggcatggagacagtgaacgatgtgagttcaaaagttaaaaatgcgtttaacaaggttttgatgtgcgttttttt

SEQ ID NO: 19285 - DNA, 2966 bp, Heterodera glycines
  misc_feature (2750)..(2750): n is a, c, g, or t
  misc_feature (2890)..(2890): n is a, c, g, or t
acgagattccctgcccgaattcggatgatgtccccgacaccgagttgttgtgtttcgatgttccgctccattccatcgcggatgacaacgcacgaagaggggagtagtttttgaaagccgcgaacaaccgaaaaaaagcaaaaaaatatttaaaaaaattgttttttttactcactttctttgcccgaagctcttcaaaccacgacagaacgcacattacggtgatcataccgtacagaatcagcgtgatgtagaggttgatcatctcactgtgtaattgcaaccattatcataattcgtttaccatatttcaataatatttcccaattaatttacgaagtatctaaaaagaattggagcagcgaaagggtggcggcgcctatgagaagcgcccacagcaaattccaaaactggcggatgagtagctcgacgctgctcatttccttgggcgccggcagaacgttggggccgttccgcagcaggaaaagctgcgcctttcccgtcgcgatgccgcggctgcgccgaacgtcggccgcgtcgacggaagaatcggggaaattctcctgcagctgcacaatgtcccaagtgtgctcgcaaaaggcactgaaaaagtgagagaaatttgcattaaaataaataaaataatttttgaatttaggttactcggcacttaaaaagaaaacatttttataattgtttattgaatttcatttccatttcccctagtcgttttcgccccttctcttttcccacccgcttagccctttctgccgcatgctccacgtccgcgacagtcgcattgagccgctccgggggaaatttttgccgcgttttggcatcgctctttcgcccaaacagcacaaaagccacgaatcgacaaagccgcgttttggtgccgatttcttggtcctttcattgtcctttttcgctttttcttcgaccgcataattaacggagggaattttattcctttcggcgttcggcacagtgccaacaattttattagtcggcattattcctcaaaagagaaatgcctcatgccaattatgaatttggattattttatgttcagtggatattcatttgctaattgcactatatttaaatcacaaattggcaattagtaatgaatgattgggcaatcaaattggttttatttttgttttcctccgctgatcgttcactctttgccccacttaatcaccgcttcccctcagtctcgactcggttgactctcgacgaatgttcaacacagaaaaggcaaagcaaagagagagagcgaaaggaacggcgagtgaggggcgatcagagaaaaatcagaaaatgagcgctcaaaaattcggcaattaatttcaccgattattttatcgccattttcgtcattcattcggcaatttccaaatgggacgagagttgtgcattaatttattaattttgtgtatgtacctttgaaaaaatgagaaaaaattccgtcggccgatggacaataaattttgccatcgatttaccacgccgaagggcaaaggaaatttattattgcctaattagcaaaaaaagtttaattggatgacccaaaaccaaagcgaaccaattatcagtaattgcgcaaaggttcggtaatgacgaacgatgggaaaatgaaatgaaatcactttcaccttcgaccttttggaaattgagagagaagcgaaatttaaatcacaaataaaattgacaaataaagaagccaaatattgaaggagctcaaattgaataattagcaaaggataagagagaaaattaggcatttatttgaaattaatcttttaacaacaagattttataaccaaattaaaagaggaaaaattcaaatggcaaaagattattttgaaatagaaaaagaaaagctaaaaaaataaattcgcttctgccttgtttaagtgaccggcttcttcaaacaaatcgtttaaacatttcttaaggaaaaattattttttgtaaaaaattatgattaaaaaaggaaaataaagtttaaaattatttatcgttggcatttacctcacattcttcggagtcaatgctaagagaattcgcaattttttcaaaattctttttggtcacaacttaattaacaattaatttgattttaattttatgtttgttattttcaacaaatttcgcattttcttacttttgtttgtgccttcccaattcgccacaatttccatgcccaattttttgaccacaatttgctggtcatttcctctttctttttgcttttggtggccgtgggaaaaaaccgcaccaaatttaccgaaggaaagaaataaaaataaaattgtaatattcaaaaacattatttattaaatatttgtaattggagaagcagtcgcatctttggcgaaaatgttaaaaatacgccaattttattgatttattgaattaaatggcaaaacaaaaaaggcttttggcttttgataaaaaataaattactggataaaaatccaaataaataattatcgacggtgtaaaatcgcttaaattaaataatgtgccgtcatttggcctttatttcgatgattttttgcttattgcaatggacaatcgttcttcttcagccctcaaatgaggaagtgaaacaaaaactaaaagatgatcagcaggcacaaaatgccaacaaagaagcggcgatgcagcgaattgtggccattgcgcggaaattggacgacgacaacggcgacggaatcgcaatgacaccgaaagtggaggtngggggagagacaatggcacaaaactggagtggaggatggagtggggggggaaggacaatgtcacacggggagaaaaagggtaacgggtgggaaagcagtgtccttttaagtagggttaagccccgagccctcaaaaagtncgggggtcggggacctcggggggcgacatgtcgggggtcgggtcgggggggggggggagctcaattgtcggggatc

SEQ ID NO: 19286 - DNA, 1953 bp, Heterodera glycines
tctcttaatatttaatttaggttgataatgagaaaagttattagcaacggcgccgaaagggtcggcgccgaactgggcggttccctacggacaactatttctggaagaaaaaatttaaaaaaatcataaagaaaaaaaaattgtttttctttgattgggtaaagcaatcagcattgaaatttatgaatctctggatttttccgaattttatgatatcatttataaatatggagatattcctttttaataaaccaaattaggtatataaattcttccaactaataattatacccacagtttcaaatacttaaagtttctatcaaattagacactttgttgcacttttaattggcttaatggtatagtggaaaatgtttttttcgggtgcggaactatttgttctgagctcggcttaaaaagataacttaacctgagttaaatgtagcaaataatttggggttgtgtttgtataaatagataaagcttttgcttttcgtttcattcaaaattgttgcaactattatttatattctatttttattaattgctatttctttataagtgccttttcatgacttttttcaattttttggtgcctattagagtgcctttttcgcgatttttggtgcctttttagtcgatctctaattatcattaatctatgcatattgatgaaaatttttggagttttaatttttttttcaaaaaattttctcttgggcaaattccaggtcgaaaaacttggtcccggcctcaggtccggtcccggttttgtcaaaattaaacagaaactttcaaatagcacttcaattgctttgattttttgatttctcattaaagggcagtcaaaatatgcaagtgcatttttttccaggcttttccatgctctaaattagtgttcagaccccgacccatcccccggggacgggacaggttttttggcctgcctcccccctgctcccgtgactcagactcccgcgaccttcgcccccgcgggggtgagtactctttcaagtttctaccgtaaactgaaccctactgattttatttatttttttatactgaggaaagtctcaagcaattagtgaattttcaagaaaatatacccttaagaatggcatttcttgggataaaaggcaaacaattatacttgtattttttttaactttttaaaccacttttgataaaattttatgtgataaatagggatgccaaaaatatgcacataaaatcgtcaaatatgcgcataacataaaatcgtaaaatatgcgcataaaatatgcactaaaaatcgtgaaatatgcacataaaaagtgaaaaatatgcacaaaaaattttccaattgagggtgtaatttctcaaaattactccccttttaagcaaagcaaattgagagaaacaatcaattaatgtgataaaaaaggtaaaacgacgacgaatgggtcgaataatcaaatgaaaggaatgaatgaataaatggcaaatgagctgattgtttgttgttttgtagttggccgatgagatgaatgtatctgttgatgttgccaattgagcactttctgagtttgtgggaaagtgagggacggacggcacaaaatttggggtaattaatgggggggggggtaattgaaaagccaaaattaaaatggataatgggaaaatgtgaaataatgaagaaaaaaagccgacattcgaggacggagtgacaaaagaaattcaatgagaaaatgcaaaaaatgcgaggggaaagaagctgagaaatgagaaaaatgtaaagggaaaagcaaaagcgcgtggtcagtaattgtaaaaggaaaaagtgatcagaaaattacttaagtgatcaatcgatcagagacgtttggtaaaattacgtgatttgtgcacgggatgatgacgaagtgaatgtaattgagggcattggtgaggaaagggtcaaagcaagggcgtagg

SEQ ID NO: 19287 - DNA, 1400 bp, Heterodera glycines
gtctaaacaaaattcaaaatcaaataccatctgcacacttttcgcttgttcaaaaagttggcgcgggaaaggcgacgggaaaagagaaaatgcgacaatttcagccgtgtcacctctgaaaatttaattaatgagaataaaaagaaaatattttaatattttaattttttcttaaattgttatctattttaattaatttttgaaatgagtttcaatttggaacacttaaagcacttcgaaagccttctctcaattctctcaatttttcaatttcattaattttgctataaatacatatatatatatttgttcattttaatcaccttccgacgagtgccttgggcgaaactatcattgaaagattttgtgccatatcaattgcctcttccaccaacatttgtatatcgtcagcatttccacctccatctatttatgatttttaaaaatttattcgggaaatgtttaaaatttattttaaccaaaatcattttgcttttaaattttaccttcatttttggataattcttcagtggttggattggaaatggcaacataaatcagttgccaaagcaaaatgatgagaagatatttgggatatgagcagaatgccatatttcctctcaaaatttttcaattataaataataatttattaaactttgcttttatagcattattttcataattattattgtgtttattttttcgaaatggcagcgtttccgccggaaattatttttcaagcatttccccggaaataattttatgttgttcaaatatttattttaatattaaataacaattttttttaattaaaaaaataaaagataaacatttttattttttaattcaaaaaaataaatagaaaattaactttgttatttttttatcatttttgtttttgaaagttacgaaatagtataataaccagggattccttctttaggcaaatgcctaaaatgtcttttgtctatttctccatttttggcgcctattatttgcctatttaagtgcctgtttcgcgattttgtgcctaaaaaaggaatccctaataataataaacattaattttttataaatgatttgtagggtgtaaattgtggctaaatgatggaattttaaaatacgacagaaattttttaattgtacattttgtggattttttaaaatttaattatctgccaaattcatgtaattttaatgttcatttgcccatcacagaagtgtaagtgagcaattgtcgtggggcggcgcccatattgaaaagaaattcgatcagtcccatcagttccacgtaaggcacattatttgtttgacccgactcgctttaattaccccccactcgtccgactcttttttcttacctcagttcctttctgatcggaaaatacaaaatcccaa

SEQ ID NO: 19288 - DNA, 1152 bp, Heterodera glycines
aacagcaccaaattttcccaatttaagcatgaaaaagcacaaaaaaggcaaaatcagcacaaaaaattggaaaaaagcataaaattatggaattaaaggcacaaaaaattgaaaaaaggcagcaaaaaaaaacgtttgtttgctccctgattataaaaatggcgctacgaaaacggcggtacgaaaacgtcctggcccggcaaaaatggacatttgtgccgctcacttaaaaatatattttaaaatatttttaccaattttcaacgaattttactcaaaatactgtgcaacaacaaaaaagcaattaaaagaaatgcaaaaaaaaaaaaaatcacaatgatagacacgtattttttgtttttgttaatgtgtacatcagcagcaaaggcaaattttgtgccaaggaaaacaaaaataataagccacatttatatatacaaattttagtttaaaaaaaactaacggattacttagaacggtgcaaatggattttgtagggcggcgcaagtgtcgaggcgcaaatgtcgcggcgcaagtgtctgcggcgcaaaagtcggtacacccaaaataggtgctaaaaatggtaatgagatacataattttaaaaataaaaaattcttgtcaagaaaataaataaaataaatttcttaaatttttgataaaattttccatttcttacaaaggagaggtacccaagtgacggtgggacttccgaatgaaacttacaatgtaggtagattaccccccctccccttttgtattataaaatttttttatttttgctaaatgaagcttctggccgagatatgaagcttttcctttttgccttattaatgtcattcacaaagaatgaaaagccaatatgggcgtctctggctcagcggttataccttccatttcttttttcttcttctaaagttcaattcccccatcctgcagataattattttttgttttttacatatccaaaatagtttttaaaccttttaacattaataattttggccttaataatatattttttaatttttattctacattaatttttggcacgtgtgatagtttttattgaaatgaatgaagcaaagaatttgtttcatcatgctaatctgaccattattagagaggggatttagatgtgctaaaaatctt

SEQ ID NO: 19289 - DNA, 2134 bp, Heterodera glycines
  misc_feature (39)..(39): n is a, c, g, or t
  misc_feature (55)..(55): n is a, c, g, or t
  misc_feature (133)..(133): n is a, c, g, or t
gtaaaaaataaactacccggctcgaaatctgcagtaccnggcggtaccgcactanccgtccctgttgatatcgataccggtcgtaactttgcatacggtatcggcatagtgatcgcagtaccggcatctgctntagtgaagaataccggtgccgctctattcaatttacaaaattagttgaaatcttttcaatattctatattaaaatttgttaattattatagaatttaatacacatggcatataaaatacaaaatcatttccatatgtcggttttatttcaagattaaaaataaaatattttgggctttagaatctcttcgaccttatttggctgctcgaatatgtttggctttccttggagtttctcgttggcactcgcgtacatgcaaaatacccatttggtgcctatctgttccgtttcgtcaatttttgcattgacactttttacatcgaattagcattcaatcggtgcaccgctttccttttcccacgtctttacagcaaaatttgcacagaaaagtttgtccatttaactaatgagaaaaaattgtatttggtgttgccaagtggacattttttgccttcgagggaaacctttggggtttttagagaaatttgaattaattcgagaaaggatttttaaaatgccaaaacatttaaataaatattttcgaaaaatggtttaaatatttacaaaaataatgactaaaaatgaaaatttcgagaaaataatgaacaatgcattgaatattatgaaaataaaaacgaaaaaaatcggttttcactttgcattttccaaattttaaataatttaattttaaatttatgccgccatttgttaaggaacatgaaaacttgcgttgtgtgcacatgtctcgtgtcaattgtttattcaatttacatgaattggtttccggagaggcgccctttccattgtctgattcagttgggctatttcgagccgatgacatccatcacgaaagtgtgacgaatgctcgcttttagcttaatcattttaattatatttaaattttaattaataactatttatttcttccagtatatcaccgcaacattgccggacgcggggctttatgacgcggttcaaatcgctgaattggcttccatttgcattccctttttcctctatggcataacagtgatcaaaatggtgcacgatcacaagaagaatccctccacaagcataagtatttctttttttattgcgtggttttttggttgcgaaattattcattaattaactaattaatgaccttcggtaaatcccggtgatatcccattaacggggggggggggatgctaaagagagccagcgaaggaagaatcgtcttgtgtgggtctgaacatggatgggtcttttgaaaagggtcacttctcgttctcgacccaagaaatctgagaagatttattgtattgtattattcattttaattaattttatttagtccaagttgcgactgtgatgccgcgcgggagccaatcgaacggagaggagcgtgccaaatttgtcaatttgatgcaggaacgcactcggctcttctccatgtgcttgctcagccaagtgccctactatttgtcccacgcgctttaccaatcgtcccgaatttttgagctcagcgaagacaccgttcaggtgaaaaaaattggcagaccaataaaattttgaaattttcagattttggccatcctttggcaacttctcggcacaatttttcatgtccaacagcccattctgatgctgttgctcagcaaggatttgcgctcatcagtgcgcaacgatttggcaaaaatattcggcacaattttgtgacccttaagagcaattttgattataatcatatgtagatgtccatttttaatgataaaatgtgtgaaatagacaataatgaactgcaaaattgatacaaaaggctcattacagtaactttaaaatggcttgtgtaaagtgcataaattaattttcagctttttccgtcaaaatgtgatctttactactttctcgaaaatacagtattccaagggaaaattgataatttttggcgcagtagattttcaagcttaaccctcctcagcggaaacgagttgtataagcacctttcaaaagccattt

SEQ ID NO: 19290 - DNA, 2697 bp, Heterodera glycines
ccattcctcataatcagctatatgtgaccctttaatgtgcatattcatatatatagtttatatcagattatagcgtttaaataaataaaatgtacaaatgtggtttaagcggaattggatagtgattttatggagcaaagtgaaaaggtggaaaaattgaagtgaaggaatgtgtgaatttcttacgcgtcaaccgctgtttaatttccctcacggttttctgcaacagtctcatactccgtgtgttgctcacccggagccaaaagtcggccgacgaacgggtatttcactggaattttgagaaaaatatgaaattgttcaaaaaatggcggcacatccggcgtatcgatgctttacctcccgccccccccccctaggggtcgaagcaaaacctttccatcccacttacatgacaagcgctgttgccactctttcgcttcttccaaatcggatgggtcaattccggcgtggtcatcaaattcgtctttgatttgcttgacatccatcgtgcccagtgcacgagttgcgtcatgcccagccaatgctgaaaagctctacgatattttgccatcaacttgctttttgttattttgccccatttccaatgctttttcgctcacctccgtacgccccctcgggtccgtaatagtcccttccctttgtcacgtcgtaaatctgaaaatggcaacccaattgtaaatgataaaaatggaaggattgaaaacctttccacagattgccatgcaaatgtgttcgtcttgtactccgtcgtagcgtctcagctgctccaccgtcatgtcctgcttctccaacggttcgacttgcggcacgtcggggggaggcggaatatggcgacgagcgaagaacaatttgtagacgacgtatacgaacagaacaacgaggacgacatctgcagagggacaattggaaaaacatcatttaattaaatgccaaaaatttgcccgttgcgctgagttcgaaaagttctgcaaaagttggcattgggcgggcgtcttacgaatggcttttggtggctgtgcactttaaaatggcaaatcccttaattaattactaattgagaaaagaaaactatgcacccaattgttttgtgattatcagtttttatgtatgatcgaatcaatcagtaaaaaggctaatcactcactgacttaaaaaactaatctggacatattaatatacccatttaggaagacacaaactactacatttttaaattaatttgagatggaaaatttatattgtgtgatggacaaacttcaattacgataaaattatagattaatacttaaaattgaaattcaaaatttttaattaggttaacaaacaccaattaaaacaaatacttataaaataaaagcaattattccatcaaataatttctttgtcattttccgagtctccttccttcaaatgcgcgattatttcgtccaaatatgaatcatcttaatatgaattttttgaatctctaattgaaagaaattaaaattaaatttttttttttaatttaggctccttatttataaaaggagaatgaatggaatcacttaaaacacaataaatgcatagtttttttactcaccgacgtcgccctcaaagcggtgaatgacctctccgttatggaaacacacctaaaaggggtgctcaattatgcagacaaaaagacgacattcattcgaggcaatgagtgaatgttaaaaagtgtaaggaaatgctcacaacggtgggcaccgaagtcacatcgaattgtgcagtaagaaaaccgagagaactgtccacattaatcctcgccaacaaaacctaaaaaaccaaaataaaattaaaaaaaacaattggaggactgacaacatttcatggcgaagaaagtgccctcccctggccaactcacttctccgttctgtccgttcactttggcctcaattctcggcgccaaattctgacacgggccgcaccaatcggcgtagaattggaccatgacgggctgttgggcttggagaacgcgatctgaccaaggggaaactgtatgaattctgttccttgtgattttcgtctccaaccgtcaaagtcattctcagagccaagttcgaagacgttcaaaccatcggactgtgaagaaaaaaagcgatgttgaacctatcaaaaaaggaatcaccaaaaatgaggcctcattttagctcggcatttttggatttaccaaatgatttgcaaaaccggtggaaaaattggaggggccaactccacaaacagtcgaatgcaaaactgagttgagacgtccaacccaaaaagactccaatggcacaaagcgatgattcgctaccaaaaagcgtctcaaaaattgtcgaaaaatcataacttaaaaaaaatttgtataataaataatatttaatatcataatgagagaatccacgtttgcttaacatgctcataaaggaaaagcaaaagaagtccttaaaattgtactggaaactctgaataaaataccatctggtcgatggcacatttgtgagtgaatttaattagaaataacaaggatacacaaattggaaattcgggggtctcattacttttagccatttcaaagtaccggggttggtcattagttagaagcggaaatatgtttaatagtagcctaataagcaatattttgaaagttaaaagacaaagactctagagatcccc

SEQ ID NO: 19291 - DNA, 1463 bp, Heterodera glycines
atgaaaatggttgtggccaaatggaatttgcggcgggacagaaagattttctaaaaagggacattcgttctgcacagcattccctcttctattggtcccctttgacttattccgcctatgttttctgtttttctcgcttttctctgccgctttctacgaatttccgtccgttcgtctgtccccttatctttcgttttgctctctctctctctcccttgcctccttttccctcttccgtccgctctttcgcttgtcctttctttctctgtccttcctctttctccacctttcactttcttcctcttcccctcccttttttcccctctttcaaaataactgtccaattcatttcccatccgttcatttcgcccgtttcttcgtttattccatccatctccttctgctgctgcacttttacttcttccaaatgttcgtccccaatgtctctctctctctctctcttttttcttttgctctttttaatccaatttcttttttccctttttctctcccattaattttctttcccttttcccccatctgtcactttcgctcaatttctttaaaagtgacaccacaatatgatatatatatatatatgtaatatgaatttccatttgttgttgctctctctctgcaaaatgcccttaggcatatatttggtcaatttccaaagtattttttccattttctcttaaaattgccaactaatcatttgcgcgaaattgccacacattttgaaattcctttcccccccccctctctcccttctctctcgtgtttgttactctttcattatgaaattggtctctttctttctttctttctttctcttcgtccatccattcttttccctccgtcgtttttttcgtccttttcattttcgaaatttccaattttctttatttaattaggcaattggaatttccccattttcaattttcccccgtcgaatgaatgttttccaattttctttttctaattgccctttttggccttttctgttaaattatgactcaaaaaaaggttgtttttttttttgctttctttgcgccgcctctctcattcattttttgttccttggcaaattgtttccatttcttttctcctcaaatcaaaaaacatacaattttttaaatttatttccctcaatttgtcccattgaaaatggcaaataattcccttccaagtgactttggcacttaaattctctttgtgtgtgttttgtaaatggattaaaaaagtgttcgagtccaatccaaacattgccccccccccctataaaattggtgggttttcctcccccttttccacttcctcttccctccgtcactttcatttttaattcctttcatatttttatgtacataattccctttttccaattctgacttttcgacaccttttacgctttttgtctgtttcgaatggatggagcggtggggagaactttctttcatcat

SEQ ID NO: 19292 - DNA, 1058 bp, Heterodera glycines
tggctcacggacaatcggacagtggacaatccgacagtaaattacactaaaagataataaaatgccgtcgccgaaggggaccgattgtgccgtatcaagaaaaaaggaaaaaatgcaaatatattgatgagtttttgtaataaccctaaaaatcaaacgatgtggcgatttgtactaaagggtgtggaaacgcattcaacaaccaatttcgttttcttcgtacaccattaagcacttttgtcaaagaaatgtaagaaagtatgcattggaattttattgataaaaatttcaccataattacgagacggcatttgtgtgcgaggaatggcaagaaaaagcgcttttatttcaataaagatgccgccgtcccttcaaaatgccaatacatgttaatttagaatgaaacaattttagactgcattcgcacttttattatttgcatatttttcttttttcttgatacgacacaatcggtccccttcggcgacggcattttattatcttttagtgtaatttactgtcggattgtccactgtccgattgaccacctctgtcgcattgtcctcactgtcggatccagtcacgttccttttcctcctcttttctcctttctctcctttttcctcctcttccttctcctttccttcctattttgcggtgccaaataaattactcgcggcgttcgttcgcgtcggtccgtccaccgccgacacaatttccaaacttttctcccctcccaagggcaccacgccctgcccaatccgtcgagtgcatttccccccaccccactttgatgagtaacacctgccatgagaatgggaaaatctcgtctcgtctcgtgattcagtgatcggtggggggaatcattgggccttcactttcattcatccatttgccttaccttttcccaaaatattgatgggttacgggggggggggcgatgggtgggcgacgtttcttcgtttcgctgttcaccgatttttgtccaactttccctttcccttccctcagcatcaaacactttatcctgctgctgctgctgtttatccgtttatccg

SEQ ID NO: 19293 - DNA, 2380 bp, Heterodera glycines
  misc_feature (56)..(56): n is a, c, g, or t
tgcaaaaaaaaaaaattcttcccatactctcttatttttctatagaagtatcattntaaattaaattattataattaattgattattatttgttaattagcagctaattattaaataaaattagtcacaatttcaagtctatctgtcgtcaatccccaatcgttcattcatttttagaattattattattttttggcctatatacgtcattgaatgcatactgatcaactgcaaagagaacatcatcaataatttgctgattggaaagggaaaaagtgtcaaattaattgctcttctatcaacgcaattcttgtccatttgtaacaatttttgaggtaatagaaaccatttcattgattgcctttagtcttttttgacaattgcaatttttttcgcttttagtaccgaacatttcctcgcccccatcttcgcatcattcgttcattcttcgaatttttttactgagtgaatgacagttgcgatggaccatcaggcgttgattgacgagctgccggaggtggagaaaatgccagcccaacagcgcatcgctttggcccgtgaacgacgtgaacaacaattgcggttgtgtcagcagcgcgaaggacatttgccgcagcccgccccgcgtcggccgcggctgcggttcagttccgacatcgctctgctggagacaaccgtccgtggcgacgcgcaggaaggtgctttgtcgtacaatatttcaatagtgttgtacaataattggcgagattctccctttatagctcatttcctttccgcttttactattgtatttaagttctttgagcgatttttcgaatccgttcataccttttttgaggggctgggaatcggggttcgtagcgaagggaaaaatgaggaaaatctcaaaaactggctattcttcttaaatggctgattttacgaaacgatccagcacaattccaatttagttgagctgatgctgatggatggtgtcaacccaaactcacacaatgaagatggcctgactccccttcaccaggttcgtctaaaaaatgatcaaattttaattgtaaattttattttttagtgtgctattgacaataatgaaagaattgtgcgacttttgcttaggttcggcgccgatgtaaacgccaaagacacggagaatgtataattgtttttttttattcaaaaattgcgattcagaaaattttgcgatttttgatttttgagtttatttataatatagtataacaaatatgcctgaaaaattggttttttctatatattgacaaatttaatttttgtcaactttttagtggacacctttgcatgccgccgcttgttgtggttacattgaaattgtcagacttttaatcaaacagtaagaatcgtttaaacattaccgtactaatagtattattcagcagtgccgatctgttggcggtcaatgcagacggaaacatgccttatgacatatgtgacgacgaacagactttggatcttattgaatccgaaatggcgggtcaggggtaattaattgaatcctcaattttctttataaaattcgaattttctttttaagcatcacccaggaaatgatcgacgaacgacgtcagttgccggagcgggaaatgctcagcgacatgaaactgctccaccagcaaggcattccactggaccaacggatgccggacgaatccacttacgtgagttcagtgtcacatcgctttttgattgctgacaccgtttagctccatattgccgctgccaacggcttttacgacgtcgccgccttcctcttgcgctgcggtgtgtcgcccgcctcgcgggacaaagactcgtggatgccaatccacgcggttggtcatatattagccggataattatttagatttttctatttatatattggaatcttctaggcagcctcttggaatcagcctgatttgatcgaattgctctgtgaatatggggctgacatcagtgcgaagacgcgcaacggggagacgccgctggacctaacggaggacccgcaaacgcaattagtcattcggaccattgcacagacggaggcacgaaggaagcgaatcggacactttggagtgcgagatagtcgacgacagtcgagaaagttggtcattttagatagtcaaattaggcccttatctaagactttttaatggtaaggtatttgaggcatttattattgtgagaacattcgctaattattttataattgggtaattaaaggcgaaagaaattcgaatcaccgcaagccgtaccgcctgccgcgaacaccgacttcattcagacagcccggggcgcaattcggcgtcagtcattacgcgatcggagtgggatgacacttgcacggcttgattcacaacgtgaaggg

SEQ ID NO: 19294 - DNA, 1461 bp, Heterodera glycines
catttaaaaaaaaataaagactatttatttaaaattcctctttattgatgagatctatttgttgcgaatcatttttgccaccttttttgttttttgaggggtctggcgaggccgataggcgccgccgggaaaaatttctaatttttgttaaacgatttttaacctaaaaaaaaaaatcatttttgacgatcttttaaaaaagaaagaaacattttaattgtttagcttcaattttttagcatttaaaagaatagaccaaattatttaaattaaatttaacaatttttaaaattcattaaatatttaaatgccccactctttagaattattcaaatacggagctaatttaaattcgtaagataaagcagcatgaatatataattaaaaattgaacataaagaaaagataaaacaattaaaaaatatataattattatgcctaaatggaaatattaaataggtaaaaaaaaaattagacattcagttatttagaatattattgaaagaataataaatatatctattctattgtttgagaaaaataaaaaaattcgaatctgtgcgcattaatcatatataatattaattaacctgaaataccaaaaggaataaaattaaatgttttaaaattctttaccaaaaatgtattatttaaaacaaacaaaatttaaaagaagaaaatggtaaattactaaagaaattgattaaaaataaatattgatttctttaacttttctgtgcagaaatgtgcttggtttttgcttttttgtcggtcgaaataaaactgaaaaattatgggaaataattaatcgaaataaattaatagtaattaacgaatataatataattgttatttatttaaacgattttcattcaagctcaagtaaagattcaaaatctgggataatcgaatgaatttaaaaaagtacaataatatttgcattgttttagtattgagtctggcggctaagaaaatgcgaattgatttggagatcatttcagacccatttggatcatcaattgtaaaatgaatttatttttaaataaaaatgaatcaaaaaataaattgatttaaaaattctcattttttcaaatattataatttaaatggcattccttttataaaaaattttctatgtattatttaataatagaaattatgatacaataattattaagctttcatgtaaactatttcaatacaaaaaaacataagaaaactaataatacaattaatttttactttaataaaactaatttaaaacccatatacaaataataataaaataaatttttaaatttatatccataaataaaacacaaacacaaaaattatttattcattataaaaattaaattaacttaataatttaaatggtacaatatatgactaataagaaacaaacttgtaaaaaaacgaagagaaagagatatgtgaaagagttctaactagagttacacg

SEQ ID NO: 19295 - DNA, 1052 bp, Heterodera glycines
ataattaatatagatactcaattcaaatagttatttaagattaataaagacgtaaatgatttttcgacaaacattaaaaaaatatatattcttaaagagttaaaatacaattaaagttatatgtaatttcattaattaaaataataaaaataaattaatcaataaatatttttatcatttgattaaaaaaaataattttataaataaatcattaactatagcagaaaagataattaattaaaagtagtaattattcgtataaatataaaggtttttaattaagaaatttgctaaatgaataaaaaatgaattcaaattaaaaattttttaactaaatgtaggagttacaaaacaagaacaaaatatattaaatattcagcaagatcttaattgatatttttataaaaaaataagtggaaaataatcatttaaaatctaaaaaatacatcgaaaactaatgtatttagtaaatactgattttcaattttcatcaataaacatgactttttcaacactagaggttgccagtagagcccggaaatttcaaatttgcggatcccgctgcgggattggtactgaaaattctttgcgggacgggatcccgcgggattaatcccgcaaatcccgcatttaaaatttgcgggatcccgcgcgggattgcgggattttggaaaattcgaaaaaatttcaattaaattcaaaaaatttccaaaaatcaaaaaatgctgaaaaataaatttttaagggctggcgggatgcattaaaaggggttgatgggtcgaaaaatttctaaatattttaataggctaaattttttaattcttaaccaagtaaaaggtatttcacaaatgtttttagtatacgcttgaaaaaattattcaatattttatcaaatttttttttgtcatttttcattattttagaacatttttgggaaaaggagtgactatttttacacgttttatacagaaaggattttttcaaaaactttttgggaacttggaggagggtacaggggtgccgataggcgccgccgggaaatttttaaaaat

SEQ ID NO: 19296 - DNA, 980 bp, Heterodera glycines
tttcataattgatcagtttgaaagtctaaaaaattccttttagtgtggggatgtgcaccaattcgaatgggtgccttcttccggcgtccgttggattcgcgaggcccggaagccaactgttcggcttcagcaaagagatgctccactgcagccagccctgattctgcttttcgagttcctccttcgattgaacgagtccggcactgcaaaacgaattgaagaaatttgattgattcaattttcttggatacttttgcatttccattacgacggttggcaacggactcggaagttgcgttcctcgtttgaatttcaatttgagttcatccaacgaaaaaatgcaattcttttggtgacgacaataatctaaacaataggcttataggctacacaattggcaaaccttattccaagttcaaagaacttgcctgaaatcactctcttccaaaactcaatgaccctatctaaattttagtaactaattagcatggttaaattacaaaattcctcattagtttaccataatttgtcgagttgacatgtcgagcctaagatgagaaatttaagaaagagtataaaaaaagaaaagacgccttacctttaaaaaagacattaagccgctcatctcaacatcattatcccaattatccggaagatacggaggcctgtttggcaatgccataatattaaaaacgtatatttgtaaggttttctagaaaaataaaagtggatggaaaaaagcagcctgtttttttttgttgttataaatagctttctacggatttcaaaggaatttgaaaaaaaacttgttgaatttaaatcttggagttgaagcctaattaaaacttttggaagaaaaaatttataaattttgatttttagaattaaattttttaaaaaataatataatggcataatgtttttagcgaaatggcaaaagagaaagaagcggcttttcaatttcagcggaagtgcgatcg

SEQ ID NO: 19297 - DNA, 1503 bp, Heterodera glycines
ttcatttcagcggaagtgcgatcgtttggtggcgttcttccttgtcctttacctttccctcaaaaagtttatgtttattttacgttttaacagcttttctatcccataaattttaaaatttctcttcagtgtaaataatgtctttaaccaataagaatggacggaataaaattgcagacaatggaaatggcaaaccaattgaagctggtccaagtggcaactgtgctagggagaatctaatccgattaaactcccttaatccttacatgtaatttctttgtttatacttttttcgaaaatcgttaattattaatttggatttttaagaacgtgccctctgtgcaacggttatttggtcgaagcgaccacagttatcgactgcttgcatactttttgcaaatcatgtctgctcaaatattttgaaggtgggcagcatccaattaaaaactaattttcatcgttattgaatttttgcctttcagataacaatgattgtccaaagtgccataaccaaatccaccagtcccatccgtctcattatgtggcatttgatcggacaatgcaggacattgtgtacaaattggtgccgggcatgcaggcggaggagcagcgacggagggaacaggtccacccgcacggatttttgttttaattagagtgacttgggttacaattttcctggtttatcatggtctcctttttaaaaatgtctatccttattttttgcccaaataaattttcaaattccatttgccgttttgcagtgtaaaaagcgccaccaacaaatgaaggaggcgcgcgaaatgaatggacgagcagcggaaaaacataatcatcagaacatttcctcctcctcttcagccaccgccgtcataccgccgccaaatacaaacgatgaaaattcagcggagtgcgctgaacagcggaagagcgcaaatttggcaaccgcggctcctaaaactgagaaaatggacgaaaacggcgacaccaatggtttgtcggtgtatttggcagcagtattttacagaatttgtggccatttgcccgagttgggtcggtaagcgagcgaaaagatatttgactggcatttttaaagggaattgtgcgcatcgcgtgggtgtttgctgtgatgaacaggacgcaaccacggcacaccgaagggtatgttaatgcaaaatttatgtcaaatccgaaaaatttattttgcaattcttacaattcagcaagacgaaccagtgctgatcagactggttccgggttcaactctcagccccctcgaccgcccatttgtgcgtctttcggcattttccactgtcaacactgtgaaacgtcttcttgcctttttgttgctcaacgatatcacaaagtacaacgactttgatgttttttgtaaccgcgaactaatgggacgcgacttttccatggttattaactcatttttaatgcatttatgacatggaatttaccttttttccattttttcaggcctttatccgtaaaacg

SEQ ID NO: 19298 - DNA, 1431 bp, Heterodera glycines
gtaaccttacactactaatgtgccaaaagtgttcaaatgcgatttatttattaattttttttaagtgaaggcaccaattaacaaacttatttaagcgaaggggaaacaaagcttattcttatcctttgtgtattgattaaaacttttaatagcttgtttagcaattcaacgaattccacagcagcagtcgggccagtgaaatgcgacttttgcatgcttttacacaaaaagtcggaaaatgtaaacccctttcatttttataaagattaattgtcatttaattacattccgcaccggaccccttattttaccgtattgaaactggcaaaaaaagcccttgcttggcgtaaacacggcctttttagcagataagcaacaatttcatccgcctttttgagagtttcaatatgatgtgcgatcgcctaagttctggaggtgatgtgtgcaagaaatatgttaaagccatgatgaatggcctgtccaacatcgttggaatacaccttgaacagactcacgctcaatttttctgtaaaaatgtttttaaatgcacgtaaaatctgcttgtaccgtttgaccatgtttttataagtatataattacaattaatgcattccgcttatattttcaattttaacctttgagtttgtctcatagccaagtttacttattgctcaattttcgttgttggtaaaatttctttatgatttaaaattaaaggcattattagggagcaaaacacgtaaaacttaaccaaaaacttaattttggtcatttaaatggttattaaatattttataatgtttttcgaataaggaaaatttttaaaccgagaattttttataagaaaaataatgaattttggcgattaatttttgagaaaatttttgattcataggggtgcattttctgaaagttttttcaattcttaaggatgtattttctgaaaatttttcaaatcatttcttaggggtgtgttttctcgattttattccatttttaaatgaattttccggaaaaacgccaaaaaaagtcaccaaaaacggaaaaaaacgccaaaaaggcaccaaaacggcaaaatgccaaagaaaaaggtaaaaaaaggcataataaaagtcaacgtaaaagcctcaaaccaagtggaaaatgtgttatttacagggctgcaaaaaatatgcacgaaaaatggccaaaatatacgcataaatatgcaaataaaatcgtgaaatatgcatcaaatatgcacaaaaaaacttgaaaataaggggtgcaaaataatttaaaaaaaaaaagtttcttcagcataaattttatcggttatttttgcaattacagatcaaaaatttttcaagattttcggcagtaaagctcatcctattgtctgccaaaatattcttataaattgaaaatgaacgttcaacttcgcaggattga

SEQ ID NO: 19299 - DNA, 3248 bp, Heterodera glycines
  misc_feature (3237)..(3237): n is a, c, g, or t
tgcaattttaaatttatttaaattttctttctatttttattaaatgtgttaattcatctatcaattttgtcaggtctttttatgggatcaattgcaatgttttcaatatgtttgaccttcttttacaccgcacatctgattggcaaagtgattcattaaataaaatttaaaaatgtcaattttttaatttatagaattgggtaaccatgtgcactaaatggccagaagtgtatggaaaagtgcactgtcgtaaaccatacccgggtaatccgcttaatgtacatttattttattattaattattttgcttttgccttcagaaatggcttacagggcaatgggacaacatgccaaatcattcacatccgccattttgaacataatggttagaaaattttttttttttaatttaaggttaaaaatattttgaattgaaatagtaattttataagattttataaatggcatttaaaatacaaatttttcttttaaatttaaatttcccactaaaacatttaaaaaaaaaaaccaatttttgagttatgaaattgcaaattttccctagaattttggcatttcaactgtttatttgctgttagctgcacgaattttgtccgagctgctgtcctcaatgttcccaaatgttgtacaacatcaaattggtctctgctcaatgatgccaattttggcactgcttcttttgcctgtcacatttttgaaatcgccacaagatttttggttggacaaaattttgaattgaattagagaccggacaactgggatcggaaggaacccgggtcgggataccgaccgaatcccgtttcccgatcaatcccgaagattttggaaaaacgatcgggacggaaccagcagaggtcaggatcccgaatttaatcccgcgggatgccaatcccgtccccggcctctactttgaataatatttttgtttatttttaaaattttcataggttggccgtcgttacggcaatggtcaccacaacattgtccgtgttgttgattgtttttggcacttttcttgaccaacctgaatgtgccccatatgcgcatcatccgccattcaattcgggctcctttttcctctcaattggcatatttttcttttcatttggtggtcacagtgtgttcccgacaattcaggcaattacaaaaattaatttaaaaaataattattagaatttaattgcattaaaaaaatgttttaactattttgcaaacaaaataattatttttcaatgtcaataaaagttgtttcaaccattttcagcacgatatgcgaaggccgaagaagttcactcgttcttcctttctcgcatttgccagtaataaattattattttttaaatgttttcaaaattatttttcattttttttcaaataaatattatatatttttttaccatttttagttgttgcttcaatgtatgtgccaatatcattttttggttattacgtttatggcgattcgttgcacgattcaatcattagctcaattcaaacgccttccattcaacaggtaaatgtgaaaaattaattgaatgaatcaactttaaatgttaaaaaaataaataaatttactattattgggatttcttgaatatttgatccagaattttctaaaattttcccggcggagtttaaaggcaccaccggatcccatttttttttttttttagaattttccaaggcctgaaaatagccaaattcggcgccgaaaatttatgtcaattacattgggaaacaaattttttgactcgaaaaacaaaaaaaaagccaaactttttttctggttatatatctgtttaattccgccatttttcatgtttaaataatttcgtaaaatttaaatgcattattattttgtcgaggtttgcttcttcatataggacatatatgaataaattttttatccaagttttgcaataaaattattaatttttaatttcaaattcattggcaccttattggctttccgttgttttctacattcaaaaattctgaggcttttttttacagttcgccaatttgtttattgcacttcactgtattctcacgctgaccgtggtgatcaatccgctgaatcaagaaattgaacatcttctcgacattccgcatcgtaaaaatccgtttaaatattttataattttttaaataaattttaagagtttggttggcaacgcattttggtcagaacatttgtgatgttttccgttgtttttgttggactcactgtgccaagttttgggccaattttgaacctcattggtggcacaactggtgaatatgaaaaaaaaattttttttaattattattttttaaaattttcagtggcactgacatcagcaattttgccatgcctttttgatttatatttgcattcatcggacaacaaaaaaggcgtgcaaaaattgggcggtgaccaacagcagaacaccactaattttaaacggttttttaatataaataatttgtaatatttatgggaaaatttcaattacatcataatttaaattgtttgtgtaaccaattctttttttattttttccaaaattgaaaattaaaaaaatataatcttaaatcattttaatttaataaaattaagctaaatcattttaatataaaaaatatttgctaaatcattttatttttaattctatatactgaaataattgttttagaattattgaaacaacacctttcccaaaattggcactcaatctcagtgtgataggtaaatttttaaatgaatttataatatttaattaaatattagagaattaaaatgaatattatattataatatatttaattaaatgttgtttatacatagaatatttaaaatgaaaatatttatagttcttgccattgtgtgcggatttgccgccacatattccgcttttgtggaactgtcaacaagccgattttctggcccatgctatttgagtacaaccaatttggcaaataaggcaacaaccactggccaacaattaatgcattgctgcggacaatttcgtaacattacgaggcaggcatttttttatgttaaaaaattaaacattaaaaacaaaaaaatttcgaaataaagttgttttatggattttctgggtcgtagaattcagttctgatatcttttttcggcccatttttgaactcctgacccggattcgaacaaaaattcgaaaatgcaactttcgaacgattcaaaattgaattttcganatttttgacct

SEQ ID NO: 19300 - DNA, 1967 bp, Heterodera glycines
cagaattcgccaaattatgcttcctgagcctgaaatattcttataatttaaatttatttgttagaaaatttattagataattttggatactgttaaataattaattaggcctttaggcccgtaacctttccctaacccgtacttgaacaaaagtcgaaaattccgaaaattcaaccttattgttttatggttttttggtctaatttaggctaggaagtaggaattggttaaaagagcagattcgtgatctgggcccccaaaaattccagaatcaatttttatgattagacattatcacaaaaaaattaataaaccaaaagccaccccccccccctcttttgttttaataaaattcaaaaataccacttttaaagtagcgctaaaatggcattaattttttaaatttccagtggactatttttttgccaaatttcggattgccttccgaagctttctgttaattgccagaacccaaccaataacgatcagcttaatccaagaataatgtaccataaattgctgcatcctgtctttgttggtcatgcgctgtttgaatctcagaaagctctataaattaaacattaaattttaaaaatttattttaaacaccaaattgaatccacgccgtgtcgccattgtaaattttgctcaacacctcctcacattccttgtgcgatttgttctcataaagccaccgggggctttcgggcagaaaccaaaagccaacaaattggacaacactcggaattgcagcaaatccgaccattagtcaaaaaaagattttttattaaatttaaatgataattaatcaataacgaaatgattacctccagccccaattcaacggatcaatgtaggaaaacgcgaacgcaaaaatatttgctgctactaagccaaaagtgatcatcagctggaagctggtgatcagtcgacctaacaatttttgtttaatatttcaaatatattaaaaaaacaatttaaaaaaatattaaaaataatataagaattaaataaataaatttaattaatacaaaacacacctcgaatatgcgctggtgaggattcactaacataaattgggacaatcattgaggcaaaccctacaaattgaatattattttttattatattattaagatataataccaattgctattcctaacaaaattcgtccggccaacaaaatccatttgcttagaccaattgcacatacaattgcaccaaatgtgaaaattattgtggaaagaatgatcatctggaaaggaaaattaataatttttatgttttatatttaaataaaagattttgtgaatcaattaaatttctactatttttaaattccatcatttaaacaattttacttttcttctgccaaaaatgtctgatgcttttccggcaagcagtgctccaaccccggccattcccggcgtaattgaaactataataaaaatttaattttctaaaacaaaaattcctcaccaataagcccaatccatgcgttgctcatcggcttcaggtccgaattttttggcacgtaaagcatcgcagcggagacaatgccttaatttgaattgttcaattaaaaaataaattaatgttttaatttaagtcccctgaaatttagaatataatttatcatattttacaatatagaagaatgttttttcacctgtgtcataaccaaacaaaaaaccaccaatgacagcaataaaagcgagctgaaagcagaaaattggcacattaaaattaatttttgttttgttttgaatattttattataaataccaaattttaatttatattaagaaataaaaagaaatcccaccaaatagataaatttcccaagctttggcttgtgttttggaagttttggaccagcggcggttggcgaaacaatattcatagacaccattttagcaagcaaaaactggtgtgtgcctcgctaaagtaatttaaaattaataaaa

SEQ ID NO: 19301 - DNA, 1094 bp, Heterodera glycines
caaatttaccttttaatagctttatgaaaatagattatactctatataaacacactccccaagagaccaaaaatcaggaattttgacatttggtaaattacatttaaacttcaaaaatttgccagacccgaacccttttactcatggaatgaaatgactaacaagggacatcgcgaactttgagtgctcaaatcgcttaaaacaatttttatatactattttatctaatagagaaatttacagctaattaaaaaaatgttaaattaaataaatctaaaaatataccacatatttttcaggtcatttttagcgcatggcaaaaaaaagaacgaaactttaaataccaaatcgattataacgttaaaaacggttttagattttgacactcacagttcgcgaagtaaaaccgccgactcaccttcgaaatggacaattgagggtaaatgctggcgttttctgcttggaactttttgacgtaactcgcgggaaacagtccgactttgcccttggagtttcgcccttccacccatcctccttcaattccctgcaacggattgattttctttttaaaagtcaaacactttttattatttacctccttaagaatggtaagaatttcaccagtttttatggtaagctctccgctgcccggttgagcttcgaagtcaaactccgccttaacctgtcccattttcagagccatttctagtgacgatttaatctcaggggtaaattttaaaagaatttaaatatttggcaattctaacgcaattaaattaagaaaaaaagggttttacgagtttaacttagttattacatatacaacataaagaattcagtaaaaatcctcgtatgctccctccatccgttcgtagtattcggccttttccgctaaatgaatggacttttttaatcaatagacaacaaaaaattaaaaaaaaataaactatgaaaggatttatgaattgtttaaccatggcaatgaggtcttaacaaaaagaggactctgagcctaaaaatactttgccgctttttaggtggctgagtaaaagcaaccatttatggtctcatttgaagtggtaaaaagtcataaa

SEQ ID NO: 19302 - DNA, 1307 bp, Heterodera glycines
gaaattcctcggaatattttgtcataaattaatttctgcctttttcttccgtcaattcaggtccatcttccgtttgtttttcagcggtatctaccatttcttcttctaattgtaataaattgtctatttcttcctttttgggtcgtttttcaggcaaagattcttctccagcatgagttcgttgcttttccttaagctgtttattttttttggttttatattaaaaattaaacaattaaatcagccgaaagcgtatcatctgacggcacagaggcagcgttctctttaaaaaatgtttaagtttaattatgcggtattatccattcattcattacacctgttgttgtcagttccgcataattacgctgctgaagccacggtatttcggcctttgtctccggtgccacatcaacgttgtcctcaagagagaccgtgataccgctcccgtacagatcagacctgggtgctcttgaaaatgcacgatgaccaagctaaattagccagataaaacagaaaaccaaacgcaaaaactgacacttgcaactgttttcgtgttcaaatcaatggtatcgccttcaattctcggaaggctggttttaatcaccggctcgagcaattcacgtgcaaatcgaagcccgtccatctgcttgagaagcatgaatatgcctgccatgtgctcgttgaattttgcctaaaaaaacgtcgtattttataccattaaacttccttttttgtccaaataccatcgacgatcgtgttatcgttgaaggaccgcctgactcatccggttctaccgatgatttgcactgccaacatcttataataggaactaatccgacaaaacttcatgtgaattatccaaactacctcatttcttgagaaaaaggatcgtaaatttttccaatatccattgcatcatattgtcttttacaattcgctccaatacagcgataatgtgctcttaagtaatttgtagataaaaaagttgctaaaacgtacttatgaacatcatccttctcgcgaacctccaatttttgacgaatgtgatcgattttgtacttggctacgttaatcacggccttatagttgatgaaaaggtaatttacttttcgtagctttccatcgactaaattttatttatacatataaagaacacatgttatatgcatatacataccttcttctggaacgagtcgctcttttacaattttatcaacctaaaaattaacaaaacgaaaacaaaagaaaattaaaaataaaacttttaatgtaatgaggaactttctccaattgtctttggtcaattt

SEQ ID NO: 19303 - DNA, 1047 bp, Heterodera glycines
ttttcttaaggatattttccaaaaaatgtcaagatagtgaaaaaatagtgacaaaactccaaaatagtgatttttaactattttagtgacgaagatgccaaaatagtgatttctagtgaccgatagttacatcagaatcgaaaaattttaatacagaaatgcgttttttgagctcctttcttcaaaacaattgagcaaaaaaaagttttttcactaaaagttgcttccctaatgattacagaattgtggggttgactgtggccattttggcgctggtcgtcctcctcctcatccttttggcgagttattaatttaatatactgatccctaatgaatttgaatagtatttgttcgcgaaattgcgcagttttgtccgcctcctcccctccatcattgtgcacggcggcgtgaacagaggcgtggaggaccctcccattggtccgtccgtttccgcccttccctcctccgatccatccgtttccgcccttccctccgcaggtccgccgtccttttcgcctggcccttcgtccgtttccgctcgtccgttgtcgcccgccgctcgtccgtcgtcgtccgccgctcgtccgtcgtcgtccgccgctcgtccgtcgtcatccgcccaccgcgctggtccgtttccgcccttcccccttccctcctccgatccatccgtttccgcccttccctccgcaggtccgtcgtccttttcgcccgccgctcgtccgttgtcgcccgccgctcgtccgtcgtcgtccgccgctcgtccgtcgtcgtccgccgctggtccgtcgtcgtccgccgctcttccgtcgttgtccgccgctcgtccgtcgtcgtccgccgctggtccgtcgtcgtccgccgctggtccgtcatcgtccgccgctggtccgtcgtccgccgctcttccgtcgtcgttccgctacgaccagagctcatgggcaacgcccgtctggaccggttgataagaaatgaaattgtaattttgttttctgcctgtctcctcactcaatactctctatctcatattttatcttttttcctctg

SEQ ID NO: 19304 - DNA, 865 bp, Heterodera glycines
accttatctctctctctctctctccctctcccttccctctatcccctcctgtatctttcttttcttctccccttcctttatttctatctctctctctccttctcctcctcatcctcctcctactcctcctcccccctcctcctcctctctcttatcttttcttctcctcttccattatctctctcttcccatatttctctctctccgtctctctttctctcccacttccgacttaatcaaacattgagaatccttctccattaccaattcttcagattcttcgtcacttcgcaatattgctgaattggttgggctaaggagagggaagtgcggcagcgaagtgttaattagcgatgccttagggatgggatgtgttgggatggcattgcaaagcacgcgcaaaaagcattctttcagtgccaaagcccgcgcaatttcattttaatttcctcaatctcttttctgatgtcttgaccatttgttgacaatggcatgagtttggctttcttttctcggctttcactgcgttctctcccctcccttttcatctctcttccgccgcctttggctttatccgttcggattgcctcgggcaacaagcttaagcatcacggcaggcaaatttgttcagaatgagtgagggagaggggagaggagagaatggaaagtgtgatacccccccccccccgtcccctccccgcactgttcgggcgaatgtgttttgttttttcattatcagaagatctcctcataaccgcatagggtttcatgcttttcctccgaattcgttaagccatcatttcccctcccttctcttcccccctctcccatttctctcttcctttttccctctctctatctctct

SEQ ID NO: 19305 - DNA, 1900 bp, Heterodera glycines
ctaaattctcctctctcttttcctctcaccttctctcttccttcacccctctctctctccccctcttcctctctctctctctctccctctctatctctctctttctctctctctctctccgaacaaaactatcagcaaacatttcccaatgtttcctcctcttttttttgttggtgtgattcattagtaaacaaaaaattccaaattttctgtcattccctaacaaattcagtggatgtatcattttcttttcttaatttgcctcgccgcactgttcgccccccacggcgttttgtgccgtcataagcattttcaccaccgagtgccaatcatcgatttggacggtgccgaacaattagtgagtgccaacttaaaaagttctcaaaatttaaaaaatgccattaaattcgttcaggtgggcacaattcgtgaagacgatcgaacagtaaatgtgtctccaaagctgcgaatttgcaaggaacaggtcattataatttattaataaactttctggcaatttaccgtatccaattacatcgtttgaccattaccgtacccctaggccctgtctgtcattatgaggtcagctgggcggacgaagacgcatttggtggtgcgcaagtgccattcgaagtgcgcattttggacaccgtggacggaacggcccaaatccggcacaaagacggaacggaagcattggactgtgcggtgaaggcgcaatttgtcatccgactaagtgcggtgaaatgcggcgacgacgcggcaaaaagcgaagcgtaaggaaaaaaggaaagaaaagccatgaaattgttaattaattaatcgtttacctctgctgttcagagtggagctcaaaattgctgtgcaagatgttaacaatcactccccccaatttgatggtacggtaattccattgttacggtcattccatttgcatatattaacgatcggctgggggaagccctgccctctccaactccccaatttgcttgatcatatttgatcaattgtcgcttcaatttcgaattttccctccttttcagctccttggtattccttcgacgttgacgagggccaaactcatgccgaaattgcgcgactgtacgcccacgacaaggactgcggccacccgtacggcgaagtgtgccgttacgaattgaccaatacgctcgcggacagtcccttccgcatcgattcacgcggagtgctcagcgcacaacgaccgttaaaccgttctttggccgagtcgtatattttgacggtggtggcagaagactgcggaatggtgtgttgattaggcagtttaagaaggaagaccaattcatgaattaagcatgtgtttatactttttgataatatgatgcctaattagggttaattagggtaattaattttccaattcatccgtttcagctccgttcaaagtccgtgcttgtcactgtccacgtccgcccgcgttgcgttgatgcgctgcgctctaacggcacggcgcggggtgcgcgtcatgttgaacaaaacgatttgcgagggattgtcgtgtttcctgatgcggaagtaatgacttgggaggatgagcacatttcaaatctcacatttgccaggtgatcgcattcggcgccgcgggtgcggaatgccaagcggaagcggacctggagttggagcagatcggctcggagcatcaagtgaaggcggacgcactggcggagtgcgggctgagcagcgcggacgccgtggaactgttgccggaagaagaaggaatacggaaactccagccggacgggatgaagaagaagaaaaaggatgaagccgagaaagaggacgccgaagcggaagaggaggaggaagaagcggacagagacacggaagggaaagcggcattagacgggaagacataaggtgg

SEQ ID NO: 19306 - DNA, 2866 bp, Heterodera glycines
  misc_feature (51)..(51): n is a, c, g, or t
  misc_feature (77)..(77): n is a, c, g, or t
cagaatgtatttccaatcgtcgcagtgtgtccttggtatccattatgatgngacatctgaagctggcccaaatcagnaaacgcttgccgccgaagaacgtcttaccaaaaacctaagcattaaattttgttttttaattcctttttgccactttctccaaatattcggtcgtaatttagttgtccatccacacgcgcccacaccaacacaagaacagccgacttttgaagcagttgatgatgtttggaattgacctttttggggagaagcacgaatggctgaagcttcttgccgtcagagcgcgccgtgaggatgactatgaagcgagctttttcatgtccggtattcaggaccgtcactgttttggcgcacttttcggtgacgcacgtgccatccgaagggtctaaccatacggccgtttaatcgcaggcgtaaacagcagagtaactaaagcaaagcaactgaaaatttgtgacggttcatgaaacactggagccaaccgttgctagcctaatgataaatgtttaaaaacaaaacaaaaaaatgaaataccgcaaaattttccatgtttttgttgatgcacagttgttgtgcttgtgcgaagatcatgttgcgcgtcacgcgcaatttcttctccctcagcgcatggacccagttcgacgattcctcgtcgaattgtgcgtcagtcaatttcctccctccaccaacaagcggcttgcgtttcgccaactcatgccttaattataatatcagttgaaaaacttgagacatttaaaatttacgtttttctcaatgccgtctcctgctttttccagtcccgaacggtgtttcgtccactttgaagtgtcggctggcggcgtgaatggacgacgtcttggcgaagtccaaaatgacgatttttggtcatggtgtagccgcgacgtttgcgcgttgatggtgaagccaatgcatcggtgttgtcgttgtcctctgcgattgtttgtgtgttgacgaattgtttgaacgcgtcgtcgtctttgtctttattggttgcttcatttatcacaatggcgttcgcgttttggtccataataccgtcatcgtcgagccaacagctgcagcatgtgacttttgcgccgaatccctcatcgtcctcagccaaaaatgagcaaggagcaattgcatggcacggctttgagcatttacggcactggtgcgccccagaacagacgtttttgcagtagcagcacatcttaagtagaaaaatctttaaatgaaaatttatgcaaagtaggtgctatcattttgaactaccttttttagcggttcagaagagttttgctcgtccatcatttaaaagaccaaaaaggtaagtaagaaactaaaaataattaggtaggtagatgaaatctcaaaaaacaggtattttggcgaaaagtttacaaaaaaaaattgccaatttttgttggattgagtgattatagttaaaattttttaatcttttcttccgtcaaacgctcaagttttttacattttttaaggtaactcgtgcttttgaatttgggctgttcattttgtgaaaaatgctttttatttgaatataaccctattaatgtcataagatttttaaaataagtaaataatactttaaatttagaatgctcttatttttgaatattttagctaattgattttatttattaaatttttaagtattgaatccattgcaaaataatttcaatttcatttaactgtatttactttgtttttatttgtttttagttgattactgagctagccggttataatcctgagttcatattgtaaattcaaaaatttaatttctcttcattattaattacaaaatgctttaaattgatgtttatcggtaattgtttttttgaatcttatgttctttaatatttggtcatttttagattaaaattttatatttatttcaatacaaatttttttcaagcaaagttaatgctttattttctgtaaaatagtcaattcattcacatttaaagaaatagtgtgagacgaggcaatagtttgttttagattatgaaaatgtatatttttttctaatattgaaaagttttttgctttaagtaaatatgcattattctttataaattaaactttaatttactttcatgagaaaacagtaaaaaattatgaattaaaatatttattacaattttgggtgaagtagcctcttgttttgcacgtgatagaccattttttgctaagtcattccagtgcactgtccgaagggtagtccaaatctattgccacttatgtgccactacatatatttgattttttttgaattaatactcaaataaattaaacttaaatcttgaataaatctaaaatatttcgccgaaaattaaatctaaatatattaattaattaaaatttgaaaaagtaaaatatattagttaattatttagttagatctttggattatttacaatttaaaatatgcattattcatttagctttttatttgtttttatgatcaaagtttttataaaataaattatttaatattttttaaaattaaaacaaagatgtaaatgagataaattatataattaattttggaataaagtaatatatgaaatcatagaaataaaatttattgttcagctgctcatttgtatatttttaggtcttaaattaaaaaaaaataataattaatatatgtatagaaatttttaattaagaaaacttattgaataataatgttatttatgttattcttaatttgttttgcctttaaaaaaagtttttgatgtatttcattttgttcgttgtgtattttcatattgtggaaaaaattgttattaaaaaaataaaatttctccttattattaaa

SEQ ID NO: 19307 - DNA, 2860 bp, Heterodera glycines
tccgaaatcgaaaattgaatgaggacaaatttatcacaaaatgacaatcaggaagataaatcgcataatttgcatttttccgttgactcgcctaaaatttattcaaatttaaaagaacaaataaaattatgctttaactttgtccaaattgtgcgaagaagtttctcgcaaaactggaaccctttacaatttcctctcaattgtcagagtagatgcttttaaggacactttattcaattgaaaatcataagtggaaatgtaaagttaaattaaagagtgatcgcgttttaaaaagcaagaaacaaagcaagatgttaagtgagtttttatcgctttaggcagggaaacttcctgaggacaaatgaataagcaaagacttaaatacaaatgtgtcaaatgggaggggcgaaaacagacggaattacacaaattatttttgagacattttccgaggggttggaagaattgagtcatttttgagtgagtaagcaacagaagagccaggggaattacaacatagaaaatgccataaactgagaaaagagataacaaataaatataggaaaaatgaactggaccaaaagatgcaacgtccatcccctcctccataaactgtacacagtgccatttcacctctcgcgcctccttccaccgcgaccattccagtttcttccacgctggcaagaccagcattgacaaatttttggcccaatttgaaattcttttcccaattggcgcaccaaataattgacatgagttcgcttttggtcttgtcccatcgtagggcaccacttttcctagtgccactttggcccctgcatcgcacatgaagcgcaccacaacttggcctttgcttgttggcactttgactcaacccttgctgttgcagagcgcaaagcttgtttcgactctccattctcgggtgggtcttactccggcgattgtctctttagctcctgagttgggctcttagactgttgctcattctcttccttttccacacgggaatgctggccaggactcatcgatcgattgttccaaagctgccatcacacgttcctgtccatttccattaatctgagggtggtatgccggcgatgttatgtgttttactccttcgttgaccaaaaatcctctaattctgccgatataactgagcgccatgtcagaaaccaaagtccgaggttacccaaaaattgcaaatatttcaatcgacgtgtgctcttttaaagggaaatatttcttcagaccatttgtagtttggctttgcgcggggaggggcgggtgcatttacctgacatatctcacattcttttactaattctccacttcctctgaaatcgttgacatcatacatgtctgcgtgcctttgccttgcattttacaattgcaaaacgagttttatgaatcattttcaacatataaactttaagaatttctgggacaataatttggctttgcgtgtattttctgattatatttccctctaaataaaagctatcccgattttgataaagagctttaatctcatctccgattgttagttcagcccaattttcctattttcaccattacttttttcaagaatcaggtccgttttcgtttcttttttaattttgctctatcaaggtttcattacctctagggcttgtaagtacgggacttgttattttaactgtaaacaacacaatcccatgtgattggcacgcgtaacagtgcaacagcgactttatttgcatgaccatgctaataaatcatttttggctcaaattcccgaagctatagccatcgctttaatttgggattattagctctgccccgtataaagcgttcgaaaattgtgaattgcgtttacaattgcaggcagctggccatgtgtaggtggtaatttactctctgtggccgaaagagttcgcgaccaaaaagctactgcatgcatttcgattccatcatttgaattttttcatttcccgccacttttgaccgtttgctgacctgttcgctttatttcttttcaatttccctcacaacgagctcattcctcctcaatttcatttttcataacgtttcgaagacgatccgccattcgctccaaatcttttttcagctcgccgtcatgggtacgcgactttttctagccctccttcaaccctttttccattttctccaaatcgtttaaagggagcttttctgcaccaattttattttctgggttcatttcaaagaaaaagggtgtaaaaagtaaaaattcaccgccacaaaaaaattaaactcaaaaattcacggtcacgattcatggggtcaattcggtcaccgtcatgatgcatgtggttcacgggttttttcagtcacggcacacctctaccaaatgggcgtttctcgttacagtattagcctccaacttacttcacactttgtctctccttaaggctgtaaaataacgcctggtgtccaatagctcaaacattatgcgtataagaaaaagttgttctttgtattaaaaattttaatatcattttaattaaacacaactttcaaaaaccaagccgttcgaattcctgtccaaaaacttaagggctgggcttgtaaatttcccaaaattatatttaaactttaaaaactcattgtgattatacaattgtatgatttcctccttcatattattgggtggaagcatttgtcaaaaaaagattttttgagatttcaggcgaacttgttttcttcatattttggtgtgctgttccataatttggactattttttggcaacaaatcgattatgaaaatgcaaaacagtctttgatattttgaccaaaagtcgaatgaaaaacgaatgactgccttttttgggccctgagggg

SEQ ID NO: 19308 - DNA, 1507 bp, Heterodera glycines
cgaaaaatgaaattggaggtcaccagtggcaaccgctccccccgcccgaaaaaggaatagagagagagagagagagaagagagagggagaaagagagagagcaacggaaataaaaaggcagagaaagaaagacgactcagagaaaatggaaattggagaggacgtgacgagaaatcaaatgcgaccagcggacctttgtcggttcgcctggatgcgtttgttgagcataggccaaaaactggtggtaagtttgtttgttaagtgcctcttggatttgtcgtctgaaaaggaaagaaaaaagtgagcattatcgaacaaaaaaaagacttttgctgttcaaattgttcaagaacttcttgcgctcggatggacgcactgtccactaagacattgaggtgacaatcgtttttggactgtccattgctgaaaagggaaagaattaaaaagtgggggtggggggggtgggcgggagaaagtggaattgatcaggaaaatcaacgaacactgaggaaaaactatcattaacgaaagatgaaagaaagaacaacgaaaggctgccaattaggggaatcgatggaaaagggggagagaatgtgccgccgacacattttggaggggaaggaatacggtaagaccacagcagacaaatgcaaatgaactttgacggaagaatgaaaggaaagcaaaagacagtgacagagtaaacattaattggaaagccgttaattatcaatgggattgaacatcggaatttatcccagaggaaactcacgaatcctttgatggattgtcaatggtggctttttgattcggctcatttgtcttcgctttgcgttcgatttctaattgtgcgcgaaatgatggacagacgacgtctaaaagtcggacgaactcgagcattgcctgttcagaagttaggtcgctgattcttttccatgttttccttaaagagacgaaagaatggcactttttcgagggagtgacgaattagacaatttatgacaatggcaatttcaaatgtaaaggcttagggaccatgtacaaggatagaataagacaaacagcgaaagagtgcacaaatccccggggcattgccaaagggcggcggggggggggggggaattttccgtttttggggaaagacggatgccgaagcgttggcagaaaagtctcacccaattcaattgaggaagtgaagctcctcctcaagaaacgagcttctcccccgcccatgaaatgttttattcgattattcaatttgcgcctttcaaaacatttgatgagataaatttaaggcggggggggggaatttactgcatcatttaggctaatgataaaaaaacatttcccacacgatttttaacatttcgcgccagagtctctcgcgaagataggaggtgcaccatttgttggtttttagcccaaattcgggtccccaaatgagaaagcacaaaataaatttaaagcattttttttattcgatttacttcgcctcgttgcccataat

SEQ ID NO: 19309 - DNA, 465 bp, Heterodera glycines
tggaagtgcgattcaaagaagacgcccgacggaataggttcagaaaaaaaaaaagttgaaaaaatttgactcaaaagggggacccaaacttaatgaggtcccggtttttcgggttttgtaccggtttaacatggaattcggtgttagttacaagctgtgtatttttagaccagctaattctgaatcaaatgcaaaaaaccacattcgaatccatcaaatctttaaagttttttgagatttggcttttctatttttttagttaagaaccatgcatatcgaacagccaactttaacttacttttgtaaaaagtaacggcgattttatacgcctgctgagcagttactccaaaatcggaaagcaaattggcactaatttctgtttgttctctcggcgattcatattcaatgacgtccatatttaaaataaataaaattccacaaagtgactgacctttaattataaat

SEQ ID NO: 19310 - DNA, 1928 bp, Heterodera glycines
  misc_feature (65)..(65): n is a, c, g, or t
ggagcgtgtgcaccgtttgttcactcaaattggcaacctaaacccttatattttcggcaatgtcncacggcagttttttggatgtaatgttttctcgggcaaattttaataaatccaccgcaacgcttcaattccaatttatatccatccatccaagaaatcaatgaaaaaacagacattttttggcaaaataatctgtcaacagatcgattcagaaaatgccatacttaacaatttttaatgccgttttttgtcctattattaagcaaaaattcaccaaacatttttcatttccaattcaccacaaattcattcataagatgggagcgcatttctgatgacgagctgcagaagaagttgcgggatgccaagcagaagctgcaacgtcaggagctggacaagcaggagctgaagcgcagggcggacaaacacccgttgcgcaggaaggacccgttgattgaacgcctgcgggtcgctgcgccgcatggaaaaatcaaaatggtatattatacgacatgtgtggactgtgaacctactggtagaacccggacaggaatgcgattccctcagggtttccctggatctcgatcccgaagtttttgaaaaagtctgttaggcatttttgaaaaaatgtaatgtcgggaccaggatcccggccaaatcgggatttgaaaagcctgtggtcctgtctgtctcgacttatttcccaatttcgatatttcttgctaaaattcctctattttaaggagtacattcgaacgatttgcccaaaatgtgcctactttaatcacacacgcatggaatgctcacgggctgatgtaataattatattattgtgccatcgataattttttttttttacagatcggccgtattttgcacaaacaaatttgcaaccaaatggaggagttcaagaaagtgttttttgtccatctccttgaagaccggatggttgacttgacacaggtgttttttttttgagttgttttacctaattcataagtactttggactacttttggcagaaatttgacactttccgtgtcatggacggcattgaactgaacggcacaattgacccggttggactccaattgcaagcgatgtgtccgggtgggtgctgtgcccgatttttcattgggacggacggacccagcaaaaaaaatatcatttaaaaaagacaaatgaatttaccacttaaattgtcccagatggcattgttacgcagatggacttgcgcgagctgtgctctaattgtgccatgttgggccacaagcggacagaatgcaaggagaaagcggagtgcagccgtacacattatgacaaaatgctggaactcgtcaaggtgggcgagagagagagggggaggggggcctaagcggccaactccgtcccagccaaattttaagggtccggttttgcataaaaaaagcatttattcatcgtgcgctttcaatgcataaaaatagtgtccaatttggtcggcaaaaaccttcaaaaaagtttttttaattaaaaaaaaatattagtgtcgtggagcgggttcgaacctccaccaagttgtcatggaatatggccaattttaacagggttatcgcgcgctggtcaaggaaggcaatggcaattttatactgccaactgcaaaaatgatgaacccacccgtgctggtgttgaaggacattgaacgcagtgagccgattgaagagatcaaaggtactcacacgagcgcttatcgacatggtgatggggcattcgaccccccacaattttctgcgccaatccaccatcattcaatcactgggactcaacccaccaatattccaatcaacaggactcaaccctccagcaatcaatcactgggactcaacccaccaacattccaatcaacaggactcaaccctccagcattcaatcactggaagtcaacc

SEQ ID NO: 19311 - DNA, 2386 bp, Heterodera glycines
  misc_feature (9)..(9): n is a, c, g, or t
acaaatctntggtacacataaaaatggcaaaatcaaaatgttaaattaaacagttaaaaagtgttcaaaaatgtcaatgatgaaggaatgagttgttgttgttgttcatcagttttgcgcttcagaattgagaatttgtgcggtccattgttcaaacacagcaatgtgtggagccaatgaagtttgacgatagactaaaacataaaagaaatagacaatttgtaagaaaaaaaaaaatttttttttttttcgaaaatttatgttgaattataatactattgtaagtttttgtcaaaaaattttccaaaaaaacacctgaaaagttttaaaaggggaaaacgggagggaaaaatgaatccataaacccacaaatcgacgaggacttttttgcttcaaaaattttgacactcatataatgaaatgtaaattttaattttgtctaattcttgagaccgcccctagcctgggctcgatgaaccttaaaaaaaccagcccaggctgccctagcccggtaaaatttaaaaaaaaactcgggcccgagcgattaaacggccttttttgaaccaggcggcccgggatcggccaaattggctaattagaagctcgaactctggcccggtaaccccaaaatcccggtctctctctaataaaagcaatttttggttatttgccgataattttttaccaattgaacgttgattctccttgttttcttggctggattctcgcaatgaggcaagttgtgccaacaatttatcaattcgtggcaccacattcggatcaaaggcacggatttccttggcactcaacggaacggcaatatttccattttctggatgcacagagaagggcgatttcagcaaatggttgagcctggaattttttttgaaaaaatttttgaagggtctctcatctcgaatgggcattcttttcgtgcaattacgaacccctaaactggatttgaactaaatacaatggataattcaaatttgtaaatttaaatttatgcttattgttagaaaagatttactttcgaattcaaactaaatgtattagaattgcatcaaccgccatcattaaagaaaagatcgaaaatttcaactctttgttcgaattcaggttcgggattcggaatgctccgaagatgcttttaaattttttccattttaatttgtctttaactgactcacccaacagtgacatttgcgtcgagttgcggataagcaaatttcatgaccaatgaaatgaaacagcgtttcgcttcatcggaaggtgtctaaaaaattgcattttttttacatatttacccaaaatttttattgaaaaccggtggcaatttgatccctcgcgcattgattcgtgttgcatcatcaaatcggagtttcattgattcccaacgcaattttggcgtttgaagcctgaaaatggaaaaccaaattaattgttgggccttagtaagaaaacggagcgagccgaaactctcgagattttgctaattgtaagaaattaaagagaattcggaacaaaattgaaaaacaaatccaaaatagatgagacacagtccaaaaattggatttcttgttaaacaatgagcgcaaattcgacataaaaacgaaaattgtgaaccaaaacccaaaatcttggtaggaaattggcggagactcaactaaaatcccaataatttcgaacaaatcccaaacaaaaaatgcacaccttgaaaagcttttgtcgagcagttcagccaaactttggtcagcccaatgggcaaggattgtggagttccattggtcagccgagtccaaccatccctgttccatgatcaattgctcaaaatcgccggattccatgatttttcggtacgattccgtcacaaatgggtgcacccggtatttgttgatctcagagccatctttgttctgacatttgaaataaattaacccaattcgaaataattatggcagtttgtcaaaaatttctaaaaaaaaaaatttttttgtcacaaaacttgaataaacgttttctgtggatttcaaggtcgcttatttgttagtacaaaagcttatatgaaactataaaaaaaacttattcaaaattaatcgtaatggattttcagggattcgtggccagagcaataccctagaaacatgtaacatgacctacaaatgtcaaatatttgacgatcgcctcacgcccgcgactgctcaatgcgcgtgcctttttgtccgccacccaacagtgaatgccacgccgtccggaaaagacccagagcaaatgttgaaagccaaaatgagctaaaatcgaaagtatagaaagccggtaaaaactttgcgtagaaatttaacagtgggggaaaaaaaaaactaaaaaattcctaaaatattctaca

SEQ ID NO: 19312 - DNA, 881 bp, Heterodera glycines
  misc_feature (868)..(868): n is a, c, g, or t
attagagttgtacgggaccgggacctggtactgaaaaaaacgtacaactgagtacctaagtcccggttttgaccagttttgagcgggaaaagtcccggttttcccaaccaaaaagccacggttttcaacccgaaaagtcccgttcccgggttttctcaaaattccccggtcccatacaactctataataaacctgtgcgctacgcacgagagttccgggctcaacacgagaaaagtctctgtttttggtctcgtctcggtctcgagtttttttttgggttctggcaagaaaatgagaaaaatacaaaacgaatataggatccaagaaaaaaaattagagggaggggggagggactgttgaaatccccaaatttaatggggttgtgatgccaaaaaaaatacaaaaactcgggaagtccgactttttgggcaattagatggagggaggagaggtttttaaaacttaaatttaatttcaaatttatctacacatatttatttacggggatggagatgcgatgccccaaaaaattacaaaaactcggattcggaattatggcccaaaaaattggttcattaaattttgtcaattcgagggaggcgtgaggggctttttaaatttaatttcaaatttacctacacatatgtatttatataaaaatccgagttaggccatcatattttcgattttttaatattcaatcattatgaacaaatcctatttttcgccattttcattaattttcacatttcttataaataataataaaatgaaaaaaatattttataaattttaaaatttaatttccaatcccattgatcgattctttccttttttttttgtttgttgctttcacgaacttgcgatngtgaacttttacg

SEQ ID NO: 19313 - DNA, 1652 bp, Heterodera glycines
  misc_feature (40)..(40): n is a, c, g, or t
  misc_feature (1608)..(1608): n is a, c, g, or t
tagggacgctgccccatcttttgggagttttaccactttnccgtcaaatttgaaaaaattcaatgtattctttggggtagtcgatgatcaaccaaacgcgcaattagtgcaattagtgaaggcacatcatcgtagaacattatcaccttagccaaagggcataaaaattttgttttttcagatgggctgaatatttttttaaagaaaattttccaactccaaggaaaattttttcacaaatttatccgatttcagctcatttttcggctttccattacatccaattttctgaaaatctcccattttttttttttgcgtaatcatttcggcttcccactggctttttcaggtaggctgaatattattttgaagaaaatttttccaaccacttagaaaatttttcgtaaatttacacgatttcaattcatttttcgggttctcagatcaaccaacataaaggagagtaatgaggcgttgcaattttaattctttaatcaatttaagtagtggattttgagaattaaattcgttttttttttaatttatttgttttaattaagaaatcattagctgaacctatgaagttaaatattttatcaaccataaataaaatatataagtgctctcaacaaattgcttaattgtttgatctcccgagcaaaaaaaaaaaaaaaatatagaacaatggagatcggccaaagccacttcagcaagcacaaagctaaggcagctgctccaaaagtccatctgagttttaagcaaataaatttatataaataattttaaaattttaatttaattaatatcaattattttttgatttatattgttccattaagtttgttgttattaggaactgaacaaatgttttcgattgatattatcggataaaacgtcgacgatatcaatgccgagaaaattttaaaaaacctttcaaagctagaattttcaataaaatatctttaaaaaggtcgaaaatatcggtagagataaatacctaatcatgccggtctacatatcttatttccaggatagattacttttagaattccaagaatttaaaatttaataaaatttattagtaataatgtcctttattatttcaaggttgtccttattttatccttatttatgggacaaatctttattttacgggctgaacgtattaaacaaattattttttgacctattttgaatagataaataataaattttgaaaattccaataataataagtttattttaacccattcaaattcaattaagaaagttgtttctatttttttttgaatttttaaatttaatattcaatttattttttatttatatacacattattattaaatattatttcaatttttaagcattattaatttttgtatacaaaaatggatcatgcacggacccaatcacttccatcgcaacaacgactttctgttaccggacgaaaaggcagcgatgttcagcgaaagaggagtttggtggagcacgcagaagcagctgggttcgacaaaaacacaatcattttgacagtaaagtgaggaatgaaaaaaatgcttaattagaaatatcatttgtattcaaattaaaaattataaaatgtattanaaaaatgtgtagtttgttttattaattgtttcattatgtatttt

SEQ ID NO: 19314 - DNA, 822 bp, Heterodera glycines
aatttggagaagctgctttttttgcatcggaatttaccaatttataatttttcttattgatttgtgaacatataaaaaaattttaattgacccgaaacacgaatcccgaaacccgacctttttctcgtcccgaaacccgaatcccgacccgatgttttttcggccgacccgacccgaatcccgacccgatatttttctcgtcccggaacaaacctggtatggaataaacgattttaactaattaataatataattattttaatctattaattagatttgttgaccatatttataatttcgatttattattttattttcccatacaaattacatttttatgagagaaatacagtgtcccaaaaaagtcttgactcaaacctgaaaaactatcgtatagttcatttaaaaacttgaaataattcatgcttgcataacttttggtgctgatcaaaaaagtctcttacaccaacttgatcagatcactccttcctagtgaccgggacacccaaaatacactaaaaattggggaaattttcgaaatccctaaggggctgggaaattttttctagagaaaatgaagccactggaaagatcacaaatttgttacagaattgcttttggaatggtggatctgcgatttgtatatagaaagttatacttggttgaataatgatcaccataaaaatgatcaatttatctacgccataacttttttctagaagcatccaaattaagcattcttggtatcatttgatacacgggaccgggaatttttgccaaaaccgggaccgggtcttgccgggatctgagaagccgggatcg

SEQ ID NO: 19315 - DNA, 1847 bp, Heterodera glycines
  misc_feature (9)..(9): n is a, c, g, or t
  misc_feature (32)..(32): n is a, c, g, or t
  misc_feature (77)..(77): n is a, c, g, or t
agatatttntaagtcccacaaaaaaaaaaatntaattaaattaatacctaatttaatgtgtgcaaaaagtaaccatntaaaaaatattgaaaaaagccaaatatttttttttggtcccattgttcgtttttaatttttccttttcgcatttttattattatctatttgtcatggcagaagtttggacaagaatacatcgcaaggttaggcacacataggtcactttttatttatggtcacaattttgaaattgtgtatgtcctcaaatgttggggatatcctcaaatgtctggtcctcaaatgtcaaactcatcaaatgtctggtcctcaaaagtcgtgtcttgaaaaaatatgcgttgaaaattttaaatgcacttttccatgcctatttgatgatcagggctgcaaaaactatgcacgaaaagtgaccaaaatatgcacataaatatgcaaataaaattgtcaaatatgcaccaaatatgtacaaaaaaacttgaaaattagagatgcaaattaattttaaaaaattttattgctcataaattttatcgcttgtttttgtaattgataatcaaaaaatttcccaaggttttgggaagtgaagctcaactgttgacccactcgcgcatcaattcagatttggacgaaatttttcgttttgctctaatcaaaaaaatttttgttgctaagattttcagttggaatatggcccttacatttttgccagcgacccctaaacactcatcgatttccaaaatccttcccttaaaattttaccaaaaaacttctcttttctcttgaaatctttttcaaaataacatgaaatggggggggggtctcttagtcgatcgtaagggttcgagacagtcgatcgtacgaagtggggggggggtgaagggaggaagaaggagaaaagaaaaatgagggagagaaaaaaagtcagcgaaaaagtcgatcgttaatatgtataaaaacagaaactttataaaattttctcattggcaattcggaaaattgccttatttcttaacaaatttcattaaaaattcaaaatttttacgatcgactaataccgatttgtgaggaaaattgtcgatcgtaagaggagaggggtagaaaaatcgaaaaattttgccggtttttcaaaaaaattccaaatttttacgatcaactaaaatcaatttttttccctttcgtctataattttctttaataggcttaaaagcataaaattgttaattttttggtgaaaattttctagaaatatgcaaaacttaggcattttttggcaaaaatcgtttacaaatcgcattaaaaatggaaaaatttttcccggcggctcctatcggcaccgctggacccccttttcccaaagtttttttgaaaaaagcgccgcaaaaaagtcgttgcccgggtgggaaccccggccccaaacggaattcttgaaaggaataggcgttcaaaatttttttataacactggagaaaacaattttgctttagtttcaattcatgaagagaaaagcctgaagcattatagaattcattctttcagctgttactggaaaattacaacttgtttcaacttcatcaatgcttaaatatgttattcattctcttgaaaatttctctgagataatcccttgtgccaggtagtcttcgggagcggggaagatttgttttccatagttgtcgggacgattggccatgtgcgggaagaatggcttctactcaacgtccaagccgtaggcggggaccagctgaccgagagcacatggcatcaggttgaaggagtcacggaaatgatgataggttcagcttcttctgtgctccaatcttcatctcgta

SEQ ID NO: 19316 - DNA, 1754 bp, Heterodera glycines
ctcttccgctttctgttcctcttccgctttctcttccgctgcctgttcctcttccgctttctcttcctcttccgctttctcttcctctttctcttccgctttctcttcctcttccgctttctgttcctctttcgctttctgttcctcttccatttcctgttcctcttccgctttctcttcctcttccgctttctgttccttttctgtttctcttccgctttctgttcctcttccgcttcctgttcctttccgctttctgttcctcttcctctttctcttccgctttctgttcctcttccgctttctgttcctcttccgctttctcttccacttcctgttcctcttccactttctgttcctcttccactttctcttccacttcctgttccttttccactttctcttaaactttctattccttttccactttctcttaaactttctattccttttccactttctcttaaactttctattccttttccactttctcttccacttcctgttccttttccactttctcttaaacttcctgttccttttccactttctcttaaactttctattccttttccactttctcttaaactttctattccttttccactttctcttaaactttctattccttttccactttctcttccacttcctgttccttttccactttctcttaaactttctattccttttccactttctcttaaactttctattctttttccactttctcttaaactttctattccttttccactttctcttccacttcctgttccttttccactttctgtctcttccactttctcttccactttctgtctcttccactttctcttccactttctgtctcttccattttctcttccactttctgttcctcttccactttctcttccactttctgtctcttccattttctcttccactttctgttcctcttccactttctgtctcttcattttctcttccactttctgttccttttccactttctcttccactttctgtctcttccattttctcttccactttctgttcctcttccactttctcttccactttctgtctcttccattttctcttccactttctgttgctcttccacgttctctaccactgtctcttccactttctctttctcatccactttctgttcctcttccactttctcttccactttctgttcctcttccactttctgttcctcttcctctgttcctcttcctctttctcttccacttcctgttcctcttccactttctcttccacttcctgttcctcttccactttctcttaaactttctattccttttccactttctcttaaactttctattccttttccactttctcttaaactttctattccttttccactttctcttccacttcctgttccttttccactttctcttaaactttctattccttttccactttctcttaaactttctattccttttccactttctcttaaactttctattccttttccactttctcttccacttcctgttccttttccactttctcttaaactttctattccttttccactttctcttaaactttctattccttttccactttctcttccacttcctgttccttttccactttctcttaaactttctattccttttccactttctcttccactttctattcctgttccgctttctcttccacttcctgttcctgttccactttcgcttagactttctattccttttccactttctcttccactt

SEQ ID NO: 19317 - DNA, 876 bp, Heterodera glycines
  misc_feature (28)..(28): n is a, c, g, or t
  misc_feature (51)..(51): n is a, c, g, or t
  misc_feature (56)..(56): n is a, c, g, or t
  misc_feature (60)..(60): n is a, c, g, or t
  misc_feature (66)..(66): n is a, c, g, or t
  misc_feature (74)..(74): n is a, c, g, or t
  misc_feature (94)..(94): n is a, c, g, or t
  misc_feature (101)..(101): n is a, c, g, or t
  misc_feature (104)..(104): n is a, c, g, or t
  misc_feature (108)..(108): n is a, c, g, or t
  misc_feature (118)..(118): n is a, c, g, or t
  misc_feature (140)..(140): n is a, c, g, or t
  misc_feature (145)..(145): n is a, c, g, or t
  misc_feature (169)..(169): n is a, c, g, or t
  misc_feature (182)..(182): n is a, c, g, or t
  misc_feature (192)..(192): n is a, c, g, or t
  misc_feature (215)..(215): n is a, c, g, or t
  misc_feature (218)..(219): n is a, c, g, or t
  misc_feature (222)..(223): n is a, c, g, or t
  misc_feature (225)..(226): n is a, c, g, or t
  misc_feature (231)..(231): n is a, c, g, or t
  misc_feature (239)..(239): n is a, c, g, or t
  misc_feature (241)..(241): n is a, c, g, or t
  misc_feature (250)..(250): n is a, c, g, or t
  misc_feature (253)..(253): n is a, c, g, or t
  misc_feature (273)..(273): n is a, c, g, or t
  misc_feature (277)..(277): n is a, c, g, or t
  misc_feature (291)..(291): n is a, c, g, or t
  misc_feature (304)..(304): n is a, c, g, or t
  misc_feature (312)..(312): n is a, c, g, or t
  misc_feature (325)..(325): n is a, c, g, or t
  misc_feature (346)..(346): n is a, c, g, or t
  misc_feature (355)..(355): n is a, c, g, or t
  misc_feature (360)..(361): n is a, c, g, or t
  misc_feature (364)..(364): n is a, c, g, or t
  misc_feature (385)..(385): n is a, c, g, or t
  misc_feature (387)..(388): n is a, c, g, or t
  misc_feature (395)..(395): n is a, c, g, or t
  misc_feature (403)..(403): n is a, c, g, or t
tgaaaagggtgtggataagtttattttntgggattattttcctatggaggnacttnaagnagaganagagaaantgaagcttattatggaaaanattgtgntgnaggngaaagttganaaaatggaagaggaaaaggganagtangaaaaggaattaatgggtaattanagtaagggaatantgtattttanagaataaagtaattttgagattntgnngannannaaatnaaaaatangnaaaatggtnagnagatggaattgataaagganaagnaaatggtaatgaangggagggaaaagnaaaaaatnagttaaataaaantgaaattggaaaatggatatngtatggatnagagnnaangaaaaatgaagaaaattgggnanntaaaatntttaaaangataaaatccggacaaattaggaattcatcattcaaagcttttaatgagttaagtttaaaaatctgaggatgaagtcgaaccgacgccatctgtgagagattgaaccagtcgaaaatccaaagaaattaaattatttttgaaaatttcaggggagggggttaaaacccaaaagtacctcactactcttttttgtcattttgagcgcctaagaactctataaaagtgctttcggatatttttggctctgtgccattgatacacatttagcttgaaattttggtttatgaaaaagcctcttttctttcgtgaaatttaaataatttaagaaattttcgagtgcacaacgccaatcgaatcgttgggattcgaatgcttgtcacaatgacattaaaatcagtgatgacaaaattttgacggtccttcaaaaggaggatatgggtaatttttattaataaaaaaaaaataaaattat

SEQ ID NO: 19318 - DNA, 1782 bp, Heterodera glycines
  misc_feature (71)..(71): n is a, c, g, or t
  misc_feature (144)..(144): n is a, c, g, or t
gatagttttgaaattttgcaatataatagaggacacttagggctatcgaatgatactaagattgttggatntggtttgcagaaaaaaaattagggccaaaaactcgtcctggtcagatataatttgtgttagacactaatcttntcatattcaaagaaattggtgacaaagacaaaatatgagcgccgctctctgctgctgctgctgtctttaaaagccgtgttattgcttatttgttagcttggatgagatcatttttattttgtttcatccttttgttttgtcatccccaaagttatttctttctttgaataaatcaattacactttaattttaattgatacctttttaatgtttgtttaacgggccacatgcccggaggggatgatttacttgaaatatggagactttttgggtttgacacaaaaaaaactatgcctatatgtaaagttaaaacattttgctttttcttgatacaaaaatgttgtgggtttggccaaaacgaaaagttatggccaaacaaaccgagggtattggacgcataaaatgaaggagggcctaattttttaattctttgaacagcaagaaagcacttttaatacctttttttgtttaggttatattttccaattttgttcaaatttcaattttaagcccgaaaatgttcttttacaaagtaaggggggggggggcagggggagtaattttcaaaaaaaaatcgaaaatttaagaaaaagacaacccagtcgaagacgaattctgaccagcagaagatgtgggaacagaagtttaaggaaggacaagcaaagctcactgaggtgggatcattttaggagcaattaataaccaattaattttcttttagactatttttgtcaaattctgtgaataagaaaactcgtgaccgttaaaatttaaaataatttttgaataatttttttcaaaaatttttattagaatttttttatcgatttttaaagattttgagccaaaaatggatagttgtcagtttttgaggaattttctaattaagaagaatggttcaggaggtgctagcataattggaaattttaatgaatttttttaattgccaaggaaaattttccatttctttccctccttcttttcatatacatactcaaagaatattgaacatttattttattaaaggccgaagcccagaatcaaaagttgaaaaatgacattgagaaaatgcaggcaaaattcgacgggaaagtagcgcaattggaaaagaatttggaggaattgcagaaaaatgtaatgatttgatttttcatttatttatttttaggtcatattagggtggggcggtaatagggatcggaaaccgattggggaatccatttctgttcaagtctaaatcagaattgaatttaaaaaagttgaaaaagaatcgggaaaaaagtatcaaagatattttctatatgtttattttttgaatttgaaaaattgaaggcacttttgaaaatttatttttttcagcaaaaggaactggtgacggaacataatgaattgaaggcaaaagttgacaaaatagaacagcaggaacaacagaagcagcagcaagaagacagcagtaagacacagacaaacgatggtaaggaaagacaaaaaatgtttctaccattttttgagttatacggtagcacttggtcagacaagcaatggatttttagatatttaactatttttcctacagttttgttttgatgagaatgcatgaaaaccagacccgaaaattcatctaatttgtaaaacagt

SEQ ID NO: 19319 - DNA, 1148 bp, Heterodera glycines
tcctttttaaactggccaaaaagtttaggcttattttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccagcacggtcccccgaaggaatggatttaattaaattctct

SEQ ID NO: 19320 - DNA, 2222 bp, Heterodera glycines
  misc_feature (578)..(579): n is a, c, g, or t
  misc_feature (597)..(597): n is a, c, g, or t
aaatctactattttttttattcactatgaaaatcgtgcatttgaatcgattttgagcaataaatgtgaattttgttgaaaattgagtttttgactttttgttcgaattcgggttcgaaatggatgtcggattcgtgatcagcgaccccgaaaacctatattttgactttttttacttagaaattaaaaaaaaaattatgggggacaaactgaataagagcccaatttttttgaaagtgatgaccatcagcagcacatttgggatgttttggcccgcgaaatttggccaatttttgcgaccaacattcgccatatagtattcaaagaaggcaatcatttggacaatttgcgcagtcgcacttcaccgacaattctcactgatctcattcaattgaattcaatctgttcctatggtctgttccccgatgtgatcgctgatgatgatgggccaaatgcaaattatgctgagccggcgttggccaaattgttgcacaatctgagaacggatgatggacgaaatcgccaaattctgtacaaatggctgcacactccgacaaaaaaatggccaaccgaagcganntggtttgctatggttctntgggctatgatccgttgggtccaccaatcctcgaatgggtcaacaatttcaaagaggtggtccgctatattttcttaattgtgtatgttttactaattttgtttaggcatttctccgtgccaccacttctgtcagttacaaaattcgatttaatttatttttggaaccaatgccaattgaaccatttgaattggtgaatgaacggaccaatgagaagctgacactgacggaggatgaagattacgatggtgaattcattggcggtggtgaagtcattaaagattggctgttgaaacggtgtccaattgttggggagacggcggcggttcagcagaagaagaaagacgaaaatttggaccatttgtgcggactctacttcaatcttcatggaaattgtattgggtgagcggaaaggaggcttatttttgaatagagcccggaggggatgatacagtagtgtcctctctcttacagtactttcccagaatcttggcagggccaggggttcctattaaacaggccttgtccctcctgttctcgtccatctcgaaaaccctggtcctcttgtccgaatttttttcaaaattccgtgctctacttttagctgttctcatccatttcaaattttgcttaatttaggccgctgtctccgccagatcaaagcgatgaaaaagtgttctcttttcccggacccagtgatcagcggaagaagaaaaagtgatcattttgggaaatgaccgatcatttttgagttgtgatgtattggattgattgatcatattttgtttggcacatttaatgctgatttgtgagttattaaaaatgggatttgagtttggtaacaacaacaacaacaaaaaaaattgatcaaattgaacaattctctggactccgatttcacatatccatttcaatggcataaattaaccattgaacaatccgcgcaacgccattccccattacttaatgtacgcataaattaacaaattattgccattatttttggccagcagacctttttaatctcttccatccgtttaacatcgctcaatttttatgtttttaccaaaaaaacggacgaaaggctaattgatccatttgagggtacttatgtactttacagaccataaaaaataatcttttaaaaatcataaaaaaaatttctaaggggttttcatccccataagaactggttgcatgacctccattgcgactgccccgaaaacaaaaaaatcgattttttcaagagtccgtttggggcactcacacaattatggggagtaaaaatctattattttttatttttctattctccttttttaaggattcggtctccccataaatctgggcgcatcggcctcggggggactgccccgaaaacaaaaaaatcgattttttcaagcgaccgtgttggcgtactaaaacaattatggggagcaaaaatccaacgcagaattaaagtacaggctatagggaagctattcccgaaggaatcgggctccccataaatctgggcgcatcagttcggggggactgccccgaaaaccaaaaaatcgaatttttcaagcgtccgtttggggcactcaaacaattatgcggagcaaaaatccaacgcccaaattaaa

SEQ ID NO: 19321 - DNA, 904 bp, Heterodera glycines
cacatcgtttatgtcgacaattagacggctctcttcctcacacatagctcttcaatcttctctatgtaaaccttttcctctgcctgtttgattttgaattttactttatttttaggttttactttacactgtcatccaggaaattcaaatattcctgtgttatctcgcgcatccgattctcatccgctttgtcggtcattcccaatgttcgtaaacgattctccattcttttctttgttaaaaatattttccgagttaaaataaagtaacagaaaagttgcttttcttaaaatgacagtataatgtaatgaaaatggcattagtttgaacagataggtaaaacttctttaaaaagagaacggaatgggaccattgaattcgcaaaaaaaaaagaaaagaaggaaggaaatataaattgaaaatttaaataacgctaaaaaaatttttatgaaacgaattttattttaatttgtattgaaaaaaaagaatttttcgtggttttttctttagtaagtttctgacagtgacagttatgttttggttttttagttttcaaacaaattcttttcacttgcatttacggttttttgaccattgaatccttttttcacgttgttttattttattttgataatcggtcttttacattttttctttttttcattccttttcaagaacttaatttgaggattacattgaaaataattaattagacttcaaaatgggtatttcccaagacagatggcacaagcggcgaaagactggggggaagcgaaaccccattcacaaaaaacgaaagttcgaaatgggacggccggcagcaaatactaaggttttctgaattaaacatgtgttgttttattttcgttatttatcaaataatatttcattagattggtcctaa

SEQ ID NO: 19322 - DNA, 1502 bp, Heterodera glycines
cccccccccccctccctttgcctttgtttgcttttccccctccctttccgcttaatcccaactcgaatttcccctcgggcgtgttcattaaaccaccgacaaatggggagaaaatgataaggccgagggcaatggctggtgaaagcgaaggagggaatgaatgcgagcggtgcttttgccggtcgctccttttcagcgaatcattcgccgggggaaacgccgccgccccccgcccaatccttcgccccccgcgcgtccgacactttatggagaaagcgttttacatgcaaagcaaacgtgcggcatttgtgggccaaagtttgccagaatgacgcattggccaggaaagggcatggacaaatggcaaattgggggggggggggggaaacgggggaccattcgcttggaattccgttcctctgaaatcaaaaaggacaaaattggccgagggagaagcaccaaaaggcattcgttcacttttctttttttgatggcattcattgattatttcacttcttccagacagattaaaatttctgtcgttggcactttcttcgccttccatttgttaattccgtcttctttttcccctcttaaaaacggaaaatgacggccaatgagtcctttgccttggatatggcaaaagttgaattggtgcccatcagtccggtcattttgcgcgtttccttcatcatgtcactggcaatcctcggcaatgtgctgcttgtgtttgtcatccgtcgtggcaatgccgtggcacgacagcgtttgtcgccggtccaggcacggaaacggaaatccaattggctatttgcaatttgatggcactttcccctccctcgccttcagcttctcctcctccacacttgcactgctgacttgctcttcgctttggtcatttgccaatgcctttcctcgctttaccttcctttttgcttagctttctctcggcactcaaattgccattctcgccacttatccctattttcatggacctgatttggttggtatgcccaaacttagcccgtacgaccctttttaagttgtgccgttttgtgcgctaccttcaggcgttgccaatgtacgcgagtccgtgtgagtggggggggggggcaatgttcgcaatgtctttctcgctttatccgttaagttcttctggtggccataagcattgaccgttaccaagtgagtttagctcggttttcttccaaaattggcactttttggcgatctgtcggcccctcgcccattaccgtagtgaccgttaccgtcgtcccaattgccttgggattttcgcttggcttttggcccttctctgctccgtccctcaattgttcttctggcgcaaggattccctgagcaatttgtccctttttggagaggaccaaaagtgaaaccaaaacaacgaatttaccctttttatggtaattttttgatttagcgaaactccgatcagagaggagtgccacaccatctacagcatttacagtcagtgccatttc

SEQ ID NO: 19323 - DNA, 593 bp, Heterodera glycines
gtcattcatgggacgcataaacttgcacctaacttttgcttacttgttgatgtaaagattcatcaagttttgaaagccttccgcgatcgtcggaatgtcagagatcgtttggtcctttaaataattttcaactctttgcgaggtcattttgctgaagcttgaaaaaacaaaaaattgtgaattgtcaaagaataagaattttatgcgctactgtaaaagtgacagatttgaaaaattttttcacttttttttcatgcaattttattttttataaatgattttttttttaaagtgaacaaattttcaaaatctgtcacttttacagtagcgccgaattttaaatctacactagagaccggcgcgggacgggatcccgcgcgggattttgcgggatcccagtccgcaatcccgcattttttggaaaatgctggatttgcgggatcgggaccccgtcccgcaaagaattttgagttccaatccctcagcgggatccgcaaatttgactttttgtgcgggattctgcgggatttcattgattttttgaaaactttaaagaacagaatgtcaaaatttttgaataaatttataataaa

SEQ ID NO: 19324 - DNA, 1131 bp, Heterodera glycines
  misc_feature (1088)..(1088): n is a, c, g, or t
  misc_feature (1116)..(1116): n is a, c, g, or t
tcgtcgtttgatcgctcacacctttaaagaagcgaaggaatggccctttctttctttccgtgcgcgggtaattaaataaaataaataaataaataaccaaacaaaactaaatatttatcggaggaaggaaaatgctttttcttgaatcaccccccccccccccccgatcgatggatgactcaccaaatcggtgcgtcctttcactttgcccaatgggtacgagtccatcacattctccaccagtttttggtcgcttgcctgctcatatcggctccgtgcttcgaattgtgtcttcagtaccaacttaaagggtgcatttaccagcagaaatgagttaaagccacaaaattaaatgatggcttttaaatgcctggaggcggcagtctttcagcgttttccgtgtcccatttctcacgtgaagatgggctctgatcaccttaacgaagccgaagtttacccttatactcggaaatcgatctaattatttgttatcgagacttttcccgaaaagcggggtttgtcccaaacatagaaaatagaccaggaccaaagaccacgattcctcgagactgaaccaggtcacgcttgagaccagtccgagcccaactccgagacttttcccgttaccacaaatggcaggaattccctggcttaacctctcccaaacaaaagccggtgcggggcaagctgatctgaaggcagactgtgccgaacggaagcgtacagacggtgaagtcaatttcgtcttggtagtcaaagtgcttgatggcatgtgggatgtcgtcaaagtaggacttggccaacaccaaaaaggggaacacttcgacggccgaacactgcgggggaaagcgaacactgacaaatgagcaataaaatggaaaagaaatgagcagcgatcaatttgccaataataaaattatggccctattcacatgctccgcgttgccgacaagctgcactttgatgctgtatcggatggagccgaattggctttcaaaactgctcggcactgagtcccgggatggtcacgcggaggccaaatttgtgccggcccggcgacaattcccatgggctggtggacagagcgngaccaccatgcgcagataagccctgtgnggcggcattcacagt

SEQ ID NO: 19325 - DNA, 2693 bp, Heterodera glycines
ccattcattttctgtttttcaccttgctcattttacgatcccacccgggttccttctctcttaagatttaacaaaaattaatcccaacaattctcctatccccttagcctgcgggcaagaaacagaaaatatggccggaaatggaaatgaattaatgagaacggaggatgacgaaaattctgatgattttttgaatttgtttgaaaatttggaactgacgacttctgaaaaattggctagtctaagggaaattgagaaaatatttgcggacaccgcaccaccgccagctggtcaaacgccaattgaaaactcagttcttgggtttgtgttcatctcacaccccatattgtgggcactggtacaaccggacattttgggcgaacaaaatgagctattggaccggaaaagtttaagcttaaaatcggatcaattagtcttccaaagtacatcaagttatgtgacgactattacactggaccctaacaataactggccacatttcacacaaatttcgttgaattggaacaaacaatctctattaggaactcgggtcaaaacaattgatttgaagcaaatgacttctcctccaaaactgggacaatcagtgaatcaaattgtcccttcgagctgctgtggaataattagggaagtgatccaaaataaaatcacctcagacattatggccattgatgtctttttgtatggggaagaaactaatcagcgttttttcccccaccaaatcgattcaagcgtcaacctgacggagttagaagaaggcacacgggttcaaactacgggattttgggccaaaacttctgcaatggaatggccaacttcgagtgatggaattcgcgattggtggactgagcagatctatatagggacgaacttaaaaatatttggcgctgatgaacatgaagacattcatcaatggctccaaaatgaacaatttcgactatcataccgttacctatgtgccgccatggacttgcaacaatcaccaaaacgcagatgaattgatttaacaaaaaaaaactccatttcttcccttttcggttcgaattggcattctttggtccaattgtttcctttttcggtttttaagcaattttctttttgttgccattcatttcccatgggattttggtggaaggcgccgttctttttgcacatccaattccatttttttccccttcaaggccaaagaattcatttttttctcttgcaccattttccctgattttttctccctttgcacaaattatcaatgtgccggtgtttgctaatgtcccattttgcaccgccccttatttctggcaatcatagtctccagagaccaaaattcattccgaataattcctgaaatatttttgcctttctttcaaccaaacgcaaaattcatattaaatgccaaagaccaaaaatctttctctttttattttttcccatgcctacgggccggacaaaagaattgcttgcaagaaattgctaatgacctttctgctattgagtttgaacgttcaaatcgtagagtcccctcaagaaaatcaaattaaaggaatttcagtggacaaagcgatttgtgaccatttttgtgcccatccatgccagctgactaatttagtatttccaaccgaagaaagaaatacaactttgggatggacttgtatacacctaaagccaaaaattgtccctcaaagttggtcctcatttttttcgaaacatgcttggacaattggcggcataatttttactcttgccggcatttccttttgtgtaattcgcgcatatttgtggtcaattgaacccgattcaattgaaattaatgtttgaattttcgtttccttaaatttgcaatttccccgcttttgactgcgtctttaattaattccatatgtccaaagttttgcatttgtcctgccatttttttttgcttcgtgccaaacatgacagccgactgaaagcaattcatctcccgttccctcccccattttttgctcttccccgtcgcgacattagctttttgcggcgatgactctcccctgccgctcaagaagaaaaggtttttgcctttttcttcccattagctcgccgctgttgtaacatttgaaaaaataaattgcattttgctgtaacgcccatcgtccactcggacccgtcgttatttaaggccggctcatccttcagaaaagccatttcttgccttcattctcatttttcctccgctccttatttttcatttttccattttccattttcttttttcaatttttatttttatttttcagtttttcatttgtttagatgcaaaaacctattccttcaaatcgccccaattcttctgtctccaaaacccttgcctgcgggcttgaaaaaattgtgaatttgagtggaaatgagccactctcggtgccggtgctggcggatcggagtgatccgctgggactcaagtcggtccaacccgacccggtgccaatggaaagtgccgaggctggcacaaaagaaatggaagtgatggaagtggatgaaatgagcggagaaaaagggaaaaagggagaaatgggtaaagaaaaggtgaaaagtggtggaattgaagaggaggaagaaagtgagggcagtgagggtgaactgctaggagacggtggatttggcaatttgcaactaaaccccagcctgagggcgggaaataaagc

SEQ ID NO: 19326 - DNA, 2464 bp, Heterodera glycines
tcattaattacagaccaaacggaatcgatgatatacatacatatcaattaataaaaaaattggagttgttagtattcttcactctttccttggccgctaacgccaccctcttttttttcatgtgcatatgaaaatgttggtaaagccaatttattaatttatgaatgagcaaaaattacatacaacaacactcaaatggtaaagtccgacataataaaggtcaaataatcgcttcaatcaaccaatcaattcatttctgttgtttctgatcagtgatcagtgatcaccactcggcccggcggaagaagcatcgagaagacttacaaaccaaaattaagaaatatgtaaatattttattgagcatctttaaattaattgttcacccgttgtcgattccgccgtagccaatgaaaatgccaattttgttctgtcgagcatcaaattctgcttccatttccttctcccatttttcctcatcacatgcagaaagtggacaacggatgagcaaaaaacaatttccatcttccgcattttcttgtgacagtgtcaatttctccccggtgaatgcgttggtcagtttaaatggcacaacggcggaagaaagcgaagacaacggcggaacgtcgatagaaatgacgaaattaacgggagaagaagcgatgaaaaatgcctaaaaagaaaaggaagggtaatatgtgtggtagtttaccccccccccccccatttttcaaaaaatttttttttgtttccaaaagacatggactccggactcgaattcgaacaaaaatcaaattttgaatttcacatttttgttcaattttttgtttaaatacacagaaacgaagcagaagtcattattgcttcaataaaagatcatttaaattatttttagactaaaaatggaaaaaacgaagatttgagttttgactttttgtttgaatttgggtctggggttcggaattggctgaaacggatgtcggatacagcaacaccgaaaacctttgggattttcaaggcttttgaaaacaaattttttttcgaaaattagagggaggagctccattagaatttaccaccaaaaaacgtattaaactggactactcaccgttttgatttgttccacggatgccaaccattgatccaccgttgtcttctcaattctgagcatcttcggcaaattgtcggcacgaggcgtgaacagccatttggccaccgcttggccatccgtcgcattggcactgtcgtcgggcggaaattcggtggaaatgccgtcgtagaaagtgacaacgcgaaggcatggacaatcgttgagcattgacggcgcaaacatgcgcatttgatgaaaattcattgtgttcaaatgcatcagaatggtggtgttgttgaacatcggccaaatgttgagcacaaagaatgccgaaattcgaacattttcagtggcaatggccaattctgttgcacaagtggccagaaaacggtgaaagcggtggagaaaagtgaacacattttggtcgatgaagctgaaaatcaaacgaaggtatgatgatgacgatggtcattgatcacaaatcattcttactagatcgaaatgcttctgaatgccatcactttattcggcaacggattttgcggggttggcaaagtttttccattggaattgacaattttcatttcaacggcgccattctttccaaatttgagtcgaattttcaatttgcccaatgtccatttgcgcgttttgaagtgttcgtcaacgaagcagtcaaatcggcggctgatcatcgcaattccgaggccaagctgatggcgtggaagcaaatcgaacactttgagccaacagtcggcagagatgaagctgaaacagcaaaatgattagcatggaaaaaaatgaaaaaataggcgaactaaattgacaaaattcaatattaatggttaatggtatttatatacctataaaatctaggacatttttgttaaaaaataaagctaggcagttaaatcagggcgcgtatcgaaaatttttcaaaatcagaacatcaacccaaaaaatcagattctggggtcgaaaatcaggacattttgcaaaattgcttcaaatcagttatttttacaatttttcgatcaaaaatgtatcaaatattatatttttcgtctcccattatcgattttaacaattttggggagaaaattagcaaatcatcaattttagcgcattcggaatcaaaaaatcagatttttaagaattttttgcggcgcatttttccaaaacacttttaggaaatgggcgaggggggagggtccggcggtgccgataggcgccgccggaaaatcttttggaatttcgctctgatttggtaacagattttcaccaaaaaatgccaattttgcaattaaattaaaagtcaagcgaccacttttttgcttgaaaaacgtttgttttgcggcgccttttttcaaaaaattt

SEQ ID NO: 19327 - DNA, 2139 bp, Heterodera glycines
  misc_feature (17)..(18): n is a, c, g, or t
tttaaaaaaaatcaaanntccgtaagggcatattcttcgaccaaaaagtcctcgcaaaaacgcgatgacatggcgaacaaattcaatgcggcgagttagacctaaaaacgtaaacaatatgggataaaaatttgaaacactataaacccgaatcaacggatgggaccgcttcttcagtgtcttcgtcgccgtcgtcggacgctgcgtcgtcaaaatttaatcaaaaaataatcatcttcaaaacgtcactcaattcacaaacacacattgcgatgcttaattgtcatttaataaaatgctgttaaactgaccctcaatgttcagtgtcggctccaattcgcctctccaccgctgttaaactgaccctcaatgttcagtgtcggctccaattcgcctctccaccgtcatttttgatgttgcacgtgtacgccccgctgtccttagcctaaattttaaagtcattttatgtcaacaatggcgtttttgaaccgctttagtcgacattggcggcttaataacaatagaaataaatttaaaaagaagtttggctgaagagaaagacaaattagattaaacaaaagtatccaagacatacgggagcagagttcgcatgtgtgccgtgccgaacaccaatgcatttttcaaagtttgggaaaaaacattatacaaaaggattccaaataaaaaaaaaaatcatttttaagtcgtcaatatttatccaagaaaaaatcattttcaaaaatggtttttcgatagaactttaatcaatttaaacgccttttttttgcctttttcgtgccttttaatgcttttttaaattttttagtgcctattataatgcctttttcgcgattttttgtgcctttttagtcgtgctctaaatataagaaaaatttctttaaattttgtgattattatttataaatttcccagttgagattgtgcagttctcatcctctaaagaacatttcatgtcaatgccaatttggtgaacaatggcccccccaacaaacgaaaatttaaaaactttatagatagatttagtccaaaaatggcactcatacgattttacttgttaagattgtgtttgaactcccatcgaaaaaaacattaattttgaaaaatgagaagaaaaaataatacttggaggggaactgatccaacgcaaaaataaggaacaaaaccaagaacacaacccgctggaccacgcatatattaacaaacttgaacaaaaaagaacctaaaatttataaaaatagaagtttaccaaaggccaacaatcattaggggtgtaaaaaagtctcggtctcgagtctcgaaaatcgagaccgagacttgaaaacccgagactcgagaccgagaccaaaaaaacccgagacttttctcgagaccgagactcgagaccgagactctcgagcatcactagtgtttatccgtacaaactcagttactacttaatgcgatgtttaagacaatttttaaggttttttggtgtagtcagttttcacatatgtaacagcttctgtttttcataaaacctattttttctaaccacctgccctttgtttgaaagtaacatatgaatcagagaaataataaaaattagcaaccatgataaatcaaaatttgaatacaaatagaattaatacatcaacatttttcgaactcgctgatcaccaaaaagataattcaacatccgatccaaaaacaaacagcagaccaaatctcccaaaatacaacaaatcaatgtatcacgcaattcgacggggatgtggacaagctctgaaatgggccatattcaaatatagcaaaaaataaaataaggtttttaataaatctaaccaaatttattgttgagatccggaaaggtatttgaagcaaaggcgaccattgcaccaaaagagcaaatgattgagtagaagaggggcttgttttctagacgtacaaacaatagaaaatcactgtgaatttagatgacaaaaatttcgaatcgttttagaaagcataatttcccttctatcgggactgatccgcgtgagttgtgtgtgttacgaccacaaaaactgaccaactaaactctccatgaaaggtctgccacggtaattgacggcaaaagttgcaatttgcagagaagcggac

SEQ ID NO: 19328 - DNA, 2851 bp, Heterodera glycines
  misc_feature (2784)..(2784): n is a, c, g, or t
  misc_feature (2829)..(2829): n is a, c, g, or t
cggcgcctctcggcaccgccggccccccaaaactcaatttttttttttttgcaaaaattgtcccaaaattgcaaaaattgctatttttttaggaaaaatctgttagcaaattgcaaattttcaaaaattttccccatggctcctaacagcaccgccgcccatccccccttctgttccccaaaagtttttttgaaaaagaacgccgcaaaaaaatggtggtcaaattcgatgttgagacgggttcgcaaaaagtatcaaattttattttttagtctcatattatctaaaattataatttcggtacattcgggatcaaaaaaattttgcgtcagaccttaaaatttattaaagtattcaattattgaattatatttctatttttattccactttaatattttaacaaacattgaggataccaaattataatgtagagtatttgtaacagatttgtccaaaaaaagaactataattggttaatttgtgggtttatggctatttaaaaattaaaaaaaaaaattttttaaagttagacaaagtttcttattaattaaatttcaaataaaataatttaaagaaaatatgaaaaatcccctatcctaatggggaattgaacccagtagacaaataatgaaagaccagaagtaaacgggattcccgggttttcccgcgggaatcccgttcccgccgggctctactgataattaactaaataaacaaaacaaataaaagtgaaaatgtaaatgaaaaataatataataatatccaggcagatattcactattgtatttgtgttgtttaattgattaattacaataataataattttgttaaagtatatatttaaatctgtaagattttcttagttaattggctatcttcaaatgcaccttatacgatatgaataatcaaaattattgattttttcgttttaaatatgttttttaattattgataacggaattcggcaatttttaagctgaatttatattaatattctaatattctacttttttattaccatttttttgcattttcaattaatttaatataattaaaaaataataaatttgttggccaattgtaaatctttctgaacaattacttagggtggaacataatttttgatacccaaattttttccaatttttaaaaattttataactccgttatttctgcgcctatttaaatgcttctttttttattttgttcttcatggtgtcctcttttatatcttactatcgtttcactttttatttgattgatagatttttctgccttttttcccgaccatgccaaaattgaaaattggcccactaatttttctcgaattttttatggtcaaaaaccaaagttgatataacaaaatcttagtttttctatacaatttagaccagtagaatccgaatatggaataaatttattattgattcaattttttttgctaaattctgcaataaaagctaattaaatccatgttacagccaatttaattattttacaacataaaattttcatgatttataattgaattatatttaaatttacaaaatgatcataaaatttaagtttaaattttatttagtcttttatcatatttgatttgaatattacaatatataaatttaataaataaattaaaaatttacaaaacttttcaataaatcattccattttcttttcaaattctcataaatatattgcttcaaaattttttaaataataaagcatcgtagtgctgtttcttgtcggatgcactaagtcatatttttatattttccgaggataatctgagtttacacaaaatccaataactcgaattgaagaaaattaagcaatattcaaatagtttaaataaattattaatttccctaataaaagttaaagaaatcatatttaaatacaataatttgttgattaaagcattaaaaattttattaaaagtcttaaatatttgatttatttaaaatatttatctccattattttaatattttattgcctttttgtttcattacataatcagtgcccggatttatttttgctaaaaaagccaaatatacagtagtatttgccaaaaaaaccacaaaatatttgctaaaaatcccaaatggcttattgtttttgcaaaatacgctatgtggttattaggtgttatttttatttttaaaaacttataatcgtttgtattatttgtgagtttatttttcggtagaattattctaaattttaaaaatattttaagaaaaattaaattattatttaattacattataattctgaatattaattaaacgttttgtattcaattacgtttaagatattatatattttgttttattattgtaattaaattttacagctaatggaattatttaatttgaattatactaattaaaaaactttttaaataatattttaataaatttttcttttttttctttttttactcattttttattttcttctcgtttgacaaagagttgaaaaatggacataattataaaattcttcaatattgtattttttaattttgtaatgttaaaaaatgtaatttaaattattcaatactcattaattgataatttcagccaaataaatttactgaattatatatgatgaacatcgaattatttgtagtaagttaaatatttttattatattattaaatttctgcgattataaaataaaatttaacaaatatctctcttgttgattaatggcagttctcttacagcattgacgccttttataaattaatgtccgcttaattaatacaatccatntaaatttatgatggtgaataaaacaatttaattaatattgattantttagtaaatctatttgtattt

SEQ ID NO: 19329 - DNA, 1379 bp, Heterodera glycines
  misc_feature (1335)..(1335): n is a, c, g, or t
tgattaatagggatgcgatttttaggtaagaaaaatcccagaataggtacttaaataggtaaaaaaaaatctcaaaataggtattaaataggtacaaaaattccaaaataggtaccaaaataggtaaataaaaatttttattaacgattttttagtggaaaaaagcaaacaaagagggaaaattttggttctacatatctctttgtaaacgaaaatttaaatatattaatattttctttgataatattgacattttaaattaaaaattttgtcaatagaaaaaataaataaattttgggataaatttttgagaaatttttccaattcttagggtgcatttttgaaaatttttttggtcgattcttatgggtatattttttgattttattgcatttttgttaagaattttttgaaaatccttaaaataggtaaccaaaatgccgaaataggtacctaggtaataggagaaaaatcccgaaataggtaaaaataggtattataaaagtgggtgtaaatctccaaaccaagctaaaaactcgttttttatgcttatctcaacgttacaagtgcgcaaaaattttaggtatttaactaaatatcgcatccctactgattaatgtaattaaatttaaccgattttttcgatcactgtcatggtcatgatttttggcttttcttatttcttagtgtcacggcggacctaaaaacagaaagaaactaaatatttttcaaaatggttactgtaattgcttggacgtaaaatttaaaaaaaaatcctttagtataagaaaaattttataattctactttaaatttgaaaattattttatttattttaatttttatattttgttcaacagattcgtggcaacaatcatttcaagggaattgaatttagttttttatcggcctcgggcaaaacgaagtatacgaacagaattacggcactcaggcaaatcaatgccacaaatgggttcggctttttggaatcaggagaccggattaatgtaatggtgcaaagcaaggatggcacaatgccaaaatcggcagtgaaagtgtttttcttaagcgaggcattggcgttcaacgaaatcagtgagtgatgaaaaaagtaaaaaatttattaaaaataattatgtaaatacaaaatttattaggttaggtgaaatttaaaaacaatcaaaattagaaaatcaattttcataatttttgctgtatttttggcaccgtttcttacaaggttggcgtggccttcctaaatacatgtgatttttcccgacctgaacctgaaatgctcttaccattttgcacatttttgccagacaaaaattattnaaggtcatttttttgggttggaaaatttaaatcttttttacacc

SEQ ID NO: 19330 - DNA, 1735 bp, Heterodera glycines
ataatgaaagcagaggtgcgcaacgagcaactgaaactcagttattacatcgtaaaattaaaaaaaaaaattaatatttttgaaacgattttactgtatttaaaagaacggtacatggaacggaacaacaaattgtacggctgtgaaattgacggaaatgtacaaattcgaattcatcgtcgtcaatagcacagcgttcaatgtgtccgttaatgaggtgcagaactgtgcctacagtacaccacttccgctatggacaattcaatacatttcggtatgaaatatttttacaatggaacttgagcaatttcctgcaaaattaacgaattttttgggaaatttcaaaatcaagtttttttttcataaataaacattacggtagaaattttttatacggtagaatatattttttacacttgaagctgaacaactttcgctgcaaaattcataattcttgcttaataagattttaatctctaattgtttaaaaaaaatttttttataaaattaaagttttaaatgtaaatttaaacaaatttatagtaatttcaaacaattgataattttttttttgtagataattattcaaaaaaaaaaattttgcaaaaaaaactttttggtaatttaaggtcgattatgctaaatggtcctttcatccgcccattatcacttgtaacccttcaattcgatgctttgagccaacatccaataattccaatatgtttatggcatttcccgagaagaaaggaaacaattgaataattgcgcacaaaaaaacaattataattattttattttactttatttataaaatttttactattttagaaaaataaaatatttatttattatttcttcaaaaagaaagactttttttacattttgtcatacatccaaaaatggttaattttaattcaaaaaaaaaaaaaactgaaaaatcaaataaaatttaggcgggagtggaacaattggtcaatcaaaatatcctttcctgattttatggtcttgattatttaatttttttgtatctttatttatttttatttatttcgttaaattaaataattgaatgaatgtatgaaaagtttctaaatatttctagagaaattcctccctgattttgatgtcttagattatttatttttattagtctttatttttatcatttagattattttttaaataattgaaaaaatgtattaatataatgaatttgaaaatgttcatattattatttccaaagaattattacttttcctatggtatttggccaggattgggcaatgaaaaatcataatttaaagtggacatggcgctgccaaaaatgccgccagagacatttataaatatcattaatttttcaattaaagaaaaatgttgaaataagaatgtcaaaaacttgtcacaaaatttgccaaaggttttttcttaatggcgcatgacttagtgccaacaaaaccatttttgaattcttgaatcttggttttattattatgcaaattttgtgcctttatggattaaacttaaaataatttaagcaaattactaaaaaagtagttagattttccttgaattatgcaaatattttgtttatacttgcttaaaatatatatttttgaataaaaaaaaactttttacatacatttcgtgaaaccttaacagctcagaactcagaaaatttaaaaaaaactttaactgttgaacttagaaataagaaataaaaattcatagttga

SEQ ID NO: 19331 - DNA, 1182 bp, Heterodera glycines
ttcgtcagattgctcaccaacgactcgctgccattttctctaccatggtgtttacgaggtgacactcgtcacgagtccccttgaaaattgcgcgtaaattatggcaacaaaataagaaaatgccaatttatcccctcccctttttttaaggttggcacgatggaacgggcggagaaaattcggacatacaattaccgggacaatcgcataacggaccatcggctcaaagtttgacgggggtacccaccacccactgtttaaaatttctgtgttgttctccgaccttgggtcttggcgttgcattcattacttttcccaattaactaaaaaaatctaaaaaaaaaaatttttttaaattttcttataaaaaaaaacttccgagtggagggaaaacgaaacgagctgctctcgagtgggacccagggtcgttgcgttttcctgctgggcctgggtccctccctaccaaagatttcttgtccaaaaaacgggtcaaaaaccctaatgtttaacttgaaaaacaatttgttttcccctaaaaaggtgacagtgcacggagttggacaattcttggacggtggccaaatgcttgaacaaatggtggacgcactgatcgaaatgtacgaacaagaaagtgtgaagcaaacgggggaacagcagaagaatgagggggaagaatcgggcaaaaaagtttaaaaattttgcgtttaatggtaaaatctagttgttttttttttgccaataaaatgtcatattaaatgcgacattttttcggaatgggggaacgaaccaaaccgggtcaatgatttcgagaaactttttttggtgtcatgacaactgatcattattatttttaatgtcaaaacgagtttttttgcttgaaaaactgacaaaaaaaatttttttatgttcgttcggtgtattgccattatttttttttaattgggtgaaagtgacaacactggacataatacacaacaatataaataagtaaatgagtgacaagaaatgggaaaaaacaaaaaaatttccgaataataagaaattacacagcgcagcaataattaataaataattttgagagtcggctgattgatgggccaccaaacggtcaatttgacgaggacaaagtgccggaaacggcgggggaagagagcgcggcggtcaatgccgcagccaccggca

SEQ ID NO: 19332 - DNA, 1961 bp, Heterodera glycines
  misc_feature (1893)..(1893): n is a, c, g, or t
  misc_feature (1950)..(1951): n is a, c, g, or t
aaaaaaaaaatttttttacgagcttggtttcataagtccctgatgtataaatagaaaccgtaaaaatatttatttactcacccctctttcttgtgcaactctgcaaagcagtactcagtcagcgccatgaaaaatccttaacatataacacaaaatggagtctaattttatgtttccaaattcccaaggggaggggggttgccttttgaaattccgataatttctatggaaatacccaaatgtttatggaaaatggcccaattttggggggtactcattgaaaaacaccacgcacggtcaatttcgccgtcagtgaccatccacaggcagccgatcacacatggcgcgcgggcgatcatgtattcgtagacggacgagcgcccgtccaggccgggcccttcgtccacaacacggacagaggagcagcccatcagcacggagacggcacggcactcactttcgcggatcaacgaacggccaaaatagcgaccgccactgccatggcccatgtaactaaacaatggaaggaataatgggtgtacaaaaaataatgttggttgatatacaatccaggaaagggatggaaattctaatttctcagatattttttatcggtaaaattattatttttttttcaatattcaaagtaaaacgagaaaaaaagcaaaggagtgtaatgaagtgtgcgcacccatttatttgaacatgaacttacaggaacaggtcatgttcgttgagcactgctcgcatctgttccctggacggaacctgcagcaaaaaatgaaaaaataattttttttttaactagaaaatcgttcagatatttagaaaattaaaaaaaggctgttgcttaaaaccggggggaaatgcatccatcatttcctccacctgtccaataatgccacgccaatggaaacgcttgatgaacgcggcaaggcgttcctgcgtcttctccaagtcaccgcccgggttcagcacgtagtaggagttgcgcccgtccaccgatgtcggaatctgtgctttttcaattgcagtcaacgcgaataatcaaatgggcaaaaaaaaaaaaaaattgagggaaaactaacattttttgtctgctccatcaaatgttcaaacagatggaagcacgggatacggtagacgaacggtgcgcgacagtaaattggcaaacattcccaaggcaaatggctaagtgactgacaaggggacgaaattcaaacaaataaatccattttaaaaaaccaaccggcggaatcaccaacatggtgtactccttcattgttgatacttttggcgattttccaacaatttttgagcgataatttgtccagaaattgcttatgaactgtaaaaatttggtcggaactgcctgaaaaagtgggaatcaaaattccaataagaaatcgttcaaatttagccatacatcttctccttcgaattaaaaaaaaacctaattctcctagaaaattcagaaaaatttcaaaattttaaagctgaccctcgtcgtgtgctgctcatccggcgaatccaagtcgatttgttgtttgtctattctgtacaacaatttgccaaaccctaaccattcgtccatcgtttcaatgaatggtaaaaggcgtgaaagtgtctaaaatttgggacccaaaatcattttattttttattttttttaccagtgccaatgccttcgccatgccatgttcactggtcagtgtgcgttccaaccgtttcagttccgtggaattggtcgtctccgcgttgacgggaagtggcaggaaaaggggggcaaatgaagagagccaaatgaattggaaatgttcgacaaatttctaaaaatttacacaaaaaatgattaatttcatggaccgaaaatgaccccctaattatagtccanaaaattgttttaccctccattttggcgtcccaactgttttcgccactgacctgcagnngccatgcaag

SEQ ID NO: 19333 - DNA, 2588 bp, Heterodera glycines
cgggcgaggggagggggtccggcggaaaactgatttgttaacagaccaaaaaaggccaatttttccaataaaaggcaagcaatgactttttcaaaggaaagatttgattgtccggcttgttatttgtgattttttgaacgagttctgtccttatttgtgaatttcgtcatttttgtaccagtgttacctatctcaggaattgaaacagaaggaagggcacactctgaatttcagtttatctccaaatttgggcggctaacattcgaattccaaacgaaatgtgtgactggtagacttataggaaggaccacttttgtctaaaactcattttgacctgaatttacaaggagtgagcagaccgagttctacgcgagctaaccctccgaccaaacagacgccaaattttaccaccccgccccccttcctacaaaagcatttgaattgaagcacattcgccccacccagcattttcaaagtataaatgggtactgtaataaaataatttcaataaggttcattatcgccgtcaaaaatgaggaagaacaccaacaaaaccgtctgagaccttacgaaagtccttttgactgggcgccgcaagtgtcggcgccgcaaatgtcagcgccgcaaatgtcgcatcaccaatcagtcgttccacaaaaaagctcagtgattgattggtcattttccggaagcctatcgcaccactttcgggcaccaaaagtgcctgatccggaacccggaccggcccggttaagaacaattttttgttcagtttttcaagggctatctcccaggccgggtccggttcttgatccattcacttggagcccgtcatgggtcggggggcacatctgccggaggaccctcagcctcgcccccgaccctgtcgatggccaacccaagctaagcttgccggtaccagcggcttttttgtacagctcgatgagctctacaaaacggtatcaatggcgtcaggttgtgtttactactaatgtagaaaattggcgagaagtgatgccaaaaattgaaaaatttgaaaatgacttgcgtcccgccgtacattagtattaaccggacggcaccgtgttttgtgaattgaataattaaatttatttatttaattttatcgatcactgagttttttgtggaacgacctagcaccggggaaaaccttttcacttcgtatcacagtgaattaaaaggcttttcctctttttcatttagtgcttttcgattcgcttttcccgacggacgttcgccgccggtgccgcctctgtccgtcattttacgtcagtctttgctcgccaatcattcgaaatttcgccaagagccggaaaaacttcgacatttttacgacaatggcgaaacaaatgcttttatgagaagcacttttcgagatgatcagcattcaaagaaaattgtgatgggtaacggcggaggaggagaaaaggaggaaaaaagagaggacgaaaagcgaaagtaaaagcgaagggcggcgaaatgggaagaaaaacgaagaaaagacgaaattaattagtaaatttaattgttttttttataaattatgaacatccttcttgtgttacacaaaaaatgcttgcattttctaatgttttgtcagactttgacaatttatcaatgttccttttctgattgaaattgacggcgaacacgcccaaaagtaaggaaaaggcagaacattgcgcgcattggcgaagaacctttcaaacaattgggtggcaatttggccattgttaattaatgcaatttgctaattgcctaaccatccggaggatctttggcgtgcgcatttcgttgttttggatgaattgtccgctccgacggtgagaagagcgaagtcgtaaaagagcgtatgacagggcgactgctcctcggaatgatccgacacaaaatgggtgctgacctttgaaaggccgtcctttggatttcaaattgccataattaactcactgccaaaacacgcccgtcctgcaggggaaaccgcgactgccacgggctcggactcttccgactcagccccggtgcccatttgtccacaagtgtctgttggtggggcaagtcccaaatgggtttgcattggaccagcgaatgcgatcggagatcagcagcagtgccattgttcatttgtttgggagggaggagaaatgatgaaaaaaggcttgattgggggagaaagaggggacggacaatgcgacgatgggggctgaccgaaatgcacaactgtagggtgggaaggggaggggaagacggtagcatactgtagcataagccatgccaattcccttttatttactcgactgatttccgggggccattgatttggcccgacgagttgagtggagaagatgaggacaacattgagaaggatgagaagagcggagaagcagagggaaaagccgaagatgacgtaatggaaaagaagggagaaatggcggacgaaagttttggcacatttgtgacggtgggagaaggaattgggactgcacgagtaatggtggagacaggggacacagccgacggacagacagagggaacagagaaacagcgaaaggagcaggcacaaaaga

SEQ ID NO: 19334 - DNA, 1437 bp, Heterodera glycines
tggccccaactaaatttaaaaaacgggcgcgaagcgcccccccaagcccaaaaaaatttaaaaacgggcgtgaagcgcccgtctggccccaactaaattttaaaaacgggcgcgaagcgcccgtctggcccaaacaaatttataaaacgggcgcgaagcgcccgtctggcccaaacaaatttaaaaaacggtcgcgaaccgcccgcccaagcccaacaaaatttgaaaaaagggcgtgaagcgcccgtctggccccaactaaatttaaaaaactggcgcgaagcgcccgttatgagtccgcgaagcggccgaatgttcttaatgaaattaaaaacgggcgcgaagcgcccgttatgaggccgcgaagcggccgaatgtccccaaaaaaattaaaaaacgggcgcgaagcgcccgtcctgaggccgcgaagcggccgaatgtcctccacaaaattatgaatgcgtcaggcgcggagcgccctttgaagccgcgaagcggccgaatgttcttaaaaaacgggcgcgaagcgaccgtcatgaggccgcgaagcggccgaatgtccccaaaaaaattaaaaaacgggcgcgaagcgcccgtcctgaggcttaacagccggccgcgaagcggccgaatgatcccataaaattatgaaatgggcgcgaaccgctcgtcctgaggccgcgaagcggccgaatgatcacataaaattatgaaaatggcgcgaagcgcccgtcctgaggccgcaaagcggccgaatgtcctccacaaaattatgaatgcgtcaggcgcggagcgccctttgaagccgcgaagcggccgaattaaaccttaaatataaaaagggtgcggagcgccctttgaggccgcgaagcggccgaaagtcctccacaaaattatgaatgcgtcctcgcgatacctatataccaaaatcccttatcacatccataaattcatttcaaaaccgcgcatgcactagcaacgaagtcctttgcgcgaagcgctcatgtcagcgcccgtccatacatataaaaagcatactgcctacacaccgagcaatcactgtgcaaagcatactgtctacaccgagcaattactgcgccacccgctagtcttggaaatttgggttaatattggaaaattcataactcggtgatggtttcatcgatttaactataataaagctttaaaaatagagaaaaataaggagaattttacgggatttatttgagttttttatttcaaaaaagaaaaaagttatttcagaatttctggaaattttcgatttttcagaaaaaaattcgtagctgccttctgaaaagctattcgggaaaagtaaaatactataaaaatccgcaatttttttctctataatataaattttattttggcatttttatcacttttttaagaatttttataaaaataaaagtgattttt

SEQ ID NO: 19335 - DNA, 1522 bp, Heterodera glycines
  misc_feature (1418)..(1418): n is a, c, g, or t
tttttatcgcggttaattagagcaacgaaaattgggttgaatcgtgaagtttatcatttctaactcacttctcaaattgttgataaattgcaaatatatttttccaaaagtatgtggacactttctgaaaataaattctatactcatgtattttccacttattagattttgcaggcttattgctgcatgttctttgacacttcttcaaaataacctatgccctttattcgttcaaaacaccatctttgttgtttcgctttggattgacaagcccaatgataaatagctcgagcgcaaaacgcgtgcatgtttggaaagtatcgttcacaccaataattgagggtttatttttaaatgaaattttatgataaaccttattatctcagaagctatttaattattcggatgtttttatcgcggttaattagagcaccgaaaattggtttgaatcgtgaagtttatcatttctaactcacttctcaaaattgttgataaattgcaaatatattttcccaaaagtctgttgacactttctgaaaataaattctatactcatgtattttccacttattagattttgcaggcttattgctgcatgttctttgacacttcttcaaaataacctatgccctttattcgttcaaaacaccatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgattcgaatgtttttatcgcggttaattagagcaacgaaaattggtttgaatcgtgaagtttatcatttctaactcacttctcaaaattgttgataaattgcaaatatatttttccaaaagtctgttgacactttctgaaaataaattctatactcatgtattttccacttattagattttgcaggcttattgctgcatgttctttgacacttcttcaaaataacctatgccctttattcgttcaaaacaccatctttgttgtttcgctttggattgattagaccaacgaaaatagctcgagtgaacgcgtgaagtttatcaattctaactcacttctcataatttttgatttatttcaaatatatttttccaaaagtctgttgacactttctgaaaataaattctatactcatgtattttccacttattagattttgcaggcttattgctgcatgttctttgacacttcttcaaaataacctatgccctttattcgttcaaaacaccatctttgttgtttcgctttggattaattagagcaacgaaaattggtttgaatcgtgaagattatcatttctaactcacttctcaaaatttttgataaattgncaatatatttttccaaaagtctgttgacactttctgaaaataattctatactcatgtattttccacttattagattttgcaggcttattgctgcatgttctttg

SEQ ID NO: 19336 - DNA, 1539 bp, Heterodera glycines
  misc_feature (1515)..(1515): n is a, c, g, or t
tgtgccaaggtgttcaaatgctggttggaatgcggcgtctcggcatttggcgccaaggattgaagccttcaaagaggtgattttgatgtgattatttacctatttgctatttttacgggctttggcgttcgctgacaaaaaaaattatacccaaattggggcatctaatcgtaaaattcattcatttatcatttcgtatttcttaaccaattttttccctattttaggaattttacgccgcttcatctcccgtcaatttcatcgctgtcattcgctttcgttcgtcttttgatcatctggttgtgccatttgttctgaccaacgaattgacccgggagcaattgacgttgaagaagatgaacgatatcgaccgtgttcttctgatccgttgtccgattgtgcgcgacgaaagcaaatgggccaaatgggagaaggaagcgattggatggaactttatggaccagtggaatcggatcgacatttgagatgggtcagtgaatgatgcttcttatgcagatatccaaacttattgcttttcgatttttaggcctcttgacgcagtaatcaacccaagtgatcagaagcagaaatgactgaacgatttgttgagaaatgatccatttaattgatgtggattggataatgaatttgagcccatctgatgtatataaaattgttttgttgcagtgatcacaaattgtattatatgtatatatcaggggtgggacaactctcgccaactctcgccatttttggtactctcgtctctcgttttttgggacgagaggcgagagttgaaaatacacccctaaagattgaacttttgaccagtcagaaaaatattcaaatttacgcgaaaaacgccataataattctctttctctgcttcctctatgttttaaaattagagaacaattattttttgataaatggtcagtaatttaattaactttcacaggttgttagaaggagtatgtcgaaaatatggaattatttcaaaaaggaaatcggaatcgctttctgcaaaaattgtgactacaaaacgaattttccgcccaaaacaccaacgacgacattggccactcatttgaagcacaaacactcagaattatacaaggaatttacagaaaaaacgggggcagccaaagagcagcaacagacttttggcataaaacggtcacacggaacataatacaaaacaacattttttacttttagggctttttcgtcttctgcaggcgcattgacatcgacgagtcttgatttaactgtcgatgaggaaatcgaagagattacattggccaaaaagctcgatgaacagccgaagatcgatcgaatttggacaagaagtccatgggaaatgggcggggaaagagcaagcagtgtgcataaaagaaagacaagtcacacccctggtatatatgcctttaggataaattaagcgatttcctgaaattacaggctcattcttttaacctaatgataaagtcggtggtcactgttcctcccaatcanatgggtttaaattaccatgcaaga

SEQ ID NO: 19337 - DNA, 1427 bp, Heterodera glycines
  misc_feature (17)..(17): n is a, c, g, or t
  misc_feature (26)..(26): n is a, c, g, or t
atgaatttttaaaaatntggaaaaanatttgggtatcaaaacctcccgtgccaccctaagtagatcaatttttacgttttaattcttttctatttatgtagttattttcattattcatatgtaattttttttaaatagaaatcatgtgtatttttcattctttctttttaaataatttaattgaaaattttacagaaattattgggttatttaaatgaattttttgttacttttgtgggaaaaatcaaaaaaattaatttttgtaaattctgctttataattattatttttatttgaatttatcttttaggataaattagggaaaacttttcaactattattaatttttttatgcttttgctattttttcttgcttttcttattgtgcaaataaataatatattttttgttaaattataatattttttatatgttaccaatttcgaagaattaattggtcttgttttccagtttgataattcattttcattaaatgatattatataattaaaatatttttatttggtttaatttttgtaaatcttgcttttttgcaacacaagcaaatttttatattacttaaatgttcattattattattttttagttttgatttaaaacaggctaaattttgaaataataatttatctgttaaaatatatttaaacattttattgaatttattttcaaaatcacggcaatcatcagacttatcaaatttatcgtctaagaggatcaacatttttttatcattcggatttattatgtgtttgttttttgatattccttatgattgttttttattgctccaatatattttttcatatttttgaatttaatttaattatttcatcaccaatattgatagatcattgtcacgaacgatttatattttcgttaaaaattatgaataatgtttgtattattgtgctttatttaatattgataattttctatttttaatagtttattttcataaaaaaaaattttaaacaaaaattaatttaataaatttgaaaaaatttgaaaattttaatcttaagaaaaatccagaaaattttaatcttgcacaggacagattttttccaatcagctttagtcgcggttattcagtttattttaataacttttaaaatttccttaaaaaggaatattttctattgacaaaataaattaattaattttatattcaataaaaaattttagatgatttttttgcgtttatatttaagaataattaaggtaaacaaattgttaacatatgcaaatcaatgggaaaagcaataaatttgaagaaacaaacgaaataatctgaacattgtaaattattaaattttttaaattacatttttgttttatttttgtaaatgacattcccgaccataattgctgtcattcactttcaccatttttattataaattccaa

SEQ ID NO: 19338 - DNA, 1320 bp, Heterodera glycines
taatattttaattaagtcatgattttttttgtttgataacggaatgcaaacatatccaatctgtaaaaattattcatttttatttttctgttaaatttaaattttgcttttccggattcatggtaaatttcttaatgtaaattgtttctatttaattttgttattttttaaaaaataaacccactaaaaaaacatttaataacaaattgtaattttgacccatgggtctcaaaatttttaaattttgaccaattttaaaaatcagaacaaaattattttaaataaaaatgatattaaaaccgattcaggcatctatttgggcataattcgaaccccaaccccggatttcgaacaaaattcgaaaaaaagtcgaaaattccttcttcaccaattttgccgtattcatggagaagttagataagaattgatgcgagcttggacgaagtatttgcctctcgagtgattctttatatgtaaataatttattctattcatgccatagtcagggtttaaaaaatcgaagcgctgttttgtataaaatgtgaacagaataatgcgagattatcaaaataaaaatttaattttattgcactttttttagttttcagtgatttccataaaattggtaaatttggcatttttattattctattaattttaggaaaatttttaatttattttttaaattaattagttaagaaattttccttaaattcataaaattaattaaaaatattaataaatagcattatttattaagtaacatacatttattattgtaatttatttgttattaccaaaattcctttttttaaatacatataattttttagatcatttttcttatcaatgttaattttcatatatcgttttttacatgtgtaatccctcgctttttttgaacgccatgtctttgacttttttcaagtttacaaagaataacacaaaatttttgcttttatttttactttcttttaaattattaacactagattttaataattaaattagtattgattaaatattttcttttcttttaaaatatgtaatttttaaaaggtttttgtgattcccctaaattgagtaaggtaattcaagactaatttgttaggctgaataattttaaagatcaaatggttcatatatgaaaatcaatgaagaattgtagacgaaacaaacaaaaattatcttttaacattgtaaagaattgtttatatcaatctaacatttttctttgttattttttatgaacgataattaattttaaaaaatcaattatatggaatatttgtctgttgtttaaattattttttaattgct

SEQ ID NO: 19339 - DNA, 1486 bp, Heterodera glycines
attaaaagcttcttccctccattcattcccatgattcctcccccatagctcttctctctgcttacatacttatgcttttctctgtaagtgaaatgccattgctaatgctaaagctaatgatttggaatgtaataatttcgttgttggcaaactgattgattccatcattgatcgaaacaaaaattcagctgctgaatttacgtttaactttattaaatttaataattataataaatttttttatcgtccgattgcctccgtttttttccctttaaaactttctaaattattaactcttttcattttcaatcaatgtcttgcgatgattaattaattaccttttttgttcagtgagtgatggtttttgactgtcaatatttttaacaaattatggagggccaagaacgccttttcatttcgtcaaaaagtaaatttcggaaattgatgagccattgaaaatgaataaatggattcatcacttttctcatttgccttttcatcgattcgattttcagctgctgccaaccgatccatgagctttctgcacaaatcgtcgtcccaaatggaagtgtacaaattgcacaaaactttcccttccgtcaattcttcttcgtcctcgccttcgtccttcttagaaatgccttcgtgagtttctcctgcctttgccttatcactgccattgaattgaatgtctttttttttgttttttgtttccttttatcgatcgttttgcttaaagaatgagaaaaccaacaaacattttacgtttttaagttaaaaactctcttccaactcaatgtttgttctttcattagcagtgaggccaattgaattttgtgattttccatttgaatttctatccattttccctccaaagtgaaacctttccgcttcatccattttttttttgtaattgtcccttttcatacgcccattggcttttcacgtaacaatgttcgtgccggtcaaatttaccagggcaaccaaactttgttaattcacacgaatttgtattgaggaattattagcattaggccatgaaattgttcgctcccattcggcacaaaatttctttttttattgttaaataattccctttcactttctccattttaaattaacttttttcagtttcctcccatttctttgcctccattttcagtccttttgagcttatgggcggcgatcggccgtcgtccgcagactttgctagccccgtgccacacgtaagaaacggcgcgagtctcgtcgatttttacattggtctcgggttggccatcagctcgagccttttcatcggctcctcatttatcatcaaaaagaaagcactgataaaaacttgcggggtcggcagaatacaaccaaagagcgtcggaaagggggttatggctatttgaaggaatggctatggtaagcggagagagagagagcttttggtacttgcctaatttagatgacactttgaattgttttaaatttccatact

SEQ ID NO: 19340 - DNA, 786 bp, Heterodera glycines
  misc_feature (714)..(714): n is a, c, g, or t
  misc_feature (780)..(781): n is a, c, g, or t
ggtcccgaacattcatggaaacacgtttttataatttaaaaaaaaatttttttatgtggcctaaactgcataagtaccaaaaaatataaaagaattttttaatttagccaaaaaatgtattcgaaggggaaaaagttcccagtaaaatttgagaaattatccaattttattgaccatatttataaataattctttttcaaaaatgatattagaagaacatcacacctcgtttgttttcatttttttttgaaaaaacatgatgaatttagaaaataacatatttcgttttcaacaattttgttgaatgctgggaaatgagctgctccgttcataaaattgaattataattatttttcgtaacttttgcttacatttgtctttattctcaccctttttctcttttagtgttcattctttacgttgcgctcgttttgctgttcacttttgtgctcgtcgtttacgttgcgccccgttatggccacaccaacattttggtgtacatcgccgtctgttctttgatcggttctctgtcagtgatttcggtcaaagggttgggcttggccataaaagagagcataacgacggaggaacagttcaccaattggtccgtcctttgcgccttttccattcctcgccacttctcttttcaggctcacttggttttggctgttggctgtcctcggctgtatctcagaggcaattggtctatctcancaaatcattggacatttacaaaagatcgatggtacccgaactttttggtgtttttaaacgagaccnntgcag

SEQ ID NO: 19341 - DNA, 1376 bp, Heterodera glycines
ctattccttatatttttgaaaataattcatatataaaaaatactgtaacttgttataaaattacaaaaaaattttgaaaacatttttatataggaatttatctatattttagtgatttttggtccacaccagggatggcacggaaccagcggcgccttccggcatcgcatccttaattttattgaaaaatttgatcaaaatcggcaaatttgatcaatttgctgctggaacccggaaaattgatacttcgagtttaatttttttagatttttcccaaaaaaataccatttagatcgattctgatattattgaaagcccttaaataaatcggacaaacaaatggaaaagatttgcgaaaatgaaatggaaatataaaaaatatatatcttaaatttgtagaaaacttattataaaatattttaaaaataaattaaacattcaaaataaagataattagtaaaattaattgaatatttaaaactccattaacccatagaaattttaaaatttatccacataatctcaaaaaaatattatattttaaattctgataaacttgtgaaattcataattttttattttcactatccgtagcattaaagtgaaatttttattttaatagtcataaatttcaataaatacaatttaattttataattataaacagaaattttaaataaataataattaattaattgtatttaacaaaaaatgttcattgccaaagcttgtgtgtgctcttccttaacagaagcatggtgaaagacaattaaatgaatgataactaaataaaatacaaatttatagcaaataattcattaagaaattaaatattatttctgttgactccaaactaacattaacagataaaataaactgaattggaaatttatgatgaatttaaaataaaagtaggataattaaaaatataaacacatttatttatttaattatcttatcttctattaaattgtatataatcaacttaaaaattcacgttcaaaaatgaaatttaaaaattcaaatttagaaatcaaaaacaaataaaataaatttaataattgataactaatataataaaaaacaataaataataatattcttatacatatacatatttaattaaactcgataataataataataatatagctactattttatatttgcaaaccaaaaattacgtacgaatacagtcgtcggcaacaaaaaaacctagcgcaacaagttatgtgaaagctaatagttaaattagtaaagcaattatttaattaaaaagcacaaatttatattgaaatgtaaaatataatattttcaaaagaaaattaattaatcactattataatgaacaaaataattttatttcatttgtaaat

SEQ ID NO: 19342 - DNA, 1523 bp, Heterodera glycines
aacttttccggaaattgtgttgaataccaatcttttttggaactcgttcaaatcttgtgtccacgatttacccctttccgactccatcaaatttacttatttgaaacaatgtttgtctggcaccccactcacactcattagcccattgccaatctcagaccagtcctataatgatgcgttagacttactaacaaaaagctatgataacccagaggatgtcgcccgttccctgcataattctctcaaaaacttgccacgtgttcgggggggcgacggtttttgtcccgatttgcgatcccttctcgatcaaatcgagtgtatttgcgtcaaagaagaagccgacgattggtcaaccgacaaattaaaggatcagctgcgcaatatcctaagaagaagggaacagatcgactccgttcaacccaaatttacaccgacaagacaatctccattcaaatctcattccccttctgatcaacgttatactaacaatcagggggacgcattcccaacactaacctttcatacgtcaaaatttaaacccccctctcacaccagacatttttccgaaaagcctaaaattgttccaaaattgccatgtttgttttgtgatgagccctcgcatttttcctcatattgccccaatttttcggacatacctggtcgaatcgaacgtttgaatgcactcaaacgttgctttaaatgtctgaaatccgggcatttctctaacaaatgtactcaaccttcaacatgttcagcgtgtaagggctcacaccctagagctctttgtcgtaataaaacgacccatcagccctcctcaactttttgtactcaaaccttttctaactatggcactgcccacaacaatcacacacaaatttcccctgaggcactatgctcgcaacctaacaacaactttgacattataaacccacaattaaatgatgagcaaagccttttccccaaaaattcaaaacgattaattggccccctcccaactaatcaaccaaataccaatcaatcaatgagtcccctccccccacagaataacattactttttctaatttacaggataattctccgattccaatccttttaaaatgcgttgaagtgacaatttttaacccagaaaaccctgctaaattcactaagggaattggtcttttggatgatgctagcacacattcctatatcgatttacataaagccgaattgctgaatcttaatcttaaaccctcttctattaatttggtagtctttaacagtgatgaacataaacccatttccgcttttaccacaaatttcggactgaaactcactgatggacgtacaattttagtcacagttacacgccaaactgcataccttcccttttcacgtgaactgttatccttttccgagacattacctaatttccaatcagcaaccccaattgtacttcttggagccgattattattatgaaaccgagccaacactaatccagcgtttatcctctggctaccacttcatccaaacataactgg

SEQ ID NO: 19343 - DNA, 818 bp, Heterodera glycines
tagagtgcagcgggaccgggaattttgggcaaaaccgggcgggaccaaccgggaatttttaaaaattcaaaaaaattcaaaaaattttaaaaaattcaaattttaatttttttttcaactgaaaataatacaaaattaaatttttactttgttttttattgaataaactccaaaagttaaagcaaattaaattaatgaaaattttcaaatcaaattttcttcagttatttcaaacaattaatcatttttggactaaatgatcgaatattatagaaattcagatttacgtttcacataaatttttttggcgcgctttttccaaaaaacttttggggaagaaggggtccggcggtgtcgataggcgccgccggggaaaattttgaaatttgggtataatttgttaacagattttcaacaaaaaaaggttggtttttgggataataggctcaaattgtaaatggatttctttaaaaaatgataaaatatgtatcaatctaaaaaaaaagtatgaggaatcatattttctcaataaggaaagccatgagttacaaaaagaaaattgaaaatattttaatttctgtcgagggattgaaccaagggaaagaagaagggaaagtcaaggatactagccactaggccatttgcacaattgtcagtgtttcttttaaagaatatattaatatatttttaaaattttttccttttaactccaattttcttcactaatttttcactcagacccccattcttaccagtgcttgtttttcccggttcccggttgccctaccgggaccgggacctgagcttttcaaaatccg

SEQ ID NO: 19344 - DNA, 1660 bp, Heterodera glycines
tttgcgggatcccagtccgcaatcccgcattttttggaaaatgcgggatttgcgggattaatcccgcgggatcccgtcccgcaaagaattttgagttccaatcccgcagcgggatccgcaatgattttttgtgcgggattatgcgggattttattgatttttttgaaaattttctaagtatttttttttattaatgactatagattatttatttttttctccttggaaggaaaaaatttactttaaaataaagaatttaaaaaaaagattttccgtaccaaaaaaactggttttttttccttagtttttttcatttggttaggcatgctttctttaaaagtttgttgtttttgcaggtcggtttttttcccggcggcgcctatcggcaccgccgtaccctcctccaagtctcccaaaaagtttttgaaaaaatcgcgctgtaaaaaacgtgtaaatagtcactccttttcccaaaaatgttctaaaataatgaaaatgacaaaaaaagattttgataaaataattgaataattttttcaagcgaatatactaaaaacatttgtgaaataccttttacttggttaagaattaaaaaatttagcctattaaaaatttagaaatttttttattatattgtatattttttgaaaaatttccgatttccgacatttttggtgtcggaattccgattttccgacttccgaaaatttttggggcctcggaatgccatccctgatagggaccgccggcccctgttcctagttttttgaaaaattgcaccgcaaaaaagtggttttgaaaagaaaaaaatagtcaaatttatgaaccgttaataatttgatttccgatcaactttttaccgtcggatccaatcgaaaaatcttagtcgacccatcagcctcttttaatgcatcccgccagccttaaatttatttttcagcattactcactcggccgcttcgcggcctcgtacggggtttctctaccttttcttccttttcttcctttttagcattttcttattattagggctgggatttttatgttttaacatattttttttgcggcttagttatggcgagagaagcccaaaaatagcattttctccgaacaatttttgatttagagcgacttataaaaacataaacacatattttggcgttttggcacataaaaacatatcgcacatatttgagctattttggattttttagcacatattttggcatttttgagaaaaatcgtaagaaaaatacaagaaaatctgaaaatggaccctaaaaattgactactttacgtttcttaagcatttagaaaatttctttatatatttaaatgcctaaagcagccaaatcgaacgctgtgttaaatcgtcactggatttcaaagttcccggaaggaacttattcaactgatggaaaaattaatccgggactttacaaattgattgatatcgccaacattttgattggcggttgggcgaaattaataaagactgatattaaatatgtttttttttgcgtaaatacacttggtttttccaatttttagcacatatttttgcattttttaacacatatttaggcctttttttggtttttagcacatattttgggtttttttagcacatattttattacatatttcaggatttttagca

SEQ ID NO: 19345 - DNA, 2929 bp, Heterodera glycines
  misc_feature (2789)..(2789): n is a, c, g, or t
  misc_feature (2822)..(2822): n is a, c, g, or t
  misc_feature (2853)..(2853): n is a, c, g, or t
  misc_feature (2885)..(2885): n is a, c, g, or t
aacgaaacacgaaacgaaaaaagaaattttgaaaaccgacatcgaaacacaaaacgaaaaaattttgacggacgaaaacgaaacacgaaaacgaaaaaatagccattttcgtacgaaacgaaacgaaaaaaccgaaaattttttaaatatattcaattttaattaagaactttaaaattgtatcctctaactgagggaattaagatcctaataggtggaaaagcggatgtggctctaggacaggggtatgactgaaaaattttcaaaataagaacatcaaggacaaaaaattattgaaaaattttacgaaattggaaaaaaatgttttttgtgataaaaactcaaaatttttacgattttgaatagcatttcgttcaattttttatgaaattctatttaatttccaattcgtaaatttcatttgaaatgaatttcgttttaaatttcttaacttttttacgatggatttgcaaattttttcaaaattatagatacctaatttttgtgaaaaatcgttgcaaaattcatataatcggttaaaaagcgcaaatttgttcgataaatctgtttaacaatttgcaatcaaattttaaaaaattttcccgccggcgtctatcggcaccgccggactccaaaaactcttgtttaatgttcgtaataaaatttagaacgaatctatattagtattttagtaaaaaaaatatggtttttattgattaaaaaacttttcaaaaaaccctgatccgtatacgggtccgtatttttcctgcatacggacttatacggagtaagggttttccgggtttttagtccgtaagtctgtagtccgtatggatgcctagtccgtagtcctgatcctgatccgtattttcgccaaatgtcgctctctagaaaaaaatatcaacatttcaaactttacatacaatttcctggcagatttaatacaatacttcaagaaatatcttattttttcttaccaaaaaagtcattcttaagggtgtatttattttcgtctttttcgtccaattttgctctgacgaaaacgaaacacgaaacgaaaaacaaaatttaaaaaccgaaaacgaaacacgaaacgaaaaacaaaattttgaaaaccgaaaacgaaacgaaaaaactttggtagacgaaaacgaaacacgaaaacgaaacacaaaaagtgccgaaaatgtaggacgaaacgaaatttcgtccatccctggttggcacataaaatgattatgggtcgcataaaatgattatgggacacgcataatatttcatgggacgcataaaaccgaccagaaccaaaaaactgtatagtacactttttgcatcaaaattcctaaaattttagcatttttaaaatacttggtgctatgtggaaaattaatttttacaaaatttgatttttgtacttcgaagaaaaaaaataataaaaatatatttaatattaaataaaacttttgggaagttgaatttgaattttattcaacctaaatcaatattattccattttggttatctcagggttgccatcgtccatgctccgtgtcgtgtccaaggaattggtttccaaggacatgacgggaaaatttcataaaatccaaggacaattaaaaattttatcatttttcgaggaacaggtgggtccggcggtgccgataggcgccgccggaaaatttttttgaaaattagagtgtaatttgttaacagattttcaccaaaaaaggtggattttgcgattttgagatgatggcgatgacaattttttattttcacaacccttcttcaaaatattgttaaaaattcaaaaatttctcaaatttcgttgaattttttaaaatttttccaaatgctgatttccaaggacgtccttggcatccaaggacattttttatttccaagaaagatagtcaaattccaaggacgtccttggcatccaaggacgaatgagaacctgtatctctttatcttccttttacagttttctttctcttctctttatttctctgtcatataatttttctctatttatctcactttatctctctctatttctatgtcatttctctctctcatctcctctctctctcatcctcccctcttatttgatcatttcattgtgtatttatttgtcgaagtggaaggattactttcaataggaaaatttttgggtaatagttcagatggtatgatacagtaacagtttccataaattttttaaattttaaaagtcaaatcaattttgaaccctgaacacgaattcgaacaaaagtcgagtttaaattttcgattgacgtttttcgtataaaacggcttaaaataatcttttttgcaggaagtgatcgccttcagtatgcttccgggtttttagtcctgtggtgattttggtggatggtggaaaatgcgttttttatgcttaatatatcggaactaatgcgcagaaaaaaggcatatgcttcaaaattcgttctctaataataattagagaccagggttgttccgggtcgagaaaaatatcgggtcgggtttcgggtcgggtcggccgaaaaatcatcgggtcgggtttcgggtttcgggtcgagaaaaaggccgggtttcgggtatcgggtcaattgacaaatttttaatttgtttaaaaatcaataagaaaaattataaattggtaaattccgatgcaaaaaaagaagcttctccaaattttctgcagttaaccgatttcttaaatcagtagacgatggaaataaaaccaaatggaatcagatttttcagccttttgcttcgcttanattcaagaaattcatacaaaatatctttagaanaaggataataatgaacaaaaacaaatacaanattttcgattccattgaaacacatcgtttcanaaaaaattctcaatttcctttatctaatttcacccagaacccct

SEQ ID NO: 19346 - DNA, 1929 bp, Heterodera glycines
caaaaaatgattatattttccggcccctttttaaaaaaattccaaaaaataacccaaaaatacctcaggcaaaaaattgagtacgttttttttattaaaaaattcaaaatttgcgccaaaatttttcttcaaaaactcgtgcgttttaactcaaaatccttctacaattccaaagacctttaagataggggaactattccgatataattaatatattccataaataattatacgattttttattcgaaattctgcctatggtcagtgttacttttatctcaactggtatcgaaatgctgttataaattttaaagattttcaaaaaaaaaatttgaattttttaaagaattaaattttttgaaaattttttgcgataattcatcacaaattgaaaaatcgttaaaaaattttcttatatctttggaaatttttttatgattttttaaaatttctgtttgaaattaaaaaaaaaatttcgaggtaaatgacagaggagataaatgaagtggtgcctatcagatagcaacaccgggagtttaatttggatgcctcaagaaaaagttatggtgcactaaagtttcaaaaaaattttatggttgtgtgaaataaaaaaattcaaccgaaaaattcaaaaaaaaattaataacattatgccagatggattttttcaaaggaaaatgaacaaaaatgaagaatttttgactatatcataaaccggtaaaagccggtcaaaaaatgccggtttccggaccggtttggtattttcaaaatgaccggtttccgggccgggcctctcaaaaaccggtcaaaccggtttttagctaattgccgcaaaaatgaaccggcagtaattagttattcgacgaagaggcattgccattaaatggaaggcctaggaaaacacggggtcgagaagcgaaatatatatcaaattcatgatagtgatcccgaaaaccacctaaatttttaaaaacaaatatagaatttaagtacattgatggcaatttgaaaatgtctgtgaaaagagtccgttaaaggaaataagtatttttgatcagaatcaaaatttgtagtcgcatgaattttttcaagattttatagccattaaattataaaaagtgaatattatgatcagatcgagaatagtcatgtaaaaaacagtataacatgttaagagtacaagttgattaaaatgtgcttctcccaacgactgccggatcgaatttgaaattgggcccaaagtttcgctttttcaccagaatccaacaactaaaaaattaaataattaattttcggttttcaaaaagatgagtttgccggaacgccgacatttgcgccgcggacatttgcgccgcagacacttgcgccgcgacacttgcgccgcccagccaaatcgacatttgcgccgcagacacttgcgccgtgacttttgcgccgctgacacttgcgccgcccagccaagtcgacatttgcgccgcaaaaaaaaatattttttaaattttcaacaatttattaacgctaatatttgataacaccctaataaaagttagcaaatggctaatcacaaagataaacgtccaattttttgtctttgacaaggcgtacataatctctatcgtgattaatcttcatattcttgtacaactcgctttcatctgctccatcgtcttgatacgaaccaagaatttctccttgctcttagaaatacaaatggccccgcttgtctctgtcatccattatctcggtcagcaaaaccaatactatccgaccgagatcctcttctattattccatgcacgaacattcaagcgaaacgcctgtttgaagcactctgatttgttcataggaaactcggcagcctaccgacgccgaccggtaaaggccaactccggggagagaccggaagaaaagccaaccaaaccagtaacac

SEQ ID NO: 19347 - DNA, 1973 bp, Heterodera glycines
  misc_feature (219)..(219): n is a, c, g, or t
tttttaaaaaatttccaaaaaattaagaaacttaaaattagacatcatattggttctcagccccttatttttaccccagaaaaaatatttttcccccccattttcgtccgaaaaaaaatttcggaaaatttttagggggcctagctcgaaaaattttgaaaatttcgggccatatggcacaccattcgatagagcttaaaaagctctacaattttgccntaaggcgtttttttgataaaaccaacccctgacgagttatgggcccgggactcaaatgtcccgctcaggccaaaaattttttctatttccgggaaaaaatcgaaatttttccgaaaaaaataccagtcgatagagctcgaaaaactatgttttggaagtggtctccgtttctctgggaaaattcgttaaaaattcctaaaattcaaaaacccgaaaaccgttttttaggcctagctcgaaaaattttgaaaattttcgaaattttaaaaactggaaaaatccagctcattgaactctacaataagtctgctggtaactccccgcccagatcaaaccctaatgagttattcaaccgggactgaactggacaaagttggtactgaaaaagtccacgaacctacagcctttcctattgcagatagaggcttggaattttttttgttttttagaaaacacttcaacttagccccctcacagcagacattttttgatttgggttttagaaaaaaagttacgggcccccaaatgcacgaaaaaatgagaaatcggtccccgggactcagtcgtccgcgcagaatttttctctatagttttcccggattctcctcaaaaagttgtaagacctttccactactttcagggcgctcccggccttcggccgggagattttgttttttgaaacgaaactccttgtcaatataacgtatatattaaatagcgtttataccgtcggctaattttatgtatgaaaatttgcgaattatgtaaacaaaatatgtatataaaatgctaaaatatgtacaaaaatccccaaatatgtactaaaacatgtaaataaaatttttttaatggttattttttggaaaaaaatcttcgtaaaaagtgaactaatcaaaaaattttttttttcttttttttttttcaataaccaaactatgcttagaatcactttttagtattttaaaaattatttttgatatatcaaattttgaaaaaattcgattttttaggaatacatttaaaaaaaaattttaatttttcacaaaaaattaaatttatataaattctcgaaaaagcacaaaatatctaaaaaaataatgaaaaaatgtacgaaaaattgcgaaatatgtacgaaaaagtccaaaaacatgtataaaacccaacgtttgttcgcaaacaaaaaaaaaagagtgtttttcctactaattaggctatggagaatccagaaaaaatatgtatttcataaaattagcagctctaatcatcatcatcattgttttctgaacattttatgtaaatttttcaattttaaaaaagcaaaaaataaataattaattaattaaatgaaattatcgccttgccttctttcttcttgcgttgtttctgttttcttcaaaaagtggcaaaattgtagtggaatttgggcccaaagttcgcttcaatttcttcatcatggataagcaaagaaacgaatggcaacaattgggaagaatggtcagccaaagcgaatgaatctgtgatccgaaataaggaatgactttttttggaatggagatcctcgacttttttgccgatgtccaaaattggattcaaaattgctaattgtttcaagccctgatagccctaagcagtattaaaattaagaaaacacacaatcttctagttaattaggaacataatttctgctgtttgactaattaatgattttttcaaaaatttactgactatcaaattatcaggcacaaccaatttct

SEQ ID NO: 19348 - DNA, 1105 bp, Heterodera glycines
aaaagggaaaaataaatgattttaaaattaaaccaaattagtaaatgggttatgaaaaatagaattataaaaaatgtattaatatttttttaaaaaaatattaaaaaatgctttcttttattaattaaaaataaactttgaatttacaatgattgagtattattgtattgagaataatttttttgacaatttctaatttaaaaaaacattaaattctttaatttaaaaaaatttttatttttaaataaaattttcaccaaaaaataatttaattcaaatgaaaattttttatttattattaataaaataaaaatattttaaatgaataaaaattgaaaataacagaaaaatatagaaaaataatgtgttaccgtccggatccgaacttgcccccccccctcccccttcaaatgatgccaaagaatccccaatcacacggggattctgagggcttaacgatgtcataactgaaatctgatgtcagattagtgatcagcagcctcaaatagccctaatgacatgttttttgaagatttttggtgaaaaaatttttcaactcaaaaatcctatgctcacccctttggtcccgaatcccaaaatcacttttatttttataactttttttaaagaagtgataaaaataccaaataaattttataaaatagagcaagaaattgcggatttttgtagtattttacttttacagtatgacttttcagaaccgagttatgaatttttttctgaaaaatcgaaaatttccagaaattctggaataactttttttcttttgagcattataaaaccaaataaatctcataaaattctcccgattttttgctatttataaaggtttaattcgccaaaatagacctgatctgaactgagttatgaattttcaaatattaggccaaaatcccgagggccaaaaaattgccaaaaaataaagaatttttaaaaaattccaaaaattatgaaacttaaaatagacatcatattcgtactcagcaccttattttaccccagaaaaatatttttcacccccattttcgtccgaaaaaaatttccgaaaatttctagggggcctagctcgaaaatttttgaaaat

SEQ ID NO: 19349 - DNA, 2126 bp, Heterodera glycines
  misc_feature (2054)..(2054): n is a, c, g, or t
aagatggaagccgcaattcatcaactcactgcggcaatccagcaattattgtcaaatcaaaatggtgcgccagccgcaaatgcgcatgcttcgccaacgcttccgcccatcgactgttttgagccatcggacgatagaagcatttccgattggttggaacgcttcaattttgccctcgactgtgcggcaccgcaactggcagacgaagcaaaggtcaagctgctcatgacgaagctgagtgaagtggctttcagccagtacagcaagtcatgtctgccgaagaaagtcatcgattttgactacagccaaacagaggagcgcctaaagattgccttcagccggccacaatctatttggattgatcgctatgaatgtctgagggcctcaaaaagcgaagatgaaagctttcgtccttttatcaacagacataagcgactcttgcgtgattttcagtttgaaaagctcaacgaagagcaattttcttgcctcatgcttttgacggcactgaaatcaccgaaggatgccgagctgagaaagcgaattctttcgaagcttgcagcggatggttacctggtcgagtatgatggagtcgtcgaagacctccaaatgtaccagtcgaccatcgctgaagcaaaggtcctcgaacaacaaccgatgggctcacgaaacttgatggcgaccaaattgaaggcaaaaaagaaacgaacgaactcggatctttcgtcgaatgcgagcagcatttcgacaggaacacggagcagcaatcgatcgcaacgcgtatgttggcgatgcggtttgagccattcgtcgaggaattgtcgacatgaaacaaccgtttgccgaaagtgcaagaagagtggccacttggaaaggatgtgtgccaagcaccaggcatggttgaagaagaatggaggaaaaaatgaaaaagcggcgaacaacgtccgcgttggaggagttttcctggttaaatctgagaaccagaggaagaatggaataatcgatgttccgattgatgtgaatggcaccaaagtggatttcattgctgatttaggcactgagggaactgttctttgtgaggacactgtgcgccaaatcagagctttgaaattgagccgttgtcaagaacgtgctcagtaccacgatggcacaactcgtccattcgttggcaaaggaaagacaactttttcgttcggagaccgctcatgctatggacatttctttgtttccaaagacggatccaagaatttgctcggattggacatgatggacagacttggattgtcggactccatcagaaatggtctgaaggacaaattccgaactgaggcttccaaagagaacggagcgagccaaaagaaaaagaagaaatcgtcagaaaagacggacgtggcaaaaagaagaatttcttcgctgtgggagcgaatgtgatcgccagcttgggtgatgagccatggcgtgccggacgtgtgatcagccgaaaagaaggcacttacgacgttcaatttttggacggcacgactggagaattcccggcaaaaggtgtacaaccgtacaagccggatgaagatgaaaatttgaattttcttcttgacgggtttggtctgaagagagcctcatccggtggatctatcgggaagcacggcagcgatggccgacgagatcaaacgaaagatgatcttcgagaagcttccgactgtggacacaaggcataagaacgccgatctgaggatgcggatgatggacggaggcccggcatttttcaaggggggagatgttagggttgggacccaattgtccggtgcccattttgaccctttgtttcatttgtatttcccttctcccttcgttatgtcacgcccacttctccgcccataaatacccgcgatgttgacccttccccatcattcttttgcttcttctccatttatttgttccctttgctcccaatcgatatttgaccccgttcgccctgtcccttctttttgaataaatatttattttattcctcttcggactttggggcgtaacaggcacgaatgttttggtcaataggngccttctttcaccggcatgtcgaactgatgacttctctatctctggctgctttttgtgtcgccgtcccttat

SEQ ID NO: 19350 - DNA, 1918 bp, Heterodera glycines
agggtcccccctttttgaaaaaattttcaaaaactgtcctcctaagatagtgccattcttgtcattcattaattttttcctttcttatatttcagcttttctcgacaaaaaattgcaaatgcctgtcgttgcggctgttgatctaattttggagaaccaaatgaattttgttaaaaaacgaagaaaacgaacccacgtgagtcaacaaaaccttccaatgttttgagtggaatccatctgagtgaatttaggatgaaactgatggaaaccacgctgacaagaccttattcttcagtgatccgaattcgcaaaatgacgagtaatattttgtttaaaactcaaattatttttatattttagatcaactgatgaagttttcttgaatgaaattgatctggaaaacccatctatccatgattttttcgttgcattggccgcacatttggataatctccttcaaaaccggaacgagaaaatcagtttccaagctgcgcaaattttcgacttggtttcttgcttttcaaagctttttacaagggttagtgatattttgttgtatttttttatattctttgaatgcaataaaattcgcttaatatatttcaggtacgacgaccgctttttcaatggcttttaaaaaagaatgtgtcaattgaggaagtgttcatcatttccttcttcatcgaaaacctagcagatgagcacaagtcttttacagagcttgtggaacgtatcgttttccttttataaattaattaggccttgttttcattttaaggtgtggtggcagagagatataagcgtcagtctctttcacagacactttccaactcggaccaattgttctttgttagcgatttaatttcgttttcataattctgtttgggttccagaaaccattggtaaagctgcggacgttcgatcgcacttaccaaagcagcaatagcgaagtacaaaaaatgatggacgtagcgcgggacaattttgagaaagttctcattgaaatggtacaaaacgctgagaataaaacagcactcaaaggaattcaatggatgggcgtaagatatccttttgaatttgtttatttttcacctttttaagaaatcaatcctctgctatttctccaaggacactgcaatttttgaatgttctgtgtgttttacagaatcatatgtctcgacggcatttcgatgcactgcaattcaacccctgaaagacgattctgaaaagcgacatttgttctgtttggactgtgttcgtggtcaagccgaagcatctgtgaatgaagctttgctttccgaagaggcgttgggtctgcgctgcatggcatcggaatgccgaaatccaatccttttcagtatttttaatgctaattgtaagtttggcaactgctttttcaccattagccgaaatcagcggatatctttcgcgtgcgcttcgtcgtcgactcgacgatcgcctcacaagtcaggccctttgctccgctgggctttctggcctcgagtactgcttgaagtgcgattttgcaatggttagttagcatgccttttccttagatgctgtgaacaatggctttttacttcctcaaattaatcctgctattctttatattaatatagtaattcgcatgaatgaattgaatttaaatcaaaaattcaagtattttgcagatcatggaagtcccaaaggaagtggacaaagtcttcaactgccagaaatgcggatattcattctgcaggttttaaaaattccaaataagatagtgctgtttcagactttgtgaggaggactggagcaaacactttgggttttcgtgtgacaaagtgaagctttaaagagggggaagcaaagcggagagaaaagtaagtgactatgggtgggagtcagaattaaattttaacaattactgttaagagag

SEQ ID NO: 19351 - DNA, 1825 bp, Heterodera glycines
cccaatgcccaacagaaaactgttgatgacattggcagtgttgttcggctttccgaacacaacgtaaattctctccaatattggaagaaaatgtatgaagattgcaacaccgtttttgcacggtgccatgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcctaatatacgacaactcacatgtcgtgccgtataatccttatattctgctgcgttaccgagtacaccataatgtactgtttgcatatggtaacaaagcaaatattaaatacgcactcaagtaccctttcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctttttgtgagcatcctggtctatggccagccgagtaatgccatagaattgtggaacaagtacaaagaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaaaagtttttctttggcgatgatgatttgaatttgcctccagggcaaccaaatcctcgtccacagccaaatacccctccgccacttaacagcgaccaacagaaggtctttgaatgctgtttttgttggc

SEQ ID NO: 19352 - DNA, 1087 bp, Heterodera glycines
agagaaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaattttttttccttcctctttagaaagtgtctaaaaatttttgttgttaatattcagaaaacgtgttttttttactgacaatttttttcaagagaaggatatgaacaatcacttataaggctcatgcttggagataaaggaatcggaaaaaaaaattatctcaacaatcagtcgtgaaacagttcaataattcagaagcagtgccatattgggaaaagatgcacaagtagagta

SEQ ID NO: 19353 - DNA, 3008 bp, Heterodera glycines
  misc_feature (2984)..(2984): n is a, c, g, or t
ttaaaaaattttatagttatttattaattaaataaattcttttagtattagtcgacaatttgacataaaaaatattttatttagtcataatttaaacattattttttgtccaacatttacagattttaatatcttttaataattgtttcttctttttaatgtaatattgtttatttatttatttcattatccttcaattttatgggttaaatttttcttacaataacaaaatattatttatcttattaatatttaaataaatgtttatttattagccgggcacaaatgtctttattatttgcaaaagaattcctttcacttttattttaataatgagtttaaaagttaatttgctttttctactttcatattttacgaaaggagctaaaagaaaaatattgtttaagattgtaaaaaaattatacaacgaaataaaaaaataaatttatgcccttaagttataatctcatttttaattacaaaccatttaaaaatttgttttttaattttttctcttaataaaaactcttattttattgatcccaatttaaatactatttccggtctaaatagtcccttttatacttcatgaatttcattttgttcgtaatttttttttcattgaaaaattctttttatttttaatttttatgctgatgataataaattttttttatgtttcttaaaatttcatttatttttgattattttatgatttttattttaactatttttatatcatctctcatgtcaatacaattccgattcctacaccggttcgcgcctttcttattctgattcttcttcagcagctttctccgtacatttattaatgatttaaaatttttaatttttattgaatacatataaattattattaaattatactattattaatttttcattttttgtaattttattttgctgtttaaaaagaatatataagacaatttatattttcttggcgaagaaggtcttaataaaccaaacgatttatgactattgttgcctaagaaagtatttcgatcggttttttgatttaaattagcaaatcattaaatatacgtgtttaataattattaaattacattaaaaataggatgttttcgatttttagcatttgttcctattttggaatttaaattattatattcattcaaaagttgacttatgtattgaatttataaaacctgttgatatatttactaatttattttttgctgagaaagttataaaaaaaaacattgtaatggaagtaagtaaaaataactcatatgaaaaaacaaattagcactggtaattgtcaatcaaaccctcagatttttttcttttcataattcactgcagttgtgttttccaaaagaagaattaaaaattatttggcattctgtccttacaaattttcaaaaaacaatgaaatcccgcagaatcccgcataaaaagacaaatttgaggatcccgctgcgggatttgaactcaaaattttgtgggccgggatcccggatgtataaatccctcaaaatctcgcaaatcccaaaaaatgcgggattgcgggctgggaccccgtaaaatcccgcgccagattataaagacggacattgctgatgattatcatttttatgtgctttttgtaatttattaaaaatttaaatcatttattttgactttatagcaattatttttaattctttatagtaattaattgttttattgtagattacaaaatgtcgaaagaattcatgatttgaatttattttttattttataaatatgtattaattaaatttcatttattcagttcagttcatctcttttatttaattaattgtaaaataattttatttaatatattttatctctttttactctttaatctcatggtacaaagttgtttttcctgtcaatggtgaggtgtcgcttttcgaaattatttgattcgcttattattaattaaataatgatatgcttaaatttatgagtacaaattaaattgcctttattatttttattaagattagttcatttctcagtaattaaaaaagagttaaatttgttttaatgatgacatttttgaaaagtcaaatttcttttaatttctttttctttatctttctatttttattatttataggttgccttgctataaatcttgtgtttccccaccaaataattggccgataacaaaatactaaattaataaattttcgcaaaataaaagtaattttttaaattttttttattgtaaaatttttggtgtcttaaggtgcttaatacatgatttattctaatttaaattttattactatttttgtattttttactaatttatttttttattttgtttatactttttggtatttttattttaaatttcaaattcgtattctcacgacgtagtcaaagaattgaatatggtcatttcaaagtattttaatgatttattattattcatttaatttttgtttattctcatttttaaatgcccatatttattagcttgcaaagcgtctaatgattatttattttctttctaatgtatatttgtttaggaaaagcttttacaaatttataactttgtatgaataattttgtttaggctttttgttttagaatctttaatgtatatatttgattttattgccagttaaatgaaaatttaatctatttttgtgttctagttttaccttaacaaagtaaacgaaaattttatttaatattttgggtgccttgctctcttttattttagaatctttttgtaaaaaatggttgaaaattaataaagaaaattaaatttataattgatttttcccttttaaagaaaaattatatttaattcctttatatatttttttttataatttattatttattacatatttattctactctttattctttaattattcttttctaaatttataaattattaaacaaaataatttttgatttttagaaattttattttttggagaccagtaaaaganttttttaagcatcattttcaaatt

SEQ ID NO: 19354 - DNA, 1234 bp, Heterodera glycines
ataattatgaataaaaagaaataaaaaatacacaaaatccttatctatgaataataaaactttaaagcaaaaataatataaaatttttttgactatatggcataaggcaaaaattgaaaaaccccgaccccgaccccgaaccatttggtcaaccccgaccccgaccccgacacttccaaccccgacgaccccgaaccccgacttttccaaccccgacggtcgggggcccaaccctagttgttaagctagttttcatttttattgttagcaattaaaaaattttgaaaaacttttcaactattggcgttttgccaaaaaaaaaattaattaacaaaaatacggactgggaccgtagtgcgacatttgcggaccgacatttgcggaccgacatttgcggaccgacttttgcggaccgacatttgcagaccgacttttgcggaccgacatttgcggaccgacttttgcggaccgacttttgcggaccgacatttgcggaccgacttttgcggaccgacatttgcagaccgacttttgcggaccgacatttgcggaccgacttttgcggaccaacttttgcggaccgacatttgcggaccgaatttttgcggacccacttttgcggaccgacatttgcggaccgacatttgcggaccgacttttgcggaccgacatttgcggaccgacttttgcggaccgatatttgcggaccgacatttgcggaccgacttttgcggaccgacatttgcggaccgacttttgcggaccgacatttgcggaccgacttttgcggaccgacttttgcggaccgacatttgcggaccgacatttgcggaccgacatttgcggaccgacatttgcggaccgacatttgcggaccgacttttgcggaccgacttttgcggaccgacatttgcggaccgacttttgcggaccgacatttgcggaccgacttttgcggaccgacatttgcggaccgacttttgcggaccgacatttgcggaccgacttttgcggaccgacatttgcagaccgacttttgcggaccgacatttgcggaccgacttttgcggaccgacttttgcggaccgacatttgcggaccgacttttgcggaccgacatttgcagaccgacttttgcggaccgacatttgcggaccgacttttgcggaccgacttttgcggaccgacatttgcggaccgacattttgcgaccgacttttgcggaccgactttt

SEQ ID NO: 19355 - DNA, 902 bp, Heterodera glycines
aattttcaacgcctcctttctcgacaattggtggccgtaaaatacgtctgaattcacgacatttggccatcatatgcatgttctattctccttttcaaatacgtgtttgcgttgtaaaataatccagatactgtacccattgggaatttgaaccattcttttctaggaagaaaccggtttgaaggtgataaagcggttgccatcgtacttatagaaagtggccataaaatcagttcgtttaaagtgacaactgcactttattttcgtattagccatcagatccccgacttagcttcaaaacaggtaaagccacacattctctaccattgtgaattttcaacgcctcctttctcgacaattcttggccgtaaaatgcgtctgaattcacgacatttggccatcatatgcatgttctattctccttttcaaatacgtgtttgcgttgtaaaataatccagatactgtacccattgggaatttgaaccattcttttctaggaagaaaccggtttgaaagtgataaagcggttgccatcgtacttatagaaatggccataaaatcagttcgtttaaagtgacaactgcactttattttcgtattagccgtcagatccatacattagcgtctaaacaggtaaagccacacattctctaccattatgaattttcaacgcctcctttctcgacaattcttggacgtaaaatgcgtctgaattcacgacatttggccatcatctgcatgttctattctccttttcaaatacgtgtttgtgttgtaaaataatccagatactgtaaagtgcagttctctctgtaaacgaactgattttatggccactttctataaaggcgatggcggtcgcagtgtgaccgtaaacccagttttttgtatagaaaagggtt

SEQ ID NO: 19356 - DNA, 1422 bp, Heterodera glycines
  misc_feature (1312)..(1312): n is a, c, g, or t
  misc_feature (1362)..(1362): n is a, c, g, or t
aaaaactttttgggaaaaagtgaaaaatttttcccttgcatcagaaacagactcaaatttttcaacacacaaaataaaatattcagactcaaattcttcacgacacaatataaaaatatacgcaagacttattttttaataaattacatcctttttagaaatgctacataaattttattgtaaatagttacaaacaaactttttttcactgccaatttctaccagttgccaaacaaaaaggcgatagttaagcattgagatataaaaaaatcgtctagaataattatctcaacaatttgtcgggaaagctgaataaatttctgttgcaataggcatattggcacaagacataaatgtagagcaggcacaaaatagaggaaataccaaagattaaaaaattcttgtttatgccccactctgctttggctggccatacctcgccagagagtggagatagaccctttgttgatacatttggaaatgtcgagcccgcctagcgcattcgaataacacaaaatttgtttgcatttgccaccaaacaatccgcttatgacgcgccgaatgaaaattcacaaaaatttggcaccggaaaaactgcattttttcatgggccagcataataaagtaaacccaaaatgtaaggaaatttaaattggtcatgagagatgtttagttttttatttgtcccatcctttttctgggaaaaaacttttcgagaaaagctgaaaaattttccacttgcatcagaagcagactcaaattcttcaacacacaatataaaaatattacgcaagaacttatttttacatcctttttagaaatgctacataaatttttattgtaaatagttacaaacaaactttttttcactgccaatttctaccagttgccaaacaaaaaggcgatagttaagcattgagatataaaaaaatcgtctagaataattatctcaacaatttgtcgggaaagctgaataaatttctgttgcaataggcatattggcacaagacataaatgtagagcaggcacaaaatagaggaaataccaaagattaaaaaattcttgtttatgccccactctgctttggctggccatacctcgccagagagtggagatagaccctttgttgatacatttggaaatgttgagcccgcatagcgcattcgaattacacaaaatttgtttgtatttgccaccaaacaatccgcttatgacgcgccgaatgaaaattcacaaaaatttggcaccggaaaaactgcattttttcatgggccagcataataaagtaaacccaaaatgtaaggaaatttanattggtcatgagagatgtttagttttttatttgtcccatcctttttctgngaaaaacttttcgagaaagctgaaaattttcacttgcatcagagcagactcaattcttca

SEQ ID NO: 19357 - DNA, 1131 bp, Heterodera glycines
aaaaaaaataattttgaaaatgaataaatttacaaaatatttcgctttttgttaaataaatttcaaataaaatatttgtgcattttttatggaaataaatttcatattttcgttccttaattttatattcataaatttaaactcattatctttcttaaaatgatggataatattctgtaaatattttagccttttataaaaataaataaatttattaattttctatttttctattttccttttccttcattcttttgttctttacacatgtaaacaaattcattcatatgaataaacaacgatttttctgaccttaaaaatattgatcataagtcgcagcatttgcatattataaaattctttcaatttttgtcccccttatccgaaaaaatagaccaattcattaaaattcaattttaataaacttataataattttcttgaaaatggttttgttattttcaagccatcaaaatggaaatctttgacgaatctattgttgttgacgaaaaagcgatcaatgaattcactgtccaaagcaatcacaactgctgctgttcatttcgtgatgtgacccaatttgctgcactgtaatttcactgtttaaattttatgtagctgggatttttagatgcttaaaatagtaaaataaatacataaataaatgcttaaaaagtgtcaaaattaatgattgggtccggcggcctgaaaccaaaattatgcagaaatttgcaagaaaattggagtaagttatgtaacaattcaaaaatggaagaaataggtaaataaaaaaataatttttaaaattaaaattcttgccacgaaaatacctttttgagaaaatttttttcatttcttaggagtgctttttgaaattttttttgtcgattcttaggggtgtattttttgaaaaaatttttaggtcgattcttaggggtgtattttttggttttattgcatttttgttaaagaattttccaaaaaatgtcgaaatagtgacaaaacgccaaaatagtgatttttaactattttagtgacgaagtcgccaaaatagtgatttctagtgaccgataatgacatcagaatcgaaaatttttaatgcagaaatgcgttttttgagctcctttcttca

SEQ ID NO: 19358 - DNA, 1426 bp, Heterodera glycines
  misc_feature (1374)..(1374): n is a, c, g, or t
  misc_feature (1382)..(1382): n is a, c, g, or t
cagaggggggctctaaatcagggggggcttaccctcaaaaggggggctttatatcagagagtggctctaattcagggggggcttaccctcaaaaggggggctttatttcagaggggggctctaattcagggggggaaaatcccagcctaaagagcataatcagtcaaaatcattttttaaactgaatactcaattaagtcaatttatgattgtgaaaaccgactatagcaaaacattgaaaatcacggacattggcaatgcttacacgccaaatgaggagccattggcacaaattgtccattggcattgggacgaaaaaggggcacaacggatcgttgatgtaagaaatttaacgaaaattatcaaaattaaataaaatgattaacaaaaattattttaagacccatacactcaacaagggtagtgaacataattgcggcatctataccaatgcttcatcatttgttgtccgaattcacaaaaagcgggagaaaaagtccaatgaaacgtaaagtgttaaaattttatctaaatagttaaaaaatttcggttcgtattctatcgtttgtctctgtcgtctgaattgtcttgtccgatcacaattaacaaaacccttaggttttattcgatcgaaatgataaatcacaaataaatatgaaagtctgagatctgatttttgtgatattttggaactcttaattgtgatcgacgactgctagtcccgttcggagttgattattgctcctccgatcactaaatatttattccgttagtctcttctctgcaccttccaacatctcaactgatcacgacgaattgacagtgaaaattggcgacaaacaggtgaaacagcagaaagagagcacaatggagagtccaaaatttttttaaattctgataaataagaaatcttgatcaaatcgttaattaatcttgctgatcagatcgctgtgtccgcccattggctgtcgtccgtttccccggtgatcagtcgcatgctcagcgtggagatgaaggagaagcagcagcgaatgatcactttggacgagttgggcgtggacatggaccaattcatggagtttttggaggccatcacttatctgacaatgagcggaccttttctgcccaaccgtaattctatgctatcgtatttattctactatatcctctggaaaattaaatctaccctttttatgggttgaaaatatgatttttaattttttaaaatgaattcccaattttaagccaaaaatgtactgatgcttctcaaattggccgactacttccaggtgggtgccttgacacttatcaacaaatcctcatttgatgtctaaattttctcgctttagcctgtaaaattttgtgaacaaaaantgtcgaanttttttttagtttttgtaatttctaaaattttacaggcttatag

SEQ ID NO: 19359 - DNA, 2138 bp, Heterodera glycines
atttcagaatcgggtttctcgaccctgaaaacctctaatacaagtttattttcaaaaaaaattttttgaaaatctgtacacagataacccacaagtaccaaactttctccatttttaacactctcgaactgggaaactttctcgatttttaagacgttcgagttggaaaattttcgattttgagtcttagttttataatttgaaaaaacgaaaactttcaaccgtattaaatagattgatcattttcatctctgaatcaactaattttcccccgatcaaccgacatccaaaggtatcaacaaaatactgatcgaatcacattcatattcccaacaattttgtacattgataccaggggtgggacaactctcgcctctcgtctctcgcctctcgccaactctcgctatttttggtactctcgcctctcgtctctcgcctctcgttttttgcgacgagaggcgagagttgaaaatacacccctaaagattgaacttttgagcagccagaaaaattttcaaatttacgcgaaaaaaaaatcttaaatctctttctttccttccttaatgttttctctatttttggatagctccaattcaaatatggtctgctggctaacaaataagccttctgcctttcattatttttctcttgggttcaattccccaacggtatacagaatttttttaataatttctttaaactgcaaatttaaccaaaactttgatcatttgttgacaagttctgttaatatattacactcaaaattttagaattttttcggcggcgcccatcggcaccgcccgaccccaactgtccccgaagttttaaaaaacgcaccgcaaaaaaaggtggaaaaaatggacaaataataaagtttgtttctaaaataaatatatttcatgaaaatattttttaattttcatgaaaaaattttaaagatttttgtttggatttttcatgacttggactcggtttaaaaactaggactctgtcccggctttctgtacccggcaataccctgacccggtatttgcccaaatacccaggcccgtacccctaatttaatatacgattttgaagttttttaaattaaaaaataaggctacagaaaaaaattgaaaaactctcgcctctcgtcctctcgcctctcgccaactctcgtgtttttggggactctcacctctcgccaaactctcgctctcgtctttttggggactctcgcctctcgccaaactctcgctctcgtcttttctgagacaagtcacacccctgattgatacatataatagtcaatattattcccctatttcctcccgcccccctaagcagtttgtttgtttgacttttcccccatttatgaccaccaaccaccacaccctattaacgttcgccggccgatcatcgcctcccccccccccccccgggggggcgtctcccgcctcccgcgcatttatattcattcttctgcgtgatttaatgcgcattaaaagtgtcatcgcgccggcccatcgtcgtcgtcgtcgatcggttggctggggaagtgtcagtcattcattcattcagtcagtcaattagtggtgccgcccgtctctgttgccggcggggcaacaaacggtcggcggcggcgacgcggttgtgcgcgaaatttccgcgcgcgttgcctcccgccctccccgccccccgggggtgcccatttacccatttacgtccgcagtccgccgcaccatccaccaaaagtgtcacacaaatgcatgcacacaacacacacaaattcttcgttgtcgtcgttttgtctttgtcgtcatataaaactgtccgtcctcctcttcctcatcctccgttctgtccttcctcttcccccgtcgttcgttcattcattgactctgtccccgtccccgcaaattgctgaaccactttaacaataatcatcatcatcatcaaacagtctcagcaatcagtcgttttcggcgcttatctcatcaaattattatttgtgtgtcaaaaaatcaatttaataaaccactttttgaaatgccatcataaggcaattggactaattgtgctccatgcccgaattttaggaaatttcgtttccatttcttttcacttccgaaaatttttttgtcgtcacacctgca

SEQ ID NO: 19360 - DNA, 998 bp, Heterodera glycines
  misc_feature (28)..(28): n is a, c, g, or t
acgaaaaatgataaagaaatagattttntgggaatttttatgcaaaaagacacttgctttttccaattttttacacatattttggcatttttggggtttttagcacatatttcagcattttttagcaaatatttattacatatttcaggatttttagcacataaaaatcccatccctattgattataaatcagaagagctaggagccctgagcaaaggcggaattgaacgaattgaacttatttctcatttaaatataatattatttttaactaaaaattccagtttgaaaataaggaattgaaatgacaaattaaggaatctcatcctaaaaatgttggattgccattttaattacaaaaaataaaattggcggaaaaatgccaaaataattcgtttcattatttttcaattcattacggtaaagagcatttactgcaaaatgcgcaattatgggctttttaaattttaagaatttctttttgtgcttttttggggctgtactgcagtttattcgttcgttcaatcactgatcattagggatgtcaaaaatatgtacaaaaagtagtcataatatgtacataaatatgtaaaaaaaatccagaaatatgtataaaaatcataaaatatgtattaaaatctgcaaatatgtagaaaaaagttgtgcaaatttattaaaaatgttctctcagctgtttttgcaattgcaaatcaaaaatttctcaaggttttcgggtgtaaaaggcatccggttatctgccaaaacattcttataaattgagaatgatcgctccacttcgcaggattgaatcgaagcatatttaaactttgcaatcacatcgggtggcaaatgaatttgaagatttttgcccctcaagaccatgccgatttcctaaatttcttaaaaactattgttaaaaaccctttttttcaccccgcactgatcgaatccctgcgttttttagcaggacagcgccgaacttttcctgggcaattttt

SEQ ID NO: 19361 - DNA, 1320 bp, Heterodera glycines
  misc_feature (32)..(32): n is a, c, g, or t
aatagtacatcgctgcactacgccaggtcccncatctcgtgatgatcgggcgagggggaagaggcaaaggccatggcacaaacatttcaaatggattaaattggggaaaaaattttgagacccttaacagaaccatttatgttagtaatttaaccaatttgggaacatttgccgccttgatcatgtaacgcgcaccgtccgttactagtaacaataaattttcggcgtaaatgaatgattggagattgtcaataacaaaacgcgcaattgtctcgttgtggtcctttcaagaaccttcaccgctattcacttgggtcgattcattttgccatccaaagtcccaataaccagatttgcaacataacgtccttgcttatctgtcgtttcatcaactgaggcccaaatttttttgccattaaaataatttttaagttcagccattttctgaaacttaagcatttcatggattctaattacacaaaacctgttcgtaacacagtctaagatggttgtgaaatgtaattcggctggggacggctcgcttacaatgttttccaacaaattctaaggaaaatacaaaatattaagaaacctcagtcctaaacctctgaaatctttgttttccaatttgtaaaacggaatattggcagaaataaaggcattgcacaactccattgtaaaggggtccggcttttttgcagtgtccatcaaaaatggttgtttttgtgcacttccgcttggtcgcgtggagagttcgacgttcgatttgtgtttggcagagtcattgtgttgttttagttgtgagaacatcttcaatggtacatgtaaatcattctcgttgtctagtcgtcgctgaagccgtgatgaaaaaggccgttttacaacctgttgtttgcacggctggcaatacacaattttgccatcagtcatgtacgttgttgctccattaatcctgttgatccagtcgcgtatccatgcagattttaatttaattttaggcatagcactttttcctaagaaatttttttgaaaattctcaaaatatgtaaaaaaaatttgccgaaattgtggattttttgatgatttccaaaaatttctgtaaaaaatcctaaatatgtaaaaaatgtatgaaaaaatccgaaaaagtccaaaatatgtaccaaatatgtataaaatcccaaaatatgtataaagccccgaaatatgtaaataaaagtcccaacttttgctcgcaaacacaaaaaagaaagtgtttttcctactaattagagcatggagaatccaggaaaaaaatgtatttacataaaattgacatcccta

SEQ ID NO: 19362 - DNA, 929 bp, Heterodera glycines
tttatttgaatatgccgccgccgcccgcacacactcacacaaacaaacattcccccgcccccggggggcgcactttgcggaccatcaccacatgacatccccgcaggcagcgcaagcaatgaaaatacccgatgccctgtgctgctgctgggcttcatcttccgctgctggcgctcgggcattgtgtgttctgtgtttgtcaagaccaacaaaacgcactctcggggggggggggggggcgcaagcgacgacggcagagaaaagaacacccccccctccggggttgaaaaatgtataagagagcaacatgggggagggtgctaagggggaccacgcgctgctcggctctgctgtgctgccggccatgccccctcccagcctggctcgtgtgtccgtccccgtgggtgccatgccatgcccacccactcgccgccatgttttacacgaaaatgctggtgcgggcgggggagggaggcagcagcgaggcagaagccgacaaaatatagcgtttttccccacgcccagcagcggggaggggcgtgtccccgctgccgccttccccgtgtgatgcttgcttatgcttctgctgatgctgggctgggcctaatcgacacaaacatcgccggtgcggcagcgcggtgcccccccacccgtctcccgccccgccccccgaatttgtgagtgaatgagtgagtgcgtctgtcgtcgtcgttgccttcatcatcatccccatcatcaccatcacattgtcgtgtggtcgcagtattatttgttcaccaaccaaaatgcccccgtctctcccgcccgccggcgccgattcagtggcgagtgtctcgctcacagtcctcacagtcgtccatccgccgccgccgtttactcgcctctcgccccgccgccgcccccggtcgtggttgttgtttgttttgtgc

SEQ ID NO: 19363 - DNA, 1994 bp, Heterodera glycines
  misc_feature (1685)..(1685): n is a, c, g, or t
  misc_feature (1688)..(1688): n is a, c, g, or t
  misc_feature (1737)..(1737): n is a, c, g, or t
  misc_feature (1759)..(1759): n is a, c, g, or t
  misc_feature (1772)..(1772): n is a, c, g, or t
  misc_feature (1776)..(1776): n is a, c, g, or t
  misc_feature (1792)..(1792): n is a, c, g, or t
  misc_feature (1798)..(1799): n is a, c, g, or t
  misc_feature (1807)..(1808): n is a, c, g, or t
  misc_feature (1828)..(1828): n is a, c, g, or t
  misc_feature (1850)..(1851): n is a, c, g, or t
  misc_feature (1853)..(1854): n is a, c, g, or t
  misc_feature (1874)..(1874): n is a, c, g, or t
  misc_feature (1887)..(1887): n is a, c, g, or t
  misc_feature (1901)..(1901): n is a, c, g, or t
  misc_feature (1917)..(1917): n is a, c, g, or t
  misc_feature (1928)..(1928): n is a, c, g, or t
  misc_feature (1931)..(1931): n is a, c, g, or t
  misc_feature (1934)..(1936): n is a, c, g, or t
  misc_feature (1939)..(1941): n is a, c, g, or t
tagaatcgtgaaagaaatgattttttgcgataatcgagaccgaaataaaaaaaaagtgataaatccatgagtcaaataatacggggacacccggcacatgccaatttggcattttgggtggtcaaagaagggaatttcttgtggtctgtcgagtctcgagcatttggtcttcagaaaacaagcatttatcacagaaatattaaagtaaaattgagaaaaggcggtaaaagtcctggcatcgaccacaagaaccgggaaatgccgaactgccgtttgtgcccctccgttaggggacccgtcttttgggccccgccggggtcatttaggccacacctttttggaccaaaaccaaaaaatagaaaatatgagggactctttgaaaagcatcgcccatctatctctacctcaaaaagtgccgaaattttccacttttttttgctcatttctatgtgcctatttaacggagtccaaacggcggggcccaaattgccccgactcctttaaattgatgcttttcgtttgacttttttttcccgattaggcttttatttatggtattttgcactaccttcaccaatttttcagtttcccgtacaaatggagttaaaagttaaggtccaaattgtggagggaaggcaataaaaattgatgaaaatcatatcgaaagaatttataaattttcaactgattatctacataaaaaactactttaaattcaaaaaaaaaaatcggccgttttccaaaaataattctcagttttccattgaccctcctccgcctccgcccccaactctcaacacaaataacaacaacaaaacaacaacgatgcttaatcggtcgggggagggggcgggaaataggcgaaagatcaaacagagagagcgagagagagggagagagaagtggagaaaagatgagagagagaagaaaagaggagacagagaaatagtgaaaagaaagagaataatctttaccctctgccgttgccacccctcgggggacatgttgttgtttaatggattagcatcttcaacaacaacatcatcatctatcctcggaaaccgacaggttgactcgcttttccacttcttcctcttcctcttccccctcccttctactcttgcttcgattcctctcctcccttctcttctttctccttttcctcctcccttctcttcttttttctcttccctcttcctgctcctcccttttcctccttcttcctctcatctttctcctctccttcttcctccatcttccgctgtttgtgcttgttgttgttttgttgttttgttgttgtgtcttcgtcctcctcgtcaaacccttgtctgcgttgtttccgttctcctccgtccgttccattccttcctttccgaaacgttcgttccattcccttatctatgcatttattcaccccctctccccccccccatcagaggccgttcgtttctttcctcccccctcatttggttaggtgcccacggcggcgtcgaatcagcccaaccccataagcagaacaaacaaacaaacaaacaaataaccaacaagagaatgtggaagcggtggaataatgaaatttaaggggggggggggcaatgaaacggtgaaaattgagacgaattttttgaaaaatacgaaagacgaacaatcaacatttttgggcgtttcctggtgggccttgttgnccncgttgtttcgttttcctggctcgtttgttggtggtgtgtttgtgtccgntttccggtctcgttggcttttngtcgcttttttgnttcngttttttggttcgggntttggnnctcctgcnncttttttctgggatgtcggnttgcttggcgttcgctttggcnncnnttctccttttcccccctttnttttcgctctccnctttgttcggtttngttgggtaagaagcgngttctggctgntcntcnnnatnnnttggcctataaagaaaacatttacccagtgtaaattttgaattagcgcgcaaa

SEQ ID NO: 19364 - DNA, 2724 bp, Heterodera glycines
  misc_feature (20)..(20): n is a, c, g, or t
  misc_feature (30)..(30): n is a, c, g, or t
  misc_feature (79)..(79): n is a, c, g, or t
  misc_feature (100)..(100): n is a, c, g, or t
  misc_feature (2699)..(2699): n is a, c, g, or t
ttcaaaaagtaaaatggttntatctagacnagcgaggaaaaataagatttattcgaactatgcatccataatgacttcnagcataattgtgcaaagtttntactaaaaacgtgcttttgatgtttttagcttaaattttgaaaaaagaaatatttaatggttcctatggtgcagataagcaccgtcggagaaattttgaacttttatgcgatttacacatattaattaaccaaataatgacaattgtttattttgatttaggattgaactcatgcaaaaactatagcagacttagccactaggctacatttacatattgtttctttacttaaagaaaaaattttttctttaaaattttcctttccccaatttccatgactattttttgcttaaatacctggcatttctaaaaacagtgaccaacacttgggaggaccgggaattcacagcttttttaaattcagttttttctttaattcaaattttttcgaatttaaaaaatccacaattccgcacgggatcccgaaaaaatggatattcgtaaaatttttaaaataagttggttcagcgaagaaattagcggtactttttggttctgccaaacccccaccccaattttttttaactctttaactccttttttaatttttaatcatggaaaatatactattatttggagacggagagatttatggagatgggcatataattagagaaaatacggtaattcaacattcttgcaatttaattaactacatattactcatttaaataaatgaaattatgtaatttactacgaacttttctaaacaaaatttctttcttcctcattattctgctgactgggtaatgtcgccaatttcgcggaaccaattggcccatgccgttgcggtgtcattttggtcgatgattttttgagcgttcatcggctcactgaattggccaaaagtgtatttattattcatagggaaagttacaaaaatattaattccaccattacatgctcagcttttgtgggatgcttttcatgaatttggcctggaaatagtcgacaaattgttggcacaattcgtccatttgcggtatttttttgaccactaattgcttcattgtttttcgcgttttcttgggaaattttccgccgtaattggccgctaattgcatgaacagttccgagccaaatgaatacatttcgacaaacatttgtaatgatttccatccctccgaaaagtcattcgtttccttctccgataattcgtccaaattgtcattctcccgtcgcttcttcagtgcttcttccactttaagttgggcaatttttgccaaataattgataaattggccataaaagtgattttcagtgagaaaatggaatttcccagtgctttcttttgccaatttgagtgcatttttccgcaaattctgtgccaactcttcaaaattttcacttgttattttgctgacaagcatttcatagggaaatgccagatcgtctaaagagatgttctttgggaatgagatttgttcattggccaaaatcagttcggtttggtgttcgaaaatgagttggacgagtgcgatacggtggtcaatggccaaagggttacggtgaataaattcggcaatttcattttcaacttcgcttatttgaggcaaaaaagcacaaattgaaaagcagaatgataaaagtaaaaatgaagaacagaaaaggggagaaaaaagtgccatttttgaaggaaaatgaaaattttatgggaagagaataaattttatgaaaatgatttttttaaattcatttgctcaatctttgcttataagtgttattgcaaggtggaattttgtttacattgctggcttttaagcttaaaaatgtgattaaggtgaattattcgtttgcatcatttttatttgtgggggtgccaatggtcagcagcaccatcaaaaatgtgccaaatttgtttttcttttataaaaaaaataaaatatttgtaaaaaaatattttcaatgaattagatgtaaggttgagcggatgagtgtatgtatttgggaaaatcaggtccgggtattgtcgggcccagaaaagtcgggtctgatgagtctaagcttttcaactgagttcggcagtgagcgcaacccgaacccggcaaatccgaattaatcagtagagcccggaattttgaaagtaccgggaccgggaccgggcttcgaagtccaaaattttgaccgggcgcccgtacgggaccgggcttttttcaaaatttttggaattttgattaaaaattcgaaaaaattttatagtcctttattttagcttagaaatgtcaagccattgtaaatcgaccttttttactcttcaaaagaattttaaggttcattttttcaaaaagattttgacgacattggggggggggcgacagggccgccgggtaaatttttgaaaatttgagtttgctttgctaacagatttacacgaaaaaatgacaaaactttgctattttgagctacattttagaaaaaaatttagctttttgtactaggcgacgctgaagaaaaactttgacttttaatgaaatttattaagaaaatttttggtttttcatgaaatttgaaatatttttttgtgtaaaaagaatgttatgaaaatgttgttcaatttcgtatggattttggggtctttttaacagttgaaattgcccanaaaatttcaaaaatccaaagttcta

SEQ ID NO: 19365 - DNA, 1149 bp, Heterodera glycines
gggcccccgggcccgtccgggctctattaatcagaaggttttctttaccttcaaatctcaaaaagagaagacactccttttttttgaattttggctatatgtttacgccaaagattgttttcagtttttgctttttcttctggctgcgtccttattttttatggagatttttcgataaattcaaatttgcggatccggatttggattggaattcaaacttttttaatcggaccgaatttgcttgattaatcccgcaaatcctacactttccaaaaatgcggtttctagtactatttatgcgcgatttctattcttttaggtagttacctcggtatttgcttgttggatttttgtcgatgcccgtttttgctgaagagtcggcctggtttcggcatgagccgatgccgtggtggggtcggctgctgttgcccattgtcaaagtgctttttcatttttatgacattataaagaatccataaatcctttcttcccctccccacgccatttcagctcgggccgatgccgcgacacattgcaattgtaatggacggaaatcggcgttttgctcgcacccaaaactgcgcaactccgatggaaggacattcggccggatttgtgcagctgacaaaggttttttttactgtttttatttatttggttaattgactgaatgaactatttccttaacgcgaaaattaaggcgttaatttgttttacggtactaaattttgtttttttcacattcaatacaaatcgcataaaaattaagattttggctctaaaaagatgagtgcttttttgaatcaaacaggacacttgactgcctaaaatctaactccaaaatcgcaaattcctaatttttttttggcattttgctctattattcctcgaaatttccttttccgatttctttcatttctcattttgtttttttcaggttttggattggtgcaatgaattgggcgttgaggaggtgggaatttctattctccaatttatggaaacgaattgaaagattcccctttcaggtgaccgtttacgctttttcaattgaaaacttcaaaaggtgagcatttttatttatttttttgggggggtcaaaaattgatgaaaacgaaaatcccgtccacgaaattacaatacttcaca

SEQ ID NO: 19366 - DNA, 1379 bp, Heterodera glycines
  misc_feature (1262)..(1262): n is a, c, g, or t
  misc_feature (1274)..(1274): n is a, c, g, or t
  misc_feature (1298)..(1299): n is a, c, g, or t
  misc_feature (1306)..(1306): n is a, c, g, or t
attaaatatcaaatttacgggttatgtaaatctaataatattttttcatttaagcattttattataggatttatttttattatgaaattccctaaatttcttttttagttcaaattttaaaatattttttcttttaaaaaggctttccatttttgcggttttaactaaaatatacgttagaagcattgttagcctaaaaaaaattaactgtttttcataaggcttatgtttttaataaataataaattgttttcgttttagatttttgtaaattttaagaaatatttttgaaatagaatagaagtatcttttttatattgatcagggaacattaattctaattaataatataaaaattcgttttaaattattctccataaatttgattactaatttgttatctgtcattattgaatcggcagaatcgttattcaatcaaagaaatatcagataaaaatgaatatcaaaactgaagcaattaaattctataatcaacgctatttttaacatcaaaataaataatgaattaattttttaattacatttttattgtttttaaatctgtgacttatgaattgtattttgttattttatttaaaatttatttttaaaaatttctcattttattttccatgtactgatgattagatgtttttctgatttctgtcgctgcttaaattatatttttttaaacgaactttttgtatatttaaataatatttattaaaaattacaaattgttctaatatagtaaatagttttataatttaatattttttaaatgcaggaattttatctgaataattacgggaaattttttttattacaaaatatgtgttggaatcaatgttagcataagaattttaaaaaaactgtttttcataaggcttctgtttttaataaataataaattgttttcgtttttttgtaaattttttaaaaattatattttgaaatcgatgaacaaatatttttgtattggtcagagaaggacgacaaataaaatataaaaattcattttttaaatcattattcattcttacataaatttttttcgaataaatttgttgcattgggttatgaaatttaaattatgattaaaataatatacatagctgtttaatattttctcctctcctttaaccgtttcccttttgaaataaataccatattttgataatctttctccatttattttgaatgatgagaataattcacatttaaaaattaaaaatgtcgttgctttacgaattactaattanataataatttanataattacaattaaatttccctannaatcgtntattacagtttttaaatgtaaataaatcattcattttttcatttctttttatataattggcgactgcataaat

SEQ ID NO: 19367 - DNA, 2273 bp, Heterodera glycines
tttaccacaaagtgttggttggaatcactgttagcctttcataaataataaattgttttcgtttttctttttgtaaattttttaaaaattatattttgaaatcgatgaacaaatatttttgtattggtcagagaaggacgacaaataaaatataaaaattcattttttaaatcattattcattcttacataaatttttttcgaataaatttgttgcattgggttatgaaatttaaattatgattaaaataatatagcggtttaatattttctcctctcctttaaccgtttcccttttgaaataaataccatattttgataatctttctccatttattttgaatgatgagaataattcacatttaaaaattaaaaatgtcgttgctttacgaattactaattaaataataatttaaataattacaattaaatttccctaaaattcgtttattacagtttttaatgttaataaattcattcatttttcaattcttttttatataattggcgactgcataaattctttttctttgttttatcttgattttatccaacgtatgctttgaataaattttgatgcatattttatgaattttaaatttgattaataatatttctgctgtttaatattttctcctcttctttaaccgtttcctttttctttcaaatattacaatattaattaatatgcgaatagctaattaaataatttaaggattaaattttgaatttgaatttttcctcaaattatgtaggtgaaacggcatactgtacttggaactgatagagtacgattttgcaaattatagttttaaataaaatgatttatgtacttttttaattttattacattttaccataataattagggtcgcaacttttagtgacgaaaaatctcgaaatattaactaaaatagagagtaaaatgacaaaatagtgataaaagaccgaatttagtgacgaatagtgacataattttcagtcaaaaattaagcaaaaataatttttattcactggttgcagttgcaaatgtggtagaaatatttccttagcaaatattgaacatttttaaatcaaaaatttgtcaagaaagaaattgggggaaaagtttttaagaaattttccaattcttagtggtattttttaaaattttttaggtcgattcttaggggtgtatattttggttttttgcatttttgttaaggaattttacaaaaaatgtcgaaatagtgaaaaaatgtgacaaacaccaaaatagaaaagtttaactattttagtgaagaaacgtcgcgacctaataataataaataaatgaggtcaagaaatttgtttgtttttttatatttcgctgttattttattcttctcttcagctgaaatttaacttaaattgtgatacctttaaaatattaattgaaattcaaaattttcttaattatataattatggattaaaaatgtaatgaaaagcatttggggaaaagtgagggaaaatggaaaaaataaataaaattccattattttaaaggaaaaataaatgacaaaaaaaaaagaattttgacgacgaattaattgggaaaaattcaaaataacaatgagtggatgaatgaatgaataaatgaattgggtggtgtcagtccgtccccccccccccccaatttaatcactccgaatttaaatttatgcagcggcagaaaatgctgctgcaaaatgttttcaaaattcaacggagcttttaatcataaataaattgactccaattttgcgctcattttgttcgtaaattgactagacaggaaaattcaaattagcgggttcgatttcgagattggggcccaatttattgccgggtgggtttgccggattaatcccagaatttcccaaattaccaatcaagttgggacagcaggtcatttaaaaatgaactggaaggactaacggaaaaagggaaataaaatcgaacgaaccgataaaagacagaatttaacaaaaacggtttttggatgacgagctaatttggaaaacaaaattgaaggaactgtcaaaattgagtgaatgaatgaatgcgttgggtggtgtcagtccgtcaccccccccccccgccgcccctcccaccgttttttggtctctccgaatttaaatttatgcagcggcagaaaatgctgctgcaaaatgtgcatttgaatgttcaaaattaaatgaactttttaattagaagttatttgtcaccttttgactaggtcgagaaatccaatttgcgggttcgatttcggaat

SEQ ID NO: 19368 - DNA, 2466 bp, Heterodera glycines
tcgataaggttcaaaaaagctatgatcggaagaattcaaaaaagcaaattttccaatctttttgcccctaaatttgttcaaaattgatgacattttttgaaattatgcaagataatagagcatctgaagggctctcgaatgataccaacaatgttagatttggttgacaaagaaaaaagttatagtccaaaaactgggctggcgccgaaacgagcggcgccggaacgaggtggacccctctttttaagtagcgccgagaggaaaatcaagcccgttcattgcatttaaatgtttaaaaaaaaccaatattcgtctttctttaaatgggcacacaaattcaaaagcccaaatgtacgttgacaatttcgccttcgtttgtgcaacacatcaccgaacgttccatttgctctttgctgaactggggaactgaaaacttcccaattttttccgaatttgtcataattgttccaatcaaaacaattaagcgcatttctgccattttccgctcacttttcgcctcctccgcgtcctcctgcggttccgtgttcacttcttctttggcctccactttgatttccacccctcccacggcttctccattcatcacattttcattttcattgtttgacattttgaaggaattcgaacaaaacggtgaagaatagacggacggcaaaataaatttacaaatttaaaagtcagaaatggagaaaacagagctagagaaaaaaaagattatttgaatgcagccatttttattttactgtttgtcttgggtccaaactagggtaggtcgcagggctggaggcgaccgcgattcgcggcgtttttttttgcgcgatccgcggccgcggcaatttgaatgcgcggtgcgcggccgcggttttttttttttgcgcggtgcgccgcgcattttttggttgtaaaatttctataaagaaaaatttttgaaacgatgtcttttttgaatattcaaaatttaaatgaaattttttttgaaaacttgtattattttctcaaaaattcgttttaaaattccaatttttcccgtcagagctgagaaaaccttaatttttctttaaaaaaattggctctaaatcacaaaataggtcatttttttacaaaactttaaccaaattgcactaaaattttcaaaatttttccctgcggcgcctatcggcaccgctggatccacccccccccctatcagttcacaaaagtttagaaaaagcgcgccgaaaaaagcttctgaaaaacaaaaaatcataggatttcatgactggaattccttcgcaaatttgaacactgactcacctcctcccccattcagtcccttcgggattttaattacttttttatataagaaaatttaaaaaaaaagttaaaaaacggtttaaaaattagaaaattttgagttttaaatgcgcgatccgcgatccgcggcaatttaatgcgcggtgcgcggttttttttttgcgcgatgcgcggccgcggcaatttgaatgtgcggccgcggttttttttttgtgcgcgccccacccctggagggggcggtgccgaaatctaacgaaaaattgtctatttcaatcttgaaaatctttaattgtttaatcttttcgcctttacgaagtcgcctgcctctctcttgccctttcgtctctaatctttcccatttaatgtatgagatgagtcagtccaatgctgtggaacataatttttaaatttcatagggaaattaatcgacgagaaatgttttaacgcttcaactttttaaatttttgcaaattcacaaaaaataaatgttacactgttggaatggttttatgttttttaactgaacattctgctgaagtttgttctcttaatacgggcaatgtaaatggccaattctatgcctttagctgtctctgcttttgtccttcctctattcattttttatgcttttacgctttcggtatgcctatcttttttctttctctctttctctgtctcctctctcctccttttacctgttcttttccctttctttcccattttctctctctttctctctctctgtctcctcccctcactttgtccctttctccttctcctctctctctcgctcccacacactctctctctctcttttatacgtttccctctcaacgaaaaataagccacaggcatttgccaccactctcttgttcttcatgctttttctgctgttgttccattcgtttttcctcttaagacatttttactaaccagaaagattttactaataatttcgtctgaaattaaatgtttttgtctttacgatcttttttattttttgctttttatttcgcttgtccaaagtgctgcttctcctttgtccccagtcgatggaatggacgggcgaaaagcggcaaaaggccaattcattgacaattcatttacctaattatcataatattcgcatttattagcgaacaaatagtaaaa

SEQ ID NO: 19369 - DNA, 1620 bp, Heterodera glycines
  misc_feature (56)..(57): n is a, c, g, or t
cacttaattacatcgatcagtttgcttctgatcacttttaattgccatgccccccnncgcttcagttgcacacctcggcgggatttttcgcgtgcgaattggccgcggtccgttccgcttcgcagttccggcaacagctcgagacgcattcgctgcttccgcccgcgccttcttcgctgcaactgatcacagatgcatcatcttcaccatcatcttccttatcttttgcctccgccaccgtaccatcgtcctcctcgttggttatcgtaccaccgctagcaacgggcggaggcgcgcggccatcgaatacggtatccggagagaatgtgcgcaaggaaatcaaacacaaattgcaactgcgcgcattcaaaatgcgatgcttttcatccgcgtctttgtccgcgtcgtcgccgtgccgccaatctgtcgaaattgttggcaaaatgtcaccgccattcgtgccggcttttaagtgccaaatgatgccacaacagcagcagcagccaaaacagaaaggaacagaacgaagtgaagacaaacaaaaacagcaaaattgggaggagaagaagcagcaaaatggtgagggtgagaagaacgaggaggaagaagccgaggccgaggagcagttcatttgccaaatttgcaacaaggacttccgcaggccggacattctgtccaggtgagatttgtcggcagcgcttggcccttccatgggttttggacaaatccttctgctgttaagctgaactgatcaaaaaagttgccagtttcccgaagtttgccgatcatgcaaacaaaactgaaccttttcgaatgatcagttcccatttcatttaataatcattttgatcgggtttccatttttgtctgatcaatgatcagaataaaataacttttgacctttggtcactgtttcgttccgcttgctttcctcccattagccttaactttgctctctctcccccctaaggcatgttcggcgtcacacgggcgagaagccgttcggctgcgattggtgcggccgcttcttctcccgctcggaccatctgcgcacgcatcagcgaacgcacaccaacgaaaagccgtaccaatgcacggagtgccattactccgcggtaaaagcgcgagcgcatttttcacagtgccataatgttttttcagcgtcgtcgcgacgtactgacgcggcacatgggcacgcggcacgagcagaagacgaaccgcgcaatgttcacgcgtaaacgacgccgaacaattgtcactgtcatgcaccagcatcagcaaaagcaaattaaaaaatcaaatgccatcggcgggggacggaatgacaggaaagggtacggtgtgttaacggaatacgatacggtattttgaaggggattcttgtagtttattgttttgtaagtgaaacttatcggcatgtatacgaagtccggattttttgaccagtatttgcaacactcaactcatttgtgccacttgtagccaatgttcctcctcctccgttttcgcgacggccgcagcaatggcacagtgccgcgacgacggcgtcgaggatcgaatgcgtcgcctgctgcgcgcgaatgtgctgagacgcaagtcgcgcacctccgcggaggaggg

SEQ ID NO: 19370 - DNA, 1272 bp, Heterodera glycines
tcacaaatgttggagagaacccgcgggcagaaaatgcacaaaatttaaatggattcacccaggtctttacctgaacaggttgacgcgcacattctcccgcaaattcgccggtccgcccgcttcccacacgtcgcgcgtttctccgtctggcaaatcgtcgtgccataattcattttctttgaaatgccatttccccgtctcacctgccccatggacaaataccagatggctagcccccagggcaacaatttcctcctccaccgcttcgtccgtgtccaggccaggccgacagttggccacggccagttgcgcgccggggacgagcgcacggagctgagccaattgcgcactttgaatggcagagggcgtgccgaagagcaacagacgagcgtacggagcacaagggatcagctgattgggcaggataatactgtagtccaggcaaatgaattcaaatacagtatctatgcgtcttgttttacttatactaccgtaactcctccacaattatttaatactgtgcctgcccataaaccttcattaatgcacatacttccattgttagactatctctcctaaattttcttctatgtcgcttacatattgctaaactacggtattccacctgtttgctaccgtactcctcctcctccttttctacggcctctccgtcacaatgtccgctcattttaaacggatggattggcgccttttcgccctctttcttcgctttttccatcacaaattctgccgctttgtcccttttatgcgcactgtccaagcgttcttcgatcagtataatttgcatgttcagacgataactgttaaagaaagatactgtaattaattaattattttttcacaaatgccaatacttcgataaaaagggggcggaatgccacagcgaccatttgaatggcaaaaagttttgaggcattttggatcattagagggcaatttacaaaaaaaaatcccctctctaattttgtatccgcacctgacagcgaacgcgtgcaaaagcgcacaaacggaagaaaaccgcgcggacgcttcgctggcgcattggacgaccgcgcgcggctgcggatgtccttcggcgaacgaatcgcactgaaaattaaacaaataatttacaatcaaagcgtgggatgttagcattggatgtttcattgatcagccgggaatgtgttggtccgaagataatgatttggaccaaatttaacttaaatgccccaagagattacggctaaatgagtcaaaaaacactaaaca

SEQ ID NO: 19371 - DNA, 2827 bp, Heterodera glycines
  misc_feature (102)..(102): n is a, c, g, or t
  misc_feature (140)..(141): n is a, c, g, or t
  misc_feature (2763)..(2763): n is a, c, g, or t
  misc_feature (2773)..(2773): n is a, c, g, or t
aaaatagcaagtcaattggtgtatttttaaatgcgcaaatgtctgacctcagcatcactttgtcagcgtaaaccacccactcgccgccatcttcctttcttnttctgctgcactcttcctgcagcacacgacgggcctgnnagttcctcttggctgagtgaagggcgaattttgatgttgctcatccccagtttttgactgatttgagcgcgcagtttgttccattgtgccaaggtttgtctctgatgttttgagcagccgaaaattactttcatcaaccgcgggcggttttgacctgtccttgcttggtccggggaacccattctgtaaacagtgatcgggctctcgatgccaagctcatcgagaacgcctgagatggccgttcggtccgcagcgactcgctcggatggcttttgtttctgcgattcgggtagacccattacgacaacgcttcgccgccgctcatgatcttgcacagcttcgtccgcaatttgccgctgtttgagagtgaaaagttcactctgttggctttggacctgttgtagaagcgtcaagcagatttggaacaattggcgtgaaatagaacagtcggtgttgttgccgtcatcttcgttttcgtccataagcctaccaatgttagctagcttttctcccaagatgttgtatgagttgtcaatggcgagtctttttgtgttgtctgtggggggagagaggtgggaggaagaacgcttttcggtctgaggcatcgattggaaattaaggcgaatggaaattaaggcgaattatatgtatattgaggtgaccaagtttttttttcaaattcaggataaagaacactaaaattcagatgtagacctcaaaattcagattattgcaaaacaagggatcagcggccaattttccaattttgcgaaggggtctccggccatgtaaattaatgtaaatcaatgaccttttttgctttcaacaccgcttttttcgcggcacgtttttctcaagactttaaatattgagtcatttacctgaataaaatttaaaaaatgaaccttaaatagcgaaaagaaaaaattaaaaaaccccgaccccgaaccccgacacttccaaccccgaaccccgaattttcaaaccccgacgtcggggacgcaaccctagaagaaatgcaccaaaaattgaaatataaataactaaatttcgaaaggaatttgaactaaaatgaaaaatatatgcgaaaatcccaagaaaaatgccaaggaagcaaaagagaaataaattatgaaataactaattagagaataatatgaaaatagctaattgaaaatctgaattaaaaataaaaattcagtccgccgagagtgccacatcatattcaatgattgaggacatcggcattgccactgtcacattgggaccatgggacaaaaacattttggaaatgttttgcacgagcatttatttaacaaattaattttcgacacgcaaaaaggtcaatttcaaaagctataaatttttaataccgatctaatcaattttaaaaattagactatgtgttcaattaaaatttgtaattttttgaaaaaaaggcttagaggcctggatcccgcttcccaagtttatctgatcaggctttgctttcgccccttcccggctgaagtcgacagtcgcgaaactctcggcaatgctctagcacagttttgaatagtcaattgttctttggtcttctccgtctcattgttgtgcggcggaagtgattgtgatgatcaaatggcagagaaatggagaaaataaaacaaattcataaaatttagaaaattattattttttcaatgaaagttctccaaaatccctattaaggtgtaatctgctaataaattttcaaattttttttgccgcattgttttcacaaattcttttgaggaggagggcctgcggtgcctgccgttagtcgccaaacaagaaaaatttaaaaaatagagtgcaatttggtaacataaaattatccatataatttagcaaattttgcaattttgattcaatgttttaataaatttaggaccatttttctgattggactggagggggtatttttgggaagaatttcaaaaaagaaaattttttattggcttcactaaggctggcatttgtttcgacaccttcggatttttagcttaataaattatttcattattattttaataaataataaattcaataaagtaaaattcaaacaaaccttcagcatacaatcggaataaatattcatataaaatgtccaaatattttcgatatttttggcacttttcttttaattccctcccaattttttcacattgccaattctttctcatcaaatacacaaggccaagttggggttcatattcttgcgtcaaatactttttcattttctcaattacgattaatttaaaagcgctaaggtgccaattattatacccacaaacacatctgacctcattaactcgacgtaaataatttgaatattcttttgtcctcttaaaaaatttctcaaaatttgtcgcttttcctttaataaattcagaaaataaggcatcttcagtctaaaagatgaatttatataattttcattgaatgtaaattctcacccaatttatttcatcatcgaatttcacaattattttatatttgtcatcatttatttcattggcactccaaggaccgtattcttttgccctttcttccgcttttttgaacattttctctaactttttgacaaatttttctccccanatttctcganattattccctctaaaggaacatttgtttgccattcattcgctgtgtcaattgcc

SEQ ID NO: 19372 - DNA, 2277 bp, Heterodera glycines
cccgtggtggtcaccgacgttgaggctggcgccttcaaagcaatgctcaaattcatttacacggacgaattaggcgagatgaacggagacacttttttcgaagtgctttttgcgggtaaataattaaaattattttatttatttatttttaatttttaaaatctaataaaaatattcgaaaatttagccaaaaaatacaatgtcacggcattggtcaaaaagtgcacagaatatcctatggaaaagctgagcaatgtttttgaaacactgctcagtgcccgtttctttgaagaacacgtaaatttaaaacatttaaaatttctttttaaattaataatttttattatttttttttttgaattttgggaattcgcttcgcactgtttgcattacattgaccaaaatgcggaaactttgttccaatcggatgtctttttgcaaattgaccaaaaattgttatgcgaaattttggggcgcgatgaattggtggccgctgaatggattggcatttggaaagccgtaaaaattgaaaataatttaattattaaaaattatatatttaaattaaattgaaaattatattttttaaattgtttatttccgcctgtcaggcacttcgttgggccgatgggcagtgccgtcggaaaggcatcgattgttcggcagagaatcgccgtcaaatgcttggcccggcacttttccaaattcgttttccgctcatttcaaaagagcaattcgcagcggacattggtcagctgctttatgtcaagataaagctattttcttcgtcccctgggattggacaatcttgctgtatccgcagcattcaaactttcatattttgtgcataatgtacattgccctactttctcccgacccaaacccgtcataaagggtcggggtcacttcggcgcggaccatttcggcgccgcaaattttgaaatgctataacttttttatttgtcagttagctttagccaatctagcatcatttgaaagctctatgtgtgctctatatttacatgtaaaaatagaaatgaatgattcaaaaataaaaaagttatgccacgtggcgccgaaaaagccggcgccgaagtgggcggttcccgtcataaacttgtccctctgttcgtcccatcccaagccaatcctatccctctcatttccaatgttatcgtgccatttctacccatttaccacctctgttcaatatgccatccatttctcttattcccttttgtgttttccgtcattacccctcatgctatccaaagtccatccccattgtgccagtatataagtccactcaatttcccccctcgggggctgcgagatgtctgcggtgggtcagtctgtgctgttccttgcctttggcaatcctttcccaaataaccaattgcactgacccacccaaaatgctctgaggttgttgttgacctaaacatattcccggtttcaattcataattatttgttaatgcttttccctataataaattcctctctcctaaaacgggaatttgaaatggcttaacgccttacacccggggacacaacaaatctgtttccgaatcttttccccactttgttttgtacagttccctccggcgtgctgaccattgacgaaatgttccgtgtgcttctgcaccattgcaacacagcggcggcggacagtgtcgtgccgcacaagcacaagcagtacccggtccatttcagtgccaaaccacgggccaactggccaccaacaacaacaacagagggcctattaataggacaacaattgttggcacaaccgcgacaacaacaatcggttggcaatggcattttgtcgtcaatccgtcgccagtgcaacagagtgacggtgagtcgaacagtcggaaaatttatcaagttagtgagtggattgattccgaatgaaaactcgagcatcaatttacaaatatgcacacacattgttcattttctctatcaattaaatttaccgtgattcgaattcgaatattttgaggaggtgatccagcagggttttttcttaaaaaagtactcataatacctaatgagtcggtctctctatgcttttacattggattcaatcagtttaataacttttttcatttgttttccctttaatactaattaattgcctttaggtcgccgcaaagaaagtgtcacggggatttctctgcttcatattttttgtttgtttcattcccccattctttgctttgttgttcgctgttctatttgctggagctcctctttggtctggtgagaaaaa

SEQ ID NO: 19373 - DNA, 942 bp, Heterodera glycines
aaatttcaaacccacggaaattggaatttgttttttattcgctgatgtacaaaaaaagttagacccaattatattccccaagaccgctccgataaaggacagtggaatgcctaaaactatttttcggcaagacacaaaaattcaaaaccactgaaattggaatttgttttttattcgctgatgtacaaaaaaagttagacccaattatactgcacaaagaccgctccgataaaggacagtggaatgcctaaaactatttttcgcaagacacaaaaattcaaaaccactgaaattggaatttgttttttattcgctgatgtacaaaaaaagttagacccaattatactgcacaaagaccgctccgataaaggacagtggaatgcctaaaactatttttcgcaagacacaaaaattcaaaaccactgaaattggaatttgttttttattcgctgatgtacaaaaaaagttagacccaattatactgcacaagaccgctccgataaaggacagtggaatgcctaaaactatttttcggcaagacacaaaaattcaaaaccactgaaatttgaatttgttttttattcgctgatttacaaaaaaggttagacccaattataatgcacaaataccactccgataaaggacagtggaatgcctaaaactatttttcggcaagacacaaaaattcaaaaccactgaaattggaatttgttttttattcgctgatgtacaaaaaaagttagacccaattatactgcacaagaccgctccgataaaggacaggggaatgcctaaaactatttttcggcaagacacaaaaattcaaaacccctgaaattggaatttgttttttattccctgatgtacaaaaaaagttagacccaattatactgcccaaaaccgctcccataaagaacaggggaatgcccaaaactatttttc

SEQ ID NO: 19374 - DNA, 916 bp, Heterodera glycines
tttttcggcaagacacaaaaattcaaaaccactgaattggaatttgtttttaattcgctgatgtacaaaaaaagttagacccattatacggcacaaagaccgctccgataaaggacagtggaatgcctaaaactattttttggcaagacacaaaaattcaaaaccactgaaattggaatttgttttttattcgctgatgtacaaaaaaagttagacccaattatactgcacaaagaccgctccgataaaggacagtggaatgcctaaaactatttttcaggcaagacacaaaaattcaaaaccactgatattggaatttgttttttattcgctgatgtacaaaaaaagttagacccaattatactgcacaaagaccgctccgataaaggacagtggaatgcctaaaactatttttcggcaagacacaaaaattcaaaaccactgaaattggaatttgttttttattcgctgatgtacaaaaaaagttagactcaattatactgcacaaagaccgctccgataaaggacagtggaatgcctaaaactatttttcaggcaagacacaaaaattcaaaaccactgaaattggaatttgttttttattcgctgatgtacaaaaaaagttagacccaattatactgcacaaaccgctccgataaaggacagtggaatgcctaaaactatttttcggcaagacacaaaaattcaaaaccactgaattggaatttgttttttattcgctgatgtacaaaaaaagttagaccaattatactgcacaaagaccgctccgataaaggacagtggaatgcctaaaactatttttcggcaagacacaaaaattcaaaaccactgaattggaatttgttttttattccctgatggaacaaaaaaagttaaacccaattattctgcccaa

SEQ ID NO: 19375 - DNA, 2120 bp, Heterodera glycines
aaaaaattgtaaaaggaaacatttattattcacaattgaacactttcacgatgccattatatatcatttttaatgaaaaaagattttatattggtttttgtttgttttgggaacatcaatattatgagatctcatcagtctcgggtctagaaaatttcaggttccaattttggggattaagtgttgctcggtctttttcctcctggcaaagactcgggctcagcaggccttgaagttaaagtgctctgctatctttggggtttagggttttcgccgtttttgagtcctataaaattctcgatccgggaatgtttccgtaagttagagttctttgttgtcttgggtttaagaaaattttcagtcttgggtttggggctcaaggtttttgagtccctgaaaatttcgacccagagaaattcttggacttgagaaatgacggcactatgaattatgcgcttggacagcagcagaagcagttgatcggttcgtggaaaaagtgatcattgtgaacagttggagcagtgcttccaatgtcaccagcacaaattcgatgccggccccaatttgttcaacaaaagcaacgtacgtttggagcagtgccaaataagcacaaatggccgcctgtgaaaacggattaaatttagggctagacggggttcatgatttttgaaaaaaggctcggataacccatatttggaaacttgtaaatccaaacggactttcagttcgaggcgacatttttttttttttgaaaaatcggcaattagcggactgacttttttaatcgtaatcaagtgttaacaaagtttgatttagaaaaaataacaaatttttttttgccaaccgcggcaatgccaagcagaagagagaagaagagttctgacgatgtttcagtcaaatttccagcgcgagcttaaacaattttctttttaaaatgctagtttttcgataatttttcaaaaattgggctaagaatttagaaaattgaattcacgacaaattcctaggttttagaaattttgaaaaattttattccaggttgattatggattttatttaaccattaatggggtaaggaaaattgaacacaaaaataaacataaaaaaatgatcacaatcactccaaatttaatagagatactccccggtacaggactaacttaccctgaaaatattccaacgcttatttgtttttaaatacttttcgaattttcggtttttccattttttaaaatttttttgaaaatttcagtcgccaaattattccgctcccctccaataaaacaacccgaagaaattcggaatgcctcaatcgggccaaacaagatgacaatgaacgcttcactgagcagcacatggagcgggtagggtagcgaaaaaactgtaaatttttggaaatttccaaatttttttttgaaaattctaacttttataaatgaacaatgcatatgtaagcaaacaaaaaagaatggagaattttgagttgacacgaagcaacaattcaagcggaacggatgaaagctaaaaaaaattaattaaaaaaataaaattttcaaaatttctcacaattttgtcagattggacgaccattgctgtcgcaaaaaattaaattattggattcaaacaatttaaaatttcatttaaaatttgggattctttgaagagagaaggatgtccgattttttttatttaaaatattaaatttcgaaatttaaatgaattaaaattatttaaaaattatatttttggtgggctaatttaagagtggattggagattcacaagttcaataaacatttgagaatgtttgaattttattttgttaccatagcaacaaaattgaaaattttgcttctgcccagaaataatggattattaaaaaataaaaatttttattattactgaaaaataaaattccgtatttcctcaaatagagggctccctgaaaatgcgacactggcaaatacgacatcagcggaaaatccgacactgagagaaagtttttcatttcaagaaaatgcgacactaagaaaatacgacaccaaacttagatttttaaaaatataaatcttatattgttgtgaattttcattctgcaaaactagcatcagtaccaaaaaa

SEQ ID NO: 19376 - DNA, 739 bp, Heterodera glycines
  misc_feature (166)..(166): n is a, c, g, or t
ttttttggtactgatgctaattttgcagacttaaaattcaaaaaaatataaaatttatatttttaaaaatctaagtttggtgtcgtattttcttagtgtcgcattttcttgaaatgaaaaactttctctcagtgtcggattttccgccggtgttcccctttcccgnctccaaatagagcccccaggggttctattatcccccccccccgaggcaataattttttttcggggggggggggggggggcttgtattttaggaatacggtaattaaaactgatggatgacattttgaaaaatatttctctctttttattttaaacaaacacattgttgcgcgaaaattaagaacaatttgtaagggcacatgaaatgctttcttccgcaatgcctgcacaaccgctaaaatttaacaagcaaatgaaataaataaattttaggtaataaataaaaacaatataaggattaaatttcttggtttttaaaatcgaacaaaaattcggcaatttatgaagtagagaaaagttagagacgagaattccggacccagaatgggaccgggactcgagaaatgtctcttcggagcggattaacctttagggatcccgatccgggtgcatttttcaagatacgaactcggtttccaatccgggatcacaagaaatccggaccggaacccgattccgaccggtatctaaagacattctcactctcgagattgatcactccttcctgattaat

SEQ ID NO: 19377 - DNA, 1930 bp, Heterodera glycines
  misc_feature (1899)..(1899): n is a, c, g, or t
gttggttatctaaccaaaacgatagttggttgactgaccgtcgtgacaaaaattgttgcggcgtttgttgtgccgcggcatttatcgtcacggacgacgtcgtcggtgcaggcaaacggggtgacagtagtgcgttcagctgacgaacttggcgcaaccaaacggccaaattgtcggcaaatgaagcggcgcggacggtgggcaaagactcggaacggtaaacggacaatttctgcaagaaaatgagggagtaaagttacacagtccaatttcgtttcggcacagaactgtttctcgctcggcggtcgcttcgcgcgatgccgccactgccgccaaaaatgcatttgtcgcagctgttgctccgcccgtgccgggcgcgtctcgcatgcgtttaagcaacaattgttgctgctgctgtttgtcagtagcgagtggcggtgccaaaactgacgaagcagcattcattgtccgcattgcttcaccatcgctttgcgctgtcattggcacggcatttgtcgccgtctgaagcggtggtggtggcaacaaatggtcaaagcggaagcgacttgtggtcgtggtcggcgcactgacaactgcgccgccggagagaggcggcacagaggagggcgttgtggtggtggaagcgaacgcggagtcggcaatttgcagcggggaaagccccgggggcgatagggacgcggccgagctggaagatggcggcaacggcagcgtactgccggggaagcaggacgaagacgcgggggtggtgaccatgccaaagggactgaacgctgtgccactgaacggcggtgacaacggaaaaggcccggcagaaggcggaaggcccgagtcggaggaggaggaggacaatctgaagcaggacgggacgggaccatcaacaaattgaaacagttcaaaaaggaaaaagcacagatggaagtgaaacacccgatcattcccacgtttgccgtgccttttagagcttctgtggaattggagcactgtcggaggatagggttttaccatgagttcgaccgtgaatgggagtcccacaatattgggagagatgaaaccttcaatctcatcccgtcctaagtggtgggtgatctgctgaccgggaagcgcattggcaccgattggccattctccaatcatttacaaaaaatcccctgaccattccttgtatggtattacagtatttcaatgattttttccaaccgttcatggcgtgttgttcgccgtgtcggccattgttgctgctgctcattcaactgctgctgctggtgatggaaccgggcaagaatgagcctggccgcggcattccctgcggacgctgagacggcacgaaaagcgtgcgcggagtgcgatggggagcaggacgaacggtgatgggcatcagcgataatgggacccaaagtgtaaggatgatggccctgagttaattagaaacgggactgtgatcagttacgagatcaccaatcagtctcgttaactgttaccatcgtgtcgacgaacagttccgccattgtactgcttgaacacgctgctgccgttgtcccgggcgcatacattgctgtcggatgcggcaacggcgttgccgacggctgtggtcgcgtgccgcgtgctgtgccggcactgttccaactcgtcatagacgtactgcaagctgatgacagctgcagctgcagcggcagctgccgatggcacggcgaagacggagcggcaccggtagaggtgggaggggcgacaaaggcaccaatggcggaggaggaaagatggtccatttttggcaattagtgtttaaactttaaagccgtatatatacaacagacttaaattgaacgaaaataattttatttgccaaaagccgcggaagagcaaaaatgtaaatggtgccanaaagtgaatgaaatgaaaatgatggaaataa

SEQ ID NO: 19378 - DNA, 2780 bp, Heterodera glycines
tgaaccagagagttgtcatcttttacagtgtcctaccattcctgggctttagagggggggaatactataaagaaaccaactttttttatcactaaattggcgaatttaaagaaatcccgtttttttaaaattttatcctgcaaaatccgggttcgctaatgatccgaatcagcctccgggttaaaaagttcaaaaccatattaagaatacaaggaaacagtatttttattcgaaaatcggtccggatgcattccggaaaacctgaccccaatttctttaaaactactcgccctatgggatactgtagggcgaaattcttcgagtttttgcctaaattcctgtttcagcccgaccttggcccccttttatctcctcacccacccttcctctcacaaaatctcatcatatcgccccatatccgtgttgtgttgtgtttgttgatgctgactttgagcccacgtgtgctctgcagctgccccagccattttttttatccattccgttgcattatttgcattatctatcccatttttcattttcttcctttctcttctcccatcatcgccatgctttcacatttttgttttatctttcttttttgtttgttttcaatttttattttcaatttattaatcgccctaattaattctcccgcaaaaaaattagcgccccgcactcatagaatgaatggcttttgttgtttctaagctttgcaactctttcataagccaaatagagatcggacgagactctgatcacttctttattagcctgatcacattagagcatttaaagtaatcggagataaatgctctgctaccaagccgcatgacccgattctgatcagttttgatgcttgatcacattttgaaaggataccgatggaaatcacccaatcagaactggtcagatgccgaacaagatttgattacttttgatcgggatccgatcaaaatttatcctctgatcacagtgaacatggctttataatactgatcagattttgatttttctgccgatctcacccggcctctgtttggcaaattttattcgtccaatgtgtttctgttcaaaccaaattatgcttttatttttgtgaaaaatgatataatcacatttttttactggtccatacataattatttgcgcataaatgaagcctaattaatacgcataaattgtgcatcgacaattaaaacaaaaattatttttttcatataaaaaaataaatttaaattaatgcattcattatgcacttctcttttacgacctttcacttaacagacacaacaaaaatattcatttcctcggcaaaacgaacactcacaaaatccgggcaattaatttgtcaattagtcaacgggcaattaaaattaccgcaagttgctcattagttcgttggttggtccattcattaattacccttcattccatactaattcaatgagacacatgcaaattggtataccttgatattgtactgcgcgactcaacagtcaaaaatcaaacacaaaccaccggcgaggcgtactttggggtgatcactgatcattaatcactgactgatcagacaaagaccaaaaaaggcgagagattcccccgcaaaattaaattgagcgcctatgtaattaacgtcagtgctcgtcgagagtgtgtcgagagtcttggcctcgagagccacgtggaaaaaacgataaaagtctgatcagggttggccttgctttgggagtaaaattttatcagggtcgaccttgagccttggaagttgcattccggcaccgatttcaagctcgacaagctgataagaaatccgggagatcgttctcgaaacttgggcacagaccccggcacaggtgtcaagcccgactcgacaaagccaagagaaaatctcatgatcggtcgcgaatgtcagagttccggcaaatcgaggctcggggaaaaaagcacaatctcgatcaggggtgggcgaaacttcgagcttcgtgcttcgagcttcgaaaacttcgcgttttttgggcttcgaacttcgagcttcgtgcttcgaaaaaagttgtgcttcgattcgagcttcggcttcgagtactaagccgagcttcgcccacccctgatctcgattccctatatgtagctttttgcaaccaaaattcatatttatgtgagaaatttgtatcgaaaaaacttaacaattttaaaattaataattttattattagagaaatttttgtataatggactattttgataatatatttggaaagtcaattaacaaataacatactgtaccacttaattaatcacactgttcttcctaataccacgtggagattttgtttttgaaaagtaacggattttggacttaaaacaacggcacggcacggcacgtgtgccacggctttgtgggaaaacatccatcaaaaattgatggatattatgttatgaatctccaacactaatccgccgagcaaagagctgcgcgactttggacggacatccgcccgccggcagcaaaagggcaaaaaagaaattaatgagaaaaaatgcatggaaaaacggaatgccaaaaagaaaaaacttagaagaaatttaaatttttgatttaaaataatttgagtgtaaatgtgaagtgattttatttaatttttaaattttcacttggtattctgtcaattcttaagtttaattttaatctaaaaaattttcaatttgttcaaaatcttcccctgtattttgaactcggcatttttcccgagaccgaaactctcgggcattatttactgatc

SEQ ID NO: 19379 - DNA, 3076 bp, Heterodera glycines
  misc_feature (2984)..(2984): n is a, c, g, or t
  misc_feature (2991)..(2991): n is a, c, g, or t
  misc_feature (3006)..(3006): n is a, c, g, or t
  misc_feature (3013)..(3013): n is a, c, g, or t
  misc_feature (3023)..(3023): n is a, c, g, or t
  misc_feature (3050)..(3050): n is a, c, g, or t
aagcctgatatgtttttgactatgacgtgtaatccactttgggaagagatttctgagaatttgtttcatgagcaagtgtcaagtgatagaccagatttagttgtgagagttttcaatttgaaagtgaaagcacttatgaatgagataaacaaagtaaagatttttggagaagttattgcatggatgtatccggtagagaaccaaggaaggggactaccacacattcatttgcttttgacattggcagaacaagacaaattggtaaatggtgaagatgttgagaagaaaggaattagtgcaagaataccagacaaggaattagaagttgaattgtttgcgttggtgaaaagatttatgatccatggcccatgtggtgatttaaacccaaattgcccatgcatggaagattttgttgacaagaatggaataagaggaaggaaatgctcaaagggatacccgaaagcatttcaagaagagacaattgttcttgaaaatggtttggctttgtatgcaagaccaaatgatggaagaacagttgaagtatttgcaaatggaagaagacatggtttagacaacagatgggttgttccacacaacttatacctgttgaaaatgttcaagtgtcacattaatcttgaaaaggttaacagtgttaattcagtaaagtatttgcataagtatgtgcataagccaccagacagagcacgattggaattagaagagaaaaatgaccatgatgaagttaaagagtttattgacgcgaggtatgtttgcccgcaagaagcagtgtggagaattttagaattgcctatgtacgaccgaagtcattgtattatgtctttgactgtacatttgcaaggcgaacagatttgttattttgacgagaatatggaagaagaagaaattcgagaaagaatttcgaatggatcagagttaatggcatattttgaattgaataaggaaagtgaattggcaaagactttgttttatcatcagatacctgagaagttttgttttaagaaaggtaaatggaccgcgagaaagacatattttaacacaattggtcgaatggtgaaggtgtcaccggctgagccggagcgataccacctgaggctgttgttgttaaatgtgaagggagcatgctcctacgacgatttgaaatcagtaattgatatgaatggcattgtaaaagtatgtgaaactttttcagcctcatgtttagaaagaggactgattagaaatgatgaagaatggaaaaaagctttagaagaggcagagagttttgaaatgccatggaaattgagagaattctttgcactgattttagtacactgcaatccggccaaaccggaggagctttggaatatgtttaaagactctttgtctgaagatttttgcaggagttttagaaaagaattggcttatgctaaagcttataaagagataacactgagcattatgaaggctggaaaaacgcttgccgattttccaaccatggaacagataaatgttgatgatgatgttgagcaagtatttgatttagctgaagaattggatttgggacaaagagaatatgctttgatgtatgccgaacagagagaaatttgtgatgaaattttgcatagaatatggaatcctgtaaatgaacccgcgttctactttcttagtggaccgggtggaactggaaagacgcatgtgaacaagacaattgtacatatgctgagaggacagaagaagaaagtttgtacaatggcttttactggcattgcagcaactttgctgcctgctggaagaacattgcacaatagatttggactgactttggatatgagtaattcgagtattagtccgagatcaaaggcttggcaagaattgaaaactacagatttgttcatttgtgatgaagcgcctatgataaataagcgcgcaatgagaactttggatgagaaattgaaagagataatgaataatggaattgcatttggtggcaaagtcatgctttggacgggagactttcgtcaaacccttccaattcagaaacatgccacgagagctgaagtggttaattcaaccttaaagagaagtgagtattggagattggctaaaagatacaaattgacgaagaatatgagagctcttgaaactgagcaagaatttgcaaaagatttgttagaaattggaagtggaaaatggaatagtgaaaatgatgagataattttgtccgagaattgtattagctatggtgatttagcagaagagatttttgcaaattgtattgcttctgagaattggaatgaaatggccaaaagtgccattttagcaccgaaaaatgttgatgttagtgaaatgaataatagagttttagaaatgttgcctggtgaagaagttgtgtataccagtatagacttagctcaagatgagaatagacaaagagcagatgactatttggatgagtatttgaatgctttgaacccttcagggtttccccgacataagttgagattgaagaaaaatgctattgttttgttaatgcggaatttgaatatagaaatgggactttgcaacggttcgagaatgaaggtagaagaaatgcatccaaatttgatcatgtgtaagattttgactggagacaaggcaggtcagactgtgtacattcctcggatcacgctttgctgttctgaagattacccttttgacctgcataggcaccaattcccgttggtgttagcttttgcaatgacaattaataaggcccaaggccaaacccttgagcaagttggcatagatttgagaaaagatgtgtttagccatggtcaattgtatgtggctctttcgagagcaagagcttggaataagttgagaattagattagatgatggcaatttagagagaaaggtgaagaatgttgtgtacagagagttattagataacagtgattagtaatgttttagactaggtttggatttagataaagtatagtattnagaattnggttttgtatagaanaatctgntgttctttgngctgctcaggacagtacgaacacattncaaagtgagtcattcctttttaattt

SEQ ID NO: 19380 - DNA, 1610 bp, Heterodera glycines
  misc_feature (10)..(11): n is a, c, g, or t
cccccccccnncccgaacccaaaaaagtaaaaaaatttcagtaattttttttaaattttaaacaattttcttaacaagagtgcattaaaatactcaaaaattttcctggcggcgcctatcggcaccgccggacccccattttatcataattttgtaaaattgaggccaaaatgacaaaaaatagtaattttttggcgaaaaattttccaaaataagctcctaattcgggatttcaaaaaaagcaaaaatacacccctaaaaatcgaatttttgacttcagccccccccctccccgaagccaagggtctggctacggccttaatgagaagttcgtttctcatacaattttgaaaaatatttcaacaattttttatttggaaacattaaaaagaaactttattcagcattaattattttttttaaatcgctagaaaaattacaaaaatatttataaattttgtaaaaatttttatataggggaggggaaacagtgcaccctgaaaagtatgtaatttcaaaaaaaaaggttaatgttattatttttggcccggttttccagccaacacccactcgggaatgggatttgtccatttacatttaactatttaattaaattattttttcccatttgaaatgagtgttttttctacccaaaatgagtttgctgcctccagttgtggcactaatgaggttggtgaaacaaatgggtgattagcagatggcaaagcgatgccgccgccgctgccacctgctgctgatgaagtggccgatgaggaggacacattgttgacctaatcattttgggagataaaaaaattaggggaaattaattctctattaagctaaaccaccggagtgctaaattgtatattctagtcccaaaacatttttaagtatttaatataggtaggtattagagttcgacatttttaaaaaagcctggacctggttttcctggacaaaaatccaggaaatttcaggtccaggaaaaatccaggcacctcgggacctggatccaggcctggacctgggggttttttgaaatttgttttttaaaaagcaaaacaatgtttgaaaaaaagcaattaaatgcttataaacctagaaaaaatatctaattttacaataataataataatgtgttttaaatctatttaatcatttttttgaaaacttgaaaaaaaacatcggtcacttaaaataattaattcttaaattttgtccaggaaatccagtttcggacggggggttaggtgttggactggcacgattgggccctaaccaacagggggctcgggccagttttggtagcataattggccaaattggatacatttggtatccttcgatagccctaagtgttcaatatcccttggcccttaagagcatgctaattataatcaacctgttgctgaatgagccgcgcattttctgcgcgcaaatgttcgttcattgaacaaacttggtttaattgagatcttaaaaaaataatttatttaaattaaatattttatttcctaaatgttaattatgtaatttgtgagacatttttgtacttatgtactttaaaaaccataaaaaaaataattattttttaaatcatataaaaa

SEQ ID NO: 19381 - DNA, 842 bp, Heterodera glycines
  misc_feature (809)..(809): n is a, c, g, or t
ttagagttattatctcaccaataaattttgaaaatttgaatgttggaattttgttagaatacgggttcgggattcaaatttggtcgaaatggatgtcagaatcagattctccgtccctgaaaagcccttagaaattttttatatgatttaaaaaatattattttttttatggtctgtaaagtaaatagttaagtaccgacattttaaataaattgatatattttaaaaataaaataaaattctgaacatgtttttaaatttagagatttaatttggtttcccctaggaaggcttaattttaagattttaataaaaaatttatatttatttttttaacgtaaaaaacatattttatgagaaaaatataaatttgcattgaacctgattgaagcatttttgtcaatctctttttgtgccatgttttgcgtttggcaaagcgccgtctgcaaatttttgatactgttgcgcagctgactgttttcggcctactgtgaaaaaataccgtaacatataaatacaaaaatggacggaaaattttaatggacgatgtgaaatgaactgacattgaataaagaaaaaatgcaataaaagtaccaataactcataaagagaaagaggcggaggttcgagcccgctccacaacattcgtatttttatttattttcttcaaaaaattaaaattttcgaaaaaatttttttgaagtaaattgaacattcaaaagcttttgatgaggagaagctttttctaagcaaattggttcatcttttgttttttctgggtgctgtattattttccacaaaagaacaanagttttttatatttttttttggaagattagaaa

SEQ ID NO: 19382 - DNA, 1264 bp, Heterodera glycines
gatagggagagcggtgcgcaatggatatatatttcccagagaatttttggctctaaagaggagtccagaaaaatggctatctattttctgaaaaattttataccgcacaaatgctctcaaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatatttcccagagaatttttggcttctaagaggaatcagaaaaatgtatatctatttttctgaaaaattttataccgcacaaatgctctcaagcatgatagggagagcggtgcgcaatggatattatatttcccagagaatttttggcttctaagaggaatcagaaaaatgtatatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatatttcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattcagaaaaatgtatatctattttttctgaaaaattttataccgcacaaatgatctcaagcat

SEQ ID NO: 19383 - DNA, 2543 bp, Heterodera glycines
ttttattgcaattattcaaataaattttaacgaaaatggtctcaaattatgtcggattccggagcatttgacaagcgaatgcctggattttctagggttctagtccgcaatccctttattggaaactgcgggatttttcggtattaacccggggtaatatgaatttcaatcccgaagtggagcccgcaaatttctgattccgttccctagttttgactccaactcgaaccacaatctgttcaacttcaaacaatctttttaaatattcacatttatataaattcttaaatattttctccgtgtattgtcttcgacatattaacggcatggaatttccgtaccagatcaacgtgtcatatgatgaggtacacacacacacattctatatgtattttaattcacttgtgcccttttattagtgcatgtgaaattctttttccccaacaaaaatgaatcgatttttgttttttttgaaagatttcttccgtttccatttagcctctaacactttccttttcaattttgtacctttatcccatcgctaataaaattgctaattgtcccatggagcacccaccaaaaaagtggcgtacgctccctcccgaactaatgctggtatgcacaatgctaactatctgcagataaatcgttatccgcagataaatccgtatgcacaatgctaaggattaaaatccgcatgcacaatgccagtttcttttacaaataatccttagcgtagctgcagctaggctacatatgcacaatgctaaagatagggtagcagctacatatctgcagattaaaatcactatcctcatcgagatgaggataatttcgatagaaatgtcgattaaaatcccaaaaataagtttaaaaattggaaaaattgtactaaatgacttttaatacctctaaaattttttgatttaaatttcatgatgattgaacaaaacccgaaaattcgacctttccagttcgggttaggaattggttgaaataaatgtcagattcatgatcagcgacctagaaaagccccaggaataagtttttacggctttttatgcaataaaattgctaaccaaatttgagttagaaaatttctcttgagggatagaaaagataaaaagatgtgtgacgagagagttgttgcggatgagtatctgcagataaaaaaatcttcagctgcagatagttagcgctagcattgtgcatagagattttatctgcagatttttttatctgcagctaccctatccacatatcgctagctacagataaatatccttagcattgtgcataccagcataagtgacgaattgtcccatttcgtttccgactctttttgccgaaaaactttgatcagcacaaactctttgttttaccgtttactccatttgacaaatcgagctaatcgttggaaaagcgaagtaatttacaacaaaaaatttagtcaatttttggataaagaaaaagcaattcctcatttaaattaagcattttaagcctgttgtgtcacaactttggacacacaataaaataataaacacaatttatgtcggaggagaaatgcagtacaaaatataaaatgtaaaatagcaaatgaatggagaaggaacaaagtggggaaggaaggagtgcttaaataaacaaaatgaataaggggagggattgacacgtcacaacattaatcaataatcgatgggcgccaaattcaaattctttaacactccaacacctcccttctttaagctgaaccctcaagggtttggcgagaagcggatcggcgctttccgttggcgttgcgatcgacgcggggccaaaggaggactcggagatcgtcgctttgcctgagtccgtcgaattggtgccggttgcggaggaggctcgcggatcggcgatgggtcccggtcttgctcttcttgagcctggggtgggatccttaccgtatcattaccgtcctcctcaagaggataacggcgtcgcagttggtttgcgtgccggtggacgtttcttccgagagccgggacgtggacacgatacgtcggggacttttccaatctttcgatgatcgttccatttagccaaaatctctttccactgttgaaattcaaaagcaaaacgggatcttttggcaaaaactcaaccgattttgatccgtggtgttgatcaaattgacgggccatttttcgcgcataatcagcttgtgatttgcggattttggctgggtcaatgacttcggcttgttcttccttcggatggacgagagacagctgagttcgaagccttcgaccgaagaacaattgatcgggcgaaagtccgttgagtgctgaattcggggttgtcctgtaggcgagaagcatcttttctgcccaaaattttccatctttggcgcatttcttcatggcccttttgaacgtatcaacgaatctctccgcttggccattggattgcgggtgatacgcaagggtgaaggtatgtttgatgccaaactcgctgcaactagagaagaattctgcggcatggaattgagtgacattgtctga

SEQ ID NO: 19384 - DNA, 2917 bp, Heterodera glycines
aaaccacttttcttttttgtgtttgcgtataaaaatcggggacttttatttgcatatttttgcatattttgaggtttttgtgcatatttatgcatatttcgccattttttggaaaattgttaacaaaaatgcaataaaaacggaaaatacaccccttaagaatcggccctaaaaaattcagaaaaatacacccctaagaatcgaccgaaaatttttaaaaacacaccactaagaattggaaattttctcaaaaattcttcccccaaattttttttcatgagaaaatttttgatttaaaaaatgtcaatatttgctaaaggaattttataaaagaaatgtagcagctcattggcaagtgcactggtaaaaaaatttttttttattgaatttgcagccctaattttcaattttttagtgcatatttggtgcatatttcacgactttatttgcatattatgtgcatattttggccacttttcgtgcatattttttgcatccctgattatcaaagtaatttacaattagaacaattcaatttaaaaatttaaattctcaatgtgtaactataagtattattaatgatatggtgcttggatttattattttttattattttgtgcatatttatcgcataaaactcgaataacagtattttacaggacaggacttcaactcaattagagcgaagtagtttttcagactaatgaaactgaataattagcgttttttaataaattaattatttttaaacaattttcgggaacttttccgttatgcctccccccccccccctcggtctacgtcagttgggccccggcacttatgggccccagcatgtttttggactataacttttttctttgtcatccaaatcaaagattattggtatcattcgaaagcccttcaaatgctctattagcctgcaaaaatccaaaaaattctgtcaattttgaacaaattatggccaaaaaggttggaaaatttggttttttgaatttttctggccataacttttctgaaccttaacgaaatttttcgaaattttgcaggctaatagaagacacttagggctttcgaatgataccaacaatgtcggatttggttgacaaagaaaaaagttatagccaaaaaaccgctggggtccaaacgtgccggggcccaactgacgggttccgtcaaattattaacgtcagaaatttttgagaatcggcgaattgaaattttaattaaatttgtgccgatcagcattgacggggaaattttcaatttttaaattaaattaataatagatgcggaaaatttgcgttaggctgactgaaaaattttgaaattttttggaggcaaaaaatgaaaatcttttgaaggtttgttaaaatggcacgcatatttaaaaattttcaattttcaggctatggcattctcttatcgcaaaataaaaattaaaattgccgtcggaaatttttgagaaggaatcgtcgaattgaaaattttaattaaataatactgtgccgatggaatcgctgacggtaaaattttcaattttttaattaaattaattaaaaaaattgacagaattttcaattacaaaatttccttacaatattttattttctttattttgaagagtttaattcagagttcccaagttttttttttcaaaataagacaaaatggcctaaaaactaagattctgaccccaaaaataagattttttctaaaactaatatttgcgtgaaggaaacgcaataaaaacatgaaaaattgacttaaaacaatattttattagcgtaaaaacaattaaaattgatcatcataagtatttttcccatccgcctattttctctgacaatttgtgattggaaatgagcatttggtacatttgtgggcaagaaagatcgtaattgactttggtttggaccaacgccttgactgtttcgacttgcaaaagatttcgtttatcagtccattgcgatccgcacaaagagaataccctctccacaaatgcattcgagacaggcacggaaagtacgacgctgaccagcttgagcagattaggcaaatctgcaaatctgcttcaaacagcttcttccacttctgttcgggggttaatttttgaaattcatcatttgggaaagaattcaatatttggtttgcttcgttaacatcgtcaaacaaatcatttgttaactcgggcgcaatttgtcgagccagagccaatgcatcgtcgtggggaattttgcggtatgccagcgcaacccattgcaacttttcaggaaatcggtcaatgcgatgccatttgtccaaatacgccagaaccgaagtgtaaaacgactgaaaatttttgaaaatatgcaaccgacaatttttacttgaaattgttcctccaacgcttcgcgtgtgctctcatcgacttttcccattgccaaatctgcaccataaaacctttcactttttcgttgttcaattttccctcaaaatttgtccatttccagcaaaagttcgggcaaaatgactttttctttctaaatttataaaattttttcatttaagatttgtaaacccacccgaaaaaagtcaattgtcttattacataagccaagaatgtggtgtaaaaaatgaatgatcgcaaacgtttgttcagaaaaaatgaaaaaaagagtcataaagaagtgccggacccttttctggtgtcaaaactagttaacatacacagcttccctcccccccccccccccccccgggggctgccccgtgtcgccaatttcgaatttgcccatgcaaattcttggcccaccaaataacctgtccaaaatgatggaaatgataaatacgctccacgcatccatccccggctgacctctgattttggggggttttcacactttttgcatttgtcatgccagtgctaagaatgtga

SEQ ID NO: 19385 - DNA, 1312 bp, Heterodera glycines
cggcggactggttgagcattgttgaagtagtaattgtcgccccgctgataataagcggacggatgaacgaacggcgccaattgctgagggacttggccaggggaagcgtagggcgaagagagaaagccggcggaagcgtagccggaggggacggaccaacctaaggggggggggggagggaagtgccgaattggggaggacgaaccactgtaaaaggagggaacttgggacggaaaattggacgccgccgccatcagagagcccatctcagcggaggacgacgaaatgggcgggaagtaggcggaagaggaggaggaagaggaagaggagggcggcaagttggggccgtacatgaacggatcgatctgtgggatcagcagacccttctgaaaatcgtagggcagcggaaaggaggcggaagacgaagcggaagtggcggacggcggatgggccgccttttgccggtcggaagatgggaaggcgcaagaggaagaggaagaagcctcaacccaatcagttgatcattccctccattatccctttaatagccaccttgtttccccgctctgcttctgtccccccactgctcatggtcttttttcgcggtggttgctggttctcctcctccgtgtcctccaccgattcttcccttttcgtcaccgtccgttcgtccccattccgtcgcttttcgcccttcacaaagctcccaattgccgtcgatgaaatcgaaagcggcgcatttgtgccgtggcaatgcgttcccgttctgatctgttccattttcttttcgtgccgttccttaattttggcctaaatccgtcccatttctttgtgtgctttccaattcacaaaaccttggctcttcggtttttgaaccaaacctaaaaaagagagaaaaaagaaaaaaaaaaagaaaaatgaagaattgaaaagtcggacaaaagcaaaaaccagccgagttcacctgcactttgacgtcggtcagctgaagactcttggcgatttgttctcgaatttgcacgtccggataagcgcagtttttgaagctcctctccaagtaactcagctgctgttccgaatatttggtgcgttctcttttgccagaagacatcaaagacggatgggccaaggaaagggaggaggacgaagtgccggaggaggagcagggcggggaacagagcgactggcacacgttggaggaggacgggccgtgggggagcatcgacggcacagagaacggactgaaccggctggggtttaacgggtaattggccaacgagcactgactgattgtgctcaatttgcactgatt

SEQ ID NO: 19386 - DNA, 1402 bp, Heterodera glycines
  misc_feature (12)..(12): n is a, c, g, or t
cccccccccccnccctttctcccggtgtccatcatccgtccgtaatccttcgcttttcaaatttcgaatgtttcgcggtgtccaattttctcaaaaaaaacaccaaacaaaaaaacaatacattatgaaggaatgcaattgtaaactgccgagtttacctcgccgattcgtcccccccccgggcgcatcattcgccattttgcgccgttgtttaagcggattggcggagattaacgcggcgaatgatcacccgaaaaatgggagagtaaaatcaccacacagcacaatttgcaaagagtcttttccaaatatttgtagtccaattcgaaaggagacagaaaagaatggccgtaggtcattttgagaagaaatgtttaagaaagtgccattggaatattggcacttatttttatggtttaaaaatttccgatattttcgcctgactctcgtctccgcacaatgaaaaacattcgaataaatttcgataagatttactgatcagtgccgctgatcactctctctgctgttgttccctttccattcatttttcatttttgcccttcggctttctctccttaaatgcccaaaggcattgttcccatatcgtacccagcgggggggggggggaaggaatccttcgcattcgcaccgtccaattgttctgtccaaatcgaattttatccctcaaggcactttcacatagccagcaggaaatggatccgaatgaacccattgaaatgaaaataatgaatcccctcgggggtttcccttcaaacacttgccaaacccattcattcataatccaaagcgaacggcgtgatagaattcaattttaccgttacccccccccccccccgcctctcgtcgcccttcaaatgttcttccatcggtcacagtccatcaaacatcgccaaatcacccggaagggcaaaatgggggaggggggggggggagagaatgccgaaaacatcccttggcacggcaccaatcggccgcttcctttgatgttttgtgccgttcctccacacgatttgtttaagtgctcttttcctccgtatgggataatcccaccacacgcgggggagaggaaaggccaatccgatggaagggagaaaaccgtgccaatgattggacagaaaaaggggggtggggagatttggacaattcaaataaaaaaaaacaaattaattttagaaaggtgtttaagaaatgacaaattcataatttcgattaaaattaccaaatttttggaaatgaatcaattaattgaggggggggggggaacggcacggctaattaagggatcatccgtcgtcgttggaggatgacgcgaggaaggcgaaggaacggcggatggctaggggaggacggcgcaggtgagaaggaaacgcatcttcggaga

SEQ ID NO: 19387 - DNA, 1925 bp, Heterodera glycines
aaaaatgtttttttatcaataaaaaagaattttaaaaataaatgggcatttcaggtgaaatttactaaaaaaagttcgctcataataggcaaaaatgagttttttatcattaaaaaaaatttaaaaaataaatgggcatttccggtaaaattcactaagaaaaaagttcgttcaaaataggcaaaatgagttttttatcattaaaaaagaatttaaaaaatcaatgggcattacaaaaattggaccggcatttttcaagtattcggcgcaaaaaaaaagtcgttaagggttttaaaagcaaaaaaaccaaaaaattctttttaattatttggtaaaaaccaaaatttagaccattttttacgattattcggtaacaaaacccctaggggtttaagaagcaaaaaaatcaaaaaattcttttaattattcgcaaaaaaccaaaatttagaccattttttaaaattaaattttcttggatttatgactctcagtaatttaatcagtttgtattacgtgcgcttgctgggcagcttttcgatcaggtccacgtgcgacaacaacatccaaaggcagcagtagtgacgcagccccaactgatccaacgcgtcgccctccgcagtgcctgttgaaaatgaatttaaaaaaataagaagagaaaattttgtgaaaattacgaacaattttaaatttaattaaaaaaaattgcatctttttatcaaattcagccaaaaaaaattgtctaaattaagcattagaaagccataaaacgcccaaaaaccaattgaattttaacctaaaaaaacccaaaattggaccgtaattttccaattattctgcggaaaaagcgcaaaaaaaagccgttaggggttttaaaagcaaaaaaaaccaaaaattagaccgtaattttccaattattcggcgcaaaaaacgcaaaaaaaagtcgttaggggttttaaaagcaatgaaaccaaaaattgttttcaattattctgcggaaaaagcgcaaaaaaaagccgttaggggttttaaatgcaaaaaaacccaaaaattagaccgtaattttccaattattcggcgcaaaaaacgcaaaaaaaattcgttaggggttttaaaagaaaaaaaaacaaaaattggcccgtaattttccaattattctgcggaaaaagcgcaaaaaaaagccgttaggggttttaaaagaaaaaaaaaacaaaaattggcccgtaattttccaattattctgcggaaaaagcgcaaaaaaaagccgttaggggttttaaaagcaatgaaaccaaaaattgttttcaattattctgcggaaaaagcgcaaaaaaaagccgttaggggttttaaatgcaaaaaaacccaaaaattagaccgtaatttaaacgcaaaaaaaattcgttaggggttttaaaagaaaaaaaaaacaaaaattggcccgtaattttccaattattctgcggaaaaagcgcaaaaaaaagccgttaggggttttaaaagcaatgaaaccaaaaattgaacggtatttttcaattattctgcgcaaaattagaatcggaaaacaacaaaataatttaaaaaatcaataggcatttccggtaaaattcaataagaaaaaagttcgttcaaaataggcaaaaatgatttttttatcattaaaaaaaattttaaaaataaatgggcatttccggtgaaattcactaaaaaatagttcgctcataataagcaaaaatgatttttttatcattaaaaaaaaatttttaaataaatgggcatttccggtgaaattcactaaaaaaaagttcgttcaaaataggcaaaaatgattttttttatcattaaaaaaattttaaaaataaatgggcatttccggtgaaattcactaaaaaaaagttcgctcataataagcaaaaatgattttttta

SEQ ID NO: 19388 - DNA, 1677 bp, Heterodera glycines
cattcttaccagtgcttgtgtttcccagttgccctaccgggaccgggacctgagatttaaagtgaaaaaaggaagatttcgagcatttaaaaagaaaaaatggtttttttgttaaaaaatttagttgatcactacccgatcggggtccccgacccccgacatgtcgccccccgaggggtcggggagcaaccctactaaaaattgaccaaaatttcagcctaagaaatgtaaaactttcgctgaaaattcgttccaaaattagtatttatatattgcagtttttttagcacctaaaaattcggtcttatctctatgtaactaaaaatttaaaaattgaattctaaaaaaagttaatttattaatgattatttttaacagaattttgcatatttctctgaacagcttccgacatttattttatttcattttaattagtgaaattacgtgaaaatgtgaacattaattaccgatgttgttgaattgcttcgatttcgaaattgattttatttatttattttatttgcctttttgggtcatcattttgccttttttaccattatgccttcttccccccccccccccccccctctgactcggcatttttttcaattcaaaatgaccctgaaacttcttatgtcattccatcactgtttatttgcccttggctgagcaccaatctctcttcggcacaaaaatgagaatataattaatggcaaaatgacccatttaggtcaattaataagaaaaaaaggacattaactcattttcattttactaagtgggaaccaaaagagcaaaatggacacagaacgggaaccggccactttggcgcaggccactttggcgcaagactatatcattttgatttcacagcaaaattaaataatcttggtatgattttaagtggcttgatagtgcctattaacctgcaaagtttcaaaaaatttagctgagaaacaaaaaagttatggccaaaaaacctcaaaaaattgcattttcctggccattttggcgcagcgcgccatatcttttttaagacctaatataattttttgaaattttgcaggctaataaagaacatttagacctattgattaatatcaacattattttatttggtcgaattaaaaaaagttatgaatctttaaacttgtctgcgccaaaatgaccccgaccccacagaacagcacaaaaagggaaaaggaaaaatattacaaaaatttgcaaaatcaaagacaattcaaagagttttaatcaatgaaaaaactcgaatttccttaaaagcaaaactaaaaggattttcggggaaaaaatcggaatttctttgacaataaatcccaggtaaaaaaatatggaagtaaaaattaccagcagttgcatatttttattgcaaaatttgattaaaattaaaagaaacattaatagaatattaaattcttctctttttatattttattaaacgaatttataaattattttcaaatgaatgcaaggttgttctggttcattttgttgcacacgaccttaaaagcggagaaaattgcgtttttttaatgaaaatatgctcaaaatatggtcaaaattcttaatttttcccccggtggcgcctatcggcaccgccggaccgtaaaatccttaattacagcaaaaattgctcaaatcgcaaatttggccatt

SEQ ID NO: 19389 - DNA, 1932 bp, Heterodera glycines
  misc_feature (38)..(39): n is a, c, g, or t
  misc_feature (50)..(51): n is a, c, g, or t
  misc_feature (60)..(60): n is a, c, g, or t
  misc_feature (67)..(67): n is a, c, g, or t
  misc_feature (112)..(112): n is a, c, g, or t
  misc_feature (181)..(181): n is a, c, g, or t
aaaactttattgtctttgttttttacaaaatcagggcnnaacataaatannaaattaaancgatctnaattaggacaaaccgaaagctatttaattaattaaaaaaggcacncaaaagaatatttaaattgaaaagcataatgaaaaatcactcttcttcagctatcttctgaaacaaatntaattatccctttttcattcctcgtttatttcttctccaaattgtttcttccaattaaaaatattctgatgagaagtgttcacagttttcgcaattgcattatcactcattttcggattttctatttttgtttgccaataaatattcattttttccattttttctttctccgttattcttttcttgctaatgccaaattgtttcttccatttatcaattatgaattggctaactccaattttcttacaaatttcggcataattttggttccattcttttcttgaatattttcttttttgcctatattcttttgtcatttcaatgaatttttgcacaatttctaatttttcttcatcactttttgatttatgacatttatttttttgaagacaaaattctttgatccatttataaattttcgttcgatttgtccccaatttttttgcaattttcaaattaattttatcccattcttttgttgaatattttctccctttttgctttattttttcttttattttataatattttccaattatttctctttttttgagttcatttcgtttttcttctttttttttctgccatttttctccaaatatttcgccaaatgacttttgctgtaactttttcttttctgctccaattttgacaattaaaaataatataattaataatagtagcggaaataatttcatttttgtcgtctcgaaatgattttatttaatttttcttcaattaaatggcaattcattttttggggcatttaaatgattttttttctgattaaaaaactgaataaatcattattttacttaataaaataaggaaatcctgtttaatttcaaagaaataataataataattttatcttaatgacaaaatgtggggagagagcgagagaaaaagtgagggagtgaaagagtgggataagagagagagagagagagaaggagaaagaaatagttagatagaaaaagtaagagagaaaaagtgaaatagtgtgtgagagagagagagagaaacttacggaagaaagagagaaaggaagacagcgaaaaataaacataagtagccattatattatggcattaaaaccaacagagaaagccagaaaataagtagccattaaatattacctaattgtttcaagaaaaatatggagttatttatttatatttgttattatatattttttattttaacaaaaaaatatttcttatcattattcaattgtatttatatttaatttttttcagggtaattaacaatattttttggaacaaaaaaggcgccactaataagtgcgtgtgctcgccggtggcgggtatctgccgagcagaacacaaaccgggaaaaacaggttgactaagtgaacgggtcccaaggatttatcccataagtaaaacaaataaacaatttatgtataaaccgtttttccaacaaaaaaaaagcatttaaaatttaattgaatattttaaaaacaatacgtcaatttaaaattaataaaaaatttttgaaaatttctttctgcgaatgacactccaacaaaaatccgccaagtgctaatttactcacaattttcatttagtcgtcacgttgtatttacgagaatcttgcccttgagtaatggctttttcgtgacaatgcctgaaggaggacggtgattctcttctcatttggaggtcagtccaaaaaatttgggttctagtcggttttatgcgtcccatgacatattatgcgtaccatga

SEQ ID NO: 19390 - DNA, 1917 bp, Heterodera glycines
caataaaaatacaaaaatttttataaaaatatataaactccaccaggatatttttagtgataacaaaattattaaaaaacctttcttttaaaaatttaaatttttcaaagtcatttaaattattaaaaaaactaatttaaaatttcctttcataataaagagtaataaagtttaaaaattattaccatacttttcgcagcagattaagttggaacaattatgtcctcattctccggcagttacctttaccgttcgccggtgcgcccaattgaagactcatcgtcccttaattactctccccaccattcaaatgccacattttggcgccattcctacactttcaacacatttcgccattcgtcggcacatccgcttcaacaatcggcattccatcggcacaactacacatcatcctatcagacaccattcgtgtgccgatttgagccagcctatcgtccggtcagctggcacccgcacccgttaaactgatcgagaaaatggaatgccatgccgaagaaattggactgatcgggaataaatgggagttggcacgatgatccaattaaatgatggcatgaaatagggagatgtgatgggaggggttaattcatattgtaaacaataacttttttattttattttatgcttatcgattaaatgtttatcgcagtgtgccgtaatgccaaactttatccaccatttttgtgacattttgctaaatttgaggatctttctttcccctcccattttgagatagtctctcattttagtttagatttttttaatttaggatattttttttattttactttttaccccagttttaaaattgataaggctcagccaatgatgccgaaatgcaccaatagaaattcttgaaatgatgtcaaaatagctccataaatggcatccttgtaattgaaagaaaaatttgtaatttactgtaatgaagttgttaattttaaaatcggataaagacttaatttgattcttaaattaaaagtaattttattcagaaattttttaaactaaaattgaacaaaatcttcgtcaccaataatttttcatataagcatatgtgtacacaccataatgaatccggatgagaattttcaattaaaaattgtcattttaattagtttatttgatcagcttaatgaaaagttgggattttgcgataaaaaacaaacaaaaagtttatccatgaaagcaaaaaatgaattaatcatgtgggatggaatgaaaaatgattgaataaattaaatgaagtgatgacataagcattaaaacttttatttacatactacgaaataatgtcactataaaagaacgtgctataatctttaatatttcacattcaataaatatttttaaattaaattaatataattatttcaaaaacttataaattgaaaagattggtttatataaattaaaaaagataaattaatctaaattttaaaatttaagatattcaattttccaataaattttctatttgataaaaatggtttcctctattccgcttccaattgctattcttgtaataattttcttggtagccaatatgtcttcaaagattttgtgtgattcatcatcggaagaaacaacatcgacgagttcaacaagttcgaccactagcagcacgtccacatccacatccacgtcaacgtcaacaagtaccagcacaagtaccagtacaagtacaacaccaagctcaacgacgagtacaactacaagcacaacaccaagctcaacgacggagtcaagcagtaccaccagcacttccagcagcacaacccctacatcgtccacttcgaccagcaccgtttcaaccacaaccaggcatggacagaccgggttaaaaatgagatttggtttcataaaaccgtaccccgcccccgttccgaaatttca

SEQ ID NO: 19391 - DNA, 1795 bp, Heterodera glycines
ccaccaaggttcatttcggaaactccacgttcattgatacagtaatattatttatcaagggtacttttaaataaatgctttagaactttttaacatttgaagcattatcctgccataaacttagtacacataatgttgagttggccatttctctctctttgtctcattatattggccttttcgttgtttgtttctctgcctcctctctttctcctccctctctctttgctgcactgctttcccgctcgtccgtctgctcctcctcttttcccattctctctctctcctctcctctttctctgaacctcctgtccctcttttgtttgcttttttgctggcaacacaatggcatttgccctcctccacccaattgagtgggcacacataaacacggctgagtctttccggcatagccaattggcggagattgacttccgtcagcagaagacgcaccgaaaccaatcccggaaatcggaggagcacttaatctggtgctgttagaatttcgatagtttgtttcgacagcaaaacttaaaaataaataaaagtttaatttttgtttttttttctataaattgattttatgtctcggtcggttttttaatgtttccgagccgagtttgtgtccatcccatggtttgagtccagcgaattttttatgaagctatttctcttacgcttgaagttgcggtgtgaatggtccgcctgttgcaaaaccgccaacaggcggagaagaacgtgggaaattttgctgaggaattggaggtagcgggaggagcggagctgcttggagttgttggggaagagcacagcaagcatcctgctgcactgaagcggcgggagtgcaaacacagacgggctgattgccggaagggggtggcggaaagggaggcggattaaactgttgtcccatcggagggggcggaggggtagggggactgaactgttgtcccatcggcggattaaactgttgtcccatcggaggggtagggggactgaactgttgtcccatcggcggattaaactgttgtcccatcggaggggtagggggactgaactgttgtcccatcggcggattaaactgttgtcccatcggaggggtagggggactgaactgttgtcccatcggcggattaaactgttgtcccatcggagggggcggtgggcagcagtcgcttctctgcaccggcgtgcaaatgcaactgattgtcaatgcctgaagtgcccttgcttctgcgccaatttgcggtgccctttgactttccatacagcacgcatctgattgcgacgctttttattgacttcacaactaataattgaagaacttaccagcagcaggggtacacaaacacattggaccatcgtcatatgaaggcgaaacgggaggaggggaggaacagcacgcatcttgcaaaactaaatgagcatatcgaaggacaacgatagtaaagaaattcacttggtgaacatatgcatgtttgtattggccccattgctcctccaggactcaattgtcccattgctcctcctgggcccatcggtcccattgctcctccaggactcaattgtcccattgcacctcctgggcccattcctcctgggcccatcggccccattgctcctcctgggcccattcctcctggactcaattgtcccattgcacctcctgggcccattcctcctgggcccatcggccccattgctcctcctgggcccattcctcctggacccatcggccccattgctcctcctgggcccattcctcctgggcccaacggacccattgctcctcctg

SEQ ID NO: 19392 - DNA, 994 bp, Heterodera glycines
ccttctttttcttccctctcccttccctctccttctttttctctctccttctttctcttccctttccctctccttcattttctctacattctttctctctttctcttctctcccccaacccacccgccttctttttctttcctctcccttccctctccttctttttctctctcattctttctcattctctcattgctttcatttcattctttgcctttttttctcattctcattgatttgtgtttctctttacgcttttgtcctttattcagctgctgctgctgcactgtctcaccgctttttgttttcctttctctctctctctttttccctttctttgcatggtaaaaatccaatcgtacttttgagatacatttttgtcgttggagttttctttaaaaacgttccattttaaagttaattgtttaaaaatattttttcacatttaaaatcttcgaccgattttcatcaactgtttattttgccattttccgaacttttctcaatgagcgtgcacaaatgtaagagttagcagcatttattttgcgattaggaaaagtgtgccaacaaatttccaatgctttagccgtttttggcctcagtttggccagtgtcaccggactgactctgctcgttttgtcctgcgcccttccgtccttcaggtttcaaatgtttagcactcagaaaattgagcaaaaaatgaataaaccaaataaaataaatgtaaaacagtcaaaaaggctctgctgcctttgacccgacaattaaagaattaatgaccacattagcctgtctggtctgatggatttgaaacatttgggtgcatggatttacgaaattcttcccttgccctaattacaatattcgtttaatatagtggttatgcatttcaatttgtggaaatacctaaaaatattatatttcaactaatttttaaaattatttgcgcctatgtccaaaattgggttcaaacttacattttttcaatcttaga

SEQ ID NO: 19393 - DNA, 2097 bp, Heterodera glycines
  misc_feature (5)..(5): n is a, c, g, or t
ccccncttcagcaattgggtggccattgttcgtgctgttcttttactttttggcaccgttgcccatttccattgccaaacatttgcgctacgaaagcagcggaacatcaccggcacgagtttaatgttttggactgtcaaattgggacaaattggagacggattgtccattcttaaacaatgggcgataaaatgtcttggggttcttacgcattttgagtaccccaattttcgagtcttttcaaatgaatttgatcaaaagatacccaataaaagagagcatttagcaaaagatttagcaacagattttggcaaaaaaatgtaaaatttagaagattttggagcaattttcgaagaaaaatctaagagaataagcggatttggcgcgaattctttgctgtcagttgtaaatttagagagttcctctaaaactaactgaaaatagaatttacgccatcttttttgttgattttggcatttttatagagaatttcccgctcatgcaacttagagagataaatgaatagaaatggcaattgccacttttttatgccaaatttgtgccatttttaggccattgaatttgcacaattcgccaccgccggcattgtcctctccgcctttgcgcttcccttcgtcctcgcccacgccggagtggtaaaacaaaaagcggaatttaaatatactaaatttatttaaatgtttgcccgtttttgtgtgccgtccccgttttcggtgttgtgtttttgtcaaagttttatcgcaattcgtcgggcaaaggaaaatttcgccggaatgaaaatttaggaaaaagccgccaaaagaatttaaaattagggccaaaattttaggcgctacaaaaaagtgtccccttttgagttttattaaatccaaaaaagagggacctttttgatttgcgactttttgtgataataaatcgtgaaaatttattcccgtgtttttgggatcactaatttacttcaatgaccaattcctaacgaatttcgatttttgtccaaaattagtttagggatttggaatcgagtttatacatttaaaaaagtgtttcaaaagttttaacttaaatgtctaaagaatggatgcacaaactttgcttttcaaaaaatgcgcattttcccccaaaatgtgtaaaatgccgttttagccccccccccctcggatttcctcccattttcgtccccttttctcccctctttctgttcagatcgctttcggtgcgtttgttgtcgcttcgttgggctcgctggtcattttttgcaccatttttgcctatttttatttgcaccaattggaggaaaacggcggatggagcgcttcagtgatttgagaaaagcacaaaattaaaaatgtttaaattttgtcaatgcgcggcggaagagcaaagccttgtaaaaatgtcaattactattgttttgtgtgtaatttctcatttattgtcccgtgctatgcggtgatgacaacggatggataatgtaaattcatcacattaattaataaattcagacggtaattaaatggcatttgtgcctatgcacaaaaccaatctcaattatgcaaagtgtgttccagatatgtagcataaacgatgactaatttcgagcccgaactgaaacggataaatacccagaacccaaatttaatgaaattcaatgagaaatgcactaaaatagaattttacttatagccgtaaaagtttgtttgcattttcgaaaatttaaactgcaaaaacaagttttcggaaaaaaattagaaaattaagagaattccgaatcttgtcgcgaaaaattctttatcaaataatatattaaaaaaagtaactgaataaaaaggtgttataatatttatttccaaaaaaggttctaaaaataaaaaaggattttttagttaaaaattgctaaaatatgtatgaaatatgtacaaaaccccccaaatatgtactaaaatatgtaaataaaatttttttaatgttaattttttggataaaaattcttcgtaaaaagtgaaacaggcacaaaatgccataaaaatgaccaaaataggcttagaatcacattttagaactttaaaatgatttttg

SEQ ID NO: 19394 - DNA, 3184 bp, Heterodera glycines
agaatatcggttttttcgagttcgagattaggaggtctatattgatattagattcgttatcagcaaccccgaaaacccacgggaacacctttcaccattattctaacgccgtataaatgaggcacaactctgtgtaatatatcgaagtcttacaattagtgttacatagtattaaataccgatttttgttggaagaatggactattgaagatccaaacgatggtaatcggccaaaacacgtataaagcaaagcgaaatgcttccaacctgaagcgaaatttcatccttggtgagttcagcttaattcgcaaaatgtacttaaaccctcagttgcagcccattgtttgttgaaaccttcaatttcttcaaagcttccaactccgcatttgtctgcttccttttgactaatgggaagagattatttccgtccattatatagaaacaaaatttgaaacaataaatctgtacaaaaagaaaggatcagtttaaaggagaccaagtgaatatgtaaaagaagcaatgaagaaatttttgcttatgggtcgctttgaaaaggggtaaacccaactcatccaaacccaactcatcaaaatgggctaatgcatttggtttaaacatctcccaaaataaaacatttattttatttcttggcaaaaataattctaaacaacaatataaattattcaacaatattattaatgaggttgaatctattagtgatttgggcattttgattgataataaattaagattttctaatcattatactaaaattactaaagctgcttatttaaggattcgcaatattgccaaaattttaaaatcccgctctatacgtatttggaccaaagtttataagacatatattcgtcctcttttagaatatgcgcctgaaatttggaatccaacatacaaaaaagatataaataaattagaaagatgccaaaaatattttacaaaaattgcattatttaaatgcagacttccttacataccttacaaacaaagacttgatttattcaaacttcaaacttagaagaaaggagaaaaacaattgattcagttcaggcattcaaaatcattaatggtctcactcatcttaaaaaagacatattcccacaattttctggtcacatcccttataatcagggatggcagatgaaaattttcaaatttgcggtttttctcaaaaaaccacaaaaagcctcaaagcctcattttgaaaatttagcctcattgacctgtcaaaaaaccacaaaatgaggctaaagcctcagatctgccatccctgcttataatcttagacgtaaagttgtgttaaaatcacaatccagtaaaactttaaattcttttatcaacagaacagccttaatatggtctaaactcaacaaagatataacagatgctccatctgttgacagttttaaaaaacgtataaataaatggattgagttaaacaaaaatttagtctgtaaaagagctccttggacttgatattaatttactaaaatctaacgtgtacctaagtggtcaccccttcgttggatattttatttcttctgaataaataaaataaattcttttttcatgcctttttcgggattttcgtgcctttttcaattttttggtgcctaatataggcgcctttttccgatttttggtgcctttttggtcggtctctaattatttcatacacgtctattatatttcaattttagtgagcagaacagaaattgaaaaaaaattgctcaaattgacatggaatatcaaaaataacacttgaacattttaagcttgttttgaataaattttataaaattaggctttttgacccaaaaatggggctttttttgcctgccaatgaagctttttaaaattttaatcttggagccctggtttaaaccagggatggcagatctgaggctttagcctcattttgtggttttttgacaggtcaatgaggctaaattttcaaaatgaggctttttgtggttttttgagaaaaaccgcaaaataaagaatttttttaatgaaaatatgctaaaaatatggtcaaaattcttaatttttcccccggcggcgcctatcggcaccaccggaccgtaaaaatccttaatttacaagcaaaaatttgctcaaaatcgcaaaatttggtcatttttcggacaaaatctgttaacaaatcgcattgaaaattacaaaagtttccccggcgccgcctatcggcaccgccggccccccttgtttcccaaaagttttttggaaaaagcgccgcaaaaaaatcaacttcgtttttcatgttcagaatcccaaaaatgcttatttctaacaaaaaaaaatgctcaaattgatcatggacaatcaaaaatataacatttgaacattttaaacgtgtttagaataaattgtgtaaaaatgaggcttttttgcttgccaaatgaggcttttgaaaattttcatctgccatccctggtttaaaccctttgcagtaaacttttcttgttttcatttttagcatcttagaaagcgtataaaaatagttttgaatgttattaattcttggccatatgatgcacattttccgatcggaattctgacagtcaggatcgttttcgcgtggccgttttcgcatgggataggttttcgcgtgagtacctgtttaggactgaaattggtcggatttgtgcaaaacatccatgtttcgaatcccgaacccgaattttctgactccaaaattcgatgacttgggccgtgattcctgtttctaattttaaatcgagacgacgcatgaaataagcttatgtgttttgtatttttacttttacgaaagaaagatgagagagggaaagagagaaggggaaagatgagagggagtgaaggtggagggaggggaggcagcggacggaggggggggggggcgaataggaaattgaattgaattagtgtttgccttccctccccggcccttctgtgttgtgggccaaaatgagtgggccaccatagacatatatatatatatatattggttatggattttccaaatttctcattgcttcctccgtcaaattaactgtagtcgaccatttttgaggggttagggaacagcacatcccttccccttccctcctcttcccccactccctttccttcgcccctcccgcttttgatcccttccccgggaagt

SEQ ID NO: 19395 - DNA, 847 bp, Heterodera glycines
actttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggatacggtctccccataaatctgtgcgcatcggttcggagggactgccccgaaaac

SEQ ID NO: 19396 - DNA, 1361 bp, Heterodera glycines
taattttcaaaaaggacacacacaattgcttctttggcttttttgacgagcaaattcgttgccacctgaaacaattggatgaatttggcgcggatgaattggacagaccgtcgacagattttatggaagcatttttaaaggaaaagctaaaaaaggacagggcgggggaacagcacaattacaggtggattattaattagaaaattgcagtaaagtgactaattgatgatttggagcaaaaagcgaatgccatggcatggcgagagtggcgaactcttcccccccccccctccacccccgccccagaaatccgattttcattttagcttcttctattttcaaaaaagtcaatattactttaattaacggagttaaagatttgtcgaatttttgattcatttgaatttttaatcttaaatagataaaataatctttagtggagtgttgatgcttttcagttcagtttcatgtgtttaagccgatttcgtaccaaaactagaaatatttttataactttttttaattcaaatttttaagttttgaccaactgaaggcaactttattcgatctttggatttcgggacaggtaggcattatgcgtacggtatcgtcttttgtacagtaggattgtaaaaaaacacaggaaacgacaacgacagcgttggcctggggagccgcttacatggttcacaaccctaaagtgatggagaagatacaggaggagttggaccaaactgttgaaaaagagcagcaaatttgttgggaagaccgactcaaattaccgtacacatcggctgcagttaatgtgaggcttagttcaaatgttctctatcggcttgtaaatataaaaatagttataaatttaaaagtgcatgaaattttattttaaaaataatccaaaaaatcattaaaagacaataaaattagcaacatttatgatagattgttttgataatttgtcaaaaaaaatttcaaagtttctttgaccgcgatgggcttttacccaatgccaacgaatgtttggtttgcaggaggtgctcagagtgggcaatgttgtggcccaggactttccgcatcggatgatgcgcgacacactcgtggacaattggacattgcctcggggacagccaatcgttgcacaaatttcggttgtgctaatggacccagaggtgataaatagaaatgaataaaaattgaattttatttagtgatcggaaaatatgttttagatgacggaaataatctatcattaccgttactattttaactggaacattaaaaaatggcataaaacattaaaaattaaaataaaagttatattttgccttcaaaaataaattttctcgactttttaatgcctt

SEQ ID NO: 19397 - DNA, 1119 bp, Heterodera glycines
cctcttcagattttccccgacccaaaggcatttcggcccgtgcgctttttggacgaacgcggaaagatgctcaaaacggacgaactgatcccattcgcattgggaaagcgccaatgcttgggcgaatcacttgcgcgcatggaaatgtttctgtttttcgccaacattttgaatcggtacaaagtgagtgatttctgagcgattttttaattgggttaagtggttcgggtggaaattcaccacatttattctccaaattgatcaaattcccactgagctctatagtataaagataattttattcttaaaaattttgctttttagatattgttttgtatttttttagctttggtttctttcgagcaatttcatttctttttttcactgactaagcaaattttcccaattttttaccatttcaatcggttcaataacagacttttggcatttacactcctcatgactattttatgcttgtcggagctcattatagtagaataggaatatttaacactcattattctgcttttgtcagctctccgctgggcaccaaatgccatcgttggagcgtcggatgggcattcccgtgctgtgcccaaagttcacgtgtcgcgttgagaagcgatgcacggaatagaaacaaacaatttgaaaatgtttttaattatccgatgctgattgactcattttaaacaaaaattaaagttttattttaacattttttccattgagctgcacagaaaattatgccattggtgatagacactaaataatgaaataaattattaatggttagtgctggaattattaaaataaaaaggcgttaaatatttgcatattgatgaatagggatgcaatttttagactctaaaaaccgccaaaataggtaggctttaggtctaaaaaccacaaaaatgggctctaaaaatggaaagtaggcactaaaaacctcatttttaggggtgtaaaataacaaaatttatttaaaaaagtaaaaaaattatgccaagtctgtattgcgataaataatttttaaaatcacaaattcatgttaagaaaataaatgaataaattttgcagatgaatttttgagaactttcatttcttaagggtgtattt

SEQ ID NO: 19398 - DNA, 2933 bp, Heterodera glycines
  misc_feature (131)..(131): n is a, c, g, or t
ttttacgatttcgagcattttgggggcctctgaatgccatcccgggtccagaccaactggatttcttcctggacctgggtttcctagtttttgtccaggaaaaccaggttcaggacaaataagaaaagacncaggttcaggtccaggttagccgtgaaaaacctggatttcctggatataatttttaattgttattcaagtaaccaatgtttttttatttcaaattacaaaaaatgattaatctaaagatcaaatgttcttttatacgatcatattaagcatatttttggtatttgatttttgcaaaaactccttctttctttcctttttttccaaatttcacttttttggaatattatttaattgatttaaacagccatttatttacttcctccgtcccattaacacttaatttggccgttatgttttagggattgaatttgtcgcgcgggggcgttgacggcgccgcattggctttggcggcgtcgcgtggcatcgccagcgacggcaaaagcggtgtttctcctcggcttaaccaacacaggggcaataaccgattggcttctgccgatcagttttttgatccgtttggagaagctgctgaattctttggacagcgcctttcggtgttcactgctaaatttgaaaaaatcgaagaattaaattagtggattagtcgagaatttattcaagcatcaatcagtcattgtttcgaaggcaaatggatttgattactaaccaactaatcaataaatctgatgattgatcaatggatataaccactgatcagtgggtttgaacagtgaccggtggatttgatcaatcggtcaatggcttaatgaccaataggactgattgatcactttgttggtcaatgtgtgtggattgatcaatttccgctttggatttcacctcgtcctatagagaattggagtttcgcaaacagcggtcatactgaagaagcagttgatcagattgttcagtgtgaatttggccactgaatcattggggccaaagaccgaagcgacgagcaaaaaggcgatggtggagccggaccaaccgacgacttggagcagtacaatcagagaaagggccttgagaatgggcaaaccaacgccaacaactgagaaaaataataatttaaatgaatttaattaaatgaaattggagacacttaaatttaaagtgcttaaaatatttaaaaataatttttaaatggaatattgttcaatttgacgcactttcgcccttttttgcacgaatcgttcgccataatttggcataaataattaaatagcacaaaacggagccgtaaatgaaggaaatgttgaaaaacagcacaactttgacggccccagaaccaaaagcatcgccaagagaacaaaacaaaggccgaaaaaagaaggaatttgaaaagttataaattaaaaaaaagaactgactcaattgaggacgaagaaagatttttgaaaattaaaaacacacaaaacaaagggtacggtaaggtacagacatacagtaggaccgagaaagtgttctcgtcccgtttcgcataccttaacaattcagaatttgattaacatttttaccacagattttaaaaataattaatatattgattaatattttggtgattaattcattttggtaccaaaaaggcaaaaaagcgctgagcagccgatcaatgctaatggccaacattaatgtataagcattggacgtgaagaaaaccggcaaaatttgcaaaaggccacaaaatgtcggggacagaaaagcgccgtcgccgggccaaaggagcacagaaaaagggatgaacagctcgaaaaagccgagaagggagcagagggcgtgcagggcgatcagcacttggcaagtgccacggagagaactgaaaaaagaggatggacggtaaggaaaaagtgatcaaaaggaccatttgatcaaaaggtcacaggagaagcgatcaaatgcttttgagagagcggaaaagagagagagagagagagagagagttagaaagagaggggagagagagagagcgaaggggggagagagagagagagacagctaaaaaaaactcggcgtttgcctgagcccccattttgattgagtcatatctcagataggacatatcacataaagttccgctttaaacatgggtttcgggcagttcggcacatgcccaactgaaaagggcactcacttgttcctaattgtcgcaattatcaaaaaagtgtccattattattccgcaaacattgaccaaagcattgaccgaaaatgacaaataaatttgaggcgaatgttttgatgctgttaaaaaatccttaaaatcgaaagtcgttttgaaatgccaaaaaatgtcaatttcttacaatgtaaatttggtgctcatcgcttaaattggccatttgaagtgcaaaataaatatgaggtgaattattttcggttttaaataatttccggcagaaaaattaatttattttttacgcgaaaaaaaattccgttttaaaatgacgtgaaaagaagcattttaagaagcatttgcgtgagatggcaaaagcacgccaatcttccgttgttctaaaatgaacaatgccattggaaaattttgtaaatgaaacaatgaaaaaaagggaaattaattttatttttgaattttaaacaatttttaatgaaattaaataaaacaattcattaaaactcgtcacgagaacatttaattctacgaatgaaaaaatatgggaaaataattcaatgctttgtgaataaatgaaaagtacaaaatgtactaacatttttcaacaattaattttttccttttttattttcatttgaatttttgattaattctttgaagtcttaaatggttttaaaatatcactataataattcaacatatttattttattcatttctttctattttatttaa

SEQ ID NO: 19399 - DNA, 1285 bp, Heterodera glycines
  misc_feature (1267)..(1267): n is a, c, g, or t
tcttaaaattgagggaaatctttttattgtctattttaagacaaaaagaagacttgtagttcaggaaaacttaattgactcaatcataatttttaaaaaaatgagaaattctatattctttcaatgctaccctccaatcgtattgacgaatttttacaaaaatctaaacaaaaaaatttgcaaactctaattctcatcatgatcaaacattaactttttttttgctgatcacttttttaaatcgataatttgaaaaataatttggttgcgtctgagaaaagttatgagttgatttagtcaaaaatttagcaaattatgcactttttgtccttcgactcaccacggggcattacagccgaattaccataaccataacgaccgtagccatcattttcaccaattctaccgtgttgatcgatcggatacggtcgaatggcagtcgaacgttggagaagaagcaaaatgagcgggagaagaagcaggcaaatgctgaatggcctcattttggggggatttggagttgggatcgggtttggaatggaaagtgattggtggagagatttggccacccttaaatactccaaaagcgatttggtctatatttattattgggttttattgcctttgctataaaaaaattatggattaataagatgggcgggccaatatcattttgactatttttgaattttaatatggaaaacgtaaaattgaacagcacttttgccgttttatgatttgaaatataataaaaaaaaatttgcatgtgaaagcttttggcaaaaaataaataaataaagatgatggaataacgaaaaagaatggagagatagagaggcattaagccagttatgaattcatttttatgtttttttatcaaaattttttgacacttggacaatttttgaattttagaaaaatgaaatttagaaaataactgtaagaattatttttaaaaatagatctatgttacccgtttttaaattttatttcaaataaatttttcaattttatttggttataattagggttgtaaattatatggactaaaaaacgcgaaatatggacattaaatatggactaaaaaagcccgaaatatggactaaaaagggcaaaaatggccaaatatggaccaaaatatggataaaaaatgccaaaatatatgttgtaaacccccaaaaatcccaaaaaaggggtgcatatttaatatttgcttaaataaacctaaaaagtacaataaacaaccaaaaaatggggtttaaaactntaaaatgcatatttttta

SEQ ID NO: 19400 - DNA, 1433 bp, Heterodera glycines
gatcaaattttcaacatcaaaatttgtcgataaataaatctgcaataaaagaatcaccggttttatcttggcaattaactgaagtgcttcgttgccctagtattgtaaacactcaaataaatatggtaataaaaaaaattctgtagaaaatgcgcgtaaaactgcaacttgaagcgtaacattatttaaagaattttttgccgtgccaattcatttttaattcatttgaactgtttttcagccaaaaatggtcatatacaacagaaactcggacaacggcccagcgcacatcaaagggaagtgccgctaaaatttcggcgtgtaattcagtcggcattttacttttcggcatgtttcaaatttttcggcatagtttttgttatcggagaaaaggaaatgtggacggaataagaatgacgaatgaatgaattaatcataattttatcccaaaaattttggggaaaccctgcgaaaatcctgaatttaacacaaaattttaacttaattaaaaaaaaattacagaataaggaaaataggaagtgagaatgttttcgatgcagagattaacgcgttcgcgtcgtccaaaacatggaaaatgtatcaaaaaatgtcggagtgatcggaagcaatagcaaactgatcaattgcctaaaatcgtaaaataatgagtcattttaccaataattagcaaagaattttttaaaaattacgtgaaaatggtaataaaaagttaaaatgattagatttgtaaaatattccttcaaaagtttccggaggcgcgcgcctactggcacagtcggacctaaaattctaaaatttacaaaattgacccaataattggcaattgtttgtgaaaagcttgaaacgaagcccaatttttttcgaaccacgaagctcgagttttaatggagagtttacatctaagtttccaattttattattcaatttcttgctttttcaacattacattttggcatactgtcaccaaaacaaaattcaaaaatcattaacattttatcaacatatcatctcatctgtctgctgccccctttccaccattctttttttctcagctcatcatcatcaatcagttcgatgacggcattcccgggatcacattccgcggcacagcaacaccgggcccgtaaggccaacgcgttggcaatggacgaggtccgaaagttgggaatggccaaggcgttgtacgaattgggaaagggggaggaggcgttggacgagttgggtattttggccgaggcggcgttgccggctgcagcagcataatggcaccgcttcgatggttgggtcgtcctcctccgccgccacccttgccattgttgccgttgccatgccatgaattcgatccccaggccttgccttggcctggtcctccctgtcccggtctccccggcgggtattgcggtggattggtt

SEQ ID NO: 19401 - DNA, 1186 bp, Heterodera glycines
tttgtcgccggttggagcagcagaagtgccgagtcggtgttgaatgagtgtttgcatctgaatggaggagctcttctgaattgcgatcttatcagtgcctaaaagttgccaagacaacaaaacttggcactggagaggcccaagatatgcaaaaatcccgagcagggctgaacgtaactggattgtcgggtttcgggacgagaaaaaggtcaagtttcgggattcggcacgagaaaatgattcttcgggacgagaaaagggtcgggtttcgggacgagaaaaggtcgggggtttcggaacgagaaaaaaggtcaggtttcgggattcgacacgagaaaatgattctcgtggacgagaaaaaggtcgggtttcgggattccggcagcaagaggttcggccaaatcaattgggcgaaattaaattggaaggaaacgcctatcaagacactaggaattccaaggcctctaaaaattacgaattgaataaagaccctccaaaacgtcagggattctgaattcgggaccagccctgacccggagactattgcggcaccaccaccaacacactttcgctccatttcggccaaattagcgcccaaaattcgcacaagcgccgcctcaatggaacgagcagtgatgataaagcggatctgacgatgcgtggtggacgagccgagacgcgcagcagctgctggtgatgaagcggtgcagagaagcagctgacgacggagcaacgcgcgaacggaaagggcctggtcaacggactccaccggtactgaattggccgcgattaatttatgccgggggcagaggcaatcggcatatggcactgcccctagtgatgctcgagaaaccgaacatttccggaatctgggactcgagacatagaaaatttccgagaatttttcaatccgaaccgacaatttctcgagacccttccttatataaccgagaccgaaaattttccgactcgttactttttgactcgaacttgaccacaaaagaaaccaagatcacaaaacataaaatgtttcaaaatcaagactgaaaattttctgaagactcgagcccccccccaccctaaaaaacggagaattctcgagtcacgacccataaccgagattcccaagcagctttaaatcactcattgaagtaagactgctcttgaagcgacagactcgagacct

SEQ ID NO: 19402 - DNA, 2092 bp, Heterodera glycines
  misc_feature (34)..(34): n is a, c, g, or t
cgggtcgaatctcctatagtttggcattttgttntaaaatttaaaaaatgttatttgataaaaaccgacacagccaaagtgccatgaagtcgcgagaccaatgtgaaaaagtaacgaattcaagagccagaattcttttgattaaagcagggaaatctttcattcacgtagggacaatattccttccccgaaataaaaaattaataaatttaggaaaaaaattaatatattttttgaaaatttgtatcaattttgattgaaaattcgttaaatttggaagtttttcaaaatttgcctctgcatttttttggcgaaaacccgctttaaaaaaaagtccgctattttagcccacacaaaaatgcttaattttctaaatttcgttttttcaaataagaaattttaaaaatcaaatttccaaaaattttacttgataaaattaataaaagtaaaaaattttcagtttttctgaaatttttagtgatgagaattgattcggtaggaactgaatgaggggggggggagggggtaggcatcccaaactgatcatctcagcttgttttgatgcccctttccatggcatttgcaccaatccaccgctcaccgatagccctggcgaactcggcccgctttgaagtggccgccgctgatcagcaaatcaccggcggcaccgccaccgtttgcttcttccgccttctgcttggccagttcaatgaccaatgccaactcgtcgcgcagcgcctgatcagcgcgctcaacattgcggtccggatcattgccaaataaatgtgtgccgtcggcgttgaacagttgccacacaggcgcttggaagcggttcggcacgggctggtgaccggcggtgcctacaaagccaatgggccagccgcgctcggcctcgtcaaattcggcttcaagttggcgctcgatgccctcaatttcggcatccaattggccaatttggacgtgcacaaagtgctcaagcagtgcccgaacgtccagctccgagagcagtggcgagacggtcagagagcgattgaaatttggccaatgggtggccaagtgggcaatttggtctaacaaaagcaagctggaaatggtatgccaaaatttgaaaaatagggaggttcgggattaaaaaaaagtctcggggggatcctgaaaataaaaattgggagaaacgggccgtgggagagaaagtccaaccaagtggggcctggattccgtaaatagggaaatttcaaagaagttctaacagagagccaattggggctgggatttgacgggaaaattgcaaaaaaaaaaaaaatcgatcaaattaagtcctcagtgcccacgactctgtaagacaccaatcgacttgaaatagtgccgcaattgtacggcacaaccttggagttgtacattttaaatgtgccgatgcttgagatccagtgccgatatgccaaaatcacgagagttttctcgactcagtattctcgaacagacatatggcacaacacatacagtacagtaacaacacaccgtactgaccgtgcaaagggagtgccgggtaattattgttgtcgggtacagtacgctgttgctgctgctgttgttgttggtcttctgtaggcatttgctgccaccacaaatggtccacccgctgtgccgacgggtgacagctcaaattggtggccaacagaatgcacttggccaacgcgaactcgtccggggacttggaaagagattatcaataatgtgggaagataaatgcgttttgaattaatttaatttaattaaaaattcgggaattttaaatgcgagcaccaaaaaaaatttagagaatgaggcagacgctaaagcaacaccaacaattagggttaagccccgagccctcgaagggcgacatgtcgggggtcggggcggggaataggtccgaaaaacgtactcgagtcggatcggtagtctccgggctcgtatataagcgcaacgaaattgcacatccgctgtctcttttacaagtgctatagtgtatagtgttctatagtgtagagtggaagagggttacatagaggaaagactcactggtcttcctgataccataatctcgaaaatc

SEQ ID NO: 19403 - DNA, 2816 bp, Heterodera glycines
  misc_feature (1412)..(1412): n is a, c, g, or t
cctctctaatatttgcataaattcatatccatatacattctaattttatcctttcatcataattaatatatttaaaaaatattttttctttttgcctatcgcatattatatcaatctatagatgttcttccgtggattgagttcaagaagtgagttttctgatcaaatttctgcgcttaattttctgttcttcgaagatgtctttcctcaaagtgttcgcccgtcgtctctttttgcatgtcacttttcttcgggtaccaacgatgatgttttatttgaacgggtcaatcaaaaattggtcatcacgctgaacaggcccaaggcattgaatgctcttaacttgccgatgattcgcaaaatttacccccagcttagggtaaatcatttccggataaatctactaacaatgagtcgctttttcagaattcttccttcgatttggcacttgtcaaaggtacgggtggcaaagccttttgtgccggtggcgatgtcctcggtttgtcagtttgttgaatgcttatgtattttttttctttttagctgtctcaaaatcctataaggcgaatgatccggaccgaatttttcagcaatttttcctagaagaataccaactcaatcatttaattggatcactcagccgaccctacgttgccttcatcgatggcattacaatgggcggggttggtgtgttttgctaaataggtttgagtgcgaagaattaggcatttttgtcattgtccgattacaaaatctgtcctgggttttagggatgtggcctctcattgcacggggcttttcgtgtggctactgaacgaacaatattggctatgccagaaacggcacttggcctttttccggatgttggcggaacgtactttctgccgcgactcagcggtcaactcggcatgtttttggcactgacaggtggcaatattcatgtattatttccagacattgatcatttttcctcgtaggttttcgtctccatggtgcggatgtgttccatgccgggctggcgacgcattatgtcccttttacttttttacaattatattttcctttttcaggtcgagtcagccaaacttcaacaagtacaagatgaacttttggcccttccatctccaacaaaaaaagacattgaacaattgctccgttcccatgggccgtccgatgtcgcttcctttgttttggacccgcatttggaactgatcgacgaatgtttcgcggcggaaagtgtcgaaacgattatcgaacgacttatgcgcagaaacgacagtgattttgcgcgggaacaatgcgaaatcttggcaaaaatggtggggttttgttgtacagaaatattggactaattcttcggtttttttacattcttaacgattttcatatttctttaacagagtccaacttccttngaagtgacatttcgccaaattcggatgggtgctaaattaaaattcgatgaggtttttatttttcatctttccggcctcaaatgttatattttttaggtttttcctattgaatatcgccttactcagcgttttatggcagcaaatgacttccatgagggctgcagagcgagtgagaatataaaattgccttttatgagtaattatttaagcataaccgattttttagctcggcaacaaaaataaaaggcttataagaatgcccaagttttttttctttccctgatatagcaaattagcatttaaccatttgagaattattttttaaatatcagcaaacaactttgctttattcaactaattgtaaaaattttgttttttttataaaattgcaaaattttgggaaaacttttcattttcagttctgatagacaaagaccgaaacccaaagtggcgcccttcggcattgtccgatgtcaacaatgccattgtcgatgcctatttcgcaccttttgacactccccaaaacgagcttcaattagagcgcattccttctaatatttaatgaaaatattgtatcttttttaagcattcaaatgttgcaaaaagaggaaactatcggatttctatatatttataaatgctttgttattttgtgccttactttttctaattatgagtattttcgttaataattacttttcgtttatgctttgggttttcccaatttttgtttttcaaattcttttctcattgcttttcctttctttttcgaatgtcttcccatccctccgaatttccgtcctcgtcttctgccccctctgttcacaatcaacaagcagctgaattcgttctgatcgagtacccgggagtgataaaaaatgttcaagcagcactcgacactttgggtggactgcgtgcaatttccaatgtctgttgttttttttttgttggttttttgcccaattgaatgatttttaaaatttaatttgcattattttaggcacatttcaacaacagtcaattggaattgcaattccaaccccaaaatccgtttaattcggcattgacgggcgagcggcgaagccaagcggcggttttctcgggccaagccaatttggtgttgcgcattcgaagacgaaaacggaggcaaacggctggaggaggcgagtaaaaaaacaaacaaataaagccaattaataaatggttcaatttaagtgattggagacattaaacttggcacagcatcaggcggaggcgccgagggaaaccaaatggaaattcgatgcatcggaatggtaaaaaaacaaacaaacaaatttaatttaaaaaaagaactcgctataatgccaatgatgataaaaacaaaaaatgagtgagaaaaataaaaagaaaatagccgtaaaa

SEQ ID NO: 19404 - DNA, 2518 bp, Heterodera glycines
  misc_feature (54)..(54): n is a, c, g, or t
  misc_feature (89)..(89): n is a, c, g, or t
ctcagatggcccgcgctcacttggcggcgctcatcctgcaggggctcaggtggncatggacccctcccacacctacccttggctaccgnaatccggtgaaaaagtgatgtgtaactactagcctcagttcggaatttgtccttcagaccatctctgatggagtccgacaatccaagtctgtccatcatgtccaatccgagcaaattcttggatccgtctttggaaacaaagaaatgtccatagcatgagcggtctccgaacgaaaaagttgtctttcctttgccaacgaatggacgaattgtgccatcgtggtactgagcacgttcttgacaacggctcaatttcaaagctccgatttggcgcacagtgtcctcacaaagaacagttccctcagtgcctaaatcagcaatgaaatccactttgtgcccattcacatcaatcggtacatcgattattccattcttcctctggttctcagatttacccaggaaaactcctccaacgcggacgttgttcgccgctttttcattctttcctccattcttcttcaaccatgcctggtgcttggcacacatcctttccaagtggccactcttcttgcactttcggcaaacggttgtttcatgtcgacaattcctcgacgaatggctcaaaccgcatcgccacatacgcgttgcgatcgattgctgctgcgtgttcctgtcgaaatgctgctctcattcgacgaatgatccgagttcgttcgtttcttttttgccttcaatttggtcgccatcaagtttcgtgagcccatcggttgttgttcgaggacctttgcttcagcgatggtcgactggtacatttggaggtcttcgacgactccatcatactcgaccaggtcaccatccgctgcaagcttcgaaagaattcgctttctcagctcggcatccttcggtgatttcagtgccgtcaaaagcatgaggcaagaaaattgctcttcgttgagcttttcaaatcgcttatgtctgttgataaaaggacgaaagctttcatcttcgcttttcgaggccctcagacattcatagcgatcaatccaaatggattgtggccggctgaaggcaatctttaggcgctcctctgtttggctgtagtcaaaatcgatgactttcttcggcagacatgacttgctgtactggctgaaagccacttcactcagcttcgtcatgagcagcttgacctttgcttcgtctgccagttgcggtgccgcacagtcgagggcaaaattgaagcgttccaaccaatcggaaatgcttctatcgtccgatggctcaaaacagtcgatggtcggaagcgttggcaaagcatgcgcatttgcggctggcgcaccattttgatttgccaataattgctggattgccgcagtgagttgttggattgcgtcgcccatcttaaccacagctcgtggactttcccctcagctcgagagtactcgttttaaatgacgtgtcgttcaccactcaattgttagcagcgccaagctactagacagagtgggtgcgcgtggatgaactgaaatgtgtcgccaagacacaaaatcagcggcgcaaaatttctcactactaacagtgtcaaactgttagcaggtccaacaaaaagttgttattatcgcctagataatagcaaatgcaggcagtcttcagcgatgacacagcaaaactcggttgctgtcaaacctcttcctccacaatcagatcaataagcccacagtcaaaagtctgcacgggcgtcgccaattgttacgccccaaagtccgaataggaataaaataaatatttatttaaaaagaagggacagggcgaacggggtcaaatatcgattgggagcaaagggaacaaataaatggagaagaagcaaaagaatgatggggaagggtcaacatcgcgggtatttatgggcggaaaagtgggcgtgacataacgaagggagaagggaaatacaaatgaaacaaagggtcaaaatgggcaccggacaattgggtcccaaccctaacaaccaacacgccggacccagccgccaccgcgttcaagctcgagtggttccagggagacgggatggtgcgccgcaagaacttgccgatcgagtacaacgtctgatggaaggatgcttcgtcacctcaacatggacatgataggatcccacccacccaccgtcccaaaattgtcattttgtcccccatcatgtaaattgttgtatctgtatgtaaatttctgtgatcatcacttcaaatgaatgtatatttaattgttgcctatgtaattgtattgttgttgtgcttaataaatgctcatatgtgcttcaattcaaatgcttttgtaggaaggggggcggggtggtaaaatttggcgtctgtttggtcggagggttagctcgcgtagaactcggtctgctcactccttgtaaattcaggtcaaaatgagttttagacaaaagtggtccttctagagaagtctaccagtcacacatttcgtttggaattcga

SEQ ID NO: 19405 - DNA, 2581 bp, Heterodera glycines
ctcggtgtgcgcaatgccaacgtttctatgcccgtactcgaattgctcggtgattttttgtacaaatgaccattgattgcattattttaaacaaaaatgctcgtgaatcggttaaggtctttctggtcttctcccagtgcatccacgaacctttctccgggcgcgaatgaaccgattgaatggtaaatgccaatggatgcttactgggataaattttcataattaaaaatgaattttttgtatcttggtgggtactgctgattttgggcttgtttaacctcattgtattacatatttgattgacattttgttttcattcagtccgttttttaatttataggcattgctggaaatgcgcaatttttcaatacgcagcagaaggaggaagaagaagaagctgatcagaaagaagatgaagaaaacggcgatggaaaagaaagcatcactcaagggatttaaggcacataaatgttgtaccaatattttgattaaagtccgttttttaattttgaatttagttcctttaatttacaattgatttatccgtttatgagcaaatttgggcttgggatgtaagacaaaatgccaataaagccaattcaataattttttgcgcgctaagaaaatcactgatcgatgccctatttttttttttgatcaggtgggcttgacccatagtgcaactacctatccaattcctaggcagcagttttcaaataaaatcagtaaactaattgtttttctaataattctaaaaaccctaagagattttgtttccttacaacaatatgttttgcctgtttcagtgtttcgatattctcaattccgttttgaaattaacagaattgaagtctcaatcatgcggtttttgttgagcgatgttcggccacaattattcgactgcatttgttaatcgcatttcttctccgtttcggttgctgtgccttttcattgcctttcttcttctatttcgacaaaccaatgccaattgttcccatcaatttttcttccgtgaagacaatcgccccacagaaagccaaggcttggaaaaattagaaatcacttttaagttagaaattctttaatttaagatgaaaacagccatcaaagccttccctggaccttttttgaggacaccaaacaatgcgacgacgaactttcttcgttgctttcgagtgggaatttctcggacgcacaacgacaggaggaaggacaacggttggacagccagcagctgacggtgactccgtgcgttgaccaattgctcgacatcgaattgacaccgctctctgtttttccagtcggaaaaaacatgtaaatgaaaacaaaacactaatgttgtgttcgtttttaaatgagaggggggatttttatacgggtttaggaagattcattaattcttattgtacataaatgatgaaagagtggcaatagaccagtttaggtagatccccctttttggttaaatttttcttttaaaaaatatttcagttcgttttgtgtttctttattgaatcacacagctaaagcggtagctttttgattttgcagtatttctgttttttctctcttcagacttccctatgtgcaactgaacatctccgtcaataccttttcttccgttgatcagctcttctttcgcttccgttgcattttcgcaccaaattcggccgattatttgtgccataaccatagcattcagctggagaagtggggccaaatgatttggccatgtcggaagcttcaaatcgaacggaataatcaggtacttgtcaagaagggcatttaatttacattaaaataagcaatggcctggcaaaaaaataaaataagaaatggtttgacaaaaaaatgtccaaattccagcacgtttctgttccccaattccacttctcctacacgtgctttcgactgttcagcctttcacaatatgtcatcgaatttttcgtgctaaatcggaatgaactttgcaggtacagaaaaaaagaggcaccacttttatctgtcatgaaagaatgggaaaatggatcggacaaatcttgatggtcaattggctgtgcaaagcattcttttttaagacgcgagttgcttttcaccattcccatggagcagcagttggacccgaaaattgcggacttttacaacgcaattcaattggaccgggaaaggacggcactcgtcgcgccgagttggtctccgctggttgcgttggacacttcgtttgacgatgtcagagcgcattataattctattcgatttaaaacacttatttttagtgtctttttgttcaattgcatccgtcggaatggcttatgcaaaatcagcaatatcgtcccaagacaataaatgtcgccgttttttccacctttgacaacgacaacaacggcactgacagtggacttaatgccaacaaaaatgatgggcacggccaccacaataaccgaacaattgaggactatcagccgaagagcattgttgggcctgaagagggctatagcccactgaaagcggagaacagcgacacaaatgtggcagtgacaatggaggcgaacaaccggcacagccaccttcactttttggt
